United States Patent 7,109,033 (STRESS-REGULATED GENES OF PLANTS, TRANSGENIC PLANTS CONTAINING SAME, AND METHODS OF USE) - sequence listing, part 2

SEQ ID NO: 2013 - DNA, 3573 bp, Arabidopsis thaliana
atgggttcgaggaagaagaagatgcagatcaggaaggtgttcgataaaatgactgaatgggttaccccttggagaagtaatttggagagtccaagagagatgatgattttgcgtggagatgttgaacaagatgagtttcaatacgctagtagtcactgtttgtcttcttactacagtgtctttgttgttcgcctcgctataatggttatgttagcaattttgatagggcttttaacggttctaacatggcatttcacaaggatttatacaaagcagtcgcttcaaacattagcgtatggccttagatacgagcttcttcagcgtccagtcttacggatgtggagcgttttaaacaccacatcagagctaacaacagctcaagtcaagttatctgaatatgtcatcaaaaaatatgacaagccaacaactcaagaagaacttgtggagatgtatcaagcaatgaaggatgtgacatgggctctgtttgcgagtgccaaagctctaaatgccataaccataaactacagaaatggatttgtccaagcttttcacagagatccagcaagtagcagcacattctacatcttctccgatctaaaaaactattccatcagtggaacagggcctgaagatgtaagtgggtggaacaacaagtcaatacacgggaacatgtctgccatttggtatcagcaacagcttgatccagtaacaggggaaaatttgggaaagcctcttaaaattccaccggatgatctgatcaacatcgcaggaatctcacaagtgcctgatggtgaagcttcttggcatgtgacagtgagcaaatacatggactctccgcttctctcagcggctttgcctgtctttgatgcatcaaacaagagtattgtggctgttgtgggggtgacaactgcactttacagcgtaggacagttgatgagagatcttgtagaagtccacggtggacatatttatttgacatctcaagaaggatacttgcttgctacctccacagatggtcctcttttgaaaaatacatcaaacgggcctcagctaatgaaagccactgattcagaagagtgggttataaagtcaggagctcagtggttagagaaaacttatggaagtaagcgccctcacgttgttcatgctgagaatgtaaagcttggtgaccaacgatattacattgattcattctatcttaatctcaagagacttccaattgtaggtgttgtcattattcccaggaagttcattatgggaaaagtggatgaaagggccttcaagactttgattattctgatttctgcttctgtctgcatcttctttattggatgtgtctgcattttaatactcacaaatggagtttcaaaggagatgaagctaagagcagaactgataaggcaactggatgcaagaagaagagctgaagcttcaagcaactacaaaagccagtttttggcaaatatgagtcatgagttgaggacaccaatggctgctgtaattggattactagatattcttatatcggatgattgtctttcaaatgagcaatacgcaacagtcactcagatcagaaagtgctctacagctctccttcggcttctcaataatatactggacttgagcaaggttgagtcaggaaagcttgttctggaagaagctgagtttgatttggggcgagaacttgaaggacttgttgacatgttctcggtgcagtgtattaatcacaatgtagagacagttctagacctctctgatgatatgccagcattagtcagaggagactcagcaagacttgttcaaatatttgcaaatcttataagcaattctataaagtttacaacaacgggtcacattattcttcgtggatggtgcgagaacataaattctctacatgatgagatgagcgtatctgttgacagaaggaaaccatgggctccaatgaagacaaaacaggtgcaacacagaaatcacttgcagaagtcttgtaagaacgcgaacaaaatggttctttggtttgaggttgatgatactggatgtggaatagatccaagcaaatgggactctgtttttgagagctttgagcaagctgatccttctaccactcggacgcacggaggaactggacttggactatgtattgtgcgaaacttggttaacaaaatgggtggagaaatcaaagtagtgcagaagaatggcttagggactcttatgagactgtacttgattttgagtactcctgacactgtagatcaaaacatccagccagatttctccaaatacggtctcgtggttatgctttccatgtatggaagtacagcaagaatgatcacatcaaagtggttgcgaaaacacggcattgcaactgttgaagcatcagactggaacgagctgactcagatcattagagacctcttggagacgggaagccgtgacaacagctttgattcacagcacaatatatctgatccactgagagcagagctttcaaatatagtagaaatcaagaaccctgtgtttgtcatagtggtggatatcggagtacttgatctcaccacaaatatatggaaggaacagcttaactacctcgacagattctccaacaaagcaaagtttgcttggctactgaagcatgacacctccaatacagttaaaacagaacttagacgaaaagggcatgtcatgatggttaacaaaccgttgtacaaggccaaaatgatccagattctggaggctgtaataaaaaaccggaagagaggcttgtgtaatgacttaagaaacagaggaaacggaagtgatgaatcccacgattgcttagaaattgatccaacacaattcgacacttgcagttccgatgattcctcggagacatctggcgagaaacaagtagataaatctgttaaaccaagcaccttgcactctccagtgcttaagaactatctcatcgatgccactaccagcaatgatgactcaacatctgcaagtatgactcaaaagaacccagaagaagaagattggaaggatcggctgtattcaggaattgcgttggatggaaagaatcagaaatctcttgaaggtataaggatcttgctggcagaggatacacccgttcttcaacgagtagccaccataatgcttgagaaaatgggagcaactgtaactgcagtctgggatggacaacaagcagttgattccctcaactacaagtctatcaatgctcaagctccaactgaagaacacaaatcgttcgaagaagaaaccgctaacaaagttacaactcgggagactagtttacggaattcctcgccttatgacttgatcctcatggactgccagatgccaaaaatggatggatatgaggcaacaaaggcgataaggagagcagagattggcacagagctgcacattccaatcgtggcgttgacagcgcatgcaatgtcttctgatgaagcgaaatgcttggaggttggaatggatgcttatctcacaaagcctattgatcgaaagcttatggtctctaccattttgtcactcactaaaccatcagcattccaaacttcattgtccgcttga

SEQ ID NO: 2014 - DNA, 495 bp, Arabidopsis thaliana
atgggactctgtttccaactcaacttagcctctctgtctctcatactcttctcttcattccctggacttttagcacaatctcaacaacatttcttgggacaaaacaacacaagcttgttgagtggagggagatgcaatttggctagaggcaaatgggtctatgattcttcatatcctctctatagtgcttttagttgtcccttcatcgattccgaattcaactgccagaaagcgggtcgtccggacactaactatcaacacttccgttggcagcctttctcctgtcctctccctagattcgatggggcgaattttatgaggagaatgagagggaagaagataatgatggtaggtgactcactgagtcttaacatgttcgaatcgttggcctgcttgcttcatgcttctctccctaatgctaagtactctcttcgtcgaagccaacctctcacttccctcactttccaggttttgatttttctttataatatctga

SEQ ID NO: 2015 - DNA, 2643 bp, Arabidopsis thaliana
atgtctgatttgaggagaagtgcttctagcaaactaagtggtacaccgatgaagaaactcattgctcgagaaatgtcaaaagaagttgaacataaacagagcccaactaatgtggttgctaagttgatgggtttggaaacacttccccagacgcatcaggagactgctacacagcgaagcaaatccagaagcaattcacactcttctctgaatcattcgatgacttctacagataatgaggttcaaaagtatcaggatttcagtagggaatttaaagatgtgtatgaaacatggcagtcacctcagaaggtgagtcgctcaagggattgctcgcctagaaaaggaagatatgatgaaagtacgactgagaaacaaatggctcttgttcgtcaaaagttctcagaagcaaaacgccttgtaacagatgatagtcttcaccaatccaaagagttccaagatgcacttgaagtgttaagctcgaacaaggatttgtttgttcaatttctccaggaatcaaattctttctctcagcagaatctttctgactttcaccatgttcctcctcattcagaggcgaagcggatcacagtattgagaccttcaaaggctggtgaaactgaaaaatatgtggttcaagggaggaggaacaagcaggttaagaaattggcttcatcaagtcaagagactggatgggggaaccgtgatctgggttacccgtcaccttatgtcaaccggggaaccgaagaacacactgtacagccaacccgaattgtcgtcttgaagcctagtctaggaaagtctctagatattaaggctgtatcatcatcccaatcctctccaaggggtttacacagtaggggatattttgatgagcctgaagatgttgagactaaagaagttgcaaaggaaattactcgtcaagtgcgcgaaaatctgatgggtcaccacaggaacgagactcagtcttcttctgtcctatccaatggctatatcggtgatgacagttcttttaataagtctgataacgaagatttagtgggaaatcttagcgattctgagatcatgtcaccagcatctaggcattcttgggactgtccaaataggtttgacagtcttttctctccttcctctttcagcagagcttcattttctccagagtcatctgtctgcagagaggcgaagaagcgactttctgaaagatgggcgttgatgtcagtatcgggaagaactcaaccgcttaaacatgtttcaagaacctcaagcaccttaggggaaatgcttgcacttacagagaccaaagtgacaactgaatccggggaagggagctatgaaatagtaccagcaacgagggtatcaacatcatgcataactagtgatctgagtcaagtggaaatggcaagtgattctctgaatattcttgcaaggtcaaaatcagtctctgacgttagactcaacggagaaacatctgttctggggagttccaaagtacaggctccacgagagctgactaagacgggaagcctgaaatcgtcatggaaagtctcaaacttgttcttctttaagaataataaagcaagcaaggagaaaagagatgcatctcaatgcagcagtatgtctcaattggcagcgccttctcctgtgactcttaccggaaaaaccagcgaagattgtgtgtttcctattgattgtctccctcctgtttcatcagaacagcaaagtataatcctaggcgaggtatcccaccaattctctaaacctttttcaatctattcgaggtggatgaatattcatgttaaatcagcggccattttgatccatttgcaggaggaagtgactacaccaaagcccctagcgactgggaatacaagtgaaaaccaggaccagccaagtccaatttcggttttgtttccaccatttgaagaggaatgtgccagcattccagaatgttctgggtcaaccaagcattggtcatctcaaggagacgaaatgtctcttaaatctaatctaatcgacaaatcaccaccaatcgggtcaattgctcggctcctctcatgggatgatgactcttgcactgacaacatagctaaacccgcaatgggagtccatgaggaggaagactggcatctcttcatagaaatgatcttgacagctgcaggtttcagcagtggttgcatagtctctcatgaccccatcatgtcacgatggcacatgccaaacagtcccttagacccttcactcagagacaaatacaccaacccggataacaacaacatcaaggagttcatccacgaaggcaaacgcagacaacaacgatcaactcgtaagctcattttcgaccgcatcaactccatcgtttcagaaacaacgactacacgcacaggtaatggttctctgcatttcgacctggtggagcatgtgtgggctcagttaaaggactgggtttcagatgagcctagcaagcgtgactcaggagaagacatggacgccaacagtttggctgcagagagtctagtgaaagatgagatagtcgggaggacatggactcatagcttgcaagttgaaatagatgactttgggattgaaattgaaaagagattgttgcaagagctagtagaggaagccgttatcgatcttacacgatga

SEQ ID NO: 2016 - DNA, 1056 bp, Arabidopsis thaliana
atggaagaagcagttgtaacgaggtattggtgtcatatgtgttctcaaactgtgaatccagtcatggaagctgagatcaaatgtcccttttgtcaaagtgggtttgttgaagaaatggaagatgacgacgatcatgattcttctgatccggctgatgttagagcaaacaactctctttgggcgcctatcttgatggaacttatgaatgatcctgtgcgtcgtaggagaaaccagagtgttgagtctgttgaagataatcaaaacgaggtacagaccgagaacaatgaagacgatggagaaaatgatttggattggcagcttcaagagattctcaggagaaggagaagacattccgctgctgttttgcagttgcttcaggggatacgagcagggttgtctgtagaatctgagagtactggtaatggaggtaataatccgggacgggtgatcttgatcaatacctccaatcagactatcacggttcaaaactctgctgatatggattctgtacctgctggttctttaggtgactatttcattggtcctggatttgaaatgttgcttcaacgtctagctgagaatgatcccaacagatatggaacacctcctgctaaaaaagaagctgtcgaggctttggctactgtgaaaatcgaagagactctgcaatgttcggtttgtttagatgattttgagattggaactgaggcaaagctgatgccctgtacgcacaagtttcatagtgactgcttgttaccatggcttgagcttcacagttcatgcccggtttgcagatatcagttacctgcagatgaagccaagactgattcagtaacaacaacgagcgataacaatggaagcagtagtgcttctgctacaaccagccatggagctgagaacagcgatggaaaccggcgccaagaagaagaagaagaagaagaagaggaggaggaggaggagaacgagaacaatgacggaagcggattctcgatcccgtggccgtttagcaccttgttctcctcgtcgcaagatagcaatgcaccaacggattctagttaa

SEQ ID NO: 2017 - DNA, 576 bp, Arabidopsis thaliana
atggagagtaacaacaacgagaagaagaaagttgcaagacaatcatcatccttcagactacgtagcccaagcctaaacgcacttcgtctccaacgaatcttcgacttattcgacaaaaacggcgacggattcataaccgtcgaagagctaagccaagctctaacacgtcttggtctcaacgctgatctctccgatctcaaatccaccgttgaatcatacatccaacctggtaacactggtctcaatttcgatgatttctcttctcttcacaaaacactcgacgattctttcttcggtggagcttgtggaggaggagaaaacgaagatgatccttcttccgcagctgaaaatgaatcggatctcgccgaggcgtttaaggtgtttgatgagaacggtgatggattcatctccgctagagaactgcaaactgttctgaagaaacttggtttacctgaaggtggagaaatggagagagtggagaagatgatcgtttccgttgaccggaatcaagatggtcgcgttgacttttttgaattcaagaacatgatgcgtactgttgtcatcccttcttcttga

SEQ ID NO: 2018 - DNA, 1380 bp, Arabidopsis thaliana
atgttgaaaatcaaaagagttccgaccgttgtttcgaactaccagaaggacgatggagcggaggatcccgtcggctgtggacggaattgcctcggcgcttgttgccttaacggtacgttttggaaacctgaatcgtcttttttaatcatgcttccattgtatgcatgtaagaatctggtaaaatccggagagaagcttgtaatcagtcatgaggctatagagcctcctgtagcttttctcgagtcccttgttctcggagagtgggaggataggttccaaagaggactttttcgctatgatgtcactgcctgcgaaaccaaagttatcccggggaagtatggtttcgttgctcagcttaacgagggtcgtcacttgaagaagaggccaactgagttccgtgtagataaggtgttgcagtcttttgatggcagcaaattcaacttcactaaagttggccaagaagagttgctcttccagtttgaagctggtgaagatgcccaagttcagttcttcccttgcatgcctattgaccctgagaattctcccagtgttgttgccatcaatgtaaagactcttgtgcagagagcttgtccgatagagtatggccatgtgctgctgattcctcgtgttcttgactgcttgcctcaaaggatcgatcacaaaagccttttgcttgcagttcacatggctgctgaggctgctaatccatacttcagactcggttacaacagcttgggtgcttttgccactatcaatcatctccactttcaggcttattacttggccatgcctttcccactggagaaagctcctaccaagaagataactaccactgttagtggtgtcaaaatctcagagcttctaagttaccctgtgagaagtcttctctttgaaggtggaagctctatgcaagaactatctgatactgtttcagactgctgtgtttgccttcaaaacaacaacattcctttcaacattctcatctctgattgtggaaggcagatcttcttaatgccacagtgttacgcagagaaacaggctctaggtgaagtgagcccggaggtattggaaacacaagtgaacccagccgtgtgggagataagtggtcacatggtactgaagaggaaagaggattacgaaggtgcttcagaggataacgcgtggaggctccttgcggaagcttctctgtcggaggaaaggtttaaggaggttactgctctcgcctttgaagccataggttgtagtaaccaagaggaggatcttgaaggaaccatagttcatcagcaaaactctagtggcaatgttaaccagaaaagcaacagaacccatggaggtccgatcacaaatgggacggccgccgagtgccttgtccttcagtga

SEQ ID NO: 2019 - DNA, 1527 bp, Arabidopsis thaliana
atgaacagaggagctcaaagatacagtaacctcgctgctgctgtcgaaaacactattactccaccagtgaaagttgaacacacacagcttctaatcggtggaagattcgttgatgcagtgtcaggaaaaactttccctactttggatccaagaaatggagaagtgattgctcaagtgtctgaaggtgatgcagaagacgtgaaccgcgcggttgcagctgcacgaaaggcttttgatgaaggaccatggcctaaaatgacagcttatgagagatcaaagatactgtttcgtttcgctgatttaatcgagaaacataatgatgagattgctgctcttgagacttgggataatgggaaaccttatgaacaatctgctcaaattgaagtaccaatgcttgctagggtgttccggtactatgctggttgggcagacaagatacatggaatgacaatgccaggagatggtccacaccatgtgcagaccttacatgagcctataggagtcgctggacaaatcatcccatggaacttccctcttctcatgctttcttggaaacttggaccagctttagcttgcggtaacaccgttgttctcaaaactgctgagcaaactcctctatctgctcttcttgttgggaaactacttcatgaggctggacttcctgatggagttgtgaatatagtttctggatttggggctactgctggtgcagctatagctagtcacatggacgttgataaggttgctttcaccgggtctactgatgttgggaagattattcttgagttagcttcaaaaagcaaccttaaggcagtgactcttgagcttggaggaaagtcaccattcattgtatgtgaagatgctgatgtggatcaggccgttgagcttgcacatttcgctttgttctttaaccagggacaatgttgttgtgctggttcgcgtacatttgtacatgaacgtgtgtatgatgagtttgtagagaaagctaaagctcgtgcactcaagcgaaatgttggagatcccttcaagtcaggcattgagcaaggtccccaggtagactcagagcaattcaacaaaatcctgaagtacatcaaacatggagttgaggctggagccacattacaagctggaggtgacaggcttggttccaagggttactacattcaacctactgtcttctcagatgtgaaagatgacatgctcatagcaacagacgagattttcgggccggttcaaaccatactgaaattcaaggatcttgatgaggtgattgcaagggccaacaactcaaggtacggtttagctgctggagtgttcacacagaatcttgacacagcacaccggctgatgcgagcactcagagttgggactgtttggatcaactgttttgatgtacttgatgcatcaattccatttggagggtataagatgagtggcattggtagagagaaaggtatctacagtctcaacaattacttgcaagtcaaggctgttgttacttccctcaagaaccctgcctggctctaa

SEQ ID NO: 2020 - DNA, 1812 bp, Arabidopsis thaliana
atggccgttgattcacctcttcaatctcggatggtttcagcgacgacttctgagaaagatgtgaaagctctcaagttcattgaagaaatgactcggaaccctgactcggttcaagagaaggttcttggagagatactgactcgtaactctaacaccgaatatctgaaacggttcgatcttgatggtgtcgttgatcggaaaacgttcaagagcaaagttccggtggttacgtacgaagatttgaagccggagattcaacgtatatccaacggcgattgttctccgatcttgtcttctcaccccatcaccgagtttctcacaagctcaggaacatctgctggtgagaggaaactaatgccaacaattgaagaagacttagaccgacgtcagcttttatacagtcttctcatgcctgtgatgaatctctacgtgccgggattagacaaaggcaaagggttatacttcttattcgtgaagtcggagtcaaagacgtcaggtgggttaccggctcgtccggttctcacgagttattacaaaagcgaccacttcaagagacgaccgtacgatccgtacaacgtctacactagtcctaacgaagccatcctctgctccgactcgtcccaaagcatgtatgctcaaatgctatgtggtctcttaatgcgccatgaagttctccgactcggcgcagtgtttgcttccggtctcctccgtgccataagcttcctccagaacaattggaaggaacttgctcgtgatatctcaaccggaaccctaagttctcgaatcttcgatcctgccattaaaaaccgcatgtccaagattttgaccaaacctgatcaagaactggctgagtttttggttggggtttgttcacaagagaattgggaagggataatcacaaagatatggcctaacacgaagtacctcgacgtgattgttactggagcaatggctcagtatatcccgacgttggagtactatagcggtggattaccgatggcttgcacgatgtatgcttcgtccgaaagttatttcgggattaacctaaagccgatgtgtaaaccctcggaggtttcttacacaatcatgccaaacatggcctactttgaattcctcccacataatcacgatggagatggagcagcagaagcatcattagacgaaacgtcacttgtggagcttgctaatgttgaggtaggaaaagagtacgaactcgtgatcacgacctacgcggggctctaccgttacagagttggcgacattcttcgtgtcacggggttccataattccgctccacagttcaaattcatacggagaaagaatgttctgctaagcgtagaatccgataaaaccgacgaggctgagctacaaaaagcagtggagaatgcgtcgaggttgtttgcagagcaaggaacacgtgtgatcgagtacacaagctacgcagaaacgaagactataccgggtcattacgtaatctactgggagctacttggtagagatcaaagcaatgctcttatgagcgaagaagtcatggctaagtgctgtttggagatggaggaatctttaaactcggtttatagacaaagccgggtcgctgataaatcgatcggcccgttggagatacgtgtggtacggaacggtacgtttgaggagctcatggactatgccatctcgagaggcgcatcgattaatcagtataaggtaccgaggtgcgtgagcttcacacctatcatggagctgcttgactctagagttgtgtctgctcatttcagcccttcgttgccgcattggtcaccagaacgacgtcgttag

SEQ ID NO: 2021 - DNA, 1359 bp, Arabidopsis thaliana
atggctgttgcgctccaattcagccgattatgcgttcgaccggatactttcgtgcgggagaatcatctctctggatccggatctctccgccgccggaaagctttatcagtccggtgctcgtctggcgatgagaacgctccttcgccatcggtggtgatggactccgatttcgacgccaaggtgttccgtaagaacttgacgagaagcgataattacaatcgtaaagggttcggtcataaggaggagacactcaagctcatgaatcgagagtacaccagtgatatattggagacactgaaaacaaatgggtatacttattcttggggagatgttactgtgaaactcgctaaagcatatggtttttgctggggtgttgagcgtgctgttcagattgcatatgaagcacgaaagcagtttccagaggagaggctttggattactaacgaaatcattcataacccgaccgtcaataagaggttggaagatatggatgttaaaattattccggttgaggattcaaagaaacagtttgatgtagtagagaaagatgatgtggttatccttcctgcgtttggagctggtgttgacgagatgtatgttcttaatgataaaaagcataggttattgatatcttcctttttgacatttgtgactctaaaggtctggaacacggttgagaagcacaagaagggggaatacacatcagtaatccatggtaaatataatcatgaagagacgattgcaactgcgtcttttgcaggaaagtacatcattgtaaagaacatgaaagaggcaaattacgtttgtgattacattctcggtggccaatacgatggatctagctccacaaaagaggagttcatggagaaattcaaatacgcaatttcgaagggtttcgatcccgacaatgaccttgtcaaagttggtattgcaaaccaaacaacgatgctaaagggagaaacagaggagataggaagattactcgagacaacaatgatgcgcaagtatggagtggaaaatgagcgacaagacgcaatctatgagctagtggaagagaagattgacctcatgctagtggttggcggatggaattcaagtaacacctctcaccttcaggaaatctcagaggcacggggaatcccatcttactggatcgatagtgagaaacggataggacctgggaataaaatagcctataagctccactatggagaactggtcgagaaggaaaactttctcccaaagggaccaataacaatcggtgtgacatcaggtgcatcaaccccggataaggtcgtggaagatgctttggtgaaggtgttcgacattaaacgtgaagagttattgcagctggcttga

SEQ ID NO: 2022 - DNA, 1812 bp, Arabidopsis thaliana
atgtcagccaccgccgccgcctcctcctcgatcgccgttgccaccaactctctcaggaacgtgactctgtcttccagatcgccccttccatcagccatctccgtggctttcccttcccgtggacgcaatactcttcagcgacgcctcgttctcgtttcctgcagtactggagacggatctaagcctacgattctcgtggcggagaagctcggtgacgctggtattaagcttttggaggatgtcgcgaatgtcgactgttcgtataacatgactcctgaggagctcaacattaagatctcgctctgtgacgccttgatcgtgaggagtgggactaaggttggccgtgaggtgttcgaatcgtctcacggacggctcaaggttgttggtcgcgctggtgttgggatcgacaacgtggatctgagtgcagcgacggagtttgggtgtttggttgtcaacgctccgacggcgaacacgatcgctgccgctgagcacggaatcgctcttatggccgccatggctaggaacgtagctcaagctgatgcgtctgttaaggctggagagtggaagaggaacaagtatgtaggtgtttcacttgtgggaaagacccttgcagtgttgggattcgggaaagttgggacggaagttgctcgtcgtgctaagggtcttggtatgcgtgtcattgctcatgatccctatgccccagcagaccgtgcacacgccattggtgttgacttagtgagctttgatgaagcccttgccaccgcggatttcatttctcttcatatgcctcttacgccaacaacatcgaagatactaaacgacgaaacctttgccaaaatgaagaagggagttcgaattgttaatgttgctcgtggaggtgtcatagacgaagatgcgttagtgagagctctggatgctggtattgttgcgcaggctgcacttgatgttttcaccaaagagcctccggctaaagatagcaagctcgtgcagcacgagagggtcactgtgacacctcatcttggagctagtaccatggaggctcaggaaggagttgccatcgaaattgctgaagctgttgttggagctctgaatggagagcttgctgctactgcagtcaatgcacctatggtttctgctgaggttctgaccgagctgaaaccatatgtggtgctagccgagaaactaggaagactggcagtgcaactggtggccggaggaagcggtgtgaaaaacgcgaaaatcacatacgcctcagcaagagccactgatgatcttgacaccagacttctccgagccatgatcaccaagggaatcatcgagccaatctctgacgtatatgtcaatttggtcaacgctgatttcacagccaagcagagaggtctcagactctcagaggaacgtgtgcttttggatggttcaccagagagcccattggagacaataactgttcagctaagcaatgtggagtccaaattcgccagttccctgtctgaatcaggagaggttaaagtggaaggaaaggttaaagacggagtcccgcatttgacaaaggttggatcttttgaggtcgatgtaactcttgaaggtagtatcatactgtgcaggcaggtggatcaacctggtatgatcgggactgtcggaagcatccttggagagtctaatgtcaatgttaacttcatgagcgttgggagaattgcaccgaggaagcaagcgattatggcgattggagtagatgacataccaagcaaagagacactgaagaagattggggaaattccagcggttgaggagttcgttttcctcaagctctag

SEQ ID NO: 2023 - DNA, 402 bp, Arabidopsis thaliana
atggctgctgcttcgatttctgcaataggatgtaatcaaactttgataggaacttccttctatggaggatggggaagttccatctccggagaagattaccaaaccatgctctccaagacagttgcgccaccgcaacaagccagagtctcaaggaaagcaatcagagcagttccaatgatgaagaatgtcaatgaaggcaaaggcttatttgcacctctagttgttgtcacacgcaacctagtaggcaagaagaggtttaatcagctcagaggaaaagccattgccttacactctcaggtgatcactgagttttgcaaatcgattggagcagatgcaaaacagagacaagggcttatcaggcttgctaagaagaatggagagaggcttggtttccttgcttag

SEQ ID NO: 2024 - DNA, 489 bp, Arabidopsis thaliana
atggccaccggagatgggaaatcggtgatggtcgtcggagttgacgacagcgagcagagcacttacgccttggagtggacgctcgatcgtttcttcgctccttacgctcccaattatccttttaagctcttcatcgtccacgccaaacctaacgccgtctccgccgttggtctcgctggtcccggaactgcggaggttgtaccttatgttgatgctgatctgaagcataccgctgctaaggttgtcgagaaagccaaagcaatttgtcagagcagatcggttcatggcgcggtgatcgaagttttcgaaggtgatgcaaggaatatcctatgtgaagttgtagataagcatcatgcttctattcttgttgtgggaagccatggatatggagctatcaagagggcggttctcgggagtacgagtgactactgcgctcatcatgctcattgctcggtgatgatcgtgaagaagcctaagatcaaggtctga

SEQ ID NO: 2025 - DNA, 822 bp, Arabidopsis thaliana
atggcagcacaagcacttgtgtcttcttcacttacctcctctgttcagacagctagacagatatttggctcaaaaccagttgcgtctgcctcacagaagaagagttcctttgttgttaaagctgctgcaactccacctgtcaagcaaggagccaacagaccattgtggtttgcttcatcgcagagtctctcttacttggatggcagcttacctggtgactatggattcgaccctcttggtctttcagacccagaaggtactggaggattcattgagccaagatggctagcatacggagagatcatcaacggacggttcgccatgttgggtgcagctggagctattgctcctgagattttaggaaaggctggtctgattccagcagagactgctcttccttggttccaaaccggtgtgattccaccagcagggacatacacttactgggcagacaattacacactctttgttctcgagatggctctgatgggattcgctgagcaccggaggttacaggactggtacaacccaggatctatgggaaaacagtacttcttggggttagagaagggtttggccggttcaggtaacccggcttaccccggtggacctttcttcaaccctcttgggtttgggaaagatgagaagtcactgaaggagttgaaactcaaggaggtcaagaacggtagactggctatgctcgccatcctcggttactttatccaaggactagtgaccggtgtgggaccttatcagaacctgcttgatcacttggctgatcccgtcaacaacaacgtcttgaccagcctcaagttccactga

SEQ ID NO: 2026 - DNA, 288 bp, Arabidopsis thaliana
atggcagattcttcttctgcttcttacattcacatggtgcagcacatgatagagaaatgtttgatcttccatatgagcaaagaagagtgtgtggaagctctctctaagcatgcaaacatcactcctgtcatcacctctactgtgtggaaggagctggagaaagagaacaaggaattcttcaaggcgtatgaggagaggcaaagcaaacaagagcaaatgtcggaggaagagacaaaccagatgatccagaagattatctcggattcatctaaagaatccgacgactga

SEQ ID NO: 2027 - DNA, 1806 bp, Arabidopsis thaliana
atggctgcaactgcaatagagccatcttcatctataagtttcacatcttctcacttatcaaacccttctcctgttgttactacttatcactcagctgctaatcttgaagagctcagctctaacttggagcagcttctcactaatccagattgcgattacactgacgcagagatcatcattgaagaagaagctaaccctgtgagtgttcatagatgtgttttagctgctaggagcaagttttttcttgatctgtttaagaaagataaagatagtagtgagaagaaacctaagtatcaaatgaaagatttattaccatatggaaatgtgggacgtgaggcatttctgcatttcttgagctatatctacactgggaggttaaagccttttcctatcgaggtttcaacttgtgttgattcagtttgtgctcatgattcttgtaaaccggccattgattttgctgttgagttgatgtatgcttcatttgtgttccaaatcccggatcttgtttcgtcatttcagcggaagcttcgtaactatgttgagaagtcactagtagagaatgttcttcctatcctcttagttgcgtttcattgtgatttgacacagcttcttgatcaatgcattgagagagtggcgagatcagacttagacagattctgtatcgaaaaggagcttcctttagaagtattggaaaaaatcaaacagcttcgagttaagtcggtgaacatacccgaggtggaggataaatcgatagagagaacagggaaagtactcaaggcattggattcagatgatgtagaactcgtgaagcttcttttgactgagtcagatataactctagaccaagccaatggtctacattatgcagtggcatacagtgatccgaaagttgtgacacaggttcttgatctagatatggctgatgttaatttcagaaattccagggggtatacggttcttcatattgctgctatgcgtagagagccaacaattatcataccacttattcaaaaaggagctaatgcttcagatttcacgtttgatggacgcagtgcggtaaatatatgtaggagactcactaggccgaaagattatcataccaaaacctcaaggaaagaacctagtaaataccgcttatgcatcgatatcttggaaagggaaattagaaggaatccattggttagtggggatacacccacttgttcccattcgatgcccgaggatctccaaatgaggttgttatacttagaaaagcgagtgggacttgctcagttgttcttcccagcagaagccaatgtggctatggacgttgctaatgttgaagggacaagcgagtgcacaggtcttctaactccacctccatcaaatgatacaactgaaaacttgggtaaagtcgatttaaatgaaacgccttatgtgcaaacgaaaagaatgcttacacgtatgaaagccctcatgaaaacaggtaaaagcttaaggaaatgtactttcaagttttattctctgaccacaagattgactgattcgaaaccgttcaacaacgcagttgagacaggtcggagatacttcccatcttgttatgaggttctggataagtacatggatcagtatatggacgaagaaatccctgatatgtcgtatcccgagaaaggcactgtgaaagagagaagacagaagaggatgagatataacgagctgaagaacgacgttaaaaaagcatatagcaaagacaaagtcgcgcggtcttgtctttcttcttcatcaccagcttcttctcttagagaagccttagagaatccaacatga

SEQ ID NO: 2028 - DNA, 414 bp, Arabidopsis thaliana
atgcaaggaacgatttcttgtgcaagaaattataacatgacgacaaccgtcggggaatctctgcggccgctatcgcttaaaacgcagggaaacggcgagagagttcggatggtggtggaggagaacgcggtgattgtgattggacggagaggatgttgcatgtgtcatgtggtgaggaggctgcttcttggacttggagtgaatccggcggtccttgagattgatgaggagagggaagatgaagttttgagtgagttggagaatattggagttcaaggcggcggaggtacggtgaagttaccggcggtttatgtaggagggaggttgtttggagggttagatagggttatggctactcatatctccggtgagttagttccaattcttaaggaagttggggctctgtggttgtga

SEQ ID NO: 2029 - DNA, 831 bp, Arabidopsis thaliana
atgtctttttctgcggatgctctggagggtggactttcgtctcttaaattggccgccgacaagtaccgatcaatcttgaacgatgaaaaaacgggaaacatacggtggagatacggtggtcctccgattttcgacaccgtgaacaagcttttcgaagaagaaagaacccatgttcaatggaggtatgataaccctccagacttcaatagtgtgaaccagctctttgaagaaggccagactaaggtgtggccagaaggttcgttagaagagacagtgcaaaacgcgatcaagtcatgggagatggagttctcacataagatccgtttacaggacttcaagactataaaccctgagaagtttaagctctttgtcaatgggagagaaggtttatcagctgaagagacgcttaggcttgggagttacaatgctttgctcaagaactctttgcctgaagagtttcagtactataagcccgaggaagagagctttgagtcatcacatgacgcctttagatctgctttaccacgcgggtttgcgtgggaaatactctctgtgtactcggggcctcctgttatagccttcaaatttagacactggggatactttgaaggaactttcaaaggtcatgctcctactggggaaatggttcaattcctgggtctaggagttctaaaggttgacgaatcacttagagcagaggagattgagatttactatgatccaggagagctgttcgggggactactcaagggacctcctatatcagagaccaaaaccacagacagtggagacaacactgcagagaaacaaagctgcccattcacacactaa

SEQ ID NO: 2030 - DNA, 6899 bp, Arabidopsis thaliana
catcctcaacgaaccgttataactctcgctctgcacaatcttctccgccgctcaaccactgtactacttggaaccagcaacactctcagtaccataacactaatttcccgccaaattacagacgtgatcgtgctccgtcgtcgggattctctcctccagtcacgcgggctaggcctaatttcatcgttcagctgcttcaccccgccgccgctaacagtgacacaaagctgtctaagaagcaagagatcgagagtatcgctttgctttgcgaaattccggaggaatcagttcacgtgcctcaatttggttgtatcgctgcaagcttcagttttcgtcagtgggtcgatgcgcgttctgccgttgtggctctttgggattatcgtcttcaagggagacatgattttgttcctgagctgattcctaatgttgttgttccgtctgacatggacgagcttaaagacaggcttcgtgatcttttctcgtctcatgttctttcgcttatggaaaatggacaaggggtcaagaaggtgagaatggagattgatgacaagtctcgtcaagttgcgtccttttcgtctaaaaggggtctgaaatttgaggtttttgagaaaaagaaggctcttgaagcggagagagatttggttgtgaatcggcttgacgaattcaataatgccatgaagagcattttgcgatatctcataggacaagacgggtatgagtttgatgtagatgatgaagatgacgaagacgtggccgtgttttctttggaaggggcctatgattggagacgtattcattatttgattcttagagagtgtcgaaggctagaggatggactgcctatctatgcctaccggcggcagattttgaagaaaattcattgtgaacagataatggtgttgattggagaaactggttcagggaagagcactcagttagttcagttccttgctgattccggagttgctgctagtgagtcgattgtttgtacacaaccacggaagattgctgccatgacattgactgatcgggtcagagaagaaagcagtggttgttatgaggaaaatactgtttcttgtactccaactttttcgtctactgaggagattagttccaaagttgtatacatgacggataattgtctgcttcagcactacatgaaagatcggagtttgtctggcatttcatgtgttattattgacgaagctcatgaaagaagcttaaacacggaccttcttttggcattgcttagaaagttgctatccagaaggattgacctgaggcttgttatcatgtctgccacggctgacgccaaccaactttcacagtatttgttcgattgtggtattcttcatgtcaatgggaggaactttccggtggagattgtatattcccctagtggcacagaagagaattctgttgttggccgcattgcttcatatgctggtgatgttgttaagatggcagtggaaatacataaaacagagaaagaaggaaccatccttgcattcttgacttcccaagcagaggtagaatgggcatgcgaaaggtttgtagctccgtctgcaattgctttgcctttgcatggaaagctttccttcgaagaacaatttatggttttccagaactatcctgggagacgaaaagtgatatttgccacgaatattgcagagacgtcgctgactattcctggtgtcaagtatgtaattgattccgggatggtgaaagagagtaaatatgaacctagaacgggtatgagcatcctaaaggtgtgccaggtcagtcagagttctgctcgacaacgtgctggtcgtgctggaaggacagaacccggaagatgttacaggctctactcaaaaaccgattttgattcaatgaatcttaatcaagaacctgaaattcggagggtccatcttggtgtagcacttttgaggatgcttgctttgggaatagacaacatagcggcttttgagtttgttgacgcgcctgtcccggaagccattgcaatggctatccaaaatcttgttcagttgggtgcagtcgttgagaagaacggtgttcttgaattaacacaggaagggcattgtttagtcaagctggggctggaaccaaagcttggaaagttaattttaggctgcttcagacacagaatgggcaaagaggggattgttcttgctgctgtcatggctaatgctagtagtatattttgcagagttggtaactttgatgataagatgaaagctgatcgcctaaaggtgcaattctgcaatgataatggagacttgttcactcttctttcggtgtacaaagaatgggcatctctgccacgagatagaagaaataaatggtgctgggaaaatagcctgaatgccaaatcaatgaggagatgtgaagacacagtcaaggaattggagatatgcattgagagagaacttactcttgtcagccctagttactgggtttggaatccaaatgagggtactaaacacgacaagtatttgaaaatggttatacttgcatctcttgcagaaaacgtggcgatgtacactggctatgatcagcttggatacgaggtggcattgactagtcaacaagttcagttacatccatcgtgttcattgctagcatttggccagaagccaagctgggttgttttcggggaacttctatctattgtggaccagtacttggtatgtgtaactgcgtttgattttgaagctttgtatatgcttgatccaccaccaccttttgatgcatcccagatggatgagcggaggctccgagttaaaaaagtggttggttgtagtagcactgtgctaaaacgattctgtgggaaatctaatcgtagtctgctttcaattgtttctcgtgctaggtctctttgttcggatgaaaggattggtatccaagtcgatgtcgatcagaatgagattcgactgtatgcgtctcccctcgacatggaaaaagtgtcagcccttgtgaacgatgcattggaatgtgaaaagaaatggatgcgtaatgaatgtttggagaagtatctatttcatggtcggggacaaatacctattgcactgtttggatctggtgctcagataaagcatcttgaagttgatcagagatttctgacagtcgatgtacattattatggcgacgatgttgttgatgacagagagcttctgacgtttctggagaagaagattgatgggtgtatctgctctatttacaagtttgctgcgaacaagcaagactgtgatgagaaggagaagtggggtagaataacctttctcactccagaatctgctatgaaggcaacagaaattcagaaatttgatttcaaaggatcagtgctcaaagtatttccatcactgtcaactggtggaggaattttcaagatgccttatttctcttccgtgacagctaagattcgttggccgagaaaggaaagtagtggtagaggatgccttaagtgcccttccggagatattcacagtatacttggtgatataaccagccttgagataggaacaaattatgtccatattcagagagatcaactgtccaatgattctatcttgataagtggacttggagatctttcggaagcagaagttttagatgttttggaattcagaacgcagagaagagatctgaattttttcatattcagaaaaaaatacagtgtgcagtgcccatctcctactgcttgcgaagaagagcttcataagagaatatttgcgcgcatgtcagcaaagaatccagagccaaactgtgtccaagttcaagtttttgaaccaaaagaagacaattacttcatgcgagcgttaattaagtttgacgggagattacatctcgaagctgcaaaagctttgcaagagttaaatggggaggtgttacctggatgtcttccatggcagaagataaagtgcgaacaattgtttcagagctccataatctgctccgcttctatctacaacactgtcaaaagacaattgaacgttttattagcaaggtttgagagacaaaaagggggtgaatgctgtctggaaccaactcataacggggcttatcgtgttaaaattactgcttatgcaacaagacccgttgcggagatgcggagagagcttgaagaactcttaagaggaaaacccataaaccatccaggcttcacacctagagtcgtgcagcatcttatgtccagagatggtattaatctgatgcggaagatccaacaggagacagaaacttacattctattagataggcacaatctcacagtacgcatttgtggaacaagtgagaaaattgccaaggcagaacaagaactggttcagtcacttatggattatcatgagagcaagcaacttgaaatccacctccgaggtcctgagatccgtcctgacctcatgaaggaagttgtgaagcggtttggtccggagctccaaggtatcaaagaaaaggtgcatggtgtggatctcaagctcaatacccggtaccatgttattcaggttcatgggagcaaagaaatgaggcaggaagtacaaaagatggtcaatgaacttgcacgagaaaagagtgcactgggtgaaaaaccagatgagattgaacttgaatgccccatttgcttgtctgaagttgatgatggctactctcttgaaggatgttcacacctcttctgcaaagcttgtttgttggagcaatttgaggcatcgatgagaaactttgacgcattcccaatactttgttctcacatagactgtggagctccaatagtagtcgctgatatgagagccctcttatcacaagagaagctcgatgaactcatcagtgcatccttgtccgcttttgtaacatccagtgatggaaagttgaggttttgctccacacctgattgcccttccatctaccgtgtagctggacctcaagaatccggtgagccattcatctgtggagcatgtcactcagaaacatgcacaaggtgtcacctcgagtatcacccgttaatcacttgtgaaaggtacaaaaagttcaaggagaatccggacttgtcgcttaaggactgggcaaaagggaaggacgtaaaggagtgtccgatttgcaagtcgacgatagagaagactgatgggtgtaaccatctgcagtgccggtgtggaaagcacatttgttggacctgcttagacgtcttcactcaggcagaaccttgttatgcccatttaaggacaattcatggtggaatcggattagtcgagttagcccaattcgatattcgaatcgaacccaccggcctaactaaactgttcagtgtccccaaatctttttgcaacttctttcttcttcatattcttctcaccgtgaaggcgtcgtcaccgccgatgttattatctccggcgatgttttctgatcatcactgctttactcttactgcgagaatgtcagattctgatgaagctaaaacgtcggaggaagaatctcaacttgctgagcaagaaacagagactcaagaaggtgaaatgactaaaaacttaaagaaaagagatcttgatgcagtagaagatgaagattcgaataacgaaagctccagattagagaaactagagaagaagataaaaaaagaaacagcgaggaagcttgaaactgactttgtgctaacaggggaagaggatgatgatgcattgcccttagcctgttccatttgccaaaacccattcttggatcctgttgtcaccaactgcaaccattacttctgcgacaagtgtgctctaaagcatcacactgagaacgatacttgttttgtgtgtaacgagccaactctagggcttttcgacacagccgtggagatcaaggaaagaatagaggaagaacgtgagaaagccagagccatggtaaaggaagtgacagcaatgttagaaaaggcatcgacaatggcggatgacgccaagggcgtagcgcaaaaggttgtaaaaatggtggaggagattgaaacaatggtggaaaaagtggcggctatggccacaaaggcgggagaaacggcgacaatggcggcagatatggtgaaagaagctgaggagacgatggaaacagctaaagctaatatgtccaaagcctttgtgctttactttgtttgcttctattatatccacttccaacaagattcctcaaaaggaaagaagagaaagaagataagagatatctggttggtcggagatggagatgatcggaggagacgatacagatacagagatgtacggagctctagtgacggcacagtccttaaggttgcgtcatcttcaccactgcagagagaaccagtgtacctctgttctcgtcaaatacattcaagctcctgttcatctttttacttgttggtctctcttagtcttaaagctaaggatagtgaatatacatatatgattcaggtttggtcactggtgcggagatttgatcagccgcagaaatacaaaccatttataagcagatgcactgtaaatggtgatcctgagatcggttgtctcagagaagtaaatgtcaaatctggtcttccagcaaccaccagtacagagagattggaacagcttgatgatgaagaacacatcctcggtatcaacatcattggtggtgatcatagacttaagaattactcttcgatcttgactgtgcatccggagatgattgatggaaggtcaggaactatggtgatggagtcttttgttgtggatgttcctcaaggcaacaccaaagatgatacatgttacttcgtggaatcactcataaagtgtaacctcaaatccttggcttgtgtctctgaaagattggctgctcaagacattaccaattccatcgcaactttctgtaacgcttccaatggatacagagagaagaatcatacagaaaccaacctttga

SEQ ID NO: 2031 - DNA, 1605 bp, Arabidopsis thaliana
atggcgatgaattcgaagaggaaaacaccacctgggattgcgcttctgaggagagtcagaggaagaaattggagtccaaagacgtttcggtacgcgattttgtttattactttcatcgcatatgcttgttaccatgcttctcgtaaaccaagcagcatagtgaagagcgttttacacccagactcaagcactaagccacctcaagaacataacagcgacaaaatttatccttggcctatgggtaacgtgtttgtgaagagagaaattggtgatatagatgaggttttgttgcatcgtaagtctaaaggatgggaaccgtttaatgggaaagatgggacgtctaggttgggagagattgatgtggcgtttcttgcttgttactctataggaatgtatgttgctggtcatttgggtgatagtttggatctgagattgtttctgacttggggaatgattgggagtgggttctttgttgggttgtttggtatgggttatttctggaacattcatgcgttttggttctttttggttatgcaaatggcggctgggttgtttcaggcgacaggatggccatctgttgtggctgttgttgggaattggtttgggaaaaggaagagaggtcttataatggggatttggaatgctcatacttctgttgggaacatttgtggttctttaattgctgctggtgttcttgaatatggttggggatggtcttttatagctcctggttttgtcatgtctttaggaggagttcttgtttatttgttcttggctgcgtatcctgaggatgttgggtttccagatatcaattctaattcagggaagtttattaagaggaagagagatgttgaagaggaagaagaggaagtagaagaagatttagggacagatgttgaaggggatggggagggatcatcagggtcaggttcagggtatgagaataaaagaagtgttggacttttgcaagcttgtatgatccctggtgttataccgtttgcgttgtgtctctttttctcgaagctggtcgcgtacacgttcttgtactggttaccgttttacttgagccaaacaactattggtggagagtacgtgtctgtgaaaacagcagggaatctctccacactatttgatgttggaggcattgtaggagggattctttgtggttacatttcagacaaattcaaagcaagggctacaactgcagctgcattcatgtacgctgcgattccggcaatgcttgtgtaccattcctatggaggtgtctctcagacagtcaacatcctcctcatgatggttgctggtttgtttgtcaatggtccttatgcactcatcacaaccgcagtctctgcggatctgggaacgcacaagtctttacaaggcgattcaagggcgcttgcgactgttactgctatcattgacgggactggatctgccggtgcggctttaggtccgcttttgacagggtttctttctactctgggttggcaagctgtgttctatatgttggtcgttggagctctctgtgctggtttgcttttgacccgtctggttattgctgaaattagagagaaacttggatatgttgatgaagaaggtaaataa

SEQ ID NO: 2032 - DNA, 879 bp, Arabidopsis thaliana
atggcccaaaagatcgaagcaattggtgggaagggagggaaacggtgggatgacggtgcgaatgataatgtagcaaaggtttacatacgaggtgatcatgaaggcattcagtacatcaaattcgactatgtcaaggatggacaatcgtttaatggatcagtccatggtgtttcagccgacggtttcacacagacgtttgagattgaccatctccagtatgaacaaattgtatctgttgagggttactacgactggaagaccggtgtgatgcaagcactccaattcaaaaccaacctcaagacttcagaatttattggatatcaaaagggtactaagttttcacttggagtcgatggaaaagtcatcgttggcttccatggatctgcttggcgtagcctccgatctcttggtgcatatgtaaagactgctcctaccaaatcagaactccagggtggcataaccggaggcgaatattgggatgatggtcctaatttcgacggtgtaagaaaggtgtatgttacttttactgaaactcatataaggagtatgaacattgactatgaccaagatggccaagtggtgacacgttatcacgggatgaagaatggagaaacgcaggagtttgctgtggactttccgaatgaatatatgacatctgtggagggtacatacgaccatatcagtgagggtaactatttggttcttacgtcattgactttcaaaacgtcaaaagggagaatctctcagacatttggattggtcattggtaccaaatttgtgttggagactaaaggtaatgttatcagtgggttccatggaagagatggtggttcttttgatgctattggagtatatttctctccaatgatatcttcctaa

SEQ ID NO: 2033 - DNA, 1869 bp, Arabidopsis thaliana
atgcgcaaacaatttgtttttcttctgcctttcttgtcacgtctctaccatgtagttatagccggaggagaacggttaactaacggcggtttttcaccggagataaatccgttcacacccaaagcgtctttagtacgttactggaacaaacagatccatcaccaatcacccggctcagcctttctcctctccaaggcttcaccacttaccgccgtcgcctccgccaccttcgccaaactcgcctccgaaaacgctcttccggatcgcctccccgacttctgctccgccgcaaacctcttctgttttccagatttaggtccaaccctcgagaaacacagcaacgacgttaaattctctgtttacgaccaacgaaacttcaccaactacggcacgattcaccccggcggtgctgactcgttcaagaaatattcacaaaacggtaacgcagtaaccgactctttccggcgatacagccgagacgccgccggtcacgaagataaattcacaggctacgctgataacagcaacgtcgtcgaggaaaaattcaattcttacggcacatcagccaccggcggctccggcgattttaaaaactatcaatccggtgttaacaatccgacgactcgtttcaaggcctattccgacgaaggaaatggccgtgctcagacgtttaaaacctatactcacgaagccaactccggaccgggtcaatctttcaccagttacggcaaaaacggtaacggagctccaaacgagttctcttcttacggtgtctcctctaacgtaatcggatctgatttctcaaactacggtgaaaacggtaacgcagccaacgacactttcaaaggctacggtggtgacggcaatgttcctcagaataacttcaaaagctacggtgcctccgggaacgctgccgttgacacgttcttgaattatagagacaatgctaacgttggtgatgattcgttctcgtcgtatgccaagaactcaaacttcgagaaggttgatttcgtaaattacggcaaatctattaacccgggttcagagtcgtttagtggttatggtaaaggagctgagggaaacaaaattgatttcaaaacgtatactcagaactctacgttcaaggactacacgaaaaccggagtcgaatttgcgaaatataaccggagtagtctcggtggtggcaaaacggtaaataagtgggtggagcctggcaagttctttagagagtcgatgcttaaagaaggtacattgatttggatgcctgacattaaggataaaatgccgaaaaggtcgtttctacctcgtagcattgtctcgaaactaccgttttctacatcgaaaatcgcggaaatcaagcgtgttttccacgctaacgataactcgacgatggaagggataattactgatgcggtaagggaatgtgagagaccgccgacagtcagcgagactaaacgatgtgtcggatcagcggaggatatgatcgatttcgcgacatctgtgcttggtcgaagtgtggtactccggacgacagagagtgtagccggatcaaaggagaaagtcatgatcggtaaagtcaatggaatcaacggtggaagagtgacaaaatcagtgtcgtgtcaccaaagtttgtacccttacttactctactactgtcactctgtgcctaaagttcgggtgtacgagtcagatcttttggatcccaagagtaaagccaagatcaaccatggtattgctatatgtcacatggacacatcagcttggggtgcgaaccatggagccttcatgttgcttgggtcccggccaggtcagatcgaagtatgccattggatctttgagaatgatatgaattgggccatcgccgattaa

SEQ ID NO: 2034 - DNA, 489 bp, Arabidopsis thaliana
atgtcgatgattccgatcagcaatcgccggagactatctcccggcgatagaatctgggaaccatttgaactcatgaacacctttcttgatttcccatcaccagctctctttctttctcaccactttccctcactttctcgagaaatattcccacaaacttcatcatccaccgtcaatacgcagctcaattggaccgagactccgacggctcacgttttcaaagcgtatcttccgggagtggatcaagacgaagtgattgcgttcgtagatgaagaaggatatcttcagatctgtactggcgacaacaagttcatgagcagatttaagcttcctaacaacgccttgacggatcaggtcacggcgtggatggaggacgagtttcttgtcgtgttcgttgagaaagatgcttcttcgtcgccgccacagctgccggagattgaggagaatcgtaacgtgagagttgtggaaatcaccggcgatgatgattaa

SEQ ID NO: 2035 - DNA, 522 bp, Arabidopsis thaliana
atgcacgagaaaactaaatttcgattacattctcacgatgtgccgtatggatccggcagtggtcagcaatcagtcactggttttccaggcgtcgttgattccaacagctattggattgttaaacctgtgcctgggacaacagaaaagcaaggtgatgctgtcaagagtggagcaaccattaggttgcagcatatgaagaccagaaaatggcttcacagtcacttgcatgcatctcctatatcagggaacttagaggttagctgctttggagatgatacaaattccgatactggggatcactggaagcttataattgaaggaagtgggaagacatggaaacaggaccaaagagtccgtcttcaacacatagacactagtggctacctccatagccatgacaagaagtaccaacgtatagctggtggtcagcaagaggtgtgtggaattcgggagaagaaggcggataacatttggttggcagcagaaggagtctaccttccccttaatgagagcagcaagtaa

SEQ ID NO: 2036 - DNA, 2508 bp, Arabidopsis thaliana
atgataacagtaaaatggagcttgtgtttaatcttctgcctttcaaactcaatacttgtttttgctaaacacttgtgtcttccagaccagagggattctctttgggggttcaagaacgaattccatgtcccaagcgagaagtggaggaacaacactgattgctgttcttgggatggtgtttcttgtgatcctaagacgggcaatgtcgttgggttagatctagcgggcagtgatctcaatggccctttgagatctaatagcagcctgtttagactacaacatcttcagaagctgtatcttggttgtaatacttcattcggaagtctttcttataatgatggtttgaagggtggtgagctactggattccatcggcaacctcaaatatttgaaggttttgagtcttcgtggttgcaatctctttggaaagattccttcttcactcggaaatctttcttatctcactcatcttgatctttcttttaatgatttcaccggtgtgataccagattcgatgggcaatctcaactatttgagggttttgaatcttggtaaatgcaatttctatggaaaggttccttcttcactcggaaatctttcttatctcgctcaacttgatctttcctataatgatttcacccgtgaaggaccagattcaatggggaaccttaaccgactaaccgatatgcttctcaagttgaactcgctcaccgatatcgaccttggttctaaccagttgaaaggtatgctcccatctaacatgagtagcctctccaaactggagtatttttatattggtggaaattcattttctggatccattccctcttctctcttcatgatcccttcgttggttgaacttgacctgcaaagaaaccacttcagcgctcttgagattgggaatatctcttcacaatctaaacttcaagtattaattcttggaggaaataatttcaatccggacattgttgatttgagtattttctcacctctcttgtcacttggttatttggatgtttcagggattaatttgaagatcagttcaaccgtcagtcttccctcacccatagaatacttggttttatcgtcgtgtaatatttccgagtttcccaaatttctacgtaaccaaaccaagttgtattctttagacatctctgccaatcaaattgaaggccaagtaccggagtggttatggagtctgccagagttgcagtctattaacatctctcataattctttcaatggtttcgaaggaccagcagatgttattcaaggaggtggagaactatatatgcttgacataagttcaaacatattccaggatccatttcctttgttaccagtagactctatgaatttcttgttcagctccaataatcgattttcgggagagattcctaaaacaatatgcgaattggataatcttgtgatgcttgttttgtcaaacaacaacttcagcggttctattcctcggtgttttgagaatttacatctttatgtcttgcatcttcggaataacaacctctctggtatttttccagaggaagctatcagtgatcgcttgcaatcacttgatgttggtcacaatcttttctcaggagaacttcccaaatcattgatcaactgcagtgcactcgagtttctatacgtggaagataaccgaatcagtgacacgtttccatcctggttggaattgttgcccaattttcagattcttgtccttcgttctaacgagttctatgggccaatattttctcctggagattctttgagtttccccaggttgcgaatctttgatatttcggaaaatcgcttcactggagtcttgccatcagattactttgcgccttggagtgcaatgtcgtcagtcgtggatagaataattcagcattttttccagggatactatcataactctgtggttctgacgaacaaaggattaaatatggagctggttgggagtggtttcacaatctacaaaaccattgatgtctccggaaacagactcgaaggagacatccccgagtccatcagtcttctcaaggaactgattgtgctcaacatgtcaaacaacgctttcacaggccatattccaccatctctatcaaacttgagcaatctccaatcattggatctatctcaaaacagattatccggcagtatcccaggagagctcggggaactcacatttctagcgcggatgaacttctcttacaacaggcttgaaggtccaataccacaaaccactcagattcaaacccaggatagttcttctttcacagagaatcctggactctgtggtcttcctctaaaaaaaaactgcggcggaaaagaagaagcaacaaagcaagagcaagatgaggaaaaggaagaagaagaacaagtatttagctggatcgcagctgcaataggctacgtacctggtgttgtgtgtggactcaccatcggccacattctggtttcacacaaacgtgactggttcatgagaattgtttccctctttacttaa

SEQ ID NO: 2037 - DNA, 1071 bp, Arabidopsis thaliana
atgatgatcggagaaactcgcaggacttatcccactgttgaaatacctccatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccgaggaagtaccattactctggtacggcttgtcctgattttcgtaaaggtggctgcaagaaaggtgactcttgtgagtttgctcatggtgttttcgagtgttggcttcatccagctcgttaccgtactcagccgtgtaaagacggtggtaactgtctccggaaaatttgtttctttgctcattcaccggatcagcttaggtttttacatactcggagccctgacagagttgattcttttgacgtttcgtctccgattcgtgctagagcatttcagctgtcgatttctccggtttctggttcgccaccgatgagtccaagagctgactcggagtcttctccgatgactcagtcactgagtcgatctctcgggtcttgttcgataaacgacgtcgttccttcgtttaggaatttacagtttaattcggtaaaatcatttcctcgtaacaatcctttattcggattcgggtcgccccgtggatcgatcttgggtcctgggtttcagtctctgcctacaacaccgacccgaccagggaatctggatatttgggagtatggtttggaggaagaacccgtaatggagcgtgtcgttgagtcgggtcgtgagctacgagaaaagatgcgcgagaaactgcacaaggagaattgcatggatcgagttgcccaggatccggatcagaatttgggtgaggctcctgatgtcgggtgggtatctgacctgctcatgtaa

SEQ ID NO: 2038 - DNA, 501 bp, Arabidopsis thaliana
atggcaccgacagttaaaacggcggccgtcaaaaccaacgaaggtaacggagtccgttacagaggagtgaggaagagaccatggggacgttacgcagccgagatcagagatcctttcaagaagtcacgtgtctggctcggtactttcgacactcctgaagaagccgctcgtgcctacgacaaacgtgctattgagtttcgtggagctaaagccaaaaccaacttcccttgttacaacatcaacgcccactgcttgagtttgacacagagcctgagccagagcagcaccgtggaatcatcgtttcctaatctcaacctcggatctgactctgttagttcgagattcccttttcctaagattcaggttaaggctgggatgatggtgttcgatgaaaggagtgaatcggattcttcgtcggtggtgatggatgtcgttagatatgaaggacgacgtgtggttttggacttggatcttaatttccctcctccacctgagaactga

SEQ ID NO: 2039 - DNA, 2163 bp, Arabidopsis thaliana
atgatgaatggtttgagaagaacgttttggagttcgattcataaaaagaaagacaacaacagagtcgatgattcacttgatcgacaaaaaccaacaacaacttcaagattcgggtttttctctaacccgtctactccaaggtctgagacccgacccgattctgtaacctgctctcctaccattccttgtcagagttggtctgctacagctatctccactccttcaccgtctcttcccgctagtcccaagcttcaatgcgatacttccggggacgttactccgacgagaaacagaagtcctctctctttcctcagcgtttcttcttcttcttctacaccttcctcacctaaatctccggcgagcttttctctactcaaatcaaaactctgtttcaccaaagtaagaatcctaaatcgaaacaaccaaagtagcatcagtagtagcaaatgtggaatttgtttacaaagcgcgaaagctggaagaggaacggcgattttcacggcggaatgttcacatacgtttcatttcccttgcgtagcttcacgcgccggtgatcggaatctactctccgattgtcctgtttgtggtgcttcatggagagaaacttcgcttcttcctctgtctctctcttcttctctccacgaatctggatccgaatccgattccaagatccgagaatcaaagaacaataacaaatcgttaagagtttacaacgacgacgagcctttgatttcatctccaatctctcgtaccggtttcaacactataccggaatcaaacgaagacgaagaagaagaagataacgatgacggagaatttaaagggttttacgttaacacgccgtcaccgttaacgacgaagaaaatgttaacggattccgttactggacacgtggacgttaagctgtcttcagaagctgcaattgtggcggttgggagaggtaacgagacgtactcggtgctcatgaaaatcaaatctccgtcgttaccgacggcgcgtagatctccggtggatcttgtaacggttattgacgttagcggagggaatattgagatggtgaagcgagcgatgaggcaagttatatcgtctctacgagaaacggatcgtttatcgatggtctcgttctcgtcgagctcgaagcgattgacgccgttacggagaatgacggcgaacggaaggcgattagctagaagaatcgtcgacgatatttccggtgatggcgacggaatgagtgttaatgatgccgttaagaaagcggctaaagtgatcgaagatcgccggcagaaaaatctcttcaccaccatcttcgtgttaacggaccgtaatagaaactcggcccaccaagcccaattagcccaaccggattttgtgacttccacgcgcttctctcatttggaaatcccaacgcacactatttggcttggcgcgtgtaatcacgctctccccgaggacgtgtttgccaaacgtatcaagagtctgttgagtttatcggttcaagatcttactctaaatctcggattagtttccgggtcgggtcaaggaaaggtgacatcagtttattcactctcgggtcgacccgtttggctcggatccgggttgattcggttgggtgacatgtacggcgatgaagaaagagaagtgttggtggaactcaaatcaccttcgtctagtagatcccagagaatcatgaccgtccgatcacgccacgtggatcctacgactcaggaaatcaaaaactatgaagatcgcgcgctaatgataccacgtcccacgaccgttagatcatctgacccgagcatcgcaaggctacgaaacctccacgtcagcacacgagccgttgccgagtctcggcggttagtggaagtcaatgattactcgggggctgagcgaatgctgacatcagctagagccttgttggtgcaatacggtttgagctcaagtgattcgtgcttacgtggtttggaagctgagctggcagatttgaaccgtttgagaggtagacacgtggcggtgaagagtccagagccggtggttcagaagagtgagccgcttacaccgacttcagcgtggagagcggctgagagattggctaaagtggcgatcatgaggaagcatatgaatagagtcagcgacctccatggattcgaaaatgctagattttag

SEQ ID NO: 2040 - DNA, 1686 bp, Arabidopsis thaliana
atggcggcgacttgttctctgctcgcgtcctttctcctctgctttgctcttctctccgccgtttctttcgcggcggaccctttcgtctcctacgacttcagagtttcttacctcactgcttctcccctcggcgttcctcaacaggttatagccgtcaatgggcagtttccaggacctctgcttaatgctactaccaactacaatgttgttgttaacgttttcaatcatttggatgagcctctcctcttgacttggcctggtatccaaatgcggcgtaactcgtggcaagacggtgttcttggcacaaactgccctattcctcccagatggaactttacttaccaatttcaagtcaaggatcaaattggaagctttttctactccccttcactcaactttcagagagcatctggtggttttggtcccatcgtgattaataaccgggacattattcctatccctttcccacagcctgatggtgaactcatcttcattattggtgattggtacactcaggaccataaagcattaaggagagcacttgactctgggaaagaacttgggatgccagatggagtcctcatcaatgggaagggtccttacaagtacaacagtagtgtacctgatggaattgattacttaacctttcatgttgaaccagggaaaacatacagaatccgtgttcacaatgttgggatctcgacaagcttgaacttcaggattcagaaccacagtttgcttttggtagaaaccgagggtcactatacttcacaggcgaacttcactgattttgatgttcatgtaggacagtcttattctttcttggtaaccatggaccaagacgccacaagtgactactacattgttgccagtgctagatttgtgaatgaaacagtgtggcaaagagtcactggtgttgccattctccattattctaattccaaaggacctgtttctggtcctctaccagttcccaaaacagatgtttctagcccgtggtcagcaatgagccagccgaagaccatcaggcaaaacacatctgccagtggagctcgtccaaatccgcagggatcatttcattatggtcaaataaacatcactaacacatacattttgagaagtttgcctccaacaataattaacggggcacttcgtgctacacttaacgggatctcatttgtgaatccaagcactccagtgaggcttgcggatcgcaataaagtgaaaggagcttataagctggacttccctgacagaccttttaatagacctcttcgtttggatagatctatgatcaacgcaacatacaagggctttatacaagttgttttccagaacaatgacaccaagatccagagcttccatgttgatggctattcatttttcgttgttgggatggactttggtatttggtcagaagacaaaaagggttcatataacaactgggatgccatctcaagaagcacaatcgaggtataccctgggggttggacggctgtactgatttcccttgataatgtcggagtttggaacattcgagtagagaatcttgacagatggtatcttggtgaagaaacttatatgcggatcacaaaccccgaggaggatggaaagacagagatggatcctcctgacaatgtcctatactgtggtgctcttaagaacttgcagaagtattcttcataa

SEQ ID NO: 2041 - DNA, 972 bp, Arabidopsis thaliana
atggctgtatcacttccaaccaagtaccctctacgacctatcaccaacatcccaaaaagccaccgtccctcgcttctccgtgtacgtgtcacctgctctgttactaccaccaagcctcagcctaatcgtgagaagcttctggtagagcaacgcactgtgaatcttcctctgtccaacgaccaatctctgcaatcgaccaagcctcgccctaaccgtgagaagcttgtggttgagcaacgccttgccagccctcctctgtccaatgacccaactttgaaatcgacatggactcaccggttatgggttgcagcgggctgcaccactttgtttgtctctttagctaaatctgtcattggagggtttgattctcatctctgcctcgaaccagctttagccggttatgcagggtacatcttagctgatctaggttccggtgtctaccactgggccattgataactacggtgatgagtcaacacctgtagtaggaacccaaatcgaagcatttcagggtcaccacaagtggccttggacaatcaccagacggcaatttgccaacaatctacacgctctggctcaagtcataaccttcacagttcttccactagaccttgcatttaacgaccctgtgtttcacggctttgtgtgcacatttgcattttgcatattgtttagccagcaattccatgcttgggcacatggaaccaagagcaagcttccacctctcgtggtcgcgttgcaggacatggggttacttgtttcacggagacagcatgcggaacatcatcgagcaccgtataacaacaattactgcatcgtgagtggagcatggaacaatgttctggatgagagtaaggtctttgaggcattggagatggtgttttatttccagcttggggtgagacctaggtcatggagtgagccaaactctgactggatagaagaaaccgaaatctccaacaaccaagcataa

SEQ ID NO: 2042 - DNA, 540 bp, Arabidopsis thaliana
atgtcttctgagaatgatttcgttgagttttcttctatgttcgagagaattatacaaggaagaggtgatggtctctctcgatttttgccggtgattgtagctttagccgccagagaagacgatgatgaccaaggatctaccgatcaaacaacgagacggggagatccgttgagtccaaggttcgtgatgatcggatcgcgatcgggactcgacgatttctttagcgacggtggaaaacaagggaggtcgccggcgttgaagtcagaagtggagaatatgccacgtgtcgtgatcggagaagataaggagaaatatggtggttcttgcgcgatttgtttggatgagtggtctaaaggtgacgtggcggcggagatgccttgtaaacataagtttcactcaaagtgtgtggaggagtggttagggaggcacgccacgtgtcctatgtgtaggtatgagatgcctgttgaagaagttgaagaagagaagaagattgggatttggattggtttctccattaacgccggcgacagaagaaactaa

SEQ ID NO: 2043 - DNA, 1128 bp, Arabidopsis thaliana
atggacttgaaaagcaacaaccaccagcaacagcaacaagtacttgatggctcggacatagttgagctggtggaaaacgagaaagtgttcgacaagtttgtggaacaaaagtttcaacagttagaccaagatgaagatggtaagctctccgtgactgagttacaacccgccgttgctgatatcggcgctgctcttggtttgcctgctcaaggaacttctcctgattccgatcacatctactccgaggtcctaaacgaattcactcatgggagtcaagagaaagtgagcaagacagagttcaaagaagtgttgtcggacattttgttgggtatggctgctggtctgaaacgtgatcctatcgtcatcctcaggatggacggtgaggatctctcggagtttgtccacggccctggatatgaaatcgagagcatttctgttttctcagagctctccagtagcaaggacgcatcgctccgtgattgtatcgtcaaagctctccagtctctttctgttgatcatggaatgcctccttccaacgacccatgggtgatgagcaacatcgtagaaccaattgttgactcttgtcttgatgaagaagataaaagagagaaaagcgcgtctcaggagagattcttggaagcattcaagagagtcgtggagagtgtggctcagcgtctcaatgaacagcccgtgatcgttgctcacagcgaaaacacctttgatgggagcggtatcaggaggctcttgtccaataaattcgaattcgataaggcactaaacgttgccatggagacgattccaaaagaccgtcagggtaaggtgtctaaaggatatctacgagctgtgcttgacactgttgcaccatcggccactttaccaccaataggcgctgtgtcccagatggataatatgataatggaagcgttgaagatggtgaatggagatgatggaaatgtggtgaaggaagaagagtttaagaaaacaatggcagagatattggggagtataatgttgcagctcgagggtagtcccatatcggtttcctctaactcggtggttcacgagccgctcacctcggctacctttctgccgtcaacttcgactgatacagaggagccttcaaactaa

SEQ ID NO: 2044 - DNA, 2982 bp, Arabidopsis thaliana
atggaagatcgtcaaaacgatcaaaacgatgacgttttctccttcttctctccttccttctccgccgcaactccgtccacgcttttcaaccgttcagcttactcctcttcatcttcctccggcgacgatgaatctcagccttccgtcgacgacagcaacaaacgtatcgattacatgatccaatttctcgaccggagactaagcgaagacggtaatcacgacgggatcggtgatggaaacggctccgattcgttaccggaatttgttggtaagtgtggtgaatctgggatcttcaaagttccgattaggtcagcggttcatccgaatcgaccacctagtcttgatgtgagacctcatccattgagagaaactcaaattgggaggtttttgaggacaatgactagtactgagagacagttatggactggtggtgaggatggtgcgttgagagtttgggagtttagtgaattgtatggaagtgggaggggattagaggtagaggatacggcgccgtataaggagagtttagggaatgagtttgggtctgctgctgttgtttgtatgattggtgatgaaggtagtagagttgtttggagtggacatagagatgggaggattaggtgttggagattgagaggtgatcatggtattgaagaagctttgtcatggcaagctcatcgtggtccggttctctccattgccatttcggcttatgggtctgagggaggtgctcttaaagtttggccctgggacggtgctcttgggaagtcgctttctttgaagatggaagaaaggcacatggctgcgttagcagttgaaagatcgtatattgaccctaggaacatggtttcggccaatggatttgctaatacattaacgtcagatgttacattcctagtatctgatcatacaagggcaagagtatggagtgctagtcccctgacgtttgctatatgggatgctcgcactagggatttgatcaaagtattcaatattgatgggcagctcgagaatcgacctgaaaattctgtatatcctgattttgggagtgaggaagaggggaagatgaaggtaactgcttccaaaaaagagaaagctcaatcttctcttggtttctttcagcggtctcgtaatgccattatgggagcagctgatgctgttcgtcgtgctgcaacgaaaggagggttttgtgatgatagtaggaaaactgaggctattgtcatatcagttgatggaatgatttggacaggaagttcaaatggtatacttatgcgatgggacggaaatggtaattgcttgcaagagttcgcatacgagtcctctggtattctctgcatgttcactttttgttctcgactgtgggttggttattccaacggcactgttcaagtatgggaccttgagggaaagctgcttggtggatgggtagctcatagtggacctgtaataaaaatggctatcggggctggttatttatttacccttgcaaatcatggaggtattcgtggatggaatgttacttctcctgggccccttgacaatgtactgcgggccgagttggctgggaaagaatttttatattcaaggatagagaatctgaaaatattagctggtacgtggaatgttggagaggggagagcatcaaccgactcacttgtatcttggctaggctgtgctgcaactggagttgagattgtagttgttggactgcaagaagttgaaatgggagcaggagttcttgcaatgtccgcagcaaaagaaacggtgggacttgagggtagtccgcttggtcagtggtggctggatatgatcgggaaaactttggatgaggctggtgcgtcatttggtgttacaatgcctcgtggtggcaatgctttgggtgtcaatacaatcgaagcaaggcctgaactatctgaggcagacatggtcatatttcttggagattttaattaccgtttggatgatataacgtatgatgaaacaagggatttcatatctcaaagatgttttgattggctaagagaaaaggatcagctacatactgaaatggaagctgggaatgtttttcaagggatgcgtgaagcaattatcaggttccctccaacatacaaatttgaaaggcaccaagctggtctagcaggatatgattctggggaaaagaagcggattcctgcctggtgtgacaggattctatatcgcgataataagaaacatttgggagctgagtgcagtttggattgtccagtggtgtcttctatatcacagtatgatgcctgcatggaagtgacagacagtgaccacaagcccgtacgctgtgtatttagtgtcaagattgcccgggttgatgagtcagtcaggagacaagaatatgggaacatcataaactcgaataagaaaatcaaggtcttgcttggagagttaagcaaggttccagaaacaattgtcagcaccaataatattattctccaaaatcaggattcaactatcctgcgtatcacaaataagagtgagaagaacatcgctttcttcaaaataatttgtgaaggtcaatctaaaatcgaggaggacggtcaggcacacgaccaccgagcaagaggctctttcgggtttccccagtggctggaggtgtctccaggaactggcacaatcaaaccaaaccaaatagccgaggtttcagtgcatctggaagacttcccaacagtagaagagtttgtggacggtgttgctcagaactcttggtgtgaagacacaagagacaaggaagtcatattggtcctcgtggtccacggaaggttctcgactgagacaagaaagcatagaatccgtgtgcgtcactgccctcgtggtggacctgcaaagaaccatttcaatgatggaaccaaaacctcgggacaaataaacgctcttcatcgctccgattatcatcagctaagcaatactcttgatgtggttgagcagctaaagaacttgcacagtccatag

SEQ ID NO: 2045 - DNA, 3612 bp, Arabidopsis thaliana
atgacaaagtgtcggagaagaagattacatctaagcaatatatacgcattcaaaggtcgtaaatcaaactttcaagaagatcattcacacataggaggacctggtttctcacgagttgtttactgtaacgaaccaaattctccggcggctgaacgacgtaactacgtcggaaactatgtccggtcaacaaaatacactctagcttctttcataccaaaatcactcttcgaacagttccgtcgtgtcgccaatttctacttcctcgtcaccggagtcttatcgctgactgctctctctccttacagccccattagtgctctcttacctctcaccttcgtcatcgccgcaagtatggttaaagaagctatcgaagattggggtcgcaaaaaacaggacatcgaaatgaataataggaaagtgaaggttcacgacggaaatggaatattccggcgagaagggtggagggatcttaaagtcggaaatatagtaagagttgaaaaagacgagttttttccggcggatcttttgctgttatcatctagctacgaagattcgatttgttatgtagagactatgaatctcgacggagaaacgaatctgaaagtgaaacaaggcttagaagcgacttcatcggctttacatgaagattcagatttcaaagagttaaaagctgttgtgaaatgtgaagatccaaatgcagatctttatacttttgttggaactttacattttgaagaacagagattaccattgtcgattacacagcttcttcttcgagattctaagcttagaaacactgagtatatttatggagttgttgtcttcactggacatgacacaaaggtgattcaaaattcaactgatccaccatcgaagagaagcagaatcgagaggaaaatggataaaatcatttacttgatgtttggtgttgtgtttttgatgtcgtttattggctccattgtctttggtattgagacaagagaagatagagtgagaaatggaggaagaacagagagatggtacttgagaccagataatgcagatatcttctttgatccagacagagctccaatggctgcggtttatcatttcttcactgcggttatgctatacagttacttcataccgatttcgctttatgtctctatcgaaatcgttaaagttcttcagagtcttttcatcaacaatgacattcttatgtactacgaggagaatgataaacctgcgcatgcaaggacgtctaatctcaatgaagagcttgggatggttgatacgattctatctgataaaaccggtaccttgacatgcaattcaatggagtttatcaaatgttctatcgcgggaacagcttatggacgtggtataactgaagttgaaagatctatggctatgagaagcaatggttcgagtttggttggtgatgatttggatgttgtagtggaccagtctggtcctaagatcaaagggtttaattttctggatgagagggttatgaaagggaattgggttaagcagcgagatgcagcagttttgcagaagtttttcaggttgttagctgtttgtcacacggcgatacctgaaaccgatgaagctacagggagtgtctcttatgaggctgagtctcctgatgaagctgcgtttgttgttgcggctcgagaattcgggtttgagttctttagccggacgcaaaacgggatatctttccgtgaattggatcttgcttcagggaaaacagttgaaagagtatatcggttgttaaacgttcttgagtttaacagcgcgagaaagagaatgtcggttattgtgcgcgacgaagatgggagacttctgttactgtccaaaggagctgataatgtgatgtttgaaagactagccaaaaacgggagaaagttcgaagagaagactcgagaacatgtaaatgaatatgcagatgcagggctaaggacattgatacttgcataccgtgaggttgatgagaatgagtatatagaattcagcaagaacttcaatgaagctaagaactcggtgacagcggatcgtgagagcttaatagatgaaatcacagaacagatggaacgtgatttgattctccttggtgctactgcagttgaggacaaacttcaaaatggggttccggattgtatcgacaagctagctcaagcagggattaagatttgggttctaaccggagacaaaatggagactgcaatcaatattggatttgcttgtagtttactaagacaagagatgaagcagatcatcataaatcttgagacaccacatatcaaagcattggagaaagctggagagaaagatgcaattgaacatgcatcaagagaaagcgtggtgaaccaaatggaagaagggaaagctctactcacagcatcaagcagcgcaagctcacatgaggcctttgcgttgatcattgacgggaagtcgctaacctatgctcttgaagatgatttcaagaagaagtttcttgatttagctacaggatgtgcctctgttatttgctgcagatcatcacctaaacaaaaggcattggttacgcggttggtcaaatctggaaccgggaagacaactttagcgattggagatggagcaaatgatgttggaatgcttcaagaagcggatattggtgttggaatcagcggtgttgaaggaatgcaagcggttatgtctagcgatatagccattgctcaattccgttacttagagcgtctcttgctcgtccatggtcactggtgctacagcagaatctcatcaatgatatgttacttcttctacaagaatatcacttttggtgtcaccgtgttcttatacgaagcctacacatcattctctgctcaacctgcatataacgactggtttttatcgcttttcaacgttttcttctcttcgcttcccgtcattgctctcggcgttttcgatcaagacgtctcagctcgttactgttacaagttcccgttgctataccaagaaggagttcagaatcttctcttcagctggaagagaatcatcggatggatgttcaacggagtctttaccgcactagccatattcttcctatgcaaggaatctctcaaacaccaactctataaccctaatggcaaaaccgccggcagagaaatcctcggcgggacaatgtacacttgcgtagtctgggtcgtcaatctccaaatggctctagccataagctatttcacttggctccaacacattgtaatatggggctcagtagcattctggtacatcttcctcatgatctatggagccatcactcctagcttctccacagatgcttacaaagtcttcattgaagccttagctccagctccatcttactggctcaccactctcttcgtgatgttcttcgctttgatccctttcttcgtcttcaagtcagttcagatgagattcttcccgggataccatcaaatgattcagtggattcggtacgagggtcattctaatgatcccgagtttgtggaaatggttaggcagagatcgattcggcccacgacggttggtttcactgcgagaagagccgctagtgtacggcggtccggtaggtttcatgatcagctcaacaagaatttcattgctttctga

SEQ ID NO: 2046 - DNA, 243 bp, Arabidopsis thaliana
atggctaagtttgcttccatcatcacccttatcttcgctgctcttgttctctttgctgctttcgacgcaccggcaatggtggaagcacagaagttgtgcgagaagccaagtgggacatggtcaggggtttgcggaaacagtaatgcatgcaagaatcagtgcattaaccttgaaggagccaaacatggatcatgcaactatgtcttcccagcacacaagtgtatctgttacgtcccatgttaa

SEQ ID NO: 2047 - DNA, 486 bp, Arabidopsis thaliana
atgaattttactggctattctcgatttttaatcgtctttgtagctcttgtaggtgctcttgttcttccctcgaaagctcaagatagcccacaagattatctaagggttcacaaccaggcacgaggagcggtaggcgtaggtcccatgcagtgggacgagagggttgcagcctatgctcggagctacgcagaacaactaagaggcaactgcagactcatacactctggtgggccttacggggaaaacttagcctggggtagcggtgacttgtctggcgtctccgccgtgaacatgtgggttagcgagaaggctaactacaactacgctgcgaacacgtgcaatggagtttgtggtcactacactcaagttgtttggagaaagtcagtgagactcggatgtgccaaagtgaggtgtaacaatggtggaaccataatcagttgcaactatgatcctcgtgggaattatgtgaacgagaagccatactaa

SEQ ID NO: 2048 - DNA, 1713 bp, Arabidopsis thaliana
atggcaataaaagagcgatcactagaggaaacaccaacatgggctgttgctgtagtttgcttcgttctccttttcatttccatcatgatcgaatacttcttgcactttattggtcactggtttaagaagaagcacaagaaagctttatctgaagctcttgaaaaggttaaagcagaactgatgcttctgggattcatatcgcttctattggttgtattgcaaacaccagtctccgagatttgcattccaagaaatattgctgcgacttggcatccttgtagcaaccatcaagaaatcgccaaatatggtaaagattatatcgacgatggccgcaaaattcttgaagattttgactccaacgacttttacagtcctcgccgaaatttagccaccaagggttatgacaaatgcgcagaaaaggggaaagtagcattagtatctgcctatggtatccaccagctgcatatattcatctttgtgctcgctgtttttcatgttctctactgcattataacctatgctttaggaaagaccaagatgaagaaatggaagtcatgggagagagagaccaaaacaattgagtaccaatatgccaatgatccagagaggttcagatttgcaagagatacatcgttcggacgtagacatctgaatatatggagcaagtctacctttaccctctggattttctttggatcagtgacaaaagtagattatcttacactaagacatggctttattatggcacatttgccagcaggaagtgccgctcgtttcgatttccaaaaatacattgaaagatctttggaacaagatttcacggtggttgtcggtataagcccactgatatggtgcattgctgtcttattcatattgaccaatacacatggatgggactcatatctttggctgcccttccttcccttgattgtgatattgatagtaggagcaaaacttcaaatgataatatcgaaattaggattaaggattcaagaaaaaggagatgtggttaaaggagctcctgtggttgaaccgggcgatgatctcttttggtttggtcgtcctcgtttcattctcttcctcattcacttggttcttttcacgaatgcatttcaactggctttcttcgtttggagcacttacgaattcacactcaaaaactgcttccaccacaaaacagaagacattgcaattaggatcaccatgggggtattaatacaagttctatgcagctacatcactctacctctctatgctcttgttactcagatgggaacatcaatgaggccgacaatattcaacgacagggtagccaatgcattgaagaaatggcaccacacagccaagaaacagacgaaacatggacactcaggatctaacacacctcactcgagccgtcctactacgccaacacatggcatgtcaccggtgcatctcctccacaactacaataaccgcagcctcgaccaacaaaccagcttcactgcttctccttctcctcctagattctctgattatagcggccaaggccatggccatcagcatttcttcgaccctgaatctcagaatcactcttaccaacgtgagatcacagattctgaattcagcaatagtcatcatccccaagttgacatggcaagtcctgttagagaagagaaggagattgttgagcatgtcaaggttgatttgtctgagtttacgttcaagaagtga

SEQ ID NO: 2049 - DNA, 981 bp, Arabidopsis thaliana
atgtcatcatcatcatcagttcctgcttacttgggagatgaagatctgacacaagaaacaagagctctgatctcttctcttcctaaagagaaaggttggttagtgagtgaaatatatgaattccaaggactttggcacacacaagctattttacaaggaatcttgatctgccaaaaacgctttgaagctaaagattccgacattatcctcgtcactaatcctaaatcaggtaccacttggttaaaagctcttgtctttgctctccttaaccgacacaagtttccagtttcttcttctggtaaccatcctcttctggtcaccaatccacaccttcttgtgcccttcttggaaggagtttactacgagtccccagatttcgatttctccagtttgccttctccaagactgatgaacacgcacatatcgcatctttcgctccccgagtctgttaagagctcgtcttgtaagattgtgtattgttgtaggaaccctaaggacatgtttgtgtccttatggcattttgggaaaaagctagctcctgaggaaaccgcggattatcctatcgaaaaagcggttgaagcgttttgtgaagggaagtttataggtggacccttttgggatcatatattggagtactggtatgcaagccgcgagaatccgaacaaggtcttgtttgttacttacgaggagctaaagaagcagaccgaagttgagatgaagcggatcgcggagttcttggaatgtggctttattgaagaagaagaagtgagagagattgtgaagttgtgtagctttgagagtttaagtaatttggaagttaacaaagaagggaaattgccaaatggaatagagactaaaactttctttagaaaaggagagattggaggatggagagatactttgagtgagtcattggcagaggaaattgatagaaccattgaagagaagtttaaaggttctggtcttaaattttcttcttga

SEQ ID NO: 2050 - DNA, 1881 bp, Arabidopsis thaliana
atgaaatcatacaaacttaataaccctaatttactcatctccacgcacacacataataaactcttcttatcctcttctccattcaatctcttattctcttttccttccttcatataccttaaacagcaacgttctctgttcttcttcttctttttcttcctctgtttttctttcacaacttccatgttggactcggacacagacacggactcaggtcctgtggttgcaacaaccaaactcgtcactttcctccagcgtgtgcagcacacggcacttcgatcataccctaaaaaacaaacgcctgatcccaaatcctacattgatctatctctcaaacgtccctacagtctctccaccatcgaatcagccttcgatgatctcacgagcgagtcacatgaccagccagtgccagtggagacgcttgaaaagttcgtcaaggaatattttgacggtgcaggggaggatctgctgcaccacgaaccagtagatttcgtctcagatccctccggcttcctctccaacgtggagaacgaagaagtcagagaatgggcgcgtgaggtacacggtctttggagaaatctgagctgcagagtctctgactcagtaagagagtctgccgaccggcacacgcttctaccgttgccggaaccggttatcattcccggttcgagattcagagaagtctattactgggattcttattgggtcatcaaaggacttatgacgagtcaaatgttcactaccgccaaaggtttagtgacgaatctgatgtcacttgtggagacttatggttacgctttgaacggtgctagagcttattatactaacagaagccaaccacctttgttgagctccatggtctatgaaatttataatgtgacaaaagatgaagaacttgtgaggaaagcaatccctctgcttctcaaagagtacgagttttggaactcaggaaaacataaagtggttattcgagacgctaatggttatgatcacgttttgagccgttattatgctatgtggaacaagccaaggcctgaatcctctgttttcgatgaagaatctgcttcagggttctcgactatgttagagaaacaacggttccatcgagatatagccacggctgctgaatcaggatgcgatttcagcacgcgatggatgagggatcctcctaatttcacaacgatggctacaacatcagtggttcctgttgatctaaatgtttttcttctcaagatggaactcgatatagcgttcatgatgaaggtttctggagatcaaaatggttcagaccgttttgtgaaagcgtcaaaagcgagagagaaagcgtttcaaaccgtgttttggaacgagaaagcagggcaatggctggattactggctttcctccagtggtgaggaatctgagacatggaaggctgagaaccaaaacaccaacgtctttgcgtctaactttgcaccaatctggattaattccatcaattcagatgaaaatcttgtcaagaaagttgtgacagctcttaagaactcagggctcattgctcccgctggaatcctaacttctttgacaaactcaggacaacaatgggattctccgaatggatgggcaccgcaacaagagatgatcgtcacagggctcggaagatcgagtgtaaaagaagctaaagagatggcagaggatattgcaaggagatggatcaaaagcaactatcttgtctacaagaaaagtgggactatacatgagaagctcaaagttacagagcttggtgaatatggtggtggaggagaatatatgccacagaccggattcggatggtcaaatggagttatcttagcattcttggaggaatatggatggccctctcatcttagcattgaagcctag

SEQ ID NO: 2051 - DNA, 537 bp, Arabidopsis thaliana
atgcctctttctctccgtctttctccttcgccgacggctttatctccgactaccggaggatttggtccatcgaggaaacagtgccggattccttactccggcgtcccgacgacgaagattggtttctgttctttggattctaggaaaagaggagattcctctgttgttaggtgtagcttagaaaccgttaatgtcagtgttggtcaggtgacggaggtcgataaggacacgttctggcccatcgttaaagccgccggtgaaaagcttgtcgtacttgacatgtacactcaatggtgtggtccatgtaaagtgattgcccctaaatacaaagctttatcagagaagtacgacgacgttgtgtttctaaagcttgactgcaatccagataaccggccattggcaaaagagctaggaataagagtggttccaactttcaagattttgaaggataacaaggttgtcaaggaagtgaccggtgcaaaatacgatgatctggttgcagcgattgaaacagcgaggtctgctgcttccggatga

SEQ ID NO: 2052 - DNA, 585 bp, Arabidopsis thaliana
atgagctctgtttgtggtaagttggatttcaaagatgcagactttgacatctctacttcgagtcccacacaatgttctaaaggctcggagcatacctcgtttactggctctgaagattctcaggagtctgatggagatgaaactggttatatagacccaactgtgaatgatgaaaccgctgttcaggatttcggcaaatctgttttaagtcctaactcttctgatgatgaagacaaggatgagaaccttatgactcagacaccaattgttcttatcccagccataaaaggcagtcgagagaagtatggcttgtcactgaggaagtcgagtgtttcatggggggctgatgtgtatgatcctcctccctcgatagcctcccacacagtcacaagaagcaagaaacagcagcagaaatccaagagcaaagacaaccacaggaagactggaaagaaaggacagaagtctaaagacaactcttcctcacgtggtggcagcagcaaagacaagaagcaagcttctcgcaaacacagtcgagacaaatttgattgggtaactcagatgcctatagttgcagcatcttcatga

SEQ ID NO: 2053 - DNA, 1206 bp, Arabidopsis thaliana
atggactatatgtatggaccagggagacaccatctgtttgtaccaggaccagtgaacataccggaaccggtaatccgggcgatgaaccggaacaacgaggattaccggtcaccagccattccggcgcttacgaaaacattgttggaggatgttaagaagatattcaagaccacatcagggacaccttttctgtttcccacgaccgggactggtgcttgggagagtgccttgaccaacacgttatctcctggagacaggattgtttcgtttctgattggacaatttagcttgctctggattgaccagcagaagaggcttaatttcaatgttgatgtggttgagagtgattggggacaaggtgctaatctccaagtcttggcctcaaagctctcacaagacgagaatcataccatcaaagccatttgcattgtccacaacgagaccgcgaccggagttaccaatgacatctctgctgtccgcacactcctcgatcactacaagcatccggctttgctgctagtggacggtgtttcgtccatctgcgcgcttgatttccgaatggatgagtggggagtggacgtggccttgactgggtctcagaaagccttatctcttccaacaggacttggtattgtctgcgccagtcctaaagctttggaagctaccaaaacttctaaatctctcaaagtattctttgactggaatgactaccttaagttttacaagctaggaacctattggccatacacaccttccattcaacttctctacggtcttagagctgctcttgatcttatctttgaggaaggacttgagaacatcatcgcccgccatgctcgtttgggaaaggccaccaggcttgcggtggaagcatgggggctgaaaaactgcacacagaaggaggaatggataagtaacacagtgacagcagttatggtgcctccgcatatagacggttcggagattgtgagaagggcatggcagaggtacaacttaagtcttggtcttggtctcaacaaagtggctggaaaggttttcagaattggacacctaggaaatgtgaatgagttgcaacttctcgggtgtcttgcgggagtggagatgatactgaaggatgttggatacccagttgtaatgggaagtggagttgcagctgcctctacttatcttcagcaccacattcctctcattccctctagaatctaa

SEQ ID NO: 2054 - DNA, 1482 bp, Arabidopsis thaliana
atgttgggattgcaacgagaaacatcctcgatgtataagagaacgtcatcgagagattattctccgatgatcgacgtcgaagacagctcaggtcttttagagaatgatgtggacaatgaaatggaaactacaaatccttcatggaagtgttctcttccgcatgttctagtggctacaatttcgtcgtttctatttggttaccatttaggagttgttaatgaacctcttgaaagcatttcgtctgatcttggttttagtggtgatacattagctgaaggtttggtggttagtgtatgtcttggtggtgcatttctcggatctttattcagtgggggagttgctgatgggtttggaagacggagagcttttcagatttgtgctttgcctatgattttgggtgcttttgtgagtggagttagcaacagcttagctgtaatgcttttgggaagattcttggttgggactggcatgggtcttggaccacctgtggcagcactctatgtgacagaggtatcaccagcttttgttaggggaacatatggaagcttcatacagatagctacatgtctgggactgatggcagctctgtttatagggatcccagtccataacatcacgggttggtggcgtgtctgtttctggctttcaacgatacctgctgcactactcgctctgggaatgttcctctgtgctgagtctccacagtggctattcaagcaagggaagatagctgaagcagaagctgagtttgagaggctgcttggagggtctcatgtgaaaacagcaatggcagaattatacaaactagatctagacaagacggatgaaccagatgttgtgagcctctctgagctgttatatggtcggcattcaagagttgtttttattggatcaaccctgtttgctttgcaacagctatctggtataaatgctgttttttatttctcttctaccgtattcaaaagtgctggagtaccatcggacctaggcaacatatttgttggagtttcaaacctcttgggatctgtaatcgcgatggtgttgatggataaagtaggaagaaagcttcttctgctttggagttttattggcatggcagcagcaatggcacttcaagttggtgctacaagttcatacttaccacatttttcggcgttgtgtttgtctgtcggtggcactcttgtgtttgtgctaacattcgccttaggagctggtccagtaccaggtttactcctccctgagatcttcccaagtcgaatcagagcaaaagcgatggctttctgcatgtctgtgcattgggtgataaatttctttgtgggtttactctttctgagattgcttgagaagcttggtcctcggctactatattcgatgttttctacgttctgtttaatggcggtgatgttcgtgaagcggaacgtgattgaaaccaaaggaaaaacacttcaagagattgagatttctctactagccaaaccatga

SEQ ID NO: 2055 - DNA, 825 bp, Arabidopsis thaliana
atggggagaactaaggagcaggcaacattaactcggtatccaccctgtcctaggaatcctgctaaattcaatgatataaacaaagcactccaggaaaaaggatatggtaaggctctgaaaagaaaaccttggacgggtgtgacatgccctgtctgtcttgaggttcctcacaactcggtcgtcctcctttgttcatcttaccacaaaggatgccgtccgtacatgtgtgccacgggaaaccgtttctcaaattgtctagagcagtacaaaaaggcatatgccaaggatgagaaaagtgacaaaccgccagagctattgtgcccgctttgtaggggtcaggtgaaaggctggaccgttgtggaaaaggaacgtaagtatctgaattctaagaaaaggtcatgcatgaacgacgagtgtttgttttatggaagctatagacagctcaagaagcatgttaaggagaaccatccgagagccaagccaagagccatagaccctgtgctggaggcgaaatggaagaagcttgaggttgagagggagaggagtgatgtaatcagcacagtcatgtcgtcaacacctggggctatggtatttggagactatgtgattgagccatacaatggttatgatcatcaagatgacagtgacgattacagtgattcgtcggatgacgaaatggaaggtggggtattcgagcttggagcattcgacctgggccgtcttcaaccgcgttcggctgccatctcaagccggggaattcgcggtatgatcataaggaaccggtgggctcgaagcagaggtgcgagcagaaggcgacaaacataa

SEQ ID NO: 2056 - DNA, 252 bp, Arabidopsis thaliana
atggcttctcctattcccgtcggcgttactaaggaacaggcgtttagtatggcacaaacggagatggagtatcgcgtggaactctttaacaagcttgctcaaacatgctttaataaatgtgtggataaaaggtacaaggaagctgagctaaacatgggtgagaatagttgcatcgaccgttgtgtttccaagtactggcaggtaaatggaatggttggacagcttctaagtgctggcaagcctcccgtgtaa

SEQ ID NO: 2057 - DNA, 489 bp, Arabidopsis thaliana
atggcgacgagcaagtgctactatccacggccaagccaccgtttcttcaccactgaccaacacgtcaccgccacttccgatttcgagctagacgaatgggatcttttcaataccggttcagattcctcttcaagtttcagctttagtgaccttacaatcacatccggtcgaaccggaactaaccggcaaattcacggtggttctgactccggtaaagctgcgtcttctctaccggttaacgtaccggactggtctaagattcttggagacgagagtcgacgacagaggaagatttcgaatgaggaagaagttgacggagatgaaattttatgcggcgaaggtacacggcgagttccaccgcatgaattgcttgcgaaccggaggatggcttcgttttcggttcatgaaggtgctgggaggactttgaaaggaagagatctgagtagggtgcgaaatactatttttaaaattagagggatcgaagattaa

SEQ ID NO: 2058 - DNA, 228 bp, Arabidopsis thaliana
atgtcaggtgcgcttgcatggcaggtcaaaaaactgatcctcaataaaaaaaagattttgtgggttttggagaggaggtcgcacgggttattattttttcccgggatctcttctcctctgtgtgtgtcgtcttgcctctgctctatctctctccctgctctttcacatttcatatctttcttaaatgctcatatacactcaaaaaccgatcataagcagagtttgtaa

SEQ ID NO: 2059 - DNA, 261 bp, Arabidopsis thaliana
atgggtatgaagtctccaaatattgctgcatttatgttaccactgcttcttatacttttcacgctttcctctcagcttaaagtcgtggaatctacaggccgcaaacttgcgtgggggttttcgggaacacctatcgtgtacacaccaccttcaaggtcatgtggaacttctccagcagtattcacttcgaagtggaggagaccccgaccatgcaggcttcctccaggcagttatattcctgcttctgaccaatctccttaa

SEQ ID NO: 2060 - DNA, 861 bp, Arabidopsis thaliana
atggcggagaaaaagagagtcaagtacttcattgttgatgcattcgctgaatctgccttcaaagggaatccagctgctgtttgctttctagaagacgataacgagagagacgacgcgtggcttcagtctcttgccaccgagttcaatatctccgagacttgtttcctcactccgatcatcggagacttgcctcgcttccgtctccgttggttcactccagtcgctgaggtggatttgtgtggtcatgcaactttagcatctgctcacgttctcttctcaactggtttggttggttcagagacagttgagttcgacacattatcagggattctaacagctaaacatctcaaaaatgatgatgatggagaagaatcaagtatcgaattggatttccctgttgttccaacatatgaagtcaactacattgatgatgatctctctttgttctccaaagccttgaatggagctaccattcttgatgtcaaagccacaaagaaagacctcctcgttgtgctttcatcttgggaagctgttattgatttgaagccaagattagatgagatatcgaaatgcccttgtgaaggaatgatggtgactgccgctgcttctgatggatctacttatgatttctgtagtcgctactttgccccgagattcggaatcaatgaggaccctgttactggaagtgctcattgtgctttagctcattactggagcctcaggatgaacaagtgtgatttcttcgcctaccaggcttcaagcagaggaggaacgttgaaggtgcacctggacaaagagaagcagagggttctactgagaggcaaagcagtcactgttatggaaggttatgtcttagtgtga

SEQ ID NO: 2061 - DNA, 645 bp, Arabidopsis thaliana
atggaagaagatttgttgggcatttgtgggtttgattcgtcgaagaaatatcgattagaagaacttgccaagtatcagtcgggttcatgtattgagtttgaagatgatgatgaaatggcagtggattatccatgcccgttttgctcagatgattatgatttagttgaattgtgtcaccatatcgatgaggagcatcaactagacgccaacaatgggatatgtccggtttgtagcagacgagtgaagatgcatatggttgatcacattaccactcagcatagagatgtcttcaagagactttacaaggatgagtcatattcagcattttctccagggactaggaaatacttacagtctctaatcgatgagccgttgtctactaatcatacatctaaaagtgttctggacccattattatcatttatatacaatccgccgtcaccaaagaagtccaagcttgtacaacctgattcatctagtgaagcaagcatggaagacaatagcttaataagggattcaacagaaaaagactgggaatcgccgtctcccttgtcagatacagagctactagagaaggcaaagaagagagagtttgtacaaggtttaatatcatcagccatatttgatcacatttacaacttctaa

SEQ ID NO: 2062 - DNA, 939 bp, Arabidopsis thaliana
atggttggaccagtaagacctcaaatcgtacttttcggttcttcaattgttcaatatagcttcactgatcgtggttggggtgccactctcgctgacctctactctcgcacggctgatatcattcttcgtggatatgctggttggaattctaggtttgccttgaaggttcttcaccaagtattcccaaaggatgctgtgatacaaccttctttggtgatagtctatttcggtgggaatgattcaactcatcctcatccttcaggtcatggccctcatgttcctttatctgaattcatcgaaaacatgaggaagattggtgaacatcttttgagcctttctgataaaactcgtgtcattttcctcactccgccaccaatgaatgagaaacagatcgagatagtttttggagatgcaataaaaggccggagtaacgagttgtgccgtccatatgcagaagagttgttaaatctatgcagagagatcaatgtgaaaggtatcgatatttggaccgcgatacagcagcaagatgattggttgaacagctgcttcacagatgggatccatttcactgcgaaggcaagtgagattgttgttaaggagatattgaaggtactgagaggagcggattggaaaccaagtctttactggaaatcattaccggttgaatttccatttgattttgatgctccaaactctataagccttcatgacctagagttaaccagaaacaaccattttgagtcaccgcaccttgtaagcctttgtgaacaagagttaaccagaaacgagcagctggagccgccacaccctgtaagcctttgtgaccatgagttaacccgaaacgagcagctggagccgccacaccctgtaagcctttgtgaccatgagttaacccaaaacgagcagctggagccaccacagcctacggcgcgcttgtaa

SEQ ID NO: 2063 - DNA, 1506 bp, Arabidopsis thaliana
atggatcgtacccaccaacccgaatctccgacggcccgacccggaaacaccgtggtcctctcaatcgattgtctaaaaggaagctctaaaagcgaagaatggagcggcgatatgcttcaaaccggagacatagtagaagagatccggatcgggtcaggacccggttcagctattttcaaagctccgtttaaaggaggtaaagcttggcttcagaaagttttacacaattcttttaggaataaagaaacttcaatcgtcgtcagagttcgacgtggctccgatgatttctccgatctgtctgcttgtattgttcctaatgaatccgccgggaagagacagtatatgcttagatccattgatgacccgaattatactgttggattctcggatcgaactgagtcggattgtctcggtttgcaagttggtgaaaaatcaattaatgttgtttttcttaacaagtgcgattttattgttgatcaaaaaaacatagagtcaagaggatcaagaatggtagaagcattggtgaaagcaaagcttcaagatggttatgtttcatatccatgggaaagacgaatgcaagaagctttaccaatctctggttccagcaatttcctctccattctttttcttcccaaagcttctggttctcggtacaatgacttggaagacacgcttgctcgtgctaatgcttggttaagttgttcacaagctaatggtgttcccattgtttttatgaatattcagactgaatctttgctcactaagatatctggagaaacagcgtcggcgacggtgaatacaacatcgctttcggatctatcgaatcttgcaaatacgagtctatatgggtttgaggattatcatggagttgatattggtgtggtgagagcggttcggctttggtttgctcctcttggtgttgagttcccacttgaaatcaaactcaaagatgatgataccaaacttggcttctccattagccgcaccgaagagggtttcatttacgtgtcatcagtgacggaccacgaagacgagagtgcaccagctgcaagatccggcttgagctcattgtacagagaagcagccaaggcatcacgtcgtctggtggtttctcgtgtcggtaaccaaaaggtattgccatggatggtgtcctccacaggagcaattcgttgctacgacacagtttcgctcagccagaaactgtcactgcaccgtcacgctaaagtccacataggcctccatgtcttcctctgggactcctctgccacggcagatttctcctcgccaccaaggagtagcagcggtgggactcacttgttgtttagtaacgaaacgctggattccacggagttcccacggtatggtgaggttttaccgccacgacaagtcggagacagacaggtgatgccgttgccggatgaagatgtgtttaggtttgaacgtgaaaatgccggtaatgcttcatttaaattccaagagattcctttcaccaacgagtctttgtga

SEQ ID NO: 2064 - DNA, 1089 bp, Arabidopsis thaliana
atgaaggaggaacaaacaagatctctgtttggaatctctttgtctgataaaccaacttggcaacagtttctcatttgcacttctggtttcttttttggttatctcgttaacggtgtttgcgaggaatatgtttataatcgtcttcaatttagctttgggtggtatttcacgtttatacaaggatttgtctacttgtttctaatctaccttcaaggctttaccacaaagcatatagttaatccgatgagaacttatgtcaaactctctgctgttctcatgggttcacatggtttaaccaaaggatctttggcttatctcaattatccagctcaaatcatgttcaaatccaccaaggtgttaccggtgatgataatgggagcgtttatacccggtcttagaagaaaatacccagtccatgaatacatttcagcgttcttgcttgttcttggtttgatcctattcacattagccgatgcgcaaatgtctccaaatttcagtatgattgggattatgatgataaccggtgcattgatcatggatgctttcttgggtaatctgcaagaagctatcttcacaatgaatcctgagacaactcaggcaaggaaactaaagaaaacacgattaactcttgttatgtgtgttgtgcagatggagatgcttttctgctcaacagttgttggattaccgttcttgttcgttcccatggttttaaccggagaggtttttcgtgcgtggactgcgtgtgcacaacatccgtatgtgtatggagtgcttgtatttgaagccatggccacatttatcggtcaagtctccgttctctcgcttattgctctctttggagccgccacaactgccttgataacaacggctaggaaaggggttacattgttgctgtcgtatttgatattcacaaagccgttaacggaacagcacggatcaggcttgctgttgatagcaatggggattgtattgaagatggttccaatggatagtaaagctccggccaagattccggcgagaccagcggttaggatcgcaggaggcgatggtgatagagaagaggacgaagaaaggaagtcattggtttga

SEQ ID NO: 2065 - DNA, 513 bp, Arabidopsis thaliana
atgacaagctccgatcaatctccatcgcacgacgtcttcgtctacggcagtttccaagaaccagccgttgttaatttaattctcgaatgtgctccggtcatggtttccgctcaactccacggctatcacttgtatagacttaaaggtcgtttgcatccatgtatttctccttccgacaatggattaatcaatggcaagatactaactggattaacagattctcagttagagagtttagatatgattgaaggaactgaatatgtgaggaagactgttgaagttgttttgactgatactttggagaagaagcaagttgaaacaattgtatgggcaaacaaggatgatcctaatatgtatggagaatgggatttcgaggaatggaagaggcttcatatggagaaatttatagaggcggcgacgaaattcatggagtggaagaagaatccgaatgggagaagtagggaagagtttgagaagtttgtacaagatgattcttctccggcttcggcttga

SEQ ID NO: 2066 - DNA, 774 bp, Arabidopsis thaliana
atggcatcatctctttgtgcttcttctgccatcgctgccatttcttctccaagtttcttgggtggtaagaaactgaggctgaagaagaagttgactgttccagctgtgtccaggcaagatgcgtcggtgcgcgccgtcgcagctgatccagatagaccaatctggttcccgggaagcactcctccagagtggctagacggtagcctccctggtgacttcggatttgatcctcttggtctttcatcggacccggacagtctaaaatggaacgtacaagccgagatagtccactgccgatgggctatgctaggagccgccgggatattcatcccagagttcctaacgaagatcggaatcctcaacactccgtcatggtacacggcgggagagcaagagtatttcacggacaaaaccacactctttgtcgttgagctcattttgatcggatgggcagaaggacgtagatgggccgatatcatcaagcccggtagcgtcaacactgacccagtcttcccaaacaacaaactgacgggcacagacgttggttacccaggtgggttatggttcgacccgttgggttggggatccggtagcccggctaagctcaaggagttgaggaccaaggagatcaagaacggaaggttggctatgttggcagtgatgggtgcttggttccaacacatctacactggcactggtcctattgataacctttttgcacatcttgctgatcctggtcacgccacaatcttcgctgctttcacacccaagtga

SEQ ID NO: 2067 - DNA, 609 bp, Arabidopsis thaliana
atggcaatgaatggtttgtccaagatggctgtagccgccgcaactgctcttctcctagttctgaccattgtcccgggcgcagtagctgtgacttacactattgaatggaccactggtgtggactactcaggttgggctaccggaaagactttcagggttggtgacattctagagttcaagtatggttcttcccacacggtggatgtggttgacaaagccggatatgatggctgcgacgcctcctcctcgactgagaaccattccgatggagacaccaaaatcgatcttaagactgtaggaataaactatttcatctgttctacacctggtcactgcagaaccaatggcggcatgaagctagccgttaatgtcgtagccggttctgccggacctccggccactcccacgccaccttcttcaactccgggaactcctaccacaccggaatcacctccgtctggcggatcacccacacccaccacacccacacctggtgcaggttcaacttctcctcctcctccaccaaaggcaagtggtgcgtctaagggagtgatgagttacgttttggtgggagtctcgatggttttgggttatggtttgtggatgtaa

SEQ ID NO: 2068 - DNA, 801 bp, Arabidopsis thaliana
atggccacttcagcaatccaacactcttctttcgctggccaaacgaccctaaagccatccaacgatctcctccgcaaaatcggagcctccaatggcggtggccgcatcatcatgcgtcgtaccgtcaagtctactcctcagagcatctggtacggaccagaccgtcccaaatacctaggaccattttccgaaaacacaccatcatacctaaccggagaataccctggagactacggttgggacaccgctggtctctcagccgatccagaaacattcgcaaagaatcgtgagctcgaagtgatccacagtagatgggcaatgttgggagctttaggctgcaccttccctgaaattctctcaaaaaacggagtcaaattcggtgaagccgtgtggttcaaggcaggatctcaaatcttctcagaaggagggcttgactacctcggaaaccctaacttgatccacgcgcaaagcatattagctatatgggcgtgtcaagttgtgctaatgggattcattgaagggtacagaatcggaggtggtcctcttggggaagggcttgacccgctttacccgggcggggccttcgacccgttgaacttagcggaggatccagaagcgttttcagagttgaaagtgaaggagcttaaaaacggtcgtcttgctatgttctcaatgtttggattctttgtccaagccatagttaccggtaaaggtccgatcgaaaatctgttcgatcacattgcagaccctgtggctaacaatgcttgggcttacgccaccaacttcgtccccggaaaatag

SEQ ID NO: 2069 - DNA, 798 bp, Arabidopsis thaliana
atggcatcaacattcacgagctcaagcagtgttcttaccccaacaacattccttggccagactaaagcctcaagctttaacccccttcgtgatgttgtctctctcggatctcccaagtacactatgggaaatgatctttggtatggacctgacagagtgaagtacttaggacccttttccgttcaaactccgtcttacctcaccggagaattccctggcgattatggttgggacaccgccggtttatccgcagaccctgaagcctttgccaaaaacagagctcttgaggtgatccatgggagatgggcaatgttgggagcttttggttgcataacccctgaagttcttcaaaagtgggtccgtgtggacttcaaagaaccagtctggttcaaagccggttcacaaatcttctccgaaggcggtttggactacttaggcaacccaaacctagtccatgctcagagcattttagccgtccttggcttccaagtcatcctcatgggtttggttgaaggtttccgcatcaacggtcttgatggtgttggcgaaggcaacgacttgtaccccggtgggcaatactttgacccgttgggtctcgctgatgatccagttacttttgctgagcttaaggtgaaagagatcaagaacggaagattggctatgttctctatgtttggcttctttgttcaagccattgttactggaaaaggtcctttggagaatctccttgaccatcttgacaaccctgttgctaacaatgcgtgggctttcgcaactaagtttgcacctggagcttaa

SEQ ID NO: 2070 - DNA, 2007 bp, Arabidopsis thaliana
atggctcgctcgtttggagcaaacagcactgttgtgcttgcgatcatcttcttcggatgtttatttgcgttttccactgcaaaagaagaggctacgaagttaggatcagttattgggatagatcttggtaccacttactcttgtgttggtgtttacaagaatggtcatgttgaaattattgccaatgaccaaggaaaccgtattacaccttcatgggttggttttactgactctgaaaggctcattggtgaggctgctaagaatcaggcggctgttaatcctgagaggactgtcttcgacgttaagagattgatcgggcgaaaatttgaggacaaggaggttcaaaaggacaggaaacttgtaccttaccagattgtgaacaaggatggtaagccatacattcaagtcaagatcaaggatggtgagactaaggttttcagtcctgaggagatcagtgccatgattctgactaagatgaaggagacagccgaagcctaccttggaaagaaaatcaaggacgctgttgtcactgttccagcttacttcaatgatgctcaaaggcaagctaccaaggatgccggtgttattgctgggctcaatgttgctagaatcatcaacgaacctactgctgctgctattgcctacggtcttgataagaagggtggtgagaagaacatccttgtatttgaccttggtggtggtacttttgatgtcagtgtcttgaccattgataacggagtgtttgaggttctctccacaaatggtgacactcacttgggaggtgaggactttgaccacaggatcatggagtacttcatcaagttaattaagaagaagcaccagaaggacatcagcaaggacaacaaggctcttggtaagctccgaagggaatgtgagagggcaaagagagctctaagcagtcagcaccaagtccgtgtagagattgagtcactctttgatggtgttgatttatctgagccactcaccagagctcgtttcgaggagcttaacaatgatttgttcaggaagaccatgggacctgtgaagaaggccatggatgatgccggtctacagaagagccagatcgatgagattgtccttgttggtggaagcaccaggatcccaaaggttcagcaactgttgaaggacttctttgaaggtaaagagccaaacaagggtgtgaaccccgacgaggctgttgcctatggtgctgctgttcagggtggtattttgagcggagaaggcggtgatgagaccaaagatatccttcttcttgatgttgcgccactcactttaggtatcgagactgtaggaggagtgatgacaaagttgatcccaagaaacacggttattccaaccaagaaatctcaggttttcacaacgtaccaagaccagcagaccaccgtctccattcaggtctttgaaggtgaaagaagtctcaccaaggactgcaggctactcgggaaattcgacctcactggagtcccaccggccccaagaggaacccctcaaatcgaggtcacatttgaagtggacgccaacggtattcttaatgtgaaagcagaggacaaggcgagtggtaaatcagagaagattacaatcacaaacgagaagggtcgtctgagccaagaagagattgaccggatggtgaaggaggcagaggagtttgcagaggaagacaagaaggtgaaggagaagatcgacgccaggaatgccctggagacatacgtgtacaacatgaagaaccaagtgagcgacaaggacaagcttgcagacaaattggaaggagatgagaaggagaagatagaagcagcgacgaaagaggccttggagtggctcgacgagaaccaaaactcagagaaagaagagtacgacgagaagctcaaggaggtagaggcagtgtgtaacccaatcatcacagcagtttaccagagatcaggcggagcaccaggtgcaggaggagaatcatcgactgaggaggaagatgagtctcacgatgagctctag

SEQ ID NO: 2071 - DNA, 1161 bp, Arabidopsis thaliana
atggcgaaaccggtgtccattgaagtgtataatcctaatgggaaatacagagttgttagcacaaaaccgatgcctggaactcgctggatcaatctcttggtagaccaaggttgtcgcgttgagatatgtcatttgaagaagacaatcttgtctgtagaagatatcattgatctgatcggagacaagtgtgatggagtcatcggtcagttgacggaagattggggagagactctgttctcagctttgagcaaagctggagggaaagctttcagtaacatggccgttggttataacaacgttgatgttgaagctgccaataagtatggaattgctgtcggtaacactccgggagtgttgactgagacgacggctgaactagctgcttctctttccttggctgctgcaagaagaattgttgaagccgacgaattcatgagaggtggcttgtacgagggatggcttcctcatctgtttgtggggaacttacttaaaggacagactgttggagttattggagctggacgtattggatctgcttatgctagaatgatggtggaagggttcaagatgaatttgatctactttgatctttaccaatccactcgtcttgagaaatttgtgacagcttatggacagttcttgaaagcaaatggagaacaacctgtgacatggaaacgagcttcgtccatggaggaggtgctgcgtgaggctgatctgataagtcttcacccggtgctggacaaaaccacttaccatcttgtcaacaaggagaggcttgccatgatgaaaaaggaagcaatccttgtgaactgcagcagaggtcctgtgatcgatgaggcagctttggtcgaacatctcaaagagaacccgatgttccgagttggtctcgatgtgttcgaggaagagccattcatgaaaccagggcttgctgatacgaaaaacgctattgttgttcctcacattgcttctgcttccaagtggactcgtgaaggaatggctacgcttgcagctctcaacgtcctcggaagagtcaaagggtacccgatttggcatgacccgaaccgagtcgatccattcttgaacgaaaacgcttcaccgcccaatgccagtccaagcatcgtcaactcaaaggccttaggattgcctgtttcgaagctatga

SEQ ID NO: 2072 - DNA, 966 bp, Arabidopsis thaliana
atggaacacagaaaggtaagagggaacggcatagacattcacgtagcaatccaaggtccctccgatggtcctatagtcctcctcctccatggtttccctgagctttggtactcatggcgccaccagatccctggactcgccgctcgtggctaccgtgccgtcgctcctgacctacgtggttacggtgactccgatgctcccgctgagatctcttcctacacatgcttcaacatcgttggtgacttaatcgccgtcatatccgccttaaccgcctcagaggatgagaaggtctttgtggttggacatgattggggagctctcatcgcttggtatttatgtctcttccgaccagatagagtcaaagctctggtcaacctcagtgttccgttctctttccggccaaccgatccatcggtgaagcccgttgatcgcatgcgtgctttctacggcgatgattactatatctgcaggtttcaggaatttggagatgtagaagctgagattgcagaggttggaacagagagagtcatgaagagactactcacttatagaactcctggaccggtaattatcccgaaggacaaaagtttttggggatccaaaggcgaaactataccactcccgtcttggctaacggaggaagatgttgcttacttcgtcagcaagtttgaagagaaaggcttctctggtccagtcaattactaccgtaacttcaacaggaacaatgagttgttgggtccatgggtgggaagcaaaatccaggttcctacaaagtttgtgataggggagcttgatctggtctactatatgcctggtgtgaaggaatatatacatggtccccagtttaaggaagatgtgcctttgcttgaagagcctgtggtcatggaaggagtggctcacttcattaaccaagaaaagcctcaggagattctccaaattatccttgatttcatctccaaattctaa

SEQ ID NO: 2073 - DNA, 1119 bp, Arabidopsis thaliana
cttcgtgttagtgctgcgagttcatcttctaatttcaagaagaagcctatcattattatcgttgttggaatggcaggtagtggaaaaactagctttcttcatcgcttggtctgtcatacttttgattcaaagagccatggttatgtggtgaaccttgaccctgctgttatgtctctaccatttggtgccaacatcgatataagagacactgtcaagtacaaggaagttatgaagcagtataatctgggtcctaatggtggaattctcacttcactcaacttgtttgctactaaattcgacgaggtaaacatacctctggaattagtccagatgattactgatttcttctcacattgtgttgtctctgtgattgagaaacgtgcagaccagcttgattatgttcttgtggacactcctggtcagattgagatctttacatggtctgcttctggggctataatcactgaagctttcgcttcaaccttccccactgttgtcacctatgtggttgatactccccgttcctcaagcccaatcacttttatgagcaacatgctttacgcttgtagtattctctacaagactcggttgcctcttgtcttggctttcaacaaaactgatgtcgcagatcacaagtttgctttagagtggatggaagatttcgaggtctttcaagcagcgattcagtctgataactcgtacacggcgaccttagctaacagtctctccctttcactctacgagttctaccgtaacataagatccgttggtgtttctgcaatctctggtgctggaatggatggcttctttaaagccattgaagcaagtgctgaggaatacatggaaacttacaaggctgatcttgacatgagaaaggcggacaaggagcggttggaagaagaaagaaagaaacatgaaatggaaaaactaagaaaggatatggagagttctcagggaggcactgtggttttaaacactggtttgaaagacagagatgcaacagagaagatgatgctagaggaggatgatgaggactttcaggttgaagatgaagaagacagtgatgatgccatagatgaggatgatgaagacgacgagacgaagcattactacctatga

SEQ ID NO: 2074 - DNA, 264 bp, Arabidopsis thaliana
atggcaaacgtctccgctttgctcaccatagctcttctcctttgctccacgctaatgtgcactgcccgccccgaaccggccatctccatctctatcacgactgctgccgatccatgtaacatggagaagaagatagaaggaaaattagatgacatgcatatggtagacgaaaactgtggtgcagacgacgaagattgcttaatgaggaggactttggtcgctcatactgattacatctatacccagaagaagaagcatccttga

SEQ ID NO: 2075 - DNA, 336 bp, Arabidopsis thaliana
atggagtactacacatttaccgaaaacgacgaagaacgtgtatcgagaaatcatcacgtgaataacacgtgggtgaaagaacgttacgagagcgatgaagaagatggagaggtgaacaaactcatcctaaaggaagatgaagaaactaaagatatggtgacatcaccgagtggtgagaggatgatgttaacaagtaaggtgaggtatctcacctatggagctctcaaacatgacacggcggcttcggcagcttccggtggtggaggaagagccttgcctcatccgtcgaacaagtacaaccgtggccaccccaagtactacagatgcagaggttga

SEQ ID NO: 2076 - DNA, 1476 bp, Arabidopsis thaliana
atggcatcggaatttcgtcctcctcttcattttgttctcttccctttcatggctcaaggccacatgatcccaatggtagatattgcaaggctcctggctcagcgcggggtgactataaccattgtcactacacctcaaaacgcaggccggttcaagaacgttcttagccgggctatccaatccggcttgcccatcaatctcgtgcaagtaaagtttccatctcaagaatcgggttcaccggaaggacaggagaatttggacttgctcgattcattgggggcttcattaaccttcttcaaagcatttagcctgctcgaggaaccagtcgagaagctcttgaaagagattcaacctaggccaaactgcataatcgctgacatgtgtttgccttatacaaacagaattgccaagaatcttggtataccaaaaatcatctttcatggcatgtgttgcttcaatcttctttgtacgcacataatgcaccaaaaccacgagttcttggaaactatagagtctgacaaggaatacttccccattcctaatttccctgacagagttgagttcacaaaatctcagcttccaatggtattagttgctggagattggaaagacttccttgacggaatgacagaaggggataacacttcttatggtgtgattgttaacacgtttgaagagctcgagccagcttatgttagagactacaagaaggttaaagcgggtaagatatggagcatcggaccggtttccttgtgcaacaagttaggagaagaccaagctgagaggggaaacaaggcggacattgatcaagacgagtgtattaaatggcttgattctaaagaagaagggtcggtgctatatgtttgccttggaagtatatgcaatcttcctctgtctcagctcaaagagctcggcttaggcctcgaggaatcccaaagacctttcatttgggtcataagaggttgggagaagtataacgagttacttgaatggatctcagagagcggttataaggaaagaatcaaagaaagaggccttctcataacaggatggtcgcctcaaatgcttatccttacacatcctgccgttggaggattcttgacacattgtggatggaactctactcttgaaggaatcacttcaggcgttccattactcacgtggccactgtttggagaccaattctgcaatgagaaattggcggtgcagatactaaaagccggtgtgagagctggggttgaagagtccatgagatggggagaagaggagaaaataggagtactggtggataaagaaggagtaaagaaggcagtggaggaattgatgggtgatagtaatgatgctaaggagagaagaaaaagagtgaaagagcttggagaattagctcacaaggctgtggaagaaggaggctcttctcattccaacatcacattcttgctacaagacataatgcaattagaacaacccaagaaatga

SEQ ID NO: 2077 - DNA, 1488 bp, Arabidopsis thaliana
atggtttccgaaacaaccaaatcttctccacttcactttgttctcttccctttcatggctcaaggccacatgattcccatggttgatattgcaaggctcttggctcagcgtggtgtgatcataacaattgtcacgacgcctcacaatgcagcgaggttcaagaatgtcctaaaccgtgccattgagtctggcttgcccatcaacttagtgcaagtcaagtttccatatctagaagctggtttgcaagaaggacaagagaatatcgattctcttgacacaatggagcggatgatacctttctttaaagcggttaactttctcgaagaaccagtccagaagctcattgaagagatgaaccctcgaccaagctgtctaatttctgatttttgtttgccttatacaagcaaaatcgccaagaagttcaatatcccaaagatcctcttccatggcatgggttgcttttgtcttctgtgtatgcatgttttacgcaagaaccgtgagatcttggacaatttaaagtcagataaggagcttttcactgttcctgattttcctgatagagttgaattcacaagaacgcaagttccggtagaaacatatgttccagctggagactggaaagatatctttgatggtatggtagaagcgaatgagacatcttatggtgtgatcgtcaactcatttcaagagctcgagcctgcttatgccaaagactacaaggaggtaaggtccggtaaagcatggaccattggacccgtttccttgtgcaacaaggtaggagccgacaaagcagagaggggaaacaaatcagacattgatcaagatgagtgccttaaatggctcgattctaagaaacatggctcggtgctttacgtttgtcttggaagtatctgtaatcttcctttgtctcaactcaaggagctgggactaggcctagaggaatcccaaagacctttcatttgggtcataagaggttgggagaagtacaaagagttagttgagtggttctcggaaagcggctttgaagatagaatccaagatagaggacttctcatcaaaggatggtcccctcaaatgcttatcctttcacatccatcagttggagggttcctaactcactgtggttggaactcgactcttgaggggataactgctggtctaccgctacttacatggccgctattcgcagaccaattctgcaatgagaaattggtcgttgaggtactaaaagccggtgtaagatccggggttgaacagcctatgaaatggggagaagaggagaaaataggagtgttggtggataaagaaggagtgaagaaggcagtggaagaattaatgggtgagagtgatgatgcaaaagagagaagaagaagagccaaagagcttggagattcagctcacaaggctgtggaagaaggaggctcttctcattctaacatctctttcttgctacaagacataatggaactggcagaacccaataattga

SEQ ID NO: 2078 - DNA, 2205 bp, Arabidopsis thaliana
atgtcgatgatgacggtgtgggcacttcgacggaatgttcgtcggaaaaatcactcgatgctcgtgagatatatttccggctccgcatcgatgaagcctaaggagcaatgtattgagaagattttggtggcgaacagaggcgagattgcttgccggatcatgagaacggcgaagcgtttagggattcagaccgttgcggtttacagtgacgctgatagagattcgctccatgtgaaatctgcagacgaagcggtacggattggcccgccctcggctagacttagttacctcagcggtgtgactatcatggaggcagcggctcggactggtgcacaggcaatacaccctggctatgggttcttgtcagaaagttctgactttgcccaactctgtgaggattcgggtctaacattcattggacctccagcatctgctattagagacatgggtgataaaagtgcatccaagagaattatgggagctgctggagttcctctcgtgcctggatatcatggccatgagcaagatattgatcatatgaagtcagaagctgaaaagattggataccctataataatcaagccaacacatggaggtggggggaagggaatgaggatagtgcaaagtgggaaggattttgctgactcgtttttgggtgcccaacgtgaagctgctgcttcttttggcgttaacactattcttctcgagaaatacattactcgaccgaggcatatagaagtccagatatttggtgacaaacatggaaatgttcttcatctatacgaaagggattgcagtgtgcaaagaagacaccaaaagattattgaagaagctcctgcgcctaatatatctgaaaagttccgcgcaaacttaggccaagctgctgtctctgcggcacgggcagttggatattataatgctgggacggtggaatttatagttgacaccgagtctgatcaattttattttatggaaatgaacacccgtctacaggtcgaacatcctgtaactgagatgattgttggtcaagatcttgtggaatggcaaattcgggttgccaatggggaacctctccccttaagccaatccgaggtgccaatgtcaggtcatgcctttgaggccaggatatatgctgaaaacgttccaaaaggatttcttcctgcaactggggtcctcaatcattatcgccctgttgcagtctcaccatcagttcgggttgaaactggagttgagcaaggagacactgttagcatgcactatgatcctatgattgcaaagcttgttgtctggggaggtaatcgtggcgaagctttagtgaaactgaaggattgcttgtctaactttcaggtagcaggtgtacctacgaacataaatttccttcaaaaacttgctagtcataaggagtttgcagtgggcaatgtagaaactcattttattgagcaccataaaagtgatctatttgctgacgaaagcaatccagctgcaacagaagtggcatacaaggcagtcaagcatagtgcagcattggtggctgcttgtatctccacaatcgagcattctacttggaatgaaagtaatcatgggaaagttccatcgatatggtattcgaatcctccttttagggtccatcatgaagccaaacaaaccattgagctagaatggaataatgaatgcgagggaactggctctaacctcatatcactcggtgtaagatatcaaccagatggaagctatctcattgaggaaggcaatgattctccaagtttagaactcagagtaacacgagcaggaaagtgcgattttagagttgaagcggccggattgagcatgaatgttagtctagctgcgtacttgaaggatggttataagcatatccatatatggcatggttcagaacaccatcagttcaagcagaaggtaggaatcgaattctctgaagatgaagaaggtgtccaacacagaaccagctccgaaacatcatcacaccctccaggaaccattgtggcccccatggctggtttggtagtcaaggtccttgtcgaaaacgaagccaaagtagatcaaggtcaacctatattagtcctagaggcaatgaagatggagcacgttgtgaaagcaccatcctctggaagcatacaggacctcaaagttaaagcaggccaacaggtttcagatggcagtgctctattcaggatcaaagggtaa

SEQ ID NO: 2079 - DNA, 960 bp, Arabidopsis thaliana
atgaggtcaatcacagctttgtttttccttttctgtttccttgctccttctgctttggcgcagctccgaactgggttctacagccgctcatgcccccgtgccgaatctatcgtggctagtgttgttgccaaccgtttcagaagtgacaagtccattactgcagcatttcttcgtatgcagtttcatgattgctttgtcagggtccgtaagcttctcctgtgtgtacatggttgtgatgcttccctcttgatcgacccaagacctggaaggccatcagagaaaagcactggaccaaatgcaagcgtgagaggctacgagatcattgatgaggctaagagacagctcgaggctgcatgtccccgaactgtctcatgcgcagacattgtaactcttgccacaagagactcggtcgcattagctggtggtccaaggttctcagtaccaacaggaagacgtgatggattaaggtcaaaccccaatgatgtgaacttacccggaccaacaattccggttagcgcatctatccaattgtttgcagctcaaggtatgaataccaacgatatggttacacttattggtggtggccacagcgtcggtgttgcacattgcagtctcttccaggacaggctttccgaccgtgcaatggaaccctcattgaagtctagcttgaggaggaaatgcagttcccctaacgacccaacaacgtttttggaccaaaagacttcatttactgtggataacgcaatctatggagagatccgaagacaaagaggaattctaagaattgatcaaaacttgggtcttgatagatcaaccagtgggattgtgtctggttatgcatcaagcaatacactcttcagaaagagatttgccgaagcattggtgaaaatgggtaccattaaggttcttaccggacgttctggagagatcaggagaaactgcagagtcttcaacaactga

SEQ ID NO: 2080 - DNA, 2079 bp, Arabidopsis thaliana
atggaatcgcggcgagagaagaatccgatgacggaggaggaatctgatgggctaattgcggcgaggcggatccaacgattgtctttacacctatctccctccttgacgccgtcgccgtcgttaccgttggtgcagacggagacgtgttcggcgaggtcgaagaagctggatgtcaacggcgaagctttgtcgctgtatatgagaggaaaacatatagatatacaagagaaaattttcgactttttcaattcccgacccgatttgcagacgccgatcgagatctccaaggatgatcatcgggaattgtgtatgaatcagcttatagggcttgttagagaagctggggtaaggccgtttaggtatgttgctgatgatcctgagaagtatttcgcaatcatggaagctgttggaagtgttgatatgtcccttgggattaagatgggcgttcaatacagtctctggggaggctctgtgatcaatttagggactaagaagcatagagacaagtattttgatggcattgacaatcttgattacaccggttgctttgccatgactgaattacaccatgggtcaaatgtgcaaggtcttcagaccacggcgacattcgatccacttaaagacgaatttgtgatcgatacacctaatgatggagctatcaaatggtggattggaaatgctgcagttcatgggaagtttgccactgtttttgccaggcttatacttccaactcatgattccaaaggagtctcggatatgggtgttcacgccttcattgttccgataagggatatgaaaacacaccagacactccctggtgttgaaatccaagattgtggacataaagtgggacttaatggagtggataatggtgcgttgagattccgttctgtgagaataccccgtgataatcttctcaatcgttttggagatgtgtcccgagatgggacgtatacaagtagtttgccaacaatcaataaaagatttggtgcaacactcggtgagcttgtaggtggtcgagttggccttgcctatgcatctgttggcgtccttaaaatctctgcaacgattgccattcgttattctcttctaagacaacaattcgggcctccaaagcaacctgaggtcagtattctcgattaccagtctcaacaacacaagctcatgccgatgttagcctccacctatgcataccattttgcaactgtataccttgtggagaaatattcagagatgaagaagactcacgatgagcaattggttgctgatgtccatgcactctctgctgggctcaaatcttatgtgacgtcttacaccgccaaggcgctctcggtctgcagagaagcctgtggaggtcatggttacgcagctgttaaccgatttggaagcttgagaaatgatcatgacattttccaaacatttgaaggagacaacactgtacttctgcaacaggtggctgctgatttattgaagcgttataaagaaaagttccaaggcgggacattgacagttacatggagctacttgagagaatcaatgaacacttatttgtctcagccaaatcccgttacagcgcgttgggaaggtgaagatcatctaagagatcctaaattccaactagatgctttccggtatcgaacatcgcgattgctacaaaatgtggcagcgagattgcagaagcattcaaagactcttggtggtttcggggcatggaacagatgcttgaatcatcttttaacgcttgcagaatctcacattgaaacagtcattcttgccaagttcatcgaagctgttaaaaactgcccggacccaagtgcaaaagctgctctgaaactagcatgtgatctttacgcattggaccgaatctggaaagatataggaacgtaccgtaacgtggattatgtggcgcctaacaaagctaaggcgattcataaactgacagagtatttgagttttcaagtaaggaatgtggccaaggaactagtggatgcgttcgagctccctgatcatgttactcgagcaccaattgctatgcagtccgatgcttattcccagtatactcaagttgttggattctaa

SEQ ID NO: 2081 - DNA, 1065 bp, Arabidopsis thaliana
atgatgataactcgcggtggagccaaggcggcgaaatcgctgttagtggcggctggaccacgtttgttctcgacggtccgtacggtttcgtctcacgaggctttatcagcaagccatattttgaagcctggtgttacatctgcttggatatggactagagctccgacgattggaggtatgagattcgctagcacgatcactctgggagagaaaactccgatgaaggaggaggacgcgaatcagaagaaaacagagaacgaatccaccggtggagacgccgccggaggtaataacaagggagataaaggaatcgcgagctattggggtgttgaacctaataagattactaaagaagatggttctgaatggaagtggaactgtttcaggccatgggaaacgtataaagctgatataacgatagatctgaagaagcatcatgttccaacgacgtttcttgatagaatagcttattggactgttaaatctcttcgttggcctaccgatttgttcttccagaggagatatggatgtcgagctatgatgcttgaaactgtagcagcagtacctggaatggttggaggaatgttactacactgcaaatcgcttcgacgttttgagcaaagtggaggatggattaaggctcttcttgaggaagcagagaatgagagaatgcatcttatgacattcatggaagtcgcgaaaccgaaatggtacgagagagcgctcgtgatcactgtgcaaggagtcttcttcaacgcttatttccttggttacttaatctctcccaagtttgctcatcgtatggttgggtaccttgaagaagaagcgatccattcttatactgagtttctcaaggaacttgacaaaggtaacattgagaatgttcctgctccggctattgctattgattactggaggcttcctgctgatgcgacacttcgtgatgttgtgatggttgttcgtgctgacgaggctcatcaccgtgatgtaaaccattttgcatctgatattcactaccaaggtcgtgaactaaaggaagctccagctccaattgggtatcattga

SEQ ID NO: 2082 - DNA, 849 bp, Arabidopsis thaliana
atgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataa

SEQ ID NO: 2083 - DNA, 945 bp, Arabidopsis thaliana
atggcaacatgcatagacacatgccgaaccggtaatacccaagacgatgattcccggttctgttgcatcaagaatttctttcgacccggtttctctgtaaaccggaagattcaccacacccaaatcgaagatgacgatgatgtctggatcaagatgcttgaagaagccaaatccgatgttaaacaagaacccattttatcaaactactactacgcttcgatcacatctcatcgatctttagagtctgctttagctcacatcctctccgtaaagctcagcaatttaaacctaccaagcaacacactcttcgaactgttcataagcgttttagaagaaagccctgagatcatcgaatccacgaagcaagatcttatagcagtcaaagaaagagacccagcttgtataagctacgttcattgcttcttgggcttcaaaggcttcctcgcttgtcaagctcatcgaatagctcataccctctggaaacagaacagaaaaatcgtagctttattgatccaaaacagagtatcagaatctttcgccgtcgatattcatcccggagcgaagatcggaaaagggattcttttagaccatgcgacgggcgtggtgatcggagagacggcggtggttggagacaatgtttcgattctacacggagtgaccttgggaggaacagggaaacagagtggtgatcggcatccgaagattggtgatggtgtgttgattggagctgggagttgtatattggggaatataacaatcggtgagggagctaagattggatcagggtcggtggtggttaaggatgtgccggcgcgtacgacggcggttggaaatccggcgaggttgattggtgggaaagagaatccgagaaaacatgataagattccttgtctgactatggaccagacatcgtatttaaccgagtggtctgattatgtgatttaa

SEQ ID NO: 2084 - DNA, 1398 bp, Arabidopsis thaliana
atggcttccatgtccaccgtcttccccaaaccaacctctttcatctctcaacctctaacaaaatctcacaaatccgattccgtaaccacatccatttcattcccttcgaattcgaaaactcgtagcttaagaaccatctctgtacgagctggcttaatcgagccagatggtgggaaacttgtggatcttgttgtaccggaaccgagacggcgagagaagaaacacgaagcggcggatttgccgagagtgagattgacggcgattgatttgcaatggatgcatgtgttgagtgaaggttgggctagtcctcttcgtgggtttatgagggaatctgagttcctccaaactcttcatttcaatttgttgaatctcgatgatgggtctgttgttaatatgtctgtgcctattgttcttgcgattgatgatcaacaaaaagccctaatcggtgaatctaaacgtgtctcccttgttgattctgatgataatccaatcgctattctcaatgatattgagatttataaacatccgaaagaagagcgaatagcgagaacttggggtacgactgcaccgggtttgccttatgtagaagaggcgataaccaatgctggagactggctcattgggggtgatcttgaggttttggaacctgttaagtacaatgatgggcttgatcgtttcaggctttccccgtttgaactgcgtaaggagctagagaaacgtggtgcggatgcggtctttgcgtttcagcttaggaacccagttcataatggacatgctcttcttatgactgatactcgtaggagacttcttgagatgggttataaaaaccctatccttttgcttcatccattgggagggtttacaaaagctgatgatgttcctctaagctggcgaatgaaacagcacgagaaggtgctagaggatggtgttcttgatccagagactactgtggtttccatattcccatctccaatgctctatgctggtccaaccgaagtccaatggcacgcaaaggctaggatcaatgctggtgctaacttctacattgtcggtagggatccggctggaatgggtcatcccgtggagaaacgtgatctgtacgatgctgatcacgggaagaaagttctaagcatggctcctggactcgaacgactcaacattcttcctttcagggttgctgcgtacgataagacacaaggaaagatggctttctttgatccctcaagggctcaggacttcttgttcatttctggcactaagatgagagcattggcaaagaacagagagaacccaccagatggatttatgtgccctggaggctggaaagtccttgtggattactacgacagtttgacactaaccggaaacaccaaacttccggaaaagattccggtttaa

SEQ ID NO: 2085 - DNA, 1278 bp, Arabidopsis thaliana
atggcgaaactaaaccctaaattcatctctttgattcttttcgctctcgtggtgatcgtctctgctgaagttatcttcgaggagaaattcgaagatggatgggagaagagatgggtaaaatctgactggaagaaagatgataatactgctggggaatggaaacacacagctggaaattggtctggtgatgctaacgataaaggtatccaaactagcgaggactacagattctacgctatatcagctgaattccctgagtttagcaacaaggataagaccttagtcttccaattctctgtcaagcatgagcagaagcttgactgtggtggtggctacatgaagttgctaagtgatgatgttgaccagacgaaattcggaggagacactccttacagcattatgtttgggccagatatttgtggctacagcactaagaaagtacatgctatccttacttacaatggaaccaaccatttgatcaagaaggaggtcccatgtgagactgatcagcttactcacgtgtacaccttcgtcctccgtccagatgctacttacagtattttgattgataatgttgagaagcaaactggtagcctttactctgactgggatcttctcccagcaaagaagattaaggatccaagtgctaagaagcctgaggactgggatgacaaagagtacattccagatccagaagacactaagccagcgggatatgatgacatcccaaaggagattccagacactgacgcaaagaagcctgaggactgggatgatgaagaagatggtgagtggactgcccctaccattcccaaccccgagtacaatggtgaatggaagcccaagaaaattaagaaccccgcttacaagggcaagtggaaggctccaatgatcgacaaccctgaattcaaggatgacccagaactctatgtcttccccaaattgaagtatgttggagttgagttgtggcaggtgaaatctggttccttgttcgacaatgtcttggtcagcgatgacccagagtacgctaagaagttggccgaggaaacctggggaaagcacaaggatgcggagaaagcagcatttgacgaagctgagaagaagagagaggaagaggaatcaaaggatgctcctgctgaatccgacgctgaggaagaagcagaagatgatgacaatgaaggagatgactcagacaatgaatcaaagtctgaggaaaccaaggaggccgaggaaaccaaggaagccgaggaaaccgatgccgcccatgacgagctctaa

SEQ ID NO: 2086 - DNA, 861 bp, Arabidopsis thaliana
atgagtttcaacaaagttcccaacattcctggagctcctgctctctctgcccttcttaaggtcagcgttattggtgggctcggtgtctatgcccttactaatagtctctacaatgtcgatggaggacaccgtgctgtcatgttcaaccgattaactggtatcaaggaaaaggtgtacccagaaggcacacattttatggtgccatggtttgaaaggccaatcatctatgacgttcgtgcacgaccttaccttgtagagagcaccactggtagtcatgatcttcagatggtgaaaattggattaagggttctcacacgtcccatgggtgaccgtttgcctcagatttaccgaacccttggcgagaactacagcgaaagggttcttccttccatcatccatgaaaccctaaaagcagtggtagctcagtacaatgcaagccagctcattacccagagagaagctgtgagcagagagatacgcaagattctgacagagcgggcttctaactttgacattgctcttgatgatgtctccatcacgactctgacattcggcaaagagttcaccgcagctatcgaggcaaaacaagttgctgctcaggaagctgaacgggctaagttcattgtggagaaagccgaacaagacaggagaagtgcggttatccgtgcgcagggagaagctaaaagtgctcagcttatcggacaagcaattgcgaacaatcaggcattcatcactctgagaaagattgaagctgcgagagagattgcacagaccattgcacaatctgctaacaaggtttacctgagctccaacgatctgttgcttaaccttcaagaaatgaacttggagcctaagaagtaa

SEQ ID NO: 2087 - DNA, 1482 bp, Arabidopsis thaliana
atgtctgcagttcgtagagtcatggcgttagcatcaaccacgttgccgacgaagtccggattatctctttggtgtccgtcttctccgtctctcgctcgccgatttcccgctcgtttttctccgatcggttctagaatcgcttccagaagcctcgtcactgcttcgttcgctaacgagaatcgcgagtttgtgattgttggtggaggaaatgctgctggttatgctgctagaacttttgtggaaaatggaatggctgatggtcggctatgcattgtgaccaaagaggcttacgcaccttatgagagaccggctttgacaaaagcttacttgttcccaccagagaagaagccagctcgtttaccaggatttcatacttgcgttggaggtggtggagaaaggcaaacaccagattggtataaggagaaaggaattgaggtaatatatgaagatccagtggctggagctgattttgaaaagcaaacactcaccacagacgcagggaagcagttaaaatatggatctctaattatcgctacagggtgtacagcctcaaggttcccagataaaatcggtgggcacttgccaggggttcactatattcgggaggttgcagatgctgattcactgatagcatctctgggaaaggcaaagaaaattgtcattgttggtggtggctacatcggcatggaggttgctgctgcagctgttgcgtggaatctagatacaacgattgtattccctgaagatcagcttttgcaaagattgttcactccatcgcttgctcagaaatatgaagaactgtaccgtcaaaatggtgttaagtttgtcaagggcgcttccataaataacttggaagcaggttcggatgggcgtgtatcagctgttaagcttgctgatgggtctacaattgaggcagacacggttgtaattggaattggagctaagcctgctattggcccctttgaaactttggccatgaacaaatcaattggaggaattcaggtcgatggcttgttcaggacaagtacccctggaatttttgctattggagatgtcgcagccttccctttgaagatatatgataggatgactcgagttgaacatgttgatcacgcccgccgctctgcacaacactgtgtgaaatcactactcacggcacacactgacacgtacgattatcttccatatttctactcaagagtattcgagtatgaaggaagcccaagaaaagtgtggtggcagtttttcggagataatgtgggagaaacagtggaggttgggaactttgacccgaaaatcgctaccttctggattgaatctggcaggttgaaaggtgttctagtagaaagcggatcgcctgaggagttccagcttctaccaaagctagcaagaagccaaccacttgtcgataaggctaaactcgcaagcgcatcttcagtcgaagaagctctcgagattgctcaagccgctctacagagttag

SEQ ID NO: 2088 - DNA, 1059 bp, Arabidopsis thaliana
atggcggctcttttaggcagatcctgccggaaactgagttttccgagcttgagtcacggagctaggagggtatcgacggaaactggaaaaccattgaatctatactctgctattaatcaagcgcttcacatcgctttggacaccgatcctcggtcttatgtctttggggaagacgttggctttggtggagtctttcgctgtacaacaggtttagctgaacgattcgggaaaaaccgtgtcttcaatactcctctttgtgagcagggcattgttggatttggcattggtctagcagcaatgggtaatcgagcaattgtagagattcagtttgcagattatatatatcctgcttttgatcagattgttaatgaagctgcaaagttcagataccgaagtggtaaccaattcaactgtggaggacttacgataagagcaccatatggagcagttggtcatggtggacattaccattcacaatcccctgaagctttcttttgccatgtccctggtattaaggttgttatccctcggagtccacgagaagcaaagggactgttgttgtcatgtatccgtgatccaaatcccgttgttttcttcgaaccaaagtggctgtatcgtcaagcagtagaagaagtccctgagcatgactatatgatacctttatcagaagcagaggttataagagaaggcaatgacattacactggttggatggggagctcagcttaccgttatggaacaagcttgtctggacgcggaaaaggaaggaatatcatgtgaactgatagatctcaagacactgcttccttgggacaaagaaaccgttgaggcttcagttaaaaagactggcagacttcttataagccatgaagctcctgtaacaggaggttttggagcagagatctctgcaacaattctggaacgttgctttttgaagttagaagctccagtaagcagagtttgtggtctggatactccatttcctcttgtgtttgaaccattctacatgcccaccaagaacaagatattggatgcaatcaaatcgactgtgaattactag

SEQ ID NO: 2089 - DNA, 1575 bp, Arabidopsis thaliana
atgactaatactctctgtttaagcctcatcaccctaataacgctttttataagtttaaccccaaccttaatcaaatcagatgagggcattgatgttttcttacccatatcactcaaccttacggtcctaaccgatcccttctccatctctgccgcttctcacgacttcggtaacataaccgacgaaaatcccggcgccgtcctctgcccttcctccaccacggaggtggctcgtctcctccgtttcgctaacggaggattctcttacaataaaggctcaaccagccccgcgtctactttcaaagtggctgctcgaggccaaggccactccctccgtggccaagcctctgcacccggaggtgtcgtcgtgaacatgacgtgtctcgccatggcggctaaaccagcggcggttgttatctcggcagacgggacttacgctgacgtggctgccgggacgatgtgggtggatgttctgaaggcggcggtggatagaggcgtctcgccggttacatggacggattatttgtatctcagcgtcggcgggacgttgtcgaacgctggaatcggtggtcagacgtttagacacggccctcagattagtaacgttcatgagcttgacgttattaccggaaaaggtgaaatgatgacttgctctccaaagttaaaccctgaattgttctatggagttttaggaggtttgggtcaattcggtattataacgagggccaggattgcgttggatcatgcacccacaagggtgaaatggtctcgcatactctacagtgacttctcggcttttaaaagagaccaagagcgtttaatatcaatgaccaatgatctcggagttgactttttggaaggtcaacttatgatgtcaaatggcttcgtagacacctctttcttcccactctccgatcaaacaagagtcgcatctcttgtgaatgaccaccggatcatctatgttctcgaagtagccaagtattatgacagaaccacccttcccattattgaccaggtgattgacacgttaagtagaactctaggtttcgctccagggtttatgttcgtacaagatgttccgtatttcgatttcttgaaccgtgtccgaaacgaagaagataaactcagatctttaggactatgggaagttcctcatccatggcttaacatctttgtcccggggtctcgaatccaagattttcatgatggtgttattaatggccttcttctaaaccaaacctcaacttctggtgttactctcttctatcccacaaaccgaaacaaatggaacaaccgcatgtcaacgatgacaccggacgaagatgttttttatgtgatcggattactgcaatcagctggtggatctcaaaattggcaagaacttgaaaatctcaacgacaaggttattcagttttgtgaaaactcgggaattaagattaaggaatatttgatgcactatacaagaaaagaagattgggttaaacattttggaccaaaatgggatgattttttaagaaagaaaattatgtttgatcccaaaagactattgtctccaggacaagacatatttaattaa

SEQ ID NO: 2090 - DNA, 1290 bp, Arabidopsis thaliana
atgtccttaacgaaatcttcagaatcagttttcactgaagaagaagaagaagattcctttagcggtcgatacacgttatggatcaaagaagcattagaggagcttccacacaatttcacaatcaccgacccgtttatttcgggtcacccgattgttttcgcgagcttagggtttttgaaaatgactggctattcacgagaagaagtgatcggaagaaacggtaaagtttttcaaggacctaagactaatcgaagatcgatcatggagattcgtgaagcgattcgtgaagagagatcagtgcaagtgagcttgttgaattatcgtaaatctgggtctccgttttggatgttgtttcatatgtgtcctgtttttgggaaagatgatggtaaagtcaccaattttgtggcggttcaggtcccgatttcgggacgagaacatcatcggaagaagttgagaaatgtcggagatttgtcgtcggatacttctccgacatttggttcttgtcgaagagaggtttgttttggtaatttcgtgtgtcaggatcgagctttaccagtggaatgtgatgatgatgaacaaggattagaggattgggaacagtgtgaagcgagtgagtccgagaagctgaaagctacggaagctattaacaatgtgttatctatcttagtgcattacagcgagttgagtggtagattagtctgcggaaagcggtactgcttgcgaggagtagattgtctaagctcgtcgttagttatttctctcggtagaatcaaacaaagtttcgtattaaccaatccatgcttaccagacatgcctatcatttatgcgagtgatgcctttttgacactgaccggttacaagagacaggaagtgttgggacaaaactgtagatttctgagtggggttgatactgattcctcagtactatacgagacagcatattttgtgggtgttcaagtagaagcaagttgtagaaatactgaaattaaagagctgagaccagagacgagacaactgagtgttgtcggtgcggttagagttgcgaatgtaagaaacaaggttggtatcggcaaacaagaaaaaaatattacaatcgaaaatgttctgctcgtgattcgacaaacagaagacatctccaatctgtattccaaaaacacgaagatttataggtggaaaatgcaacatagaaaagtagaagacatttccaatctgtattccaaaactgttggatacggacaccggatattgcacttatggcaaattgggcgagaagcagaattgttgcgttga

SEQ ID NO: 2091 - DNA, 1134 bp, Arabidopsis thaliana
atggtgaaaccatcggatttcaaagcaattcaagggtttattcggctgcattacactcgggtcaaccctgtcacaattggccgatcaaacccatcagctttgtcttctccagctattccctccaatggtgtttctcagcttcagcctaagtttagcttccacagcttatcctcgaaacccacttccaaaaacgtgggattatatcagattctgtcgtctcctaagctcaatcctaagttgcagcaagctttgggtttgcctcgtgtgaatgtgagttttgcatcggcgtttagattggtatccactaagagctctggatttcgaaaggttgatgggagttttgcgagaaaggttgttgataagcctgtcaaagctgttagttctacttttgctagataccgtgaggctatagggttgcacattgatgcattttggaaaaagaatagtcttgttgtgtttggagctgcaggtgtttttgtatgtattttcctttggcggattatgtttggaattgctagtacgtttgttggcctctcagagggcatggccaagtatgggtttcttgcactctcctcagccattgtagcattttctggattatacctccgctcaaggtttacaattaatccggataaagtttatagaatgaccatgaggaagatcaacacggcagctgaaattctagaagttatgggtgctcctctgtcaggatcagatttacgagcgtatgtgatgtcaggtggtggcataacatttaagaaattcaagccaacaattaggagcaagcgctgctttcttctattccccgttcagggttctgagcaaaagggccttgttagcgttgaagttaagaagaagaaaggccagtatgacatgaagcttttggcggtagatattccaatggcatctggtcccgaccaacggttatttctgattggcgatgaagaagagtacagaattggtggtggtttaatctctgtgttaagagaccctgttgtgaaagcaatggcagcaactaaggagttcgataatcttgatagaatcgaagaggaagaagacgctgaaagagaacttcaagaagctgaaagaaagcatcgtgaagagatcgagaaactcgagaaggagggctcataa

SEQ ID NO: 2092 - DNA, 2112 bp, Arabidopsis thaliana
atgaaactcacaaacgctctcttcttcttcttccttatctgtctcctctctttatcgtcagcttcatcgaacaagcctcagctttcaaatggctcgaccatcttattcacgacgatagggagacccactttcgaattcgacatctttactctccccacgagccaccgtccaccgtcacccgccgatgagcaccgtctcaccgatggcaaatctattaacttcaacggctatttcgcttctccttctacggcgttaatctcacttctacccaaaagaactcagattcaaccacaagacgtgcatctcatctacgtcactgagagagccggaactcctagcttaaactacgacgtcgttcacagcgataacgttggatctagaattcaggttccgttattttccggcgaggaacaacagagtggtatgaatgtaaattccatgaaagacacgcctgttttaacaaacggctatcttgtccacgtgtcgacacatgagaatccgggtaagcccatggcgagttgggccgctgtttactcgactgagttacgaactaagtcgactcggcggcttacaccactgggtatcgctgacttttctccggctgtgtctccgtctgggaagtggactgccgtggcttcgtttggagagaaaggctggacttggagcatggtagagaaagagattagttcagacgtctacgttttcctgactcaggatggaactcagcgagtcaaggtggtcgagcaaggcgggtggccgagatgggtcgatgactcgactctgtatttccaccggaaaagcgacgacggttggatcagcgtgtaccgagcgattttacccaaaaccggaccggttaccaccaaatcggttacgattcaaagagtcacaccaccgggtcttcacgctttcacacccgccacgtcaccaaacaataacaacttcatcgcggtggctacaaggaggcctggatcagaaatccgccacgtggagcttttcgatttaaagaagaacgagttcgtcgagttgactcgtttagtctcgccgaagagtcatcactttaacccgtttctttcccctgactcgtcccgagtcggataccatagctgcagaggtgacgcaactggacgtaaaactcctcggaatctcctccaaagcctcaaaacaacttcaaacgacctctctctcttcagattcgacggtgcgttcccgtctatctcgccggaaggtgacagattcgcgttcgtctctttcacaggcgttttcgtggtgaacccagatggttcaggtctacgtcaattgcttccacaaatgggatttggaacagtttgggatcctattcgacatggaatcgtctacacaagctcaggtccagctttagctccaggaaagtctcaaatcgatattctcgccataaacgtcgatgcacctagtccagcaaccgccgttaaaaaactaacgactaccggtgaaaacaacgcttttccgtggccatcacctgacggtaaacggatcgtgttccgttctgcgcggtccggtactaaaaacctttacataatggacgcagagaaaggtgaatccggtggtttgttccggttaacgaacggaaactggaacgatacgatagctacttggtcacctgatggtaattggattgtgtttgcatccaaccgggaatttcccggtacgttgttgatgaatatatatgtggttcatccggatgggaccggtttaaggaagctggcgcaaaacttgaccggtttggtatcgatgcatccgatgtttagtcccgacagtaagagaatcgtgtttactaccatttatgctggaatctcggcggagcagatcggtaatccgcattttaacgtcccgagtagtgagatttttaccgtgaacttggacggctctggtttgacgaggctaacgcataactcggtggaagatggaccacccatgtggttccctaagatcaaagctactggtgatgtggcttggcctaagaggtttggccctagttgctctatccaagatttcaagacgcaaaatactaccgtgaaaatgaaaatgaataagcccgcaacaatgtcatcaatgtgtgttgttccttcacaatga

SEQ ID NO: 2093 - DNA, 1425 bp, Arabidopsis thaliana
atggccgccgcagtttccaccgtcggtgccatcaacagagctccgttgagcttgaacgggtcaggatcaggagctgtatcagccccagcttcaaccttcttgggaaagaaagttgtaactgtgtcgagattcgcacagagcaacaagaagagcaacggatcattcaaggtgttggctgtgaaagaagacaaacaaaccgatggagacagatggagaggtcttgcctacgacacttctgatgatcaacaagacatcaccagaggcaagggtatggttgactctgtcttccaagctcctatgggaaccggaactcaccacgctgtccttagctcatacgaatacgttagccaaggccttaggcagtacaacttggacaacatgatggatgggttttacattgctcctgctttcatggacaagcttgttgttcacatcaccaagaacttcttgactctgcctaacatcaaggttccacttattttgggtatatggggaggcaaaggtcaaggtaaatccttccagtgtgagcttgtcatggccaagatgggtatcaacccaatcatgatgagtgctggagagcttgagagtggaaacgcaggagaacccgcaaagcttatccgtcagaggtaccgtgaggcagctgacttgatcaagaagggaaagatgtgttgtctcttcatcaacgatcttgacgctggtgcgggtcgtatgggtggtactactcagtacactgtcaacaaccagatggttaacgcaacactcatgaacattgctgataacccaaccaacgtccagctcccaggaatgtacaacaaggaagagaacgcacgtgtccccatcatttgcactggtaacgatttctccaccctatacgctcctctcatccgtgatggacgtatggagaagttctactgggccccgacccgtgaagaccgtatcggtgtctgcaagggtatcttcagaactgacaagatcaaggacgaagacattgtcacacttgttgatcagttccctggtcaatctatcgatttcttcggtgctttgagggcgagagtgtacgatgatgaagtgaggaagttcgttgagagccttggagttgagaagatcggaaagaggctggttaactcaagggaaggacctcccgtgttcgagcaacccgagatgacttatgagaagcttatggaatacggaaacatgcttgtgatggaacaagagaatgtcaagagagtccaacttgccgagacctacctcagccaggctgctttgggagacgcaaacgctgacgccatcggccgcggaactttctacggaaaaggagcccagcaagtaaacctgccagttcctgaagggtgtactgatcctgtggctgaaaactttgatccaacggctagaagtgacgatggaacctgtgtctacaacttttga

SEQ ID NO: 2094 - DNA, 1062 bp, Arabidopsis thaliana
atggatcgttgcacgtcgtcgtttttgcttctcacattggtctctaccttgtccattctccaaatctcctttgctcaacttgttccagcaatcatgacattcggtgactctgtagttgatgtcggcaacaacaactatcttccgacccttttcagagctgattatcctccttatggccgtgatttcgctaaccacaaagccaccggtcgtttctgcaacggcaaattagccactgatataactgctgagactttaggcttcactaagtacccaccagcttatctaagtcctgaagcttctggtaagaatcttctcattggtgctaatttcgcttctgcagcttcaggttatgatgacaaagctgctcttctcaatcacgcgatcccgttgtatcagcaagtagagtatttcaaggaatacaagagcaagctaataaaaattgcaggaagcaaaaaagctgattcgatcataaagggagcaatctgtctcttaagtgcaggaagcagtgattttgttcaaaactactatgtgaatcctctgctttacaaagtttacactgttgatgcatacggatctttccttatcgataacttctctacatttatcaagcaagtgtatgcggttggagcaaggaagatcggtgtgacatctctgcctccaacaggatgtcttcccgctgcaagaacccttttcggtttccatgaaaaaggctgtgtttcaagactcaacacagatgctcaaaactttaacaagaagcttaacgctgctgcttcaaagcttcagaagcaatattccgatcttaagattgttgtcttcgacatctactctccactttatgatcttgttcagaacccttccaaatccggattcacggaagcaaccaaaggatgttgtggaacaggaacagtcgagacaacttcactcttgtgcaacccgaaatcgtttgggacatgctccaatgctactcagtatgtgttctgggacagtgtgcatccttctgaagctgccaatgagattcttgccactgccctaattggacagggcttttctctcctcggttga

SEQ ID NO: 2095 - DNA, 630 bp, Arabidopsis thaliana
atggcaggaatcaaagttttcggtcacccagcttccacagccactagaagagttctcatcgctcttcacgagaagaatctcgactttgaattcgttcatatcgagctcaaagatggtgaacacaagaaagagcctttcatcttccgcaacccttttggtaaagttccagcctttgaagatggagacttcaagcttttcgaatcaagagcaatcactcaatacatagctcatttttactcagacaaaggaaaccaacttgtctcccttggctccaaggacattgcgggcatagccatgggcattgaaattgaatcgcatgagtttgacccagttggttcaaagcttgtttgggagcaagtcttaaagcctttgtatggtatgaccacagacaaaaccgttgttgaagaagaagaggctaagctagccaaggtcctcgatgtttacgaacacaggcttggtgagtccaagtatttggcttctgataaattcactttggtcgatcttcacactatccctgtgattcagtacttgcttggtacaccaactaagaaactctttgacgagcgtccacatgtcagtgcttgggttgctgacatcacttctaggccttctgctaagaaggttctttaa

SEQ ID NO: 2096 - DNA, 810 bp, Arabidopsis thaliana
atggaaggttgtccaagaaacagagaaatcggtccaaaacttcttgatttgattccacaaggaaggaaatggtaccaagaagacaagaacaacacagatcaggagaagaaacttgagctaaggcttggaccacccggtggtgatgaagaagatcattcagcaatcaagaagaagaacacagagataagaaacatcaagaaggaaacagaagacaaatctttccactgttttaatggcaatcacttctctccttccaacaaaaccacttctgttcctcacatctcacagaaaagaactgctcctggtccagtggtgggttggcctccggttcgttcgttcagaaagaatctagcgagcacaagctcttcaaagctaggtaacgaatcctctcatggaggtcaaatcaacaagagtgatgatggtgaaaaacaagttgaaaccaagaaggaaggaatgtttgtcaagatcaacatggatggtgttcctattggtcgtaaagttgatctcaatgcttacaacagctacgaacagctctcttttgtcgttgacaaactcttcagaggtctactcgcagctcaaagagatatctctgatggtcaaggagaagagaaacctatcattggattattagatgggaaaggagaatttactttaacctatgaagacaatgaaggggacaagatgcttgttggggatgttccatggcaaatgtttgtttcatctgtgaagagactgcgtgtgattaaaagctctgagatttcatctgccttgacatttggatgcagtaagcaagagaagatgatgcactga

SEQ ID NO: 2097 - DNA, 1701 bp, Arabidopsis thaliana
atggcggccacaacaagcttctcctcttccctctctttaatcactaaaccaaacaattcttcttacaccaatcaacctctccctctcttccccaaacccttccttaaacctccccatctctctctccttccttctcccctctcctctcctcctccttcactcatccatggagtctcctcctacttctcctctccttcaccatccgaagacaattctcataccccttttgattaccacaacgacgaagacgacgaaaagcctcgagaagagtgcggtgtcgttggaatctatggagatccagaagcttcacggctctgttacttagctctccacgcacttcaacatcgtggtcaagaaggtgcaggtattgtaacagttagtcccgagaaagttcttcaaaccattacaggtgttggtttagtctctgaggttttcaacgaatcaaaacttgatcaattacctggtgaatttgctattggtcatgttcgttactcaacagctggagcttctatgctcaagaacgttcagcctttcgtcgccggttatcgattcggttctatcggtgttgcccacaatggtaatttagtaaattacaaaactttgagagctatgcttgaagagaacggttctatcttcaatactagctctgatactgaggttgtgcttcatttgattgctatttctaaagctagacctttttttatgaggattattgatgcttgtgagaaacttcaaggtgcttattcaatggtgtttgttactgaggataagcttgttgctgttcgtgatccttatgggtttagaccgttagttatgggtaggagaagtaatggagctgttgttttcgcttcggagacttgtgctcttgatttgattgaagctacttatgagagagaggtttatcctggtgaggttttggttgtggataaggatggtgtcaagtctcagtgtttgatgcccaagtttgagcctaagcaatgtattttcgaacatatctacttctcgttgcctaactcgattgtgtttggtcggtccgtgtatgaatctaggcatgtttttggtgagattttggctaccgagtcgcctgttgagtgcgatgttgtcatcgctgtgcctgactctggtgttgtggctgctctcgggtacgctgcgaaatccggtgtgccgtttcaacaggggttgattaggtctcattacgtagggaggacgttcattgagccgtcacagaagattagagactttggtgtgaagcttaagttgtctcctgttcgtggtgttttagaagggaagagagttgttgtggtggatgattcgattgttagaggcacaacttcgtctaagattgtgcgtttattgagagaagctggtgcaaaagaggttcatatgaggattgctagtcctcctatagtagcttcttgttactatggtgttgatacgcctagctcagaggagttgatatccaatagattgagtgttgaggagattaacgagttcatcgggagtgactctcttgcgtttctatcgttcgatacgttgaagaaacacttggggaaagactctaagagcttctgctatgcgtgcttcacgggtgactatcccgtgaagccaacagaagttaaggtgaaacgaggaggaggggatttcattgatgacggtctcgttggtagcttcgaaaacatcgaagcaggttgggttcgataa

SEQ ID NO: 2098 - DNA, 2991 bp, Arabidopsis thaliana
atggaaccaacagaaaaaccatcgaccaaaccatcttctcggactctacctagagacactcgtggctctctcgaagtattcaacccgtcaactcagctgacccgacccgataacccggtgttccgtcctgaaccaccagcgtggcaaaacttgagtgatccacgtggcaccagtcctcaaccccgaccacaacaagaaccagctccatccaaccctgttcggtctgatcaagaaatcgctgtcacgacctcatggatggctctgaaagacccatcaccggagacaatctccaagaagacgatcaccgccgagaaaccacagaagtcggcggtggcggctgagcagagagcggcagagtggggattggttttgaagaccgatacaaagacgggaaagccacaaggagtaggcgtgaggaactctggtggaactgagaatgatcctaacgggaaaaagactacatcgcagagaaactcgcaaaactcttgccggagctccggtgagatgtcggacggagatgttcccggcgggaggagtgggattccaagagtatcggaagatctaaaagatgcgttgtcgacgtttcaacaaacgtttgtggtctcagatgctacaaaacctgattatccgattatgtatgcaagtgctggtttcttcaatatgactggttacacttccaaagaagtcgtcggcagaaactgccgatttttacaaggatcaggtacagatgcagatgagttagcaaagataagagagacattagctgctggtaacaattattgtgggcgtatattgaattacaagaaagatgggacctctttttggaatcttctcacgattgctcccattaaagacgagagtggcaaagtcctcaaatttatcggaatgcaagtggaggtgagcaagcacactgaaggggccaaagaaaaggctttgaggcccaatgggcttccggaatctctgattcgatacgatgcccgccaaaaagatatggcgacaaactcagtgacagagctagtagaggcggtgaagagacctcgggcactaagcgaatcgacgaatctccatcccttcatgacaaaatcggagagcgatgaacttccgaaaaaaccagctcggcgaatgtccgaaaatgttgttccgtcaggccgaagaaactctggcggcggaagaagaaactcgatgcagcgaatcaacgaaattcccgagaaaaaatctagaaaatcttccctttccttcatggggatcaagaagaagagcgaatctttggatgaatctatagacgatggatttatagagtatggagaagaagacgatgagattagtgatagggacgagagacctgagagtgtggatgataaagtgagacaaaaggaaatgagaaagggtattgatctagctactacactcgaacgtatcgagaagaatttcgtcatcactgatcctaggcttcccgataatcccattatttttgcatctgatagtttcttggagctcacggaatatagccgtgaagaaattcttggaagaaattgcaggtttctacaaggtccagagactgatctaaccacagtgaagaagattcgaaatgctattgataaccaaaccgaagtgacagttcagctcatcaactacaccaagagcggaaagaagttctggaacattttccacttgcaacctatgcgtgatcagaagggagaagtacaatactttattggagttcaactagacgggagcaagcacgtagaaccagttcgcaatgtcattgaagaaaccgcagtgaaagagggagaagacctggtgaaaaaaacagctgtgaatatcgatgaagcggttcgagaacttcctgatgccaacatgacaccagaggatttatgggcaaaccactcaaaggttgttcattgtaagcctcacaggaaagattcaccaccatggatagctatccaaaaggtgttggaaagtggtgaaccgattggtttgaagcatttcaaaccggtgaaacctttgggttctggtgacacaggaagtgtgcatctagtggaactcgttggaacagatcagttgtttgcaatgaaagcaatggacaaggctgttatgcttaaccgaaacaaagtacatagagctagagctgagagagagatcctagatttgcttgaccatccttttcttcctgcactctacgcttcttttcagacaaaaacacatatatgtcttataacagattactatccaggaggagaactcttcatgctcctagatcgacaacctaggaaggttctcaaagaagatgctgtaagattctatgctgctcaagttgtcgttgcactcgagtatcttcactgtcaaggaataatttaccgagacttgaaaccggaaaacgttttaatccaaggcaatggcgatatctctttgtcggattttgatctgtcttgcttgacatcttgcaaacctcagctgttgattccgagtatagacgagaagaagaagaaaaagcaacaaaagagtcaacaaactccaatcttcatggctgaaccaatgcgtgcatcaaactcatttgttggcactgaagagtacattgctccggaaattatatccggagcaggacatacgagtgcagtagactggtgggctcttggtatacttatgtatgaaatgttatacggatacactccttttagaggaaaaacaagacagaagactttcaccaatgttcttcaaaaagatctcaagtttccagctagcattcctgcaagtcttcaagtgaaacagctgatttttaggctgttacaacgagatccgaagaaaagactaggttgttttgaaggagcaaatgaagtcaagcaacattctttcttcaaaggcataaattgggctctgattcgatgcacgaaccctccagagctcgagactccgatattttctggtgaagctgaaaacggagagaaagttgttgatcctgagctagaagatctgcaaacaaatgttttttga

SEQ ID NO: 2099 - DNA, 1374 bp, Arabidopsis thaliana
atggagagagctatggaaagacaaaagatattgcttcgtcatctcaatccagtttcttcttctaattcttctcttaaacatgaaccttctcttctgtctcctgtgaattgtgtttctgaagtttccccaatggctgcttttggagatgacattgtgattgtagcggcatatcgtaccgccatttgcaaagcgagacgtggaggtttcaaagacactcttcctgatgatcttcttgcttctgttcttaaggctgtagtggaaagaacatctttggatccaagtgaagttggtgatatcgttgttggtaccgtgatagcgcctggttctcagagagcaatggagtgtagagttgcagcttattttgctggttttcctgactccgtgccagttagaactgtcaatagacaatgctcatcaggactacaagcagttgctgatgttgctgcttccattagagctggttattacgacattggtattggtgctggagtggaatcaatgtcaactgatcatattcctggaggcggctttcatggctctaatccaagagcacaggatttcccaaaagcccgtgattgtttgcttccaatgggaattacttctgaaaacgttgcagaaaggttcggtgtcacaagagaagagcaagatatggctgcggtggagtctcacaaacgcgctgcagctgcaatcgcgtctggtaaactcaaggatgaaatcattcctgttgctactaagattgtggaccctgagactaaagcagagaaggcaatcgtcgtatctgttgatgacggtgtacgtccaaactcaaacatggcagatttggcaaagctgaagactgtctttaaacagaacggttccaccacagctggcaatgctagtcagatcagtgatggtgctggagcagtactgctaatgaagagaagtttggctatgaagaagggacttcccattcttggagtattcaggagttttgctgttactggtgtggaaccatctgtaatgggtattggtccagctgttgccattcccgctgcaactaagctcgcagggctcaacgtcagcgatattgatctattcgagatcaatgaggcatttgcatctcagtatgtgtactcttgcaagaagttagagctggatatggaaaaggtcaatgttaatggaggagccattgctattggccatcccctgggtgctacaggagctcgatgtgttgcgacattgttgcacgagatgaagcggagaggaaaagattgccgctttggagtaatctcaatgtgcataggcactggaatgggagctgcagctgtttttgagaggggagactctgttgataacttgtccaacgctcgtgtggctaacggggatagtcattag

SEQ ID NO: 2100 - DNA, 507 bp, Arabidopsis thaliana
atggcttcaaagaactcagcctctattgctcttttcttcgcccttaacatcatattcttcaccttaaccgctgcaacagattgtggttgcaacccaagtcctaagcacaagcctgtcccaagtcctaaacccaagccggtcccaagtcccaaacccaagccggtcccaagtccttcagtaccaagtccttcggtcccaagtcctaaccctaggccggtcacgcctccgagaacccctggctcatctggaaactgtcctatcgatgctctcagactcggtgtatgtgcgaacgttttaagcagtctactcaacattcaattgggtcagccatcagctcaaccatgttgctcgctcatccaaggtttggttgacctcgacgctgccatttgtctttgcactgcgcttagggctaacgttcttggtatcaaccttaacgtcccgatatctctcagtgttcttctcaacgtttgtaacagaaaggttccgtctggcttccaatgtgcttga

SEQ ID NO: 2101 - DNA, 1500 bp, Arabidopsis thaliana
atggcgaggaagatgcttgttgatggtgagattgataaggtggcggctgatgaagccaacgcgacgcactatgattttgatttgtttgtcatcggtgccgggagtggcggtgttcgtgctgctaggttttcggctaatcatggcgctaaggttggtatttgtgagcttccatttcaccctattagctctgaggagattggaggcgttggtggaacctgtgttatccgtggttgtgttcctaaaaagattctcgtctatggagctacttacggtggtgaacttgaggatgctaaaaattatgggtgggaaataaatgagaaagtcgacttcacatggaagaagcttttgcaaaagaagactgatgagatactaagactgaataatatctacaagcggttattggcaaatgctgcggtgaaattgtatgaaggtgaaggaagagtagttggtcccaacgaagtggaggtgagacaaatagatggcacaaaaataagttataccgcaaagcacatattgattgccactggcagtcgggcgcaaaagcctaatattcctggacatgagctggctattacatctgatgaagctttgagcttggaagaatttcccaagcgtgctatagtgcttggaggagggtatattgctgtggagtttgcatcaatatggcgtggaatgggtgctactgtagatttattcttcaggaaggaacttccgctaaggggttttgatgacgaaatgagggcactagttgctagaaatcttgaaggaaggggcgttaatctgcatccacaaacaagtttgactcagttgacaaaaacagaccaggggatcaaagtcatatcgtcccatggggaggaattcgtggcagatgtcgtcctatttgctactggcagaagtcctaataccaaaagattgaatttagaagctgttggtgttgaacttgatcaggctggagctgtgaaggttgacgagtattcacgaactaatatacctagcatatgggctgtaggagatgccacaaaccgaattaaccttacacctgttgcgttaatggaggccacctgttttgcgaacactgcttttggtggaaagcctactaaagcagaatacagcaatgtcgcctgtgctgtattttgcataccaccactagctgtagtgggtctcagcgaagaagaagcagtagaacaagcaaccggtgatattctggtcttcacctcaggctttaatccaatgaagaacaccatttctggacgccaggaaaagacattgatgaagctaatagttgatgagaagagtgataaggttattggagcatccatgtgcggtcctgatgcagctgagatcatgcaggggattgcaattgcgctcaagtgtggagcaaccaaagcacaatttgatagcacggttgggatacatccatcttctgcagaggaatttgtgacaatgcgcagtgtgaccagacgcattgcccacaaacccaaacctaagacaaatctatga

SEQ ID NO: 2102 - DNA, 1467 bp, Arabidopsis thaliana
atgcatagagtacgcaataaaccggttaaatccaccgctactgcttccgtcaagcatttaatcaaacagagaggcggcgacggagctacggcggcttccaagtcggcgaatgattataataataatgatagtctcttgacggatatgcaggaaccaagcatcgatacagataaactcagctacgagattttctctattcttgagagcaaatttcttttcgggtacgacgactcgaaacccgaacccgcgaattcggttgttgctgggtcgattaagaaccagagaggtaaaatctgtattctgagtatcgatggaggtggaatgagagggatcttacccggtaaggctttggcttatctagaacacgctctgaaatctaaatcgggtgacccgaatgcccgaatcgccgattactttgacgtagccgccgggtccggtataggtgggatttacacagccatgttgttcgggtcaagagacggtaaccgccccatcttcaaagcagatgacacgtggcagttcttaacgagaaacgccaagggtctttacggaggagcaggaatcttgaaacgggtcttgagaaccgggtcgggttgttgttccgggacggctaagttaaagaaagtgatgaaagagtctttctcggagctaaccttaaaggacacgcttaaaccggtgcttataccttgctacgacctcaaaagctctggcccgtttctgttctcacgggccgatgcgcttgagacggacggctatgattttaggctctcggaggtttgtagagcgacttgggctgagccgggtgtgtttgagcccgtggagatgaagtcggttgatgggcagaccaagtgtgtggctgttggtggaggattagccatgagcaatcccacagcggctgcaatcacgcatgtcctgcacaacaagcaggagtttccgtttgtgcgaggtgttgaggatttgcttgtgttgtctcttggtatgggtcagttgcttgatgttagctatgagtatgatcggattatcaagtggaaggctaagcattgggctcgccccgcagctcttatttctaatgacggtgctgctgacactgtcgatcaagctgtggccatggcttttggtcactgccgcagtagtaactatgtccggattcaggcgaatgggtcgaacttaggaccttggagtcctaacatggacacagaccctagtgggagcaatgtgaatatgctgatgggagtagcagaggagatgcttaaacaaaagaatgttgaatctgttttgtttggaggtaaaagaatcgatgaacagagcaacttcgagaagcttgactggttagctggggaacttgttctcgagcatcaaaggagaaatagcagaatcgctccaaccgtagcgttcaagcaatccgtgcatagagcagatcaaaagacaagtgataaagatatcggtgtgaccgcaagagaacgatga

SEQ ID NO: 2103 - DNA, 1344 bp, Arabidopsis thaliana
atggatactacaataatttactcagggtttagtaaattagggttcttgtctaaagatgagtataatcagaaagttgaaaacttggagatggttttctcttcggttgctgttcaaattgcgagatacattgtgacgatgacaagtactggagctattcttttgattgggtttcaattatcagtgtatgtatttgtgatgaaaggtggagatagttcgatgaactcattggtttggtatagttggcttggtggaattatcattggaaccatgactggtgctaacatggttttggaagatcattatcgagccggtccacggaatgttgttataaccggaaggggactagggaaagctcttgctagagagtttcttctctctggagacagagtcattgtcacatctcgcagttctgaatctgttgatatgactgtcaaagagctagagcaaaatctcaaagagattatgagtaacgctagcgagtcagctagaaagaaactgagtgatgctaaggtagttggtattgcctgtgatgtttgcaaacccgaagacgttgagaagctgtcgaatttcgctgtaaaagagcttggttccatcaacatatgggtaaagaaacatatttctttttgtacaataaacaatgctggtactaacaaaggttttagaccgctactcgagttcacggaagaagatatcacacagattgtctccacaaatttgattggatcaattctatgtacacgaggggctatggatgtgatgagcagacagcacagtggtggacacatctttaacatggatggtgctggctctggaggttcaagtactcctctcactgccgtatatggttcaacaaaatgtggacttaggcagtttcatgggtctatagtgaaagaaagccaaaaaacaaacgttggccttcacactgcatcccctggcatggttctgacagaacttcttctcagtggttcgagcattaaaaacaagcagatgtttaacataatctgtgagcttcctgagacagtagctagaactttggtaccacgaatgcgagttgtgaaaggttcgggaaaagccgtcaattacctaactcctcctcggatattgttagctattgtcacttcctggctaaggagaggccgatggtttgatgaccaaggacgggcgttatatgcagcagaagcagatagactaaggaactgggcagagaacaggacgaggttgtcgttaacagacgcgatggagatgtatacagagaatacttgggtctctgttttctctctttctgttgtttgcgctttcatcatcttacaaagcacaacacctagctcttttccaggcacataa

SEQ ID NO: 2104 - DNA, 3972 bp, Arabidopsis thaliana
atggcgggtgacgatttggtgtttgctgttaatggagagaaatttgaagtcttgtcagttaatccttctacgactttgctcgagttcttgcgttccaatacttgctttaagagtgtcaagctcagctgtggcgaagggggttgtggtgcttgcatcgtaattctatcaaaatacgatcctgtgttagaccaagtcgaggagtattctataaactcttgcctgacccttctttgcagcttaaatgggtgctccataactacatccgatggactcggaaacactgaaaaagggttccacccaattcacaagagatttgcggggttccatgcctctcaatgtggtttctgtaccccagggatgtgcatctctctctactccgctctttcaaaagcccataactcacaatcttctccagactacctgactgctcttgcagcagagaagtccattgctggaaatctttgtcgctgcaccgggtatcgtcccattgctgatgcttgtaagagttttgcttccgatgtcgatatagaggatttgggcttcaactctttttggaggaaaggagaaagcagagaagagatgttaaagaaattgcctccttacaaccctgagaaagatcttatcacttttccggatttcttgaaggaaaagattaagtgtcaacacaatgttttggatcagacgaggtatcattggagcactcctggtagcgtcgcagagcttcaggaaatattggcaacaaccaaccctggcaaagatagaggtttgataaaattagttgttggcaacacgggaacaggttactacaaagaagagaaacaatatggtagatatattgatattagccacattccagagatgtcaatgatcaagaaagatgacagagaaattgaaattggagcagttgttaccatatctaaagttattgatgctttgatggaggaaaatacatctgcttatgttttcaagaaaatcggtgtccatatggagaaggtggctaaccattttatcagaaactcagggagtatcggtggtaatctagtgatggcacagagcaaaagttttccttctgacataaccacacttttgctcgctgcagatgcatctgtgcatatgataaatgctgggagacacgagaagcttaggatgggagagtatcttgtgtcgcctccaatattagacactaaaactgttcttttaaaggttcatattcctaggtggattgcttcttccactactggtttgcttttcgaaacctatcgggctgcacttcgccctattggaagtgcattgccttatatcaacgctgctttcttagcagtagtctctcacgatgcatcatcaagcggcatcattgtggataaatgccggttggcatttggttcttatggtgggtatcattccatcagggcgagggaagttgaggatttcttgacgggtaaaatactcagccacagtgttttatatgaagctgtgaggttacttaaagggatcatagttcccagcatagatacctcatattctgagtataagaaaagcttggccgttgggtttctctttgattttctctatcctctgatcgagagtggcagttgggattccgaaggaaagcatatcgatgggcacatcgatccaacaatatgtctacctttgctgtcatctgcgcagcaggtgtttgaaagtaaagaatatcaccctgttggtgaagccattatcaaatttggagctgaaatgcaggcttctggtgaagctgtttacgttgatgatattccatccttaccccattgtctacatggagcattcatttatagcacaaagccattggcttggataaagagcgttggtttctcaggaaatgtgacaccaattggagttttggcagttattactttcaaagatatacctgaagtggggcaaaacattggttacataacgatgtttggcacagggcttctatttgcagatgaagttactatatctgccggacaaataattgctcttgtggttgcagacacacaaaagcatgcagatatggcagcacaccttgcagtagttgagtacgattcaaggaatataggaacaccagtattatctgtggaggatgcagtcaaaaggtccagcctttttgaggttcctcccgagtatcagcccgaacctgttggcgatatttcaaaaggaatggctgaagctgatcgcaagatacgctcagtagagttgagacttgggtcacagtacttcttctatatggagacacaaacagcacttgccttgccagatgaagacaactgtttagtggtttacagttcaactcaagcacccgagttcacacaaacagtaattgctacatgtcttggaatcccggagcataacgttcgagtcatcaccagaagagttggaggtggctttggtggaaaagctataaagtctatgcctgttgcgacagcatgtgcgcttgctgcaaaaaaaatgcagcgtcctgtaaggatatacgtcaaccgtaagactgatatgataatggctggaggaaggcatcccctgaaaataacttacagtgtaggattcagatctgacgggtcagatgtggatgtaagtctagtgatgccacagaatataatgaactccctgaggaaatatgactggggtgcattgtcatttgacatcaaagtgtgtaagacaaaccttccgagcagaacgtctttgagggcacccggtgaagtacaaggttcatacattgctgaatccattattgagaacgtagcatcttccctgaagatggacgtggatgttgtgagaaggataaatcttcatacgtacgaaagcctccgcaagttttataagcaagctgctggtgagcctgatgaatatactttgcctttattgtgggacaaattggaggtatctgcagatttcaggcgaagggctgaatctgtgaaagagtttaaccgatgtaacatatggcgcaaaagggggatttctcgagtaccaatcatccatctagttatacataggccaactccaggaaaagtaagcattttgaatgatggttcagttgcggttgaggttgcagggattgaggtgggacaagggttatggacaaaggtacaacagatggttgcttatggtcttggtatgataaaatgcgagggaagtgatgatctgcttgaaagaatacggcttcttcagactgacacgctcagtatgtctcaaagcagttacactgcgggtagcacaacatcagagaactgttgtgaagcagtgaggctttgctgcggtatcttggtggagaggctgagacctaccatgaatcagattctggagaatgctcgatccgtgacatgggacatgctcattcaacaggcgaatgctcaatctgtggacctatcagctcgaaccttttataagccagagtcctcttctgcagaatatctcaactatggagttggagcgagtgaggtggaggttgaccttgtgacaggaagaacagaaattataagatcagatattatctatgactgtggaaaaagccttaatcctgctgttgatttaggacagattgaaggagcgtttgttcaaggaatcggatttttcatgtatgaggagtacacgacaaatgaaaacgggcttgtgaatgaagaaggtacatgggactacaaaatacctacaatagacacaattcccaaacaattcaacgttcagattctcaacagtggtcatcacaagaaccgcgttctctcctctaaagcttcaggtgagcctccgttgcttgtggcggcttcagtgcactgtgcaacaagatcagccattagagaagctcgaaaacagtacctatcatggaattgcattgatgatgatcatagagaaagatgtgatcttggttttgagttaccggttccagcgactatgccggtggtgaagcagctttgtggccttgaaagcatagagaagtacttagaatggaaaacatatccttaa

SEQ ID NO: 2105 - DNA, 660 bp, Arabidopsis thaliana
atggcagcgagtgcatctccaatggcgagccagctaaggagcagcttctcctccgcttctctttctcagcgtctcgccgtcccgaagggcatctccggtgctcctttcggtgtttctccgaccaaaagagtctcttccttcactgtccgagctgttaaatccgacaagacaacattccaagtagttcaaccaatcaacggtgatccattcatcggaagtttggaaactccggtgacatcaagcccattgatcgcgtggtacctttccaacctccctggataccgtaccgccgtcaaccctctcctccgcggtgtggaagtgggcctggcccatggtttcttcttagtgggcccattcgtcaaagctggcccattaaggaacactgcttacgccgggtcagccgggtctttagccgcggctgggctggtagtcatcctcagcatgtgcctcaccatctacggtatctcttctttcaaggaaggagagccatcgatcgcaccgagtttgactttgactgggcggaagaagcagcctgaccagcttcaaacggctgatggatgggctaagttcactggaggattcttctttggagggatctctggggtgacttgggcttacttccttctctacgttcttgaccttccttacttcgtcaagtaa

SEQ ID NO: 2106 - DNA, 423 bp, Arabidopsis thaliana
atggctgcttcagtgatgctatcttcggtgacattgaaaccagctggtttcacggtggagaagacggcggctagaggattaccgtcgctcacaagagctcgtccctccttcaaaattgtcgccagtggcgtcaagaagatcaagaccgacaagcccttcggaattaacggcagcatggacttgagggacggcgtcgacgcctccggcagaaagggcaagggatacggtgtttacaagtacgtcgacaagtatggagctaacgtcgatggatacagtcctatttacaacgagaacgagtggtcagcgagtggtgacgtgtacaagggaggagtcaccggattggcaatttgggcggtaactctcgccggaattcttgccggaggtgctcttcttgtgtacaacacaagtgctttggctcagtaa

SEQ ID NO: 2107 - DNA, 402 bp, Arabidopsis thaliana
atggctagctttactgcctccgcttccaccgtctccgccgctcgtccggctctccttctcaagcctaccgtcgccatctctgctcctgttcttggtttgcctccaatgggtaagaagaagggaggagtgagatgttcaatggagacaaagcaaggaaacgtctcagtcatgggggctggagtttcagctgcagcaacagctgctttgacggcggtgatgagcaatcccgcgatggctttggttgatgagaggatgtcaacagaaggaacaggattaccctttggtctaagcaacaacctcttgggttggattctgtttggagtctttggtttgatctggactttcttcttcgtctacacttcatctctcgaggaggatgaagaatctggtctttcactctga

SEQ ID NO: 2108 - DNA, 999 bp, Arabidopsis thaliana
atggcagcctctctccaatccaccgctacattcctccagtcggcgaagatcgccaccgctccttctcgcggaagttctcacctccgatcgactcaagccgtcggcaaatcttttgggctcgaaacttcctcggctcgcctcacttgctccttccagtctgactttaaggacttcaccggtaaatgctccgacgctgtcaaaatcgccggattcgctcttgccacctctgctctcgtcgtctcgggagcaagtgcggagggagctccaaagagattgacctatgatgagattcagagcaagacatacatggaagtgaaaggaactggaacggctaaccagtgccctactattgacggtggctctgagactttctcgttcaaacccggaaagtatgcaggaaagaagttctgcttcgagcctacttccttcaccgtcaaggcagacagtgtaagcaagaacgctcctccagagttccagaacacaaagctcatgacccgtcttacctacacccttgacgagatcgaaggacccttcgaggttgcttcagacggaagcgtcaatttcaaggaagaagatggaatcgactatgctgcagtcacagtccaacttccaggaggtgaacgtgtgccattccttttcacagtcaaacagcttgacgcctcaggcaaaccagacagcttcaccggaaaattcttggttccatcgtaccgtggctcttccttcttggacccaaagggccgtggtggatccacaggatatgacaacgccgtggcattgccagctggaggcagaggagacgaggaggagcttgtaaaggagaacgtgaagaacactgccgcttcagtgggagagatcactctgaaagtgacaaagagcaagccggagacaggagaggtgatcggagtgttcgagagtcttcagccgtcggatactgacttgggtgctaaggtaccaaaggatgtgaagatccaaggggtgtggtatggtcaacttgagtga

SEQ ID NO: 2109 - DNA, 549 bp, Arabidopsis thaliana
atgagggacattaaagtgcagaagctggttctcaacatctccgttggtgagagtggagatcgtctcaccagagcctccaaggttcctcctgttttttacccattctctgtggttttggaacaattgagtggtcagactcctgttttctccaaagctagatacactgttcgttcttttggtatcagacgtaacgagaagatcgcatgctatgtaaccgtcagaggtgagaaggcaatgcaactacttgaaagtggattgaaagtcaaggaatacgaacttctcagaagaaacttcagtgacactggttgcttcggttttggtattcaagaacacattgatttgggtatcaagtacgatccatcaactggaatctatggtatggacttctatgtggtcctagaacgtcctggctaccgtgtagcacgtcgcagaaggtgcaaggctcgtgttggtatccaacacagagtaactaaagacgatgcaatgaaatggttccaggtgaaatacgaaggagtcattctcaacaagtcccagaacatcactggctaa

SEQ ID NO: 2110 - DNA, 384 bp, Arabidopsis thaliana
atggcttattctaagattgctcttctcctcatcttcaatgtcatcttcttcactttagtcagctcgacttcagtcccttgtccaccaccaccgcccaagagccaccacaagaaacccgcaacgccatctcctaaacccacttgtaaagacgctcttaaacttaaggtatgtgctaacgtgttggatttggttaaggtttctctgccaccaacgtccaactgttgcgctcttatcaaaggtctagttgatcttgaagccgcggtctgtctttgcactgccctaaaggctaatgttcttggtatcaaccttaatgttcccatttctttgaacgttgtcctaaaccattgtggtaagaaggttccatctggtttcaaatgtgcctag

SEQ ID NO: 2111 - DNA, 924 bp, Arabidopsis thaliana
atgcaagatattcatgatttctccatgaacggagttggtggtgggggaggaggaggagggaggtttttcggtggaggaatcggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaaggtggtgttctccgtaacgttcccgtcggaggtggttgccggaaagctaaacgttcgaaaacaaaacaggttccgtcgtcgtcatcagccgacaaaccaacgacgacgcaagatgatcatcacgtggaggagaaatcgagtacaggatctcactctagcagcgagagctcttctctcaccgcttctaactctaccaccgtcgccgccgtctccgtcaccgcggcggcggaagttgcttcgtcggttattccaggttttgatatgcctaatatgaaaatttacggtaacgggatcgagtggtcgacgttacttggacaaggctcatcggccggtggtgttttctcggagatcggtggttttccggcggtttcagctattgaaactacaccgtttggattcgggggtaaattcgtaaatcaagatgatcatctgaagttagaaggtgaaactgtacagcagcaacagtttggagatcgaacggctcaggttgagtttcaaggaagatcttcggatccgaatatgggatttgaaccgttggattggggaagtggcggtggagatcaaacactgtttgatttaaccagtaccgttgatcatgcatactggagtcaaagtcaatggacgtcgtctgaccaagatcagagtggtctctaccttccttga

SEQ ID NO: 2112 - DNA, 1299 bp, Arabidopsis thaliana
atggcggagactgtacattctccgatcgttacttacgcatcgatgttatcgcttctcgccttctgtccacctttcgtcattctcctatggtacacaatggttcatcaggatggttctgttactcagacctttggcttcttttgggagaatggagttcaaggacttatcaacatatggccaagacccactttgattgcttggaaaattatattttgctatggagcatttgaagctattcttcagctgcttctgcctggtaaaagagttgagggtccaatatctccagccggaaaccgaccagtttacaaggccaatggtctggctgcttactttgtgacactagcaacctatcttggtctttggtggtttggaatcttcaaccctgcaattgtctatgatcacttgggtgaaatattttcggcactaatattcggaagcttcatattttgtgttttgttgtacataaaaggccatgttgcaccttcatcaagtgactctggttcatgtggtaacctaataattgacttctattggggcatggagttgtaccctcgaattggtaagagctttgacatcaaggtgtttactaattgcagattcggaatgatgtcttgggcagttcttgcagtcacgtactgcataaaacagtatgaaataaatggcaaagtatctgattcaatgctggtgaacaccatcctgatgctggtgtatgtcacaaaattcttctggtgggaagctggttattggaacaccatggacattgcacatgaccgagctggattctatatatgctggggttgtctagtgtgggtgccttctgtctacacttctccaggcatgtaccttgtgaaccaccccgtcgaactcggaactcagttggcaatatacattctcgttgcaggaattctgtgcatttacataaactatgactgtgatagacaaaggcaagagttcaggaggacaaacgggaaatgtttggtttggggaagggccccgtcaaagattgtggcgtcgtatactacaacatctggtgaaactaaaactagtcttctcttaacgtctggatggtggggattggctcgtcatttccattatgttcctgagatcttaagtgctttcttctggaccgtaccggctctcttcgataacttcttggcatacttctacgtcatatttctcacccttcttctctttgatcgagccaagagagacgatgaccgatgccgatcaaagtatgggaaatattggaagctgtattgtgagaaagtcaaatacaggatcattccgggaatttattga

SEQ ID NO: 2113 - DNA, 654 bp, Arabidopsis thaliana
atggcgagaagaccggacgaagaatacgactacttgtttaaagtggttttgatcggagactccggtgtcggcaagtctaatctcctctctagattcactcgcaacgagttctgcttagaatccaaatccaccattggtgtcgaattcgctactcgtactctccaagtggaaggaaggactgtgaaagctcagatatgggacacggctgggcaagaacgatacagagccataactagcgcctattacagaggtgcacttggagctcttttggtctatgatgtcaccaagccaacaacgtttgagaatgtaagcaggtggttaaaagaactaagagaccatgcagattccaatatagtgatcatgttgattgggaacaagacagatctgaagcatctcagagcagttgccacagaggatgctcagagctatgcagagaaagaaggcttatctttcatcgagacatcggctctcgaggcattaaacgtagaaaaggcttttcagacgattctctcggaggtttataggatcatcagcaagaagtcgatatcttcagaccagacaactgcaaatgccaacatcaaggaaggccaaacaattgatgtggctgctacttctgaatcaaacgctaagaagccttgttgctcatcgtcttga

SEQ ID NO: 2114 - DNA, 1377 bp, Arabidopsis thaliana
atggccaacaacaattccaactctcccaccggtccacactttctattcgtaacatttccagcccaaggtcacatcaacccatctctcgagctagccaaacgcctcgccggaacaatctctggtgctcgagtcaccttcgccgcctcaatctctgcctacaaccgccgcatgttctctacagaaaacgtccccgaaaccctaatcttcgctacctactccgatggccacgacgacggtttcaaatcctctgcttactccgacaaatctcgtcaagacgccactggaaacttcatgtctgagatgagacgacgtggcaaagagacactaaccgaactaatcgaagataaccggaaacaaaacaggccttttacttgcgtggtttacacgattctcctcacttgggtcgctgagctagcgctcttctccattttttaccattacttcaatggctacgaagatgcaatctcagagatggctaataccccctctagttctattaaattaccttctctgccactgcttactgtccgtgatattccttctttcattgtctcttccaatgtctacgcgtttcttctacccgcgtttcgagaacagattgattcactgaaggaagaaataaaccctaagatcctcatcaacactttccaagagcttgagccagaagccatgagctcggttccagataatttcaagattgtccctgtcggtccgttactaacgttgagaacggatttttcgagtcgcggtgaatacatagagtggttggatactaaagcggattcgtctgtgctttatgtttcgttcgggacgcttgccgtgttgagcaagaaacagcttgtggagctttgtaaagcgttgatacaaagtcggagaccattcttgtgggtgattacggataagtcgtacagaaataaagaagatgagcaagagaaggaagaagattgcataagtagtttcagagaagagctcgatgagataggaatggtggtttcatggtgtgatcagtttagggttttgaatcatagatcgataggttgtttcgtgacgcattgcgggtggaactctacgctggagagcttggtttcaggagttccggtggtggcgtttccgcaatggaatgatcagatgatgaacgcgaagcttttagaagattgttggaaaacaggtgtaagagtgatggagaagaaggaagaagaaggagttgtggtggtggatagtgaggagatacggcggtgcattgaggaagttatggaagacaaggcggaggagtttagaggaaatgccacgaggtggaaggatttagcggcggaggctgtgagagaaggaggctcttcctttaatcatctcaaagcttttgtcgatgagcacatgtga

SEQ ID NO: 2115 - DNA, 561 bp, Arabidopsis thaliana
atggcaggaggaggaacagaagcgtttcctgatcttggagagcattgccaagaccctgattgcaaattactcgattttctcccttttacttgcgacggctgcaaattggtgttttgtttggagcatagatcatacaagtcacataactgtccgaaatccgatcatgggagcagaacggtttccatctgtgaaacatgttcaatagcgattgaaacaactggttttgatgaaaaaggaatcaaatctttgcttgagaaacacgaaagatccggagattgtgatccaaacaagaaaaagaaaccaacgtgtcctgtaaaacgttgcaaagagattctgacttttgcgaataaccttacttgcaaatattgtggagtcaagttctgtttgaaacaccggtttccgacagatcatgtctgtaacaagaagatcattaataccgcgggaacaagctcgaggtggaacgagaggtttatggaagctttgagtttaagaaaccagaaagggtgtggaagagggagctctgtttcatcaaaatcttcaccatcagttagatcgttttag

SEQ ID NO: 2116 - DNA, 684 bp, Arabidopsis thaliana
atgaagtcattagcttcgccgccgtgtctccgcctgataccgacggcacaccgtcagctcaattcgcgtcaatcttcctccgcctgttatatacacggtggctcttctgtgaacaaatccaataatctctcattctcctcatccacatccggatttgcgtcaccactagctgtagagaaggaattacgctcttcattcgtacagacggctgctgttcgccatgttacggggtctcttatcagaggcgaaggtcttagattcgccatcgtggtagctcgtttcaatgaggttgtgactaagttgcttttggaaggagcgattgagactttcaagaagtattcagtcagagaagaagacattgaagttatttgggttcctggcagctttgaaattggtgttgttgcacaaaatcttgggaaatcgggaaaatttcatgctgttttatgtatcggcgctgtgataagaggagataccacacattatgatgctgttgccaactctgctgcgtctggagtactttctgctagcataaattcaggcgttccatgcatatttggtgtactgacttgcgaggacatggatcaggctctgaatcgatctggtggcaaagccggcaataagggagctgaaactgctttgacggcgctcgaaatggcgtcgttgtttgagcaccacctgaaatag

SEQ ID NO: 2117 - DNA, 393 bp, Arabidopsis thaliana
atggtgaacgaaacagaagcattaccatgcgagggaggctgtggactctacggcacccgagtgaacaacaatctatgctctctctgctacaaaaagagtgttcttcaacactcgcccgctttaagattcgaacccgagaccgagcaatcacagtgttgccctcctacgaatagtcccgccgttgaagaagaaccggtcaaaaaaaggagatgtgggatatgtaagaggaaggtaggaatgttgggattcaagtgtagatgtggacacatgttttgcgggtcacatcgttatccggaggagcattcttgtccctttgattacaaacaatctggacggctcgccttggccacacagttgcctttgatcagagctgacaagttgcagaggttttag

SEQ ID NO: 2118 - DNA, 735 bp, Arabidopsis thaliana
atggcaaacctcttggtctctactttcatattttccgcacttttgctcatctccaccgcaacagccgccacattcgaaatcctaaaccaatgtagttacaccgtgtgggctgccgcaagccctggaggtggccgacgtctagatgctggccaatcatggaggctagatgtcgcggcgggcactaaaatggcacggatttggggtaggaccaattgtaactttgactcctcaggtcgtggccgatgccaaactggtgactgcagtggtggactccaatgtactggctggggacagccaccaaacacgttggctgagtacgctttgaaccaattcaacaacttagacttctacgatatctcacttgtcgatggatttaacatacctatggagtttagcccaactagttcgaactgccatcggatactatgtaccgcagacataaacggacaatgtccaaacgtgttgagagccccaggtggatgcaacaacccgtgtactgtatttcagacgaaccaatactgttgtacgaacggtcagggatcatgtagcgatactgagtactcaagattctttaagcagagatgccctgacgcttacagctatccacaagatgacccgactagcactttcacttgcaccaacactaactacagggtcgtgttttgtccaaggtctaggctcggtgctactggatcccaccagctcccgatcaagatggtcaccgaggagaattaa

SEQ ID NO: 2119 - DNA, 1437 bp, Arabidopsis thaliana
atgggaactcctgtcgaagtctctaagctccatttcttgctcttccctttcatggctcatggccatatgataccaactctagacatggctaagctctttgccaccaaaggagctaaatccactatcctcactacacctctcaatgccaagctcttcttcgagaaacccatcaagaatctgaatccgggtctcgaaatcgacatccagatcttcaatttcccttgcgtggagctggggttaccagaaggatgtgaaaacgttgatttcttcacttcaaacaacaatgatgataaaaacgagatgatcgtgaaattctttttctcgacaaggtttttcaaagaccagcttgagaaactcctcgggacaacgagaccagactgtcttatcgccgacatgttcttcccctgggctactgaagctgctgggaagttcaatgtgccaagacttgtgttccacggcactggctacttctctttatgcgctggttattgcatcggagtgcataaaccacagaagagagtggcttcaagctctgagccatttgtgattcccgagctccctgggaacattgtgataactgaagaacagatcatagatggcgatggagaatccgacatgggaaagtttatgactgaagttagggaatcggaagtgaagagctcaggagttgttttgaatagtttctacgagctagaacatgattacgccgatttttacaaaagttgtgtacaaaagagagcgtggcatatcggtccgctatcggtttacaacaggggatttgaggagaaggctgagagaggaaagaaagcgaacattgatgaggctgaatgcctcaaatggcttgactccaagaaaccaaattcagtcatttatgtttcctttgggagcgtggctttcttcaagaatgaacagttattcgagatcgctgcagggttagaagcttccggtacaagtttcatttgggttgttaggaaaaccaaagaaaaagaagaatggttaccagaagggttcgaagagagggtgaaaggaaaagggatgattataagaggatgggcaccacaggtgctcatacttgatcatcaagcaacttgtgggtttgtgacccattgcggctggaactcgcttctggaaggagtggctgcagggctaccaatggtgacatggcctgtagcagcggagcaattctacaatgagaaattggttacgcaagtgctcagaacaggagtgagcgtgggagcgaaaaagaatgtaagaactacgggagatttcattagcagagagaaagtggttaaagcggtgagggaggtgttggttggggaagaggcggatgagaggcgggagagggcaaagaagttggcagagatggctaaagctgccgtggaaggagggtcttctttcaacgatctaaacagcttcatagaagagtttacctcgtaa

SEQ ID NO: 2120 - DNA, 447 bp, Arabidopsis thaliana
atggcttccactgctctctccagcgcaatcgtaagcacctctttcctccgccgtcaacagacaccaatcagcctcagatccctcccgtttgccaacacacaatctctcttcggcctcaaatcttccaccgctcgcggcggccgcgtcacggccatggctacctacaaggtcaagttcatcacacctgagggagaacaagaggtcgaatgcgaagaagatgtctacgtcctcgacgctgctgaggaagccggactcgacttgccctactcatgccgtgccggttcttgctcaagttgcgccgggaaagtcgtctctggttctattgaccagtcggaccagagcttcttagacgatgaacagatgagtgagggctatgtcttgacctgtgtggcttatccgacttctgatgtcgtcatcgaaacccacaaagaagaagccattatgtaa

SEQ ID NO: 2121 - DNA, 1839 bp, Arabidopsis thaliana
atgcctgaggcaccaaagaaagaatctttagaggttttcgatctgacgcttgaccaaaaaaacaagcaaaagcttcagttgatcgaagaactcacctctaacgccgaccaagtccaaagacaagtcttggaggagatcttgacccgcaatgctgacgtggagtatctcaggcgacacgacctcaacggtcgcactgaccgtgagactttcaaaaacatcatgcccgttatcacctacgaagatattgagcctgagatcaacaggatcgctaatggtgataaatcacctatcctctcttccaaacccatctctgagttcctcacaagctctgggacatctggtggggagaggaagctaatgccaacaatcgaagaggagctagacaggagatcactcctctacagtctcttgatgcctgtgatgagccagttcgttcctggtctcgaaaacggcaaaggaatgtatttcttgttcatcaagtccgaatccaagactccaggaggcctccctgctcgtcctgtcttaaccagttactacaaatcttcccatttcaaagaaagaccctatgatccttacaccaactacacaagccctaacgagaccatcctttgctctgactcttaccagagcatgtactctcagatgctttgtggcttatgtcaacaccaggaggttcttagagtcggcgctgtcttcgcctctggattcatcagagccatcaagtttcttgagaaacactggatcgagttggtccgtgacatcagaaccgggactctaagttccctgatcaccgatccttcagtgcgtgaggcggtcgccaagatccttaaaccgagcccaaagctagctgatttcgtggaatttgagtgcaagaagtcgtcctggcaagggattattactaggctgtggcctaacacaaagtatgtggatgtgattgtgaccgggacaatgtctcaatacattccaactttggactactacagtaatggcttgcctcttgtctgcacaatgtatgcttcctctgagtgttactttggtgtgaatctaaggccactctgcaaaccaagcgaggtctcttacacgctcataccatccatggcttatttcgagttcttgcctgttcatagaaacaacggtgttactaactccatcaaccttcctaaagcactcactgagaaagagcaacaagagcttgttgatctagttgatgtcaagcttggtcaggaatacgagcttgttgtcaccacttacgccgggctttgcagatacagagttggtgatttattgagagtgactggtttcaagaacaaagcgcctcaattcagtttcatatgtcgcaaaaatgtggtcttgagcatagattccgacaagaccgacgaggttgagcttcagaacgcggtgaagaacgcagtgacacaccttgtcccatttgatgcctcactctctgagtacacgagctatgcagacacaagttccatcccaggccattatgtcctgttttgggagctatgtttggatggaaacacaccgatccctccttcggtcttcgaggactgctgcttagctgtagaagagtcattcaacactgtttatagacaaggaagggttagtgacaagtccataggcccgcttgagatcaagattgttgagccagggacattcgataagctcatggattacgcaatcagcttgggagcatcgattaatcagtataagacgccgagatgcgtgaagtttgctccaattatcgagctattgaactcaagggttgttgatagttacttcagccccaagtgtcctaaatgggttcctggtcacaaacagtgggggagtaactaa

SEQ ID NO: 2122 - DNA, 357 bp, Arabidopsis thaliana
atggagggactcttgaagttgtcaactttggtgattgtgtgcatgttagtgaccgctccaatggcgtccgaggcagcaatctcgtgcggcgcagtcaccggcagcttaggtcaatgctataactacttgacccgaggcggtttcattcctagagggtgttgctctggcgttcagaggctcaacagcttggctcgtaccacccgtgaccgccaacaagcttgtcgttgtatccagggagcagcgagagccttgggttctcgacttaacgctggtcgtgctgctcgtctccctggtgcttgccgtgttaggatctcttaccccatcagtgccagaaccaactgtaacaccgtcaggtga

SEQ ID NO: 2123 - DNA, 825 bp, Arabidopsis thaliana
atgggttttgatgatacatgcaacacaggtcttgttcttggattaggtccctcaccaattccaaataattacaatagtaccatcagacaatcctccgtttacaagctcgagccgtcgttgactctatgcctctcgggcgatccctcggttaccgtggtgaccggagctgaccagctatgccgtcagacgtcatctcacagcggagtctcttctttctcaagcgggagggtggtgaaaagagagagagacggtggcgaagagtcgccggaggaggaagagatgacggagagagttataagtgattaccatgaagatgaagaaggtattagtgctagaaaaaaacttaggcttacgaaacaacaatctgctcttcttgaggaaagcttcaaggatcatagcacccttaatcccaaacaaaagcaagttctggctagacagctgaatctaaggcctagacaagttgaagtatggtttcaaaatagaagagccaggacaaagctgaagcaaacagaagtagattgtgagtttttgaagaagtgttgtgaaacattagcagatgagaacataagacttcagaaagagattcaagaactcaaaaccctaaaattgactcagcccttttacatgcacatgcctgcatcgactctaacgaagtgtccttcttgtgagagaatcggcggcggcggcgggggtaatggaggaggaggtggcggcagcggggctaccgcggtgattgtagatggaagtacggccaaaggagctttctctatctcctcaaagcctcacttcttcaacccttttactaacccatctgcagcttgttga

SEQ ID NO: 2124 - DNA, 1509 bp, Arabidopsis thaliana
atgacgatcttgctctgtttcttcttagtttcacttcttactatcgtatcatcaatctttcttaaacagaataaaacctcaaaattcaatcttcccccaagcccttcaagccttccgatcattggaaacttacaccatctcgcaggattgcctcacagatgttttcataagctctctatcaaatacggacccttggtctttcttcgtctcgggtctgttccggttgttgtgatctcatcgagtgaagcagctgaagcagttctcaaaaccaatgacttggaatgttgcagccgaccaaagacggtggggagcggaaaactctcttacggtttcaaagacatcactttcgcaccatacggtgagtattggcgagaagtgcgaaaactcgcggttatcgagctttttagctctaaaaaggttcaatctttcaggtatataagagaggaagaggtcgacttcgtggtcaagaaagtgtcagaatcagctttgaagcaatctcctgtggatttaagcaaaacctttttctccctcaccgctagtatcatttgtagagtcgccttaggacagaatttcaatgaaagcggctttgttatcgatcaagacaggatcgaagaacttgttaccgaatcagcagaagctctagggactttcactttctctgacttcttccctggtggacttggaagatttgtagattggttgtttcaacgacacaagaagatcaacaaagtctttaaggaacttgatgctttttatcagcatgtgattgatgatcacttgaagccagagggaagaaagaatcaagatattgtcaccttgattttggatatgatcgataaacaagaagattcagattctttcaaactcaacatggataatctcaaggcaattgtcatggatgtatttctcgcggggatagatacaagcgcggtaacaatgatttgggcgatgacagaacttattagaaaccctagagtgatgaagaaggctcaagaaagtattcgaaccactctgggtctcaagaaggaaagaatcactgaagaagatttaggcaaagttgagtatttgaaccacatactcaaggaaacttttaggttacacccggcacttccatttgtggtgccaagggaaacaatgtctcacatcaagatccaaggctatgatattccaccgaaaacacaaatccagcttaacgtgtggacgatcggacgtgaccctaagcgttggaatgaccctgaagaattcaaccctgaaaggtttgcaaatagctctgtagattttagaggacaacattttgacctattaccgtttggttctggtcgaaggatttgtcccggaatgccaatggcgattgctagtgtggaactagcattgatgaatttgctttattattttgattggagtatgcctgatgggactaaaggtgaagacattgatatggaagaagctggtaatatctctattgtcaagaaaatacctcttcaacttgtgcctgttcaacgttattga

SEQ ID NO: 2125 - DNA, 798 bp, Arabidopsis thaliana
atggagttcgaaaggtatctgggggaaggttcgtttggatcggtgagccttttcagttataaaagacgatgcgacgttgagactctctacgccgccgtgaaaacctctgacgatgctaagtctctctacgaagagtttcagattctgtctaaattcaagggttgctcgagaatcgtccaatgctacggtagcggagtagaacagagacttaacgacaagggttacgtagagtacacgattcctatggagtacgcagccggaggaagcttgagcgatttcatggaccgattcaacgacaaaaaattgcctgatccgatgatcagaaagtttactcgtatgcttctcgagggtttagccacaattcacagacacggctatgttcactgcgatctcaaacccgagaacatccttgttttccctggttctgtctgcgatctcaaattgaagatttctgattttgggttgtcgaaaagagatggagacactacgtggtggcatcctcttaaatcgtatgcgggaacaccgatctatatgtcgccggagtctatctctcacggggagatagggaaaggacttgacttatggtcgttgggatgtgttgtgttggagatgtacactgggaagagaccatggtggcatactaactatgaactagaagatctcatgaagtgttacgagccattgtttccgcctaatcttccttgtgatgcaaaactctttctcatgacctgctttgcgcctgaaccagatgagaggaaagacgcgttgacattgttgagacaaagcttctttcgttga

SEQ ID NO: 2126 - DNA, 1059 bp, Arabidopsis thaliana
atgacccggtccgtcagtttccctctcttcctcttcgccgttgtactctccctctcttcttctctcctcgccgacgatcccaaaccaatccgccgtgaggtctacgaaggaggtaagatatacgacatcagccatcgttacacgccggagattccagcttgggaatcttcggaaggattgggaaagacgttcctgcgattagccgcgagtatgaagaatggatcattcgctaacgtatcggagatgaaactatctgttcactctggaactcacgtggatgctccaggtcacttttgggataattattacgatgctggttttgatactgattcgcttgatctccaagtcctaaatggtcctgctttgttggttgatgttccgagagataagaacattactgctgaggtaatggaatcacttcatatacaaagaggagttcgtcgtgtgctctttagaacatccaacaccgacaacttgtattacacatttttttctgaaaccggttattctgcattgtggaatccagggcttgattatctttcatttgctgcttttgaggaatcacctgcaacacacagggttatacttaaaggacggcggtattcactggacaagaaagtgagagagataggtaggcttaaaagggagatgaactacgtcttaacacgtgagatacacatgttttcaggatataatcccagtggaagcgctgaagctggatggtgtggaggtaggaacatactcgcttcattgcttaccgctgagattagttggagcggaaggagcaccgacaagatgcattctcatcaagtgattcagggaaaaaggaaacacaatctgtgtgttttggttgtattccattatattgaaagagacatgcaagtcccatctagcttgcaaaaagctagcgtacttagcaccaaggagaagcctctgaatgcacaagagagcgttctcgtggttcatcagttgaatgataatagaagtgaaccagctctgcttaccactaaaattagattgttagatgttgccaaacgaattgcaaaagaaaaatcataa

SEQ ID NO: 2127 - DNA, 1344 bp, Arabidopsis thaliana
atggccacacatgcagctctcgccgtctcaagaatcccggtcacacagcgactgcagtctaagagtgccattcactctttccctgctcaatgctcctccaagaggctagaagtcgctgaattctccggtctgcgtatgagtagtatcggtggggaagcatctttcttcgatgctgtagctgcacaaatcatccctaaggctgtgacaacatcaactcctgttagaggagagacagtggcgaaactgaaagttgcgattaacggttttggaaggattggtaggaactttcttaggtgttggcatggtcgtaaagactctcctctcgaagttgttgtacttaacgacagtggtggtgtcaagaatgcatcccacttgcttaagtatgactccatgcttggaaccttcaaggctgaagtgaaaattgtggacaatgaaactattagtgttgatggtaagctcatcaaagttgtctccaacagagaccctcttaagcttccatgggctgagctcggcattgacattgttatcgagggaacaggagtgtttgttgatgggccaggagcagggaagcatatccaagccggagcctcgaaagttatcatcactgcaccagccaaaggtgctgatatccctacctatgttatgggagtcaatgagcaagactatggtcacgatgtcgctaacattattagcaatgcatcttgcaccaccaactgtttggcaccttttgctaaagtcttggatgaagaatttggaattgtcaaggggacaatgacaaccacacactcctacaccggagaccaaaggcttctagatgcatcacacagggacctaaggcgtgcaagagccgcagcactgaacatagtgcctaccagcacaggagcagccaaggcggtgtcattagtgttgccgcagctgaagggtaaacttaacggcattgcactccgtgtgccaacaccaaacgtctcagtggttgaccttgttataaacgttgagaagaaaggtttgacagcagaggatgtgaacgaggcctttagaaaagccgctaatggaccgatgaaaggcattttagacgtttgcgatgcgcctcttgtctctgttgacttcaggtgctctgatgtctctaccaccattgactcgtccctcactatggttatgggtgatgatatggtcaaggtggttgcttggtatgataacgagtggggttacagccaaagagtggtggatttggctcacctagtggctagcaagtggccgggagcggaagctgttggaagtggagatcctttggaggatttctgcaagacaaacccggctgatgaggaatgcaaagtctatgactga

SEQ ID NO: 2128 - DNA, 1086 bp, Arabidopsis thaliana
atggcgaaatctcagatctggtttggttttgcgttactcgcgttgcttctggtttcagccgtagctgacgatgtggttgttttgactgacgatagcttcgaaaaggaagttggtaaagataaaggagctctcgtcgagttttacgctccctggtgtggtcactgcaagaaacttgctccagagtatgaaaagctaggggcaagcttcaagaaggctaagtctgtgttgattgcaaaggttgattgtgatgagcaaaagagtgtctgtactaaatatggtgttagtggatacccaaccattcagtggtttcctaaaggatctcttgaacctcaaaagtatgagggtccacgcaatgctgaagctttggctgaatacgtgaacaaggaaggaggcaccaacgtaaaattagctgcagttccacaaaacgtggttgttttgacacctgacaatttcgatgagattgttctggatcaaaacaaagatgtcctagtcgaattttatgcaccatggtgtggccactgcaaatcactcgctcccacatacgaaaaggtagccacagtgtttaaacaggaagaaggtgtagtcatcgccaatttggatgctgatgcacacaaagcccttggcgagaaatatggagtgagtggattcccaacattgaaattcttcccaaaggacaacaaagctggtcacgattatgacggtggcagggatttagatgactttgtaagcttcatcaacgagaaatctgggaccagcagggacagtaaagggcagcttacttcaaaggctggtatagtcgaaagcttagatgctttggtaaaagagttagttgcagctagtgaagatgagaagaaggcagtgttgtctcgcatagaagaggaagcaagtacccttaagggctccaccacgaggtatggaaagctttacttgaaactcgcaaagagctacatagaaaaaggttcagactatgctagcaaagaaacggagaggcttggacgggtgcttgggaagtcgataagtccagtgaaagctgatgaactcactctcaagagaaatatcctaaccacgttcgttgcttcttcttaa

SEQ ID NO: 2129 - DNA, 1056 bp, Arabidopsis thaliana
atggtggaattggagattgtgtggttggttagaggcgcttggatcactgtttggatcgtctctatacttcctttggtgattgcttcgatacccacttcaaagctcaactcttttcgtgaactcgttttgagtttcgctggtagaggcaagattcttcacccttcttctcagatgtgtaattctctctatatgcagaagtttacaattcctcagaaatgctttgcacacttttatgttattggagtggtgtggacaactctcctgcttgctgcaacttggatgtatgcttgcaaaatggcgcctttatcttctgaggagttccagttatccgacattgcaagccgtttagccggaggttcagatgttttctccgttcataaatctaatatgactcctgtcgagcatcggtttaaagtgtggcgagcggtgtttctacttcttctgatggagatccatgtcttgagacggcttatagagtcattctatgttttcaaatatagcccttctgctcggatgcacattctcggttatttcgcaggattgtttttctatgtaacagctcctttgtcactctgctccaatatagctccagaggtagcaggattcgtaggaaatcaagtggctgagttcattgctaatgggaaaagccatacttcagcacctgaatttaacttgttatcatctataagtcctttgatgaagcttggatcactccagtggattggtggagccatttttctttggggatggatacatcagcgccgctgtcacgccattcttggatcgctccgggaaaatccgagccaagcgaaagagtacattattccgtatggagattggtttgggatggtgtcttctccacatttcttggcagaaattgttttgtatgcgggtttactgattgcgagtggaggaacagatataaccatctggttactctttggttttgtggctgctaatctgacatacgcggctggagaaacgcaccgttggtatctccggaagtttgagaattatccggctaatcggcatgccattttcccttatgtctactaa

SEQ ID NO: 2130 - DNA, 921 bp, Arabidopsis thaliana
atgaccacgttattcctccttattgctctattcatcacaaccatcctcaacccaacaagtggagaatcagtaggtgtatgctatggaatgatggggaacaaccttccttctcaatcagacacaatcgctctctttagacaaaacaacatccgacgtgttagactctacgatccaaaccaagccgctttaaacgctcttagaaacacgggtatcgaagtcatcatcggcgttccaaacaccgatcttcgttcactcactaacccttcttccgctagatcatggctccaaaacaacgtcctcaactattaccccgccgttagcttcaagtacatcgccgtaggtaacgaagtatctccgtcgaacggcggtgatgttgtgctccctgccatgcgtaacgtttacgatgctctaagaggtgcaaatcttcaagatcgtattaaagtttctaccgccattgatatgactttgattggaaactctttccctccttcctccggagagtttcgtggtgacgttagatggtatatcgatcccgtcatcgggtttcttacgagtacgaactcagcgttactagccaacatctatccttacttcagctacgttgacaatccacgtgacatatctctctcttacgctctcttcacttctccttccgtcgtcgtatgggacggctctcgtggctaccaaaacctctttgacgctttacttgacgttgtttactctgccgttgaacgctcaggcggtggatctctcccagtggttgtttccgagagcggatggccttctaacggtggaaacgccgcgagtttcgataacgcgcgaagctttttacacgaatcttgcgtcgcgtgtgagagagaacagaggaacaccgaagagacctggaagaggagtggaaacgtatttgttcgctatgtttga

SEQ ID NO: 2131 - DNA, 819 bp, Arabidopsis thaliana
atggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttag

SEQ ID NO: 2132 - DNA, 2157 bp, Arabidopsis thaliana
atgaatccccaaagaaacaaattcgtaaggtttgtatcaattcttccttttgatttaataattacgatgtttaatggaaatgatgatgagttttcgaccaaaactactagaccatcagtatcttcagttatgaaaaccgttagacgaagcttcgaaaaggggtcagagaaaatcagaacctttaagcggcccttaagcgttcattcaaataagaataaagaaaataataagaagaagaagatactaagagtgatgaatccgaacgattcatatcttcaaagctggaacaagattttcttgcttctctctgttgtggctttagcctttgatcctctgtttttctatatcccctatgtgaagcccgagcgattttgtcttaatctagacaagaaactccagacaatcgcttgcgttttccgcactttcatcgacgctttctatgtggttcacatgctgtttcagtttcataccggtttcatcactccttcttctagtggtttcggcagaggagagcttaatgagaaacataaagatatcgctttaagatacctcggctcatactttctaatcgatcttctttcgattctccctattcctcaggtagttgttctagctattgttccaaggatgagacgacccgcgtcgctagtagcaaaagagctactgaaatgggtaatcttttgccaatatgttccgaggatagcgagaatctatccgcttttcaaggaagtaacaagaacttctggtttggtaactgaaactgcttgggctggtgctgctttaaacctattcctctacatgttagctagccatgtttttgggtctttttggtacttgatttcgatagaaaggaaagatagatgttggcgtgaggcgtgtgctaagatacagaattgcactcatgcatacttatactgttcaccaacaggggaagacaataggttatttttaaacggttcttgtccgttgatcgatcccgaagaaatcacaaactcgacggttttcaactttggtatattcgctgatgcattgcagtctggagttgtggagtctagagatttccctaagaagtttttctactgtttctggtggggtctccgcaatcttagtgctttgggccaaaacttgaagacgagtgcctttgaaggagagatcatttttgcaatagtcatttgtatttctggactagtcttgtttgctctcctcattggaaatatgcagaaatatttgcaatcaactactgtaagagttgaggaaatgagagtgaaaaggagagatgcagagcaatggatgtctcatcggatgttgccagacgatctgagaaaacgtatccgtaaatacgaacagtataaatggcaagaaaccaaaggagttgaggaagaagctcttctctctagtcttccaaaagatctcagaaaggacattaaacgccatctttgtctcaagttgctcaaaaaggtgccttggttccaagctatggatgatcggttactagatgctctatgtgctcgtctcaaaacggttctttatacagagaagagttacattgtgcgtgaaggtgaaccagtggaggatatgttgtttataatgagaggaaatttaatcagcaccactacttatggtggcagaactggtttcttcaattctgttgacttagttgctggtgatttctgtggagatcttctcacttgggcattagatcctctcagttcccaattccctatctctagtagaaccgttcaagctttgacagaagtcgaaggctttcttctctcagctgatgatctcaagtttgtcgctactcagtatcgtcgcctccatagcaagcaactccgacacatgttcaggttttattcagtgcaatggcagacatgggcagcatgttttatacaagcagcatggaagagacattgtagaaggaagctctcaaaggctttacgtgaagaagaaggcaaactacataacactcttcagaacgatgattcaggaggcaataaacttaacttaggtgctgcgatttatgcgtcgaggtttgcttctcatgctctgaggaatctaagagcaaatgcagcagcccgaaattctagattcccgcacatgttaactttgttgcctcagaaaccagccgatcctgagtttcctatggatgaaacctag

SEQ ID NO: 2133 - DNA, 591 bp, Arabidopsis thaliana
atggcggcgtcaatgacgaaacccatctcaataacttctctcggtttctattctgatcgaaagaacattgctttctctgattgcatttcgatttgttctggattcagacattcccgaccatcttgcctcgatttggtcacaaagtcaccgagtaataacagtcgtgttttacctgtcgttagtgcccaaatatcttctgattatattccagactcgaaattttacaaggtggaagcaattgtcagaccatggagaatccagcaagtttcatcggctttactgaaaatcgggattcgaggtgttactgtttctgatgtgagagggtttggtgcacaaggaggttctaccgagagacacggtggctctgagttctcggaagacaaatttgttgctaaagttaagatggaaatcgttgttaagaaagaccaagtggaatctgtaatcaacacaataattgaaggagcaaggacaggagagattggtgatggcaagatttttgttttgcctgtgtcagatgtcataagagttaggacaggtgagcgtggggagaaagcagagaagatgactggtgatatgctttcaccgtcttag

SEQ ID NO: 2134 - DNA, 1923 bp, Arabidopsis thaliana
atggtggtcaaaaggaagttaaattgtggtggctctaatggttttgatttccccaatattcccaaggctcctcgttcaagcaggaggaaggtctcaggtaagagatctgatgatgaaagtgagatctgtgcaattgatttgctagcttctcttgctggaaagttgttggaagaaagtgaaagttcctcaacgtctacctatgcatctgaagctgataatcttgatcatttgggtggactgattaagcaagaacttgaagatggctatactactaagccttgtaaatccgagtttttcgatccaggaaaccctgcttcaaagtctactagtgaaaatactagcgtgacttgtttgccattttcgtctttcgaaaatgattgcattttggagcaaacaccggtttctgattgtaagagggcatctggtttgaagtccctggtagggagcatcactgaggagacatgtgttgttaatgaggatgccggatctgaacaaggtgctaatactttcagcttaaaggatccaagtcaattacattcgcagtctccagaatcggtccttctggatggcgatgtgaaattagcaccatgcacggatcaagtccctaatgattcttttaaaggatataggaatcattctaagttagtttgcagagatgatgacgaaaactattgtaagtattataaatttagtgacaaatgtaagtcatataggcctctctcccgggttggcaatagaagaataatgcagtcggtgagagcaatctccaagttgaagtgttttgaagacactagaacagatggtcgtttgaaggctctctaccgcaagagaaaattatgttatggttacaacccatggaagcgtgagaccattcataggaagagaagattgtctgacaaaggtttggtcgtaaattatgatggtgggctcagtagtgaaagtgtttccaattcacctgaaaagggagaatcagaaaatggtgatttctctgctgcaaaaataggtcttctttcgaaagactcccgtgtaaagttcagcatcaagtcccttaggattccggagcttgtaattgaagttccagaaacagcaacagtaggcttactgaagaggacggtgaaggaggcggttactgctttactcggtggtggaatacgtattggggtgttagtccaagggaaaaaagttagagatgacaacaacactctatcacagactggtctttcgtgtagagaaaatcttggcaaccttggcttcaccttagagcctggtttggaaacactgcctgtacctctttgttctgaaactcctgtcctttctctgccaactgactctacaaagttgtcagaaaggtccgcagcttctccagcgttagagactggaattcctctccctccccaagatgaagattacttgattaatttgggaaatagtgtggagaacaatgatgaattagtcccacatctgagtgacataccagctgatgaacaaccttcatcagattcaagagcgctggttccagttttggccttggaatccgacgctcttgcacttgttccagttaacgagaaacctaagcgtacagagctttcacaacgcagaaccaggagaccattctctgttacagaggtagaagctctagtaagcgcagttgaagaagttgggactggaagatggcgtgatgtgaagttgcgttcttttgagaatgcaagtcatcgaacctatgtggacttgaaggacaaatggaaaacgttggttcacacagcaagtatatcaccacagcaacgaagaggagaaccagtgcctcaagaactgctagacagagtcttaggagcacataggtactggacacagcaccaaatgaaacagaacgggaaacatcaggtggctacaacaatggtggttgaagcaggttcgtccatgtaa

SEQ ID NO: 2135 - DNA, 243 bp, Arabidopsis thaliana
atgtcaaaagaagctgagtaccatccagaaagttatggaccaggaagtctgaaatcataccaatgtggaggacaatgcacaaggagatgtagcaacacaaagtatcataagccatgcatgttcttctgccaaaagtgttgtgctaaatgcctttgtgtccctccaggcacgtacggcaacaaacaagtgtgtccttgttacaacaactggaagactcaacaaggtggaccaaaatgtccataa

SEQ ID NO: 2136 - DNA, 1530 bp, Arabidopsis thaliana
atggccttcttctccatgatctccattctccttggctttgttatctcctccttcatcttcatcttcttcttcaagaaacttctctccttctccagaaagaacatgtctgaagtctccactctcccctctgttccagtggtaccagggtttcctgttattgggaacttgctgcaactaaaagagaagaaacctcacaagactttcactagatggtcagagatttatggtcctatttactctataaagatgggttcttcttctcttattgtcctcaattctactgagactgccaaagaggccatggtgacgcggttttcgtctatctcaacgaggaagttgtcaaatgcgttgacagtccttacttgtgacaaatctatggttgctactagtgattatgatgatttccacaagttggtgaaacggtgtctcttgaacggtcttttgggtgctaatgcacagaaacgaaaaagacattacagagatgcactcattgaaaatgtgtcttccaagttgcatgcccatgctagggaccatccacaagaacctgtaaacttcagagctatatttgagcatgagcttttcggtgtagcattgaagcaagcttttgggaaagatgtggaatccatttatgttaaagaactcggtgtgactttgtcgaaagacgagatcttcaaggttttagtacatgacatgatggaaggtgcaattgatgttgattggagagacttcttcccatacttgaaatggattccaaataaaagttttgaagcaagaatccagcaaaagcataaacgtagactcgcagtgatgaatgctctgattcaagatcgactgaagcagaatggttcagaatcggatgatgattgctatctcaacttcttgatgtcggaagcgaaaacactaaccaaggagcaaattgctatcttggtttgggagacgattatcgagacagctgacactactttggttacaactgaatgggccatctatgagctcgctaagcatccaagtgtccaagatcgtctgtgcaaagaaatccaaaatgtctgcggaggagaaaagttcaaagaagagcaattgtctcaagttccttatctcaatggagtctttcatgaaacgcttaggaaatacagtcctgctcctctagttcccattcgctacgcccacgaggatacgcaaatcggaggctatcatgtccctgcaggaagtgagattgcaataaacatatatggatgcaacatggataagaagcgttgggagagaccagaggactggtggccggagcggtttcttgatgatggcaaatatgaaacgtcagatcttcacaagacaatggcgtttggagcgggaaagagggtttgtgctggtgctcttcaagcatctctcatggcaggcattgctattggaagattagtgcaagaattcgagtggaagcttagagatggcgaagaagagaatgtggatacatatggcttgacctctcagaagctttatcctcttatggctattatcaatccaaggcgttcttaa

SEQ ID NO: 2137 - DNA, 1344 bp, Arabidopsis thaliana
atggcgttacaaaggcaactcctgaagagagctacttccgatatctatcaccgccgtgcgatctctctcctccgtactgatttctctacttctccttcgattgctgatgctccgccgcacattccgccgttcgttcaccagccacggccgtataaaggtccttccgccgatgaggttttacagaaacggaagaagtttctcggaccttctcttttccactactaccagaagcctcttaacatcgttgaagggaagatgcagtacttgtatgatgagagtggtaggcgatatctggatgcctttgctggaatagtcactgtgtcgtgcggtcactgccatccggatattcttaatgcgattacggaacagagcaagctacttcagcacgcgactactatttacctgcatcatgccattggtgattttgctgaagcattggctgccaagatgcccggaaatcttaaggttgtgtactttgtgaattctggctcagaagctaatgagctagcaatgatgatggctaggctttacactggtagccttgagatgatttccttgagaaatgcttatcatggtggaagttccaatactattggactaactgctcttaacacatggaagtacccattacctcagtatggtacctctggaaaagtagctggatttatcgcagagaccatccagggggtcggaggagctgtagaattggctcctggttacttaaagtcggtttatgaaattgttcgcaacgctggtggtgtatgcattgctgatgaagtccaaactggatttgggcgaacaggaagccactattggggtttccagactcaagatgtggttcctgacatagtcacaatggcaaagggaattggaaatggattgccattaggagctgtggtgactacaccagaaatcgcaagtgttttagctagcaagattctgttcaacacttttggtgggaacccggtttgttcagctggtggacttgcggttctaaacgttattgataaggagaaacgccaagaacattgtgctgaagttggttcacaccttatacaacgtttgaaagatgtgcagaaaagacatgatatcattggagacgtgagaggaagagggttaatggttgggattgagcttgtgagtgaccggaaagacaagacaccagccaaggctgaaacatctgtcttgtttgagcaacttagagaacttggcattctcgtcggaaaaggaggacttcatgggaacgttttcaggataaagccaccaatgtgtttcactaaagatgatgcaggtaaattcttaatgcattggactattccatctccaggttgtgaacaaggatga

SEQ ID NO: 2138 - DNA, 960 bp, Arabidopsis thaliana
atgggaaaatcttcaagctcggaggaaagtgaagtgaagaaagggccatggactccggaggaagacgagaagctcgtaggctatattcaaacgcacggtcccggcaaatggcgtacccttcccaagaacgccgggttaaaaagatgcgggaagagttgtagattgcgatggacgaattatctaagacccgatatcaagagaggagagttctctcttcaagaggaagaaaccatcattcaacttcatcgtcttcttggaaacaaatggtccgcaattgctattcacttaccaggaagaacagataatgaaatcaaaaactattggaacacacatattaaaaagaaactcttacgaatggggattgatccggtgactcattgtccccgcattaatcttctccagctctcttcgtttcttacctcatcattgtttaaatctatgtcacaaccgatgaatactccatttgatctcactacttcaaatattaatcctgatatcttgaatcatctcactgcctctctcaacaacgttcagaccgaatcataccaaccaaaccaacagcttcaaaacgacctaaacactgaccaaaccactttcaccggtttgctcaactcaacaccacccgttcaatggcaaaacaatggagaatacttgggagattatcacagttataccggtacaggtgatccatctaataacaaagtccctcaagccggaaactactcatcagccgcatttgtatccgaccacattaatgatggtgagaattttaaggccggatggaatttcagttcatcaatgctagcgggaacttcatcgagcagctcgacaccgttgaattcgtcttcgactttttatgtcaatggtggaagcgaagatgatagagagagttttggtagcgacatgttgatgtttcatcatcatcatgatcataataataatgctttgaatctatcataa

SEQ ID NO: 2139 - DNA, 954 bp, Arabidopsis thaliana
atggaacaaattcacggcggcgattcgaattccggcggcggaggaggaggaagtagccggaacgatgagatttctgtgacgagagcgtcgcgtttcgatgcattgccggaagattgtatctcgaaggtgatttcacatacgagtcctcgggacgcttgtgttgtggcttcggtttcgaaatcggtgaaatctgcggcgcaatcggatttggtttgggagatgtttcttccgtcggagtactcgtctcttgttcttcaatcagcgaatcatttatcgaaaaaggagatctttttatctctcgctgataactctgttttggttgaaaatggcaaaaagagcttttgggtggagaaagctagtgggaagaagtgttatatgttatcagcgatggaattgacgatcatttggggagattctcctgcttattggaaatggattacagttcctgaatctaagtttgagaaagtagcggagttgcgtaatgtgtgttggtttgaggttcggggaaagataagttgtggaatgttatcaaaagggactcattactcggtttacgtagtgttcaagacagcaaatggtagatcatatgggtttgatctcgtacctgtggaagctggagttggttttgtggggaaagtagctaccaagaagtcagtgtattttgaatccggtaatgcggattcacggagcgctacttcccattactcggggatttcagaagaagaagaagaagttgaaggagaaagggagcgtggtatgaatgtggtggggccaaaggagagagtagatgggtggagtgaagtggagcttggaaagttttacattaacaatggaggttgtggtgatgatggtagtgatgagattgagattagtataatggagactcagaatggaaattggaagagtggtttgattattcagggaattgagatcaggcctgaaagaagcaactga

SEQ ID NO: 2140 - DNA, 1074 bp, Arabidopsis thaliana
atggatcgaccagcagtgagtggtccaatggatttgccgattatgcacgatagtgataggtatgaactcgtcaaggatattggctccggtaattttggagttgcgagattgatgagagacaagcaaagtaatgagcttgttgctgttaaatatatcgagagaggtgagaagatagatgaaaatgtaaaaagggagataatcaaccacaggtccttaagacatcccaatatcgttagattcaaagaggttatattaacaccaacccatttagccattgttatggaatatgcatctggaggagaacttttcgagcgaatctgcaatgcaggccgcttcagcgaagacgaggcgaggtttttcttccagcaactcatttcaggagttagttactgtcatgctatgcaagtatgtcaccgagacttaaagctcgagaatacgttattagatggtagcccggcccctcgtctaaagatatgtgatttcggatattctaagtcatcagtgttacattcgcaaccaaaatcaactgttggaactcctgcttacatcgctcctgaggttttactaaagaaagaatatgatggaaaggttgcagatgtttggtcttgtggggttactctgtatgtcatgctggttggagcatatcctttcgaagatcccgaggaaccaaagaatttcaggaaaactatacatagaatcctgaatgttcagtatgctattccggattatgttcacatatctcctgaatgtcgccatttgatctccagaatatttgttgctgaccctgcaaagaggatatcaattcctgaaataaggaaccatgaatggtttctaaagaatctaccggcagatctaatgaacgataacacgatgaccactcagtttgatgaatcggatcaaccgggccaaagcatagaagaaattatgcagatcattgcagaagcaactgttcctcctgcaggcactcagaatctgaaccattacctcacagatgacgatatggaggaagacttagagagcgaccttgatgatcttgacatcgacagtagcggagagattgtgtacgcaatgtga

SEQ ID NO: 2141 - DNA, 1599 bp, Arabidopsis thaliana
atgggtctttctctttctttgctcttgtctgcttggaaagaagttgtgacgacccagttcttcagtttcaagaaccctgtcgagagttttcttgaaaccagatctttcagcttaaaacttaaagaaggaggcttgacttcaagaaccaacagtttcaagagtgagaacccgcaggaaaagtctccgaagacgggtatggagcggtctttgagcttcaacagctgggagattgtgacagaagttgagactgaaccgatgaacaaggaagatgaggagattgttgaaccgacgaagcctgctcgtaacagtttgaatggaaggaactgtgagagaatccaaataacgaagcctactattactccacctacgccttttgtgttcttctctccaagaccggtcaccgagcttgatgcagctgcaactacgttacagaaggtgtacaagagttacagaacaagaaggaacttagcggattgcgcggttgttgttgaggagctctggtggaagactctggatgctgcagctttaaatttgagctcagtcgccttctttgaagaagagaaacatgaaaccgcggtttcgaagtgggcacgagctaggacacgagctgctaaggttggaaaaggattgtcaaaagatgaaaaagctcaaaagttagctcttcagcattggcttgaagctattgacccacgccatcgttatggccacaacttgcacttctattatgatgtctggtcagcaagcatgagcgcacaaccattcttctactggttggacattggcgatggaaaagatgtgaatcttgaacaccacccaagaagtgttctgcaaaaacagtgcattaaatatctaggaccactggagagagaagcatacgaagtgatagtagaagatggaaagctaatgaataaacaaagcatgactctgatcaattcaacagaggattccaagtcaatttttgtacttagcacaactagaaccttatacgtagggcagaagaagaaaggtcgtttccaacattcgagtttcttgtctggaggtgccacaactgctgcaggaagattggttgctcgcgaggggatcctcgaggctatatggccatacagtggacactacctcccaacagaagacaacttcaatgaattcataagtttcctggaagagaacaatgttgatatgaccaatgttaagagatgctctgtgaatgaggaatattcgtcattcaattccagtggctacgaagaagaagcaacaaaagaagaagaagcagagaagaaaccagcagaaaccatcgttacagaggaacaagaagaagagaaagagagagaaagaccggtgttccagcttgcaaagaggctgtcttgcaaatggaacagtggagttggtccaagaattgggtgtgttagagattatccaatggaacttcagtcacaagcgttcgaacaagtcagtttgtctcctcggatttcgcctggttctacacgttttccgtcaccatacggcccaattccttctccaaggcctagtcctagagtaagagtctctccacgcttagcatacatgggaatcccaagccctagagttcaagtaaactgttag

SEQ ID NO: 2142 - DNA, 1923 bp, Arabidopsis thaliana
atggaatctggtttctccggcggtggtggtgggtcggatttttacggcggtggtggtggtagatctatacctggaggtccaggaactgttatcaacgtcggtaacaataatcctcagacgacgtatagaaaccagattcctggaatcttctttgatcagatcggaaacagagtcgccggcggtaatggattctccgggaaaaggactttagcagattttcaagcggctcagcaacatcaacaacaacaacaacaacaaccgttttatagtcaagcagctctcaacgcttttctttcaaggtctgtgaagcctcgaaattatcagaattttcaatctccgtcgccgatgattgatctcacgtcggtgaatgatatgagtttgtttggtggttctggttcatctcagcgttacggtttaccggttcccaggtctcagacgcaacagcaacaatcggattacggtttatttggtgggatccgaatgggaatcgggtcgggtattaataattatccaacattaaccggcgttccgtgtattgaaccggttcaaaaccgggttcatgaatcggagaacatgttgaatagtttaagagagcttgagaaacagcttttagatgatgacgatgagagtggtggtgatgatgacgtgtcagttataacaaattcaaattccgattggattcaaaatctcgtgactccgaacccgaacccgaacccggttttgtctttttcaccgagctcttcttcttcgtcttcttcgccttctacagcttcgacgacgacatcggtatgttctaggcaaacggttatggaaatcgcgacggcgatcgcggaagggaaaacagagatagcgacggagattttggcgcgtgtttctcaaacgcctaatcttgagaggaattcagaggagaagcttgttgatttcatggtggctgcgcttcgatcgaggatagcttctccagtgacggaattgtatgggaaggagcatttaatctcgactcaattgctctacgagctctctccttgtttcaaactcggtttcgaggccgcgaatctcgccattctcgacgccgccgataacaacgacggtggaatgatgataccgcacgttatcgatttcgatatcggagaaggtggacaatacgttaaccttctccgtacattatccacgcgccggaatggtaaaagtcagagtcagaattctccggtggttaagatcaccgccgtggcgaacaacgtttacggatgtttagtcgatgacggtggagaagagaggttaaaagccgtcggagatttgttgagccaactcggtgatcgactcggtatctccgtaagtttcaacgtggtgacgagtttacgactcggtgatctgaatcgtgaatctctcgggtgtgatcccgacgagactttggctgtgaacttagctttcaagctttatcgtgttcccgacgaaagcgtatgcacggagaatccaagagacgaacttctccggcgcgtgaagggacttaaaccgcgcgtggttactctagtggagcaagaaatgaattcgaatacggcgccgtttttagggagagtgagtgagtcatgcgcgtgttacggtgcgttgcttgagtcggtcgagtctacggttcctagtacgaattccgaccgtgccaaagttgaggaaggaattggccggaagctagtaaacgcggtggcgtgcgaaggaatcgatcgtatagagcggtgcgaggtgttcgggaaatggcgaatgcggatgagcatggctgggtttgagttaatgccattgagtgagaagatagcggagtcgatgaagagtcgtggaaaccgagtccacccgggctttaccgttaaagaagataacggaggtgtgtgctttggttggatgggacgggcactcactgtcgcatccgcttggcgttaa

SEQ ID NO: 2143 - DNA, 282 bp, Arabidopsis thaliana
atggcttcgtattactctggttttttgggttgtgaagagccacactttttggaatcgtgttctctttgccggaaacaccttggtcttaactccgatatcttcatgtacagaggagacaaggctttttgtagcaacgagtgtagagaagaacagattgaatctgatgaagctaaggagagaaagtggaaaaaatcttcaagatctctccggaaaaattcttctgaaactaaagaatccgccgccggaaacaccgtacggacaggaactctcgtcgtggcttag

SEQ ID NO: 2144 - DNA, 2136 bp, Arabidopsis thaliana
atgggttgtactgtgagggagaagcatgttagaccaaaccggaagaccagatccgtgaaacccgaattcgatccgtgttgtttgctcgacaggacggctctatcgaaatcgattgttgaatcgagtcttaagcatcttgtttatcatccgggtcttctcgattcgtgtccagagtcaaaccctagtggcagttttgaggataataatggttggggttattgtacggaggagcaattagaggatattttgttgaaacatttggagtatttatacaatgaagcgatttcgaagcttgtgggttctggttatgatgaggatgtggcgttgagagctgttcttagtaatgggtattgttatggtggaatggatgttatgactaatattcttcataattcgttggcttatcttaagagtaatactggtgaaggtagtaatgtgaacaatgaggatcaatcagagacggtttttacggatttgagacagttggaggagtattcacttgcgggtatggtttatttgttgcaacaagttaaacctaatttgagtaaaggtgatgcaatgtggtgtttgctaatgagtgagcttcatgttgggaggccgagtactatggatataccgagttctggaaaaggggatagtagtaatgtaggggttggtggtgctagtagtactgtaaatggggttggtggtgctattgctccggcattgtgtagattccatggaggttggggttttggtaatgggaaaggacccaagttttctggtaatgggttttctttgcacagtgaagagttaacgttgcagagagagattgattgtccaaggagatttaatctctcaccttcgatgaagtctttgttgagagagaatgttgcagcctttgctgctgggtatcgtgctagtatggagcaaaagaagcaggtgcaaatgcagtctgaaactagtggtactagcttgtcttgcacggctgctgctacacattcagagaagtgtgagcagccacatgtcttcggaagtgaagaatgtttcagttcagtgctggagaaattccgggatctgaaccttgatgacaatgttgattcggcacctgaggagctgaaggatgatgctttaataggactacttcagcaggttcaggatctcaaaaagcaattgaaggagaggaaagactgggctcagaagaaggcaatgcaagctgcccaaaaggtcagcgatgaactgtccgagcttaaatcgttgaggagtgagagagaggaaattcagcgggtgaaaaaggggaaacaaactcgtgaggactcaaccttgaaaaaattatcagagatggaaaatgctcttagaaaagctagcggtcaagttgacaaggcaaatgcggtagtaagggcacttgagaacgaaagtgcagaaatccgggcggaaatggaagcttccaaattaagtgcatcagaatcgctcacggcatgcatggaggcctcgaagaaagagaaaaaatgcttaaagaaactactggcgtgggagaagcagaaaatgaagttgcaggacgagattacagctgagaaagagaagattaaggcactcaatagagctttagctcagatcactcaggaagaaaaagaatatgaggcgaaatggaggcaggagcagaaagctaaggagcaagttttggctcaagtggaagaagaacagcgctcgaaggaagcaattgaggctagcaacaagagaaaggtggaaagcctgcggttaaagatcgaaatagacttccagagacacaaagatgatctccaaagactggaacaagagctgtctcggctcaacaaagcctcttcaactgactcaagcctccaatccaataacacctctcacacaaaggtgaaatcagacaagtcgaagggagaaacaatgtctaagctgcttgaagagctgaataggcttgatggatcatatgagaaggaagcaaactatgaccgggaatgtctgatctgcatgaaagatgaggtttcggttgtgtttctcccttgtgctcaccaagtggtctgtgcgagctgcagcgatagcttcatgggcagtggcaaagcgacctgtccttgttgcagagctccggttcagcagagaatccgtgtctttggagcgagttcttag

SEQ ID NO: 2145 - DNA, 522 bp, Arabidopsis thaliana
atgagtacgatgaagccaagccggagcgacgaaatatccgacccggaacagcagatcaagaacgcgaaccagatcagagctgatttcgattccttggctcccaaacgacccactaaacccactcgaagcgaaccgggatttcctggatctttctctgcttccgacaaaatcaccgaccatcctgaagctgacaaattccaatctctccagtcacaaactcatggtaaagttctaggtgagggagattcatctgcagttcaagatgagttcctggaaacagagtattactcaaatctcaccgccattgataagcaacatcacacgaccggaagtgggtttataaatgtggtgaaggaagacaacggtgaagaatccgaggccgtaaccgccgccgcaatcggagacggaggagaaaaagcggtttacagaagcaatccggcgacgaacgaatggattcctgcgacggaggaagattttgattcggaatcttcgtctaaaccaaaccggagcgagagttcttga

SEQ ID NO: 2146 - DNA, 1599 bp, Arabidopsis thaliana
atgagagaacggattattacattcgtttcgctgcttcttgtagctttgctttcgtttcccagtgttagctactgtgacgaccaaacgatcctgtatgaatcgtttgacgagccttttgatggtcgctgggtcgtttcagagaaagctgaataccaaggtgtgtggaagcacgagaagagtgaagggcatgatgattatggacttctagtgagtgagaaagctaagaagtacggaatagttaaagagcttgatgttgatgagcctctaaaccttaacgaaggaactgttgttcttcaatacgaggctcgtttccaagaagggcttgagtgtggtggtgcttacttaaagtatcttcgtcctcaagaagctggatgggttcctcaagggtttgataatgattctccttactctatcatgtttggacctgataagtgtggtgctaccaacaaggttcatttcatcttgaagcataagaatcccaagagtggcgagtttgttgagcaccatctcaagttccctccttctgttccgtttgacatgctttctcatgtctacactgcggtcttgaaatctgataatgaggtgaggattttggtcgatggtgaggagaagaagaagggtaatttactgtctgctgaagactttgagcctccgttgattccttccaagaccatccctgatccagaggacaagaagccagaagactgggatgagagagccaagattcctgatcctaatgctgtgaagcctgatgactgggatgaggatgcacccatggagattgaagatgaggaagctgagaaacccgaaggatggttggatgatgagcctgtagaggttgaagaccccgaggcaagcaagccagaagattgggatgacgaggaagatggtgagtgggaggctcctaaggtttccaacaccaagtgtgaggcagcacccggatgtggcgaatggaagagaccgatgaagaggaaccctgcttacaagggcaaatggagctcacctctcatagataacccagcttacaagggaatctggaaaccaagagacattccaaatcctgattattttgagcttgagaggccgaatttggagcccattgctgccattggtattgagatatggacaatgcaagacggtatcttatttgacaacatcttgatatctaaagacgagaaggttgctgaaacttacagacaaagcacttggaagcccaagtttgatgtggagaaagagaaacaaaaggcagaggatgaagctgctggtgaggcagatggtctcaagagttaccagaagaaggtgttcgacctcttgtacaaggttgcagacatttctttccttagtgcgtacaagtcaaagattatggaacttattgagaaagctgaaacacagccaaacttaaccatcggtgtgctcatttccatcgtgatcgtcttcctctctctcttcttcaagctcatatttggtggtgcaaaggctaaggtagaaaagaagaaaccggaaacagctgcagagacctcgacaagcgaggcaaagacagaggagaaagcagaagcggtggctgcaccacgaaagaggcagacgaggcgtgagagttag

SEQ ID NO: 2147 - DNA, 1434 bp, Arabidopsis thaliana
atgatagctttgaacagggaggtcgaaactcagtcactgaaaaaactcagtctaaaatctgttagacgagctcgtgaaattttctcccccgtccatggccaatttcctcagcctgatcctgaaagcaaaagaattcggctctgccataagattcaagttgcatttggaggcgtagaacctgcaagtaagcctacacgtattgctgaccataacagtgaaaagacggctccattgaaagcccttgcgcttccaggtccaaaagggtccaaggaacttcgaaaaagcgcaacagagaaagctttagttgttggtccaactttaccgccaagagacttgaacaatactggtaatccaggcaaaagcacggccattcttcctgcacctggatcattttccgaaagaaatctgtcaactgctgctttaatggagagaatgcctagtagatggccccgtccagagtggcatgcaccatggaagaattacagggtgctccagggacacttgggttgggtcagatctgttgcgtttgacccaagcaatgaatggttttgcactggttcagctgatcgtaccatcaagatatgggatgtagcgactggagttctgaaactcacacttactggacatatagggcaagtacgaggcctcgctgtaagcaatagacatacctatatgttttctgctggtgatgacaagcaagtcaaatgctgggaccttgagcagaataaggttattcgatcttatcatggtcatttgcatggcgtttactgtttagctcttcatcctactcttgatgttgtactaaccggagggcgagactctgtctgcagggtatgggatatccgtacgaagatgcaaatttttgtactcccacatgacagcgatgttttttccgttttggcccgcccaactgatccacaagttattacagggtctcatgactcaaccatcaaattttgggacctccgatatggcaaatcgatggcaaccataacgaatcataagaagactgtccgagcaatggctctccatccgaaagagaatgattttgtttctgcatcagctgacaacatcaagaagtttagccttcctaagggagagttttgccacaacatgctttctctacagagagacataattaacgcagtggctgtgaatgaggatggcgtaatggtcactggaggtgataaaggtggcttatggttctgggactggaagagtggtcacaatttccaacgggcagaaactattgtacagcctggttcgctggagagtgaagcaggtatatatgcagcgtgttacgatcagacgggttcaaggctggtaacgtgtgagggagacaaaacaataaagatgtggaaggaagacgaggatgcaactcctgaaactcatcctctcaacttcaaacctcccaaagagatcagacgcttctga

SEQ ID NO: 2148 - DNA, 849 bp, Arabidopsis thaliana
atgaagctttcttgtggtacaagctttgcgttcttacttctgtttcttcttgcggcacaatctgtgcatgtctatgcgggtagcttccacaaagacgttcagatacattggggtgatggccgcggaaagattcacgacagagatggaaaacttctttctctctcgctcgacaaatcctctggatccggttttcagtctaaccaggagtttctctatggcaaagccgaggttcaaatgaaacttgttcctggtaattcagctggaacagtgacaacattctatctaaaatctccgggaactacgtgggatgagatcgatttcgagttcttgggaaacataagtggtcatccatatactctccatactaatgtttacacaaaaggcacaggagacaaagaacaacaatttcatctatggttcgacccaaccgttaactttcacacttattgcatcacatggaatcctcaaaggattatttttacggttgatggaattcctattagagagttcaagaaccccgaggcgattggagtcccgttcccaactagacaaccaatgagactctacgcgagtctttgggaagccgagcattgggcaacaagaggaggattagagaaaacagattggtcaaaagctccttttactgctttttatagaaactacaatgtcgatggatgtgtatgggctaatggaaaatcatcttgttccgcgaattccccatggttcactcaaaaactcgattcgaacggccagacaagaatgaaaggtgtgcaaagtaaatacatgatctacaactattgcaccgataaaagaaggtttcctcgaggagttcctgccgagtgcacttaa

SEQ ID NO: 2149 - DNA, 456 bp, Arabidopsis thaliana
atggcggatgctttcacagatgaacagatccaagagttttacgaagccttctgtctcatagacaaagattccgatgggttcatcacgaaggagaagctaacgaaagtgatgaagtcgatggggaagaatccaaaggcggaacaactgcaacagatgatgagcgatgttgacatctttggcaacggtggcatcacttttgatgatttcttgtatattatggctcaaaacacttctcaggaatcagcatcggatgagttaattgaggtattcagagtgttcgacagagacggagatggtctcatatctcaacttgagttgggagaaggaatgaaggacatggggatgaagataacagcagaagaagcggagcatatggtccgagaagccgaccttgatggcgatggttttctttctttccacgaattctctaaaatgatgattgctgcctcttattag

SEQ ID NO: 2150 - DNA, 1023 bp, Arabidopsis thaliana
atgggtgaagccgtagaggtcatgttcggaaatgggttcccggagattcacaaagccacatcacccactcaaaccctccactctaaccagcaagactgccattggtatgaagaaaccatcgatgatgatctcaagtggtcttttgccctcaacagtgttctccatcaaggaactagtgagtaccaagatattgctctgttggacaccaaacgttttggaaaggtgcttgtgattgatgggaaaatgcaaagtgctgagagagatgagtttatctaccatgaatgtttgatccatcccgctctccttttccatcccaatagccccaagactgtgtttataatgggaggaggtgaaggctctgctgcaagagaaatactaaaacacacgacgatcgagaaagttgttatgtgtgatattgatcaggaagttgttgatttttgcagaagatttctgaccgttaacagcgatgctttctgtaacaaaaagcttgaacttgtgatcaaagatgcaaaggctgaattagagaaaagggaagagaagtttgatatcatagtgggagatttagctgatccagtggaaggtggaccttgttatcagctctacaccaaatccttctaccaaaacattctcaaacccaagcttagccctaatggcatttttgtcacccaggctggaccagcaggaatattcactcataaggaagtcttcacatcaatctacaacaccatgaagcaagtcttcaagtacgtgaaggcttacacagcacatgtgccatcatttgcggacacatggggatgggtgatggcatcggaccacgagtttgacgttgaagttgatgaaatggatcgaagaatcgaagagagagttaacggagaattgatgtatctaaacgctccttctttcgtctctgctgctactctcaacaaaaccatctctctcgcgctagagaaggagactgaagtttatagtgaagagaatgcgagattcattcatggtcatggtgtggcgtaccggcatatttaa

SEQ ID NO: 2151 - DNA, 91 bp, Arabidopsis thaliana
ttgcctccgatgatgatcaaatcataactttcgttcttccgagattttatcatgcggagaaattatggagacctgaactgagctgaggcaa

SEQ ID NO: 2152 - DNA, 483 bp, Arabidopsis thaliana
atggccacaagcgcatcagctttgctctcaccaaccacattctccactgcaatctcccacaaaaaccctaactccatctcattccatggccttcgtcccctccgtctaggtggctcctcctccgccctacccaaactatcaaccaccgggagaaaatcctcctccgctgtcgtgagagctgagctaagcccttccatcgtcataagtctcagcacaggtctctccctcttcctcggccgtttcgtcttcttcaacttccagagagagaacgtagcaaaacagggcttaccggagcagaacggaaaaacccatttcgaagctggagatgatcgtgctaaggagtacgtcagtctcttgaaatcgaacgatccaattggattcaacattgttgatgttcttgcttggggttctattggacacatcgttgcttactacatcttggctacttccagcaatggatacgacccaagcttctttggatga

SEQ ID NO: 2153 - DNA, 2379 bp, Arabidopsis thaliana
atggcggcaagagtagaagcagcaacgatgggtggtgagattgatgaagaagagagtgatgagagaggtagcatgtgggatttggaccagaagcttgatcaatccatggatgaagaagctggtcgacttagaaacatgtacagagaaaagaaattctcggctcttctacttctgcagctttcatttcagagtcttggtgttgtttatggtgatttagggacatctcctctatatgttttctacaatacatttcctcatgggatcaaagatccagaagatatcattggagctctatctctcattatttattcactcacactcatccctctcctcaaatacgttttcgttgtatgtaaagcaaatgataatggtcaaggtgggacgtttgctttgtattcattactctgtagacatgccaaagtcaaaacaattcagaaccaacaccgtactgatgaagagcttactacttacagccgcactacgttccatgagcattcctttgctgctaagactaaaagatggttagaaaagcggacatctagaaaaacggcgcttcttattttagttcttgttggtacgtgtatggtcatcggcgatggtatccttactcccgctatttctgttctctcagctgctggtgggctaagagtaaaccttcctcacataagcaatggtgttgttgtttttgttgctgttgtgatattagtcagcttgtttagcgtacagcattatggaacagaccgggttggttggctttttgcgcccattgttttcctctggtttctctctatcgcaagtattggtatgtacaatatctggaaacatgatactagtgtcttgaaagctttctctccggtttatatatatcggtattttaagagaggaggtcgggatcgttggacctctcttggaggcattatgcttagtataacaggaatcgaagcactcttcgctgatctatcgcattttccggtctcagctgtgcaaatcgcttttacggtaatcgtgtttccttgccttcttttggcttatagtggacaagctgcgtacattaggaggtatccggatcatgtagctgatgcgttttaccgttccattccaggaagtgtgtattggccaatgttcattattgcaaccgctgcagcgattgtggcgagccaagctactatctcggcaacattctccttagtcaagcaagctctagcccatggttgctttccaagagttaaagtggtgcatacttcccggaaattcctcggtcagatttacgttcctgacataaattggatcctaatgatcctttgcattgctgtcaccgctggattcaagaaccagagtcagataggaaacgcttatgggactgcagttgtgatcgtcatgctcgtgacaacactgcttatgacgctgatcatgatcctagtgtggcgttgccattgggttctggttctcatattcaccgtgctctcacttgtcgtggagtgcacttatttctcggccatgcttttcaaaatcgaccaaggtggttgggtaccgctcgtgatcgctgcagcttttctcctcatcatgtgggtatggcactacggaactttaaagagatatgagtttgaaatgcactgtagagtctcaatggcttggatcctcggtctgggtcctagccttgggcttgttcgggttccgggggttggcctcgtttacactgaactagctagtggagtccctcatattttttctcatttcatcacaaacctaccggccattcactcagttgtggtgttcgtatgcgtcaagaacctcccagtttacaccgtacccgaggaagagcggttcctcgttaaaaggattggtccaaaaaatttccacatgttccgttgcgtcgcaaggtacggatacagagacttgcacaagaaagatgatgactttgaaaaacgcctctttgagagcctcttcttgtacgtacgccttgaatcgatgatggaaggaggctgttcggattccgatgactacagcatctgcggaagccagcaacagcttaaagacacgctcgggaatgggaatgagaacgagaatctggcaacgtttgatacatttgactcgatagagtcaataaccccagtgaaacgggtgagcaacacagtgacagcgtcgagccagatgagtggagtagacgagctggagttcataaacgggtgcagggacgcaggagtggtacacataatggggaacacggtggttcgagccaggagggaagcgaggttctacaagaagatagcgattgactatgtgtatgcatttcttaggaagatttgcagagaacatagtgttatctacaatgttcctcaagagagccttttgaatgttggtcagattttctatgtataa

SEQ ID NO: 2154 - DNA, 1599 bp, Arabidopsis thaliana
atggagaattatccagaaacacagtttattcccggagattcaatgatccagaatgctatagtttcttactctgaggaatcagccggtagagaaagaagaactgaagctaacaatgtctcagcctcacaagagaggcaagcattgtccagatttgggggagttccacaaatgcagaacattggtcaagatttcggttcttggagagatcaagcgagtgacaggaacggtttccagctaatgagcgcgatggcaggtgccacggggattcttcagaccggtcagggactgtcccttagccttggttcacagattcttccaggaattcatcagataagccatcaaaatatggcgccgagaggcaatgagtatgcaacacagagttttccgggcgggaatcagaacttggatgttgtgagaacaattcccaactcaaagtatcttaaggcggctcaacagcttctagatgaggctgttaatgtaaagaaagctctaaagcagtttcaggcagagggagataaaaacaatgagaaccctcaagaaccgaatcagagcactcaagactcgagcacgaatcctcctgcggacatctctcagtcggagagacaagaaatgcagagcaagttgacaaaactcttgtcaatgttggatgaggtggatagaagatataagcaatattaccagcagatgcagatagttgtatcctcgttcgatgtgatagctggttatggagcagctaagccatacacagcactcgcccttcaaacaatttctcgccattttcgtagcctaagggatgcgatatccggacaaatcctcgtgctacgtaaatgccttggggaacaacaagatggatcagatgggaaaagagttgggattataagccggcttaagtacgttgatcaacatttaagacaacaaagaggttttatgcaacctcaagcttggagacctcaacgcggtctacctgaaaactctgttttgattctccgtgcttggctctttgagcattttcttcacccttacccaaaggattctgataagatcatgctagcaagacaaacgggcttgagccgcggtcaggtttcaaactggttcataaatgcacgagtgcgtttatggaagccaatggtggaggagatatacaaggaggaattcacagagaatgattccaactcgtcttccgaaaatacaccgaaaatgtctgagataggacctgttgctgctgatgatgaagatcgagctcgagagttttcacaagaccagaccaaaccggaccatggacatggatatggcgaggaaactcgtggcatggtccaaggcagtcatatggatggtcgccggttcatggcagttgagcctacatatcatgtggctgatacgtcaagattgggtcgtggtgatgtgtccttgactctagggcttcaaaactctcaaggacaggacaatgttgtggctatgtctagtgaggcatacaacaacttttccggggtggatatttacgagaatgccatcccgggagatgaaatggagtatgtaaaccccggaagtcgccagaaccggataaattcttcacaattggtacatgattttgtagcttga

SEQ ID NO: 2155 - DNA, 816 bp, Arabidopsis thaliana
atggcggatgaacataagcatgaagaatcttcacctaatttggatccagcagtggaggttgtagagagggaatcgttgatggagaagttatcggagaagatccatcacaaaggtgattcgtcgtcttcatcatcatcagatgacgaaaacgagaagaagtcttcgtcatcgtctccaaagtctttgaaatcgaaggtttatcgtttgttcggaagagagagacctgttcataaggttctcggcggcggaaaaccggcagatatatttatgtggaaggacaagaaaatgtcaggaggtgtatttggcggtgctacagtggcatgggtgctatttgaattgatggagtatcatcttcttactctgttatgtcacgttatgatcgttgctcttgctgtgttgtttctatggtctaatgccactatgttcattcacaagtctccaccaaagattcctgaagttcatatccctgaagaacctcttcttcagcttgcttcgggtcttagaatcgaaatcaaccgtgggatctcttctcttcgtgagattgcgtcggggagggatatcaagaagttcctctctgctattgccggattgtgggttctatcgatcttgggcggctgctatagtttcttgacattggcatacatagctctggttctgctcttcactgttcctcttttctacgacaagtacgaagacaaagtagactcatacggtgagaaagcaatggctgagttgaagaagcaatacgctgtgttggacgcaaaggtattcagcaaaatcccaagaggaccgttgaaagacaagaagaaggattag

SEQ ID NO: 2156 - DNA, 216 bp, Arabidopsis thaliana
atgagtcaatacagccaaaaccaatcttcaggagcttatcctacgccgccagtgtctaccggcccttacgtggcaccgccaccgctaggttacccaacgaacgacacaagtcatgccacggtggcaacggtggagacaaagtccaagggtgatggattcttaaaaggctgtcttgcggccatgtgttgttgttgtgtcctcgacgcatgcttctga

SEQ ID NO: 2157 - DNA, 486 bp, Arabidopsis thaliana
atgtcatcgaagaacggagttgttcgtagctgtttaggatcaatggacgacatcaaaaaagtcttccaacgattcgacaaaaacggcgacgggaaaatctccgtcgacgagctcaaagaagtgatccgcgctctctcaccaacagcatcaccagaagaaacagtaacgatgatgaaacaattcgatctagacggtaacggattcatagatctggacgaattcgtcgcgcttttccaaatcggaatcggaggaggaggtaacaatcgaaacgacgtaagcgatttgaaagaagcgtttgagttatatgatttggatggtaatggaaggatctcggcgaaagagcttcattcagtgatgaagaatttgggtgagaagtgctctgtgcaagattgtaagaagatgattagtaaagttgatattgatggtgatggttgtgttaattttgatgagtttaagaagatgatgagtaatggtggtggtgcttga

SEQ ID NO: 2158 - DNA, 1068 bp, Arabidopsis thaliana
atgggtacatacctaagttctccgaaaactgaaaagttatcagaagatggtgagaatgataagctcagatttggtttatcgtctatgcaaggttggcgcgctaccatggaagacgcgcatgctgcaattcttgatcttgatgataagacatcgttcttcggtgtgtatgatggccatggaggtaaagtcgttgcaaagttctgtgccaagtatctacaccagcaggttatcagtaatgaagcgtataaaactggagacgtcgaaacatctcttcgaagagcattctttagaatggatgacatgatgcaaggacaaagaggatggcgagagttagctgtacttggcgacaagatgaacaaatttagcggcatgattgaaggatttatatggtcaccaagaagcggtgacaccaataaccaacccgatagttggcctcttgaagatggtcctcattctgatttcacgggacctacctcggggtgcacagcgtgtgtagctcttattaaagataagaagctctttgttgcaaatgccggtgactcacgttgtgtgatatcaagaaagagtcaggcttacaatctttctaaagatcacaagcctgatcttgaagttgaaaaagaaaggatattgaaagctggtggctttattcacgctgggagaatcaatggaagcttgaatctgacaagagccattggtgatatggagttcaagcagaataagtttttaccatctgaaaagcaaatggttactgctgatccagatataaacactattgacctatgtgatgatgatgactttcttgttgttgcttgcgatggaatatgggattgtatgtcaagccaggaactagttgattttatccatgaacagttaaaatctgaaacaaaactttcaacagtatgtgaaaaggttgttgatagatgtttggctccagatacagcgactggtgaaggttgtgataatatgaccatcatcttggttcagttcaagaagcctaacccatctgagactgaaccagaagattccaaaccagaaccaagcgaagatgagccgagctcatcaagctag

SEQ ID NO: 2159 - DNA, 1545 bp, Arabidopsis thaliana
atggccggagggttcgtcagtcaaacgccgggtgttcggaactacaattacaaactgacaccgaaagtgtttgtgacatgtttcatcggtgcttttggtggtctcatcttcggatacgatctcgggatctcaggaggggtaacctcaatggagccattcttggaagagttcttcccttacgtctacaagaagatgaagagcgcacatgagaacgagtactgtcgatttgatagtcagcttctcactctcttcacttcgtctctctatgtggcggctttggtgtcttctctctttgcctccaccattactagagttttcggaaggaaatggtcgatgtttctcggtggtttcaccttcttcatcggttctgctttcaacggctttgcccaaaacatcgctatgcttctcattggtcgtatcctacttggtttcggagtcggattcgccaatcaatctgtaccggtttatttatcagaaatggctcctccgaatctaagaggagctttcaacaacgggtttcaagtagcgattatctttggtattgtggttgcaacgatcatcaattacttcaccgcacagatgaaaggaaacatcggatggagaatctctctcggattagcttgtgtccctgcagtgatgatcatgatcggagctctgatccttcccgacactcccaactctctcatcgaacgtggctacaccgaagaggccaaggaaatgcttcagtccatccgaggaaccaatgaagtcgatgaagagtttcaagatctcattgatgcaagtgaggagtccaagcaagtgaaacacccatggaagaacatcatgcttcctcgttacagaccacaattgatcatgacttgcttcattcctttctttcaacaacttaccggaatcaatgtcattaccttctacgccccggttttgttccaaaccctcgggttcggtagcaaagcttccctcctatcagctatggtaacgggtatcatcgagctcttgtgtaccttcgtctctgtttttacagtggataggtttggaagaagaatcttgttcctccaaggaggtatccagatgcttgtctctcagatcgctattggagccatgattggagtcaaatttggagtggctggaacaggaaacatagggaaaagtgatgccaatctaatcgtggcactgatctgcatctatgtagcgggtttcgcctggtcatggggaccgttgggatggttggttcctagtgagatatctccactagagatccgatcagcagctcaagccataaacgtttcggtcaacatgttcttcacattccttgtggctcagctcttcctcactatgctttgtcacatgaaattcggactattcttcttcttcgccttctttgttgtcataatgacaatattcatctacttgatgttgcctgagacaaagaatgtgccaatcgaagagatgaacagagtgtggaaggcacattggttctggggaaagtttattcctgatgaagctgtcaatatgggtgctgctgagatgcaacagaagtccgtatga

SEQ ID NO: 2160 - DNA, 2253 bp, Arabidopsis thaliana
atggagaagcttgttgaaatatgctatttttctagatatttttgcagtaatgctaacagcccatatcatcatcatcgtccacacaacacaaaactatattcgatttcttccaccaccacacgctctcacatctctccggcgatgccttccttatccaccccgccgtcccaaaatctcgccttctcccctgccgcttctgccacgtcatccagactcactccctcctccaaaagatctttttaccctcatcgtctccccgatcccaccgctctctgtcgctgctcctcctcctccggcagcaattcttcctcttcctcttcctccgatgataaccctagatgggactctgcgattcaggatgttctcaagagcgccatcaaacgcttcgattcggttttgagctggtacgctactctggataacgatgatggtgagcaaggatcggagaatgtcgagaagattgatgatgattgggattgggaccgttggaagaagcatttcgatcaagttgatgaccaagaccgtcttctctccgtcttaaagtcgcaattgaatcgagccattaaacgagaagactatgaagatgctgcgaggctaaaggtggcaattgcagctactgctactaatgatgctgttggcaaagtcatgtccactttttatgtaataactcgagttgtgattatagtttctaacaacactagagctcttctagaagagcgttacaaggatgcagtatacttgcgagacaaagctggtgctgggttggtgagctcattatttgtattttttctcgtttcttttataactgtggtagggtggtggtctggtatttcggaagatgtcaaagatccgtttggtcttattgttcaaattactgcagagcatggaagatatgtggcaagaagttataatcctcggcaacttagtacatctgctgctggtgctcctctttttgaaatctttctgacacttgatgggaaagggaactacaaaaagcaggctgtgtacttaaaatggaaggagatttttccagacgtaccaactatgccctccagaactttgactcctggtaggtttttgacttcacctggaaggaaggaagatactggtaatcttgcagttgagagtagtgaagatgaagagagtgataactcagatgatgattctgatctccttgaggaatcttctggtttccagagtttcctgcgagatatgattcccggggtcaaggttaaggttatgaaagtaactgcgcctggaagggtggataaggatttcatctcaaaagttattgagcagatagctgatgaagaagatgaagagaacgatcttgatatagaagatatagatgtggaagatgacactaaggctgaaatcgatgaaaaaaatgctgacattgaattggaatctgtgacggatgaaatcattgacaacaacggaggaagggaaatcgcagtgaaatttgtgataggcgatattgttgatcgactttctggaaaccaacctcttaaagagtcacttcgatcccctgccaatctggaatctgtggagaattcttcgttttatcttcggttagagaaagatttaaacgttaaagagtctaagggtgtagaaggtactacactagttgatgggaaaggtagccgccagagtagacgtaggattgaaaacattatgggtgatttggccaaatcaattgagaaagagaagaagatttctgtcaagatgcttaaggatgttggggagctattaagcctcactctcagccaggctcaaaaccgtcaacagctgtcgggtttgacaaaatttcgtcgcattgatgtgacaccatcactagatcccctagacggactttatattggcgcacatgggctatatacatcagaagtaatccatttaaaacgcaaatttggccagtggaaaggtggaaaggagtctaagaagccaacagatatcgaattttatgaatatgttgaagctgtgaaattaactggagatccgtatgtgcctgctgggaaggttgcatttcgggcaaagattggtagacgttatgagctcccacataaaggactcatccccgaagaatttggagtgattgccagatataaaggacaaggtaggcttgctgatcctggatttcgtaatccgagatgggtagatggcgagcttgttatcctcgatggcaaggttcctctcttcgtctctcaatatactaaaacaaacttgtccatggattcaaactcaaataaatga

SEQ ID NO: 2161 - DNA, 1941 bp, Arabidopsis thaliana
atgaggaaggaagaagaagaagaagcaggatcttataacatgaacgtcgacgatactaacaacaacaacaactatatctgcactgataatgattacatcgaagaagatgaagataatagcaacactaagaagagccaaacacaagcatggggcacgtgggaagagctgttattagcatgcgccgttaaacgacacggatttggtgattgggattccgtcgctacggaggttcgatcccggagctctctctctcacctcctcgcttccgctaatgattgtaggcacaagtatcgagatctcaagcgtcgatttcacgaacaagaaaaaacagatgtgacggcgacggtggaagaagaagaagaagaagaagagagagttggtaataatatcccgtggcttgaacagctacgtaaccttcgtgtagctgagctccgtcgtgaagttgagcgttatgattgttcgatactatcgcttcaattgaaagttaagaaattagaggaggagagagaagtcggagaagagaaaccagatctggaaaacgagaggaaagaagagagatcggagaacgatggttctgaatctgagcaccgtgaaaaggcggtttcagcggcggaggaatctgatcgggaaaataggtcgatgaacgagtccaactcgacagcaaccgccggagaagaagagagagtttgcggagacgaaccgagtcaaactcgagaagatgattccggtaatgataagaatccggatcctgatccggttaacaaggatgcgacggctgcggaggaggaggaaggatcggttagtagaggatcggaagcgagtcactcagacgagttaggcgagtcagggacatcggaaagtaaatggaaacggaaacgaaggaaacagggtggtgccggcgagatcagatcggctgagagtaaatcacagccgttgattagtcttcttgatctgattcggtcccatccgcgtggatctttgttcgaacgccggcttcggagccaggaggctaaggattacaagagcatggttaagcaacatttggacattgagacaatacagagaaagttgaagcaaggatcttatgattcttcaagcctcattttttacagagatctacagcttctcttcacaaacgcaattgtcttctttcctttatcttcctcagaatcgatggcagctcacgaactacgagctgttgtttctcaagaaatgagaaaagagaccggaaaagctggccccaggttaataaaacaggaagcatccggtatgcgtagtggcaaagcggatgctgaaacatcagactcgtctctctctaggcagaaatcttcaggtcctcttgtcgtttgtaagaagaggcgttctgtttccgctaaggcttctccttcgtcatcaagctttagccaaaaagatgatacgaaagaagagacattatcagaggaaaaagacaacattgcgactggtgtaagaagctcgagaagggcaaacaaagtggctgcggttgtcgctaataataccaagacgggcaaaggcaggaacaaacagaaacagacagagtcgaaaacaaattcgtcgaatgataatagtagtaaacaagacacaggtaaaacagagaagaaaacggtttcagcagataaaaagaagagtgtggctgatttcttgaagagattaaagaagaactctccgcaaaaagaagctaaagatcagaataagagcggtggaaatgttaagaaagatagtaaaacaaaaccaagagaacttagaagtagcagtgtgggtaaaaagaaggccgaggtagagaatactccggtgaaaagagcccccgggagaccgcagaagaaaacagcagaggcaactgcatctgcctcaggaaaacggggtagggatacaggaagcacggggaaggacaataaacagccaaagaaaagaatcagaaaatga

SEQ ID NO: 2162 - DNA, 906 bp, Arabidopsis thaliana
atggtgacggttaccgattggaaagggttagattgcggcgaagagacgagaatcgtaaggagattgatgaagttcgaagacttgcctgagtatttgaaggacaacgagtttatacacaaccattatcgatgtcaatggtctctcaaagatacttttctcagtgctttctcttggcacaacgagactctcaacatttggacaagtttcgaaattgattttgtggagattttgataatcgttaggcatttaattggatttggtatatttctgtggatgacggtggtgagttgcttggagacgacggagattagtctcgccggcgtttttaacggcatggccgggtacgaaccaccgagctctgtttcacacctccttgcttgtcactcaaaacgtttcaacgtcttcttctggcgtttggactacgcaggaatatcacttatgatcgtcgcttctttctttgcaccaatctactacgcattctcctgccaccctaacttccgtttactctacttatcctcgatctcgatcctcggtctcctcgctatcatcactctcctctctcccgctctctctacgccgcgttttagacctttcagagctaatcttttccttgcaatgggatcatctgctgtgatacctgctacacatgtgctttgcctttactgggatcaccctaatgtcttcatcgccctcggttacgagattgccacggctttgtcgtattttgtgggagcaacgttttatgtcagccgtgtgcctgagagatggaagcctggagcgtttgatatggcgggacatagccatcagattttccatgtgtttgtagttatgggtgctcttgctcattgtgttaccactcttctcatcattgatttttcacgggcttccccttcttgtgggttttag

SEQ ID NO: 2163 - DNA, 1020 bp, Arabidopsis thaliana
atggagaagtatgagatggtgaaggatttaggatttggtaatttcggattggctcggcttatgcgtaataagcaaacaaacgagcttgtggctgtcaaattcatcgatcgaggctacaagatagatgagaacgttgcaagagaaataatcaatcatagagctctcaaccatccgaatattgttcggtttaaagaggttgttttaactccgacacatcttggaatagtaatggagtatgcagctggaggagaactgttcgagcggatatctagcgtgggtcgatttagcgaagctgaggcaagatatttctttcaacaactcatttgtggagtccattacttacatgcattgcaaatatgccatagagatctgaaattagaaaacacattgcttgatggaagcccagcaccacgtttaaaaatttgtgattttggctactcaaagtcttctgttctgcactccaacccaaaatcaacggtgggaactccggcatatatagcaccggaagttttttgtcgatcggaatacgacggaaagtcagttgatgtgtggtcttgtggagtggccctctatgttatgttggtaggagcttatccattcgaagaccctaaagaccctcgcaatttccgaaaaactgttcagaaaataatggccgtaaactacaagattccaggatatgttcacatatccgaagactgcagaaagttactatctcgtatatttgttgccaatccgttacatagaagtacgcttaaagagattaagagtcatgcatggttcctaaagaatttgccaagagaattaaaggagccagcacaagcaatctattaccaaaggaatgttaatcttattaatttttctcctcaaagagtagaggagattatgaagatagttggtgaggcaagaaccattccaaacctttctcgcccggtcgaatcgcttggatcagataaaaaagatgatgatgaagaagaatatttggatgctaatgatgaagaatggtatgatgattacgcatag

SEQ ID NO: 2164 - DNA, 1053 bp, Arabidopsis thaliana
atggagagatacgacatcttaagagatcttggttccggtaactttggagttgctaagcttgtcagagaaaaagccaacggagagttttacgccgttaaatacatcgaaagaggccttaagattgatgaacatgttcagagagagatcataaaccacagagacttgaagcatcctaatatcatcagatttaaagaggtttttgtaacaccaacacatcttgccatagtaatggagtatgcagctggtggtgaactttttgaaagaatttgcaatgccggtagattcagcgaagacgaaggaagatattatttcaaacaacttatctcgggagttagctattgtcacgctatgcaaatatgtcacagagaccttaagctcgagaatacactcttagacgggagcccgtcgtcgcatcttaaaatatgtgattttggatactccaagtcatcagttttacactctcaaccaaaatccaccgtgggaactccggcttacgttgctccggaagtcttgtcccggaaagaatataatggaaagattgcagatgtgtggtcgtgtggggtgaccttatatgtaatgttagttggtgcttatccctttgaagatcccgaagatccacggaacattagaaacaccattcagaggatattaagtgtacactacaccataccggattacgtcaggatttcctccgagtgcaagcatctcttgtctcgtatctttgtggctgaccctgataagagaataactgtaccggaaatcgaaaagcacccgtggttcttgaagggccctttggttgtgccgccggaggaagagaaatgcgataatggagttgaagaagaagaagaagaagaagagaagtgtcgacagagtgttgaagagatagtgaagataatagaggaagcaagaaagggagtaaatggtacggataataatggtggattagggttaatagatgggagcattgatcttgatgatattgatgatgctgatatttatgatgatgttgatgatgatgaggagagaaatggtgatttcgtatgtgctctatga

SEQ ID NO: 2165 - DNA, 912 bp, Arabidopsis thaliana
atgttgaaagattcaactgggttggcaaaggcccaaaagttggatgcaattggtgggaagggaggcaagcagtgggacgatggagctgaccatgacaatgtagcaaaggtttatataagaggtggtcttgaaggcatacaatacatcaaatttgattatgtcaaagatggaaaaactatagatgcatctatccatggtgtttcgggtagcggtttcacacagacgtttgagattgattatcaaaacagtgaatatattgtatctgttgatggctactacgacaaatctggtacgatgcaagcacttgaattcaaaaccaacctgaagacttctgaagtgattggatatccaaagggtactacaaagttttcactcggtggagtcaatggcaagatggtgattggcttccatggatctgctgggaaagtcctaaactccattggagcatatttaacaacagctcctcctactaagtcacaacttgtaggtggtctaaccggaggcgaaccttgggatgatggctctaattatgatggcgtgaaaaagatatctgtcacttacattagcactcttataaggagtatcaatgtggactatgaaaaggacggccaagttgtaacacgttaccacgggatgaagaatggagatacagaggagtttgtgatagactatccaaatgagtatttgatatcagtggagggaacctacaacatactccccgatgataacgttttggtcattaggtcgttgattttcaaaacatcaaaagggagaatctctcccacatatgggtttgtgtcaggtaccaaatttgtgttggagagccaaggtaatgctattgttggattctatgggcgggatggtggtgctttcgacgctatcggagtttacttctctccaattccttcgtaa

SEQ ID NO: 2166 - DNA, 621 bp, Arabidopsis thaliana
atgggtcaaaagactcaaaggccagaattgacgcagccgtttatgagaagtgagaagacaatttcggagtcacttcctttatttcctctcttccttcactctctcctatataaaccttcctctcctcttcctctcttctcatctcttcaaaccattttcgaaagccttgagagagagaacacagacgataccaactttcttcaatctcgttgccgcagtataattatctcattcctcggatatatctctccttctgcggcggcgacaagaagctacaagaataaaaagtctgttttctctcttttcaagaaaccacttacttcgaaaatggctcgttctatctctaacgttaagatcgtatctgctttcgtctctcgtgaactctccaatgctatcttccgacgtggttatgcggccacggcggcgcaagggagcgtttcgagcggtggaagaagtggagctgttgcttcggctgtgatgaagaagaagggagtggaagaatcaacccagaagatttcttgggttccagatcccaaaaccggttattacagacccgaaaccggttccaacgagattgacgcggctgagctacgagcagctctcttgaacaacaagcagtga

SEQ ID NO: 2167 - DNA, 1149 bp, Arabidopsis thaliana
atggagcttccgttactctcgtatgctagctccgcgtcgttttcacggacaggcttatgctcttcttcttcttcctcctcaactagtatctatgagtttccggagagaagacggagtttaaaattgagattcaatggtggagaaaggtcacgaagcgttatagcttccgctgaacggagcagtgaagggattgagaagacaacagacaccgtcggtggcggaggaggaggaggagcaggcagatttgctggtactgccatggaggttactacacttgatcgtggttttgctaactccaccaccgttgattttccgatctgggacaaaatcggcgccgtcgttagacttacttatggaatcggaatatatggagcaatggctgtagcaggaagatttatatgttcagtgactggaattgattcatctggtggatttgatccttctcttgatgcactacttgctggacttggctatgcaacaccaccaatcatggctcttctcttcatactcgacgatgaagttgtgaagctatcaccgcatgctcgggccattagagatgtggaagatgaagaactaagaagctttttcttcggaatgtccccatggcagtttatactcattgtcgcggccagttcaataggagaagagctcttttaccgtgttgctgtacagggtgctctgtctgatatattcttgaaaggaacacagttgatgacagattctagaggcatggcatctctgaccggagtgtttcctccatttgtcccatttgctgaagtctttgcagctgtaatcaccgcgactctcacaggctctctctactttcttgctgcgtctccaaaagacccgacatacatagttgccccggttttaaggtcacggcgagatgattttaagaagcttttgtcagcttggtatgagaagagacagatgaagaagatttactctccactccttgaaggactcttagccctctatctcggtattgaatgggttcagacggataatatattagcaccgatgatgacgcatggtatatactcggcggtcatattagggcatgggctgtggaaaattcacgatcaccggagaaggttacgccggagaatcgaacacattagatcggaggccacggataagttgatttaa

SEQ ID NO: 2168 - DNA, 825 bp, Arabidopsis thaliana
atgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatga

SEQ ID NO: 2169 - DNA, 2085 bp, Arabidopsis thaliana
atggtgatgatttctcataagttggatttgattttggttttcataatcgtaatcggaggatctattttccgacgagtttctgctaatttcaccgtaccttgtaacggaagatgcggtggattgactctgccttatcctttcgggttttcaaacggttgttcgatccgattcgattgctctgcggcggagaaaccgatgatcggagacttttccgttcaaaacgtgacggaaaacagtatatttgtcggtctctctcacaattgtactcggaagattgaagatatgaatccgcttttcggcgagaatttcgcaccaacgtcggagaacagtttcttgatggagaattgtaaccgtaccaccgatggttgctctatcaagcagaagtttctggagaatgtgctgaaactcaaaagttgtgatgctactggaaacataagttgtttttctttagatagtaattcgagttcgaagaactcagctaagtttttcagtatgaagacattaaggaacagctcgtgtagtttgttgttctcgtcgatagctttcgagtctgtaggtgtgaatgcgggtatagcgttagagtttgagcgagttcggttaggttggtggcttaagggaggttgcgagagcggaacttgcgcggctaacaccgattgtacagacgttgaaactcctcatggatatgcaggacaccggtgctcatgtcttgacggtttccacggtgacggatacaccaacccttgccagagagcactaccggagtgccgtggttccaagctcgtctggagacattgtagatctaatcttattactattgtaggaggaactgttggtggagcgtttttactagctgccttggcttttttcttcttttgtaagcggagacggtctactcctttgagaagtcatttaagcgcaaagcgtcttttgtctgaagctgcagggaactcgagtgtcgcctttttcccttacaaggaaatcgagaaagcgacagatggtttctctgaaaagcagaagttaggaataggtgcatatggtacggtctatagaggaaagctccaaaatgatgaatgggttgctatcaaaagacttagacatagagattcagaaagtcttgaccaagtcatgaatgagatcaagcttctttcctctgtgagtcacccgaatcttgtccgtctcttaggatgttgtatagaacaaggcgatccagttctcgtttatgagtacatgccgaatggaactctatctgaacatctacaaagagatagagggagtggtcttccatggaccttgcgtctcactgttgctactcaaacagctaaagcaatcgcgtatctccactcttcaatgaacccaccgatctatcaccgtgacatcaaatctaccaatatccttcttgattatgatttcaactccaaagttgcggatttcggactctctagactgggaatgacggaatcttctcacatatcaacggctcctcaagggactcctggttatcttgacccgcagtaccatcaatgctttcatctctctgataagagcgacgtctacagctttggagtcgtccttgccgagattataacgggattgaaagtcgttgatttcacacgtccacataccgaaatcaacctagcggctcttgctgttgacaaaatcgggtcaggttgtatcgatgagataatagacccgattcttgacttggatctcgacgcatggactctctcatccatacacacggtggctgagcttgcatttcgatgcttagccttccacagtgacatgagaccgacaatgaccgaagtagcggacgagcttgaacagataagactcagtggttggattccaagcatgagcttggattcaccagccggttctctccgttcatctgatcgaggaagcgaaagatcagttaaacaatcatcaataggaagcagaagagtcgttatccctcagaaacaacctgattgcctcgcatccgtcgaagagattagcgatagctcacccatctcagttcaagatccttggttaagtgcacaaagctcaccgtctacaaatacattgctcggtaacattccaagatga

SEQ ID NO: 2170 - DNA, 417 bp, Arabidopsis thaliana
atggccaccgttgaggttgaacaagtcactccagtagcagtagagaacgttgaggtaccaacaaagacagtggaggagacagtggtggagacagaggtgacccaacagccggaagaatccgtccccgccgtgacagaacaaaaatccgaagcaccaattgtagaaacaaacgaagaagtggttgtggaagaggcagagaagaaagatgaagaaaccgagaagaaaacagaggagaaagacgagaagacagaagtgatcacggaaactccggtagttgaggaggaggagaagaaagctgaggaagtgaccgaaactccggcggttgtggaggaggagaagaagacagaggtggttgaggagaaacagactgaggttgcggctgctgaggaagtcgccgttgagaaggccgaggagtaa

SEQ ID NO: 2171 - DNA, 2379 bp, Arabidopsis thaliana
gttatcgaatcatctccagaacgggatcgaatccgataacctactctggtctcgtgtccctgaatccgatgatacttccaccgacgatattactctactcaactctcaccgtgacggtgacggaggtgtcaatagtctcgattacgaagtcatcgagaattacgcttatagagaagaacaagctcatcgaggaaagctttatgttggttactacgttgctgtcaaatggttcttctctttactcatcgggatcggtactggattagctgctgtgttcatcaatctctctgttgagaatttcgctggatggaaatttgctcttacttttgctattattcagaagtcgtattttgctgggtttattgtttatcttctcatcaatttagtcttagtgttttcttctgcgtatattattactcaatttgctcctgctgctgctggttctggcattcctgagattaagggttatctcaatggtattgatattcccggcaccttgctctttagaactctcattggaaaggtatttggaagcattggttctgttgggggtggcttagccttggggaaagaaggtcctcttgtgcatacaggtgcctgcattgcatcgttgcttggtcaggttggatctacgaaatatcatttgaattctagatggccgcaactttttaagagtgatagagatcggcgtgatcttgtcacttgtggatgtgcagctggagttgctgctgcctttagagccccagttggtggagtgttatttgcattagaggaggtcacatcatggtggagaagtcaacttatgtggcgtgtctttttcacttccgctattgtggctgttgttgtgcgtactgccatgggatggtgcaagagtggaatatgtggacattttggtggaggtggtttcattatatgggatgtatcagagtgtcaagatgactactacttcaaagagctactgccaatggctgtaataggagttatcggagggctacttggtgcattatttaaccaacttacactctatatgacatcttggcgtcggaactctttgcacaagaaaggaaatcgagtgaaggtaattgaagcatgcatcatctcttgtataacttcagctatctcatttgggctgccactcctaagaaaatgcagtccatgccctgaatcagttcctgactctggtattgagtgtccacgacctccaggaatgtatggaaattatgtaaatgtcttctgcaagacggataacgaatacaatgatctcgctacaattttcttcaatactcaggttgatgctataaggaatttgttcagcgcaaaaacaatgcgagagttcagtgctcagagtctactaacttttctggttatgttttacacattagctgtagtgacctttggcactgctgttcccgccggccagtttgttcctggaataatgataggatcaacttatgggcgccttgtaggcatgtttgtggtcaggttttataagaagctcaacattgaggagggaacgtatgctttgctgggagctgcttcatttctcggaggctcgatgcggatgactgtatctttatgtgttatcatggttgaaatcacaaataacctgaaacttctgcctcttataatgttggtacttctcatctcaaaggtcgtcggtgatgctttcaatgagggattatatgaagtacaagcacgcctgaagggcattccgttacttgaatcgagacctaagtatcacatgcgtcaaatgatagcaaaggaagcgtgtcaaagtcagaaggtaatctctttacctcgagttatcagggtcgcagatgttgcttcaattttgggcagcaataaacataatggatttcctgtaatcgaccacacgagaagtggtgaaacacttgtcatagggttagtccttcggaggtacttgcttgttctccttcaatcaaaagtcgatttccaacatagtcctttgccttgtgatccaagtgccaggaatatcaggtacagttttagcgagtttgctaaacctgtttcatcgaaagggttatgcatagaagatatacatttaacttcagatgatttagagatgtacatagatcttgctccatttttgaatccgtctccatacgttgttcccgaagacatgtccttgacaaaggtatacaatcttttccggcaacttgggttgcgacatctattcgttgttccccgtccttcccgtgtgataggcttgatcaccagaaaggatttactgattgaggtaaatggggaatcatcagcagtggaactccaacagtcaactagtgtaaggtgtcggtacagtgagacagcaacgcggatggacgctgcacgaccgcttctagacgatcttttaggttaata

SEQ ID NO: 2172 - DNA, 1479 bp, Arabidopsis thaliana
atggatttgaaccaaatcttgatcctctcatttctctctctttttaccttagccatattcttgctcacaagatccaaacggaaactaaaccttcctccgtcgccggcgatctccttgccggtgatcggacacctccatctcctcaagccaccgcttcaccgtaccttcctttccctttccaaatccatcggaaatgctccggtcttccatctccgactcggaaatcgcctcgtttatgtcatctcttcacgttccatcgctgaagaatgtttcacaaagaacgatgtcgttctcgcgaaccgccccaagttcaccataagtaagcacctcggctacaacgccacctacttactctcggcatcttacggcgatcattggaggaacctccgccgcatagccgccgtcgagatattctccactcatagactcaattcgtttctgtatattcgtaaggacgagatccgacggctcatttcacatctctctcgtgattccttacacggatttgtggaggtagagatgaaaacattgttaaccaatttggcatccaacaccaccatcagaatgttggccgggaagagatatttcggtgaggacaacgatgacgctaaactcgtgaagaaccttgtgtcggaggcggtgaccagcgccggtgcaggaaaccccattgattatctttccattttacgttgggtctcgagttatgaaaaacgaatcaagaatttgggaaataggtttgatacgtttttgcagaaattagtcgacgaaaaacgtgcggagaaggaaaaaggtgaaactatgatcgatcacttgcttgctctccaagacattcaacctgattactatacggatgtcatcatcaaaggaatcatacttaccctgataattgcagggacagatacgtcatcagtaacactagaatgggcaatgtcaaatctgttgaaccatccagaaatacttaagaaagcgagaatggaaatcgatgaaaaagtcggtttagaccgattagtagacgaatcggacattgtaaatctctcttatctccaaagcattgtattggaaacactacgtatgtacccggcagtcccactactactacctcatttgtcatcagaagattgtaaagttggaggctacgatataccaagtggaacaatggtattgaccaacgcatgggccatgcatagagatccagaggtatgggaagatcctgagatattcaaaccagaaagatttgaaaaagaaggagaggctgagaagctaatctcatttgggatgggacgaagagcttgtcctggagccgggctagctcatcggctaataaaccaggctcttggaagtttggttcaatgttttgagtgggaaagagttggtgaggattttgtggacatgaccgaagacaaaggagccacattgcccaaagctataccattaagagccatgtgcaaagcacgttctattgttgataaactgatataa

SEQ ID NO: 2173 - DNA, 672 bp, Arabidopsis thaliana
atgggcaaaaatgaggaagtgaagcttttgggaatatgggcgagccctttcagccgtcggatcgagatggctctcaaactcaaaggtgtaccgtacgaatacttggaggaagatttggagaacaagagctctttgcttcttgctctaagccctattcacaagaagatccctgttcttgttcataatggtaaaaccattatcgagtcgcatgtgatcctcgaatacatcgatgagacttggaaacacaatcccattcttcctcaggatcccttccaaagatccaaggctcgagtcttagctaaacttgttgatgaaaagatagtaaatgtgggatttgcctcactggccaaaacagagaaaggaagagaagttctgattgagcagacaagagaattgattatgtgtctcgaaaaagaactcgccggaaaagattacttcggcggcaagacagtcggattcttggactttgtcgccggaagtatgatcccgttttgtttggagagggcttgggaaggaatgggagtggagatgattacagagaaaaagtttccagaatataacaaatgggtgaagaagctgaaggaggttgagatcgttgttgattgtattcctctaagagagaaacatattgaacacatgaacaatatggcagagaaaattagatctgcttaa

SEQ ID NO: 2174 - DNA, 1854 bp, Arabidopsis thaliana
atggatggtattagctgttatggatcttccacatcatcaaatgctaatgttcttcgtagtcccgacctttctcaagctcttcattggacacctaacgattttgaatctgctacaagaagagatcagattgttaagcaactaccaggtacatcaagaaatgtcggtattggtgactctgaacctggtcgtaactcctcaagccggcgctttttcttgtctaagccggttcatcctatactgcatccttctgataatgttagggatacagcatctgattctgcggatgcctgcagttggagcagcgggaccccaagcagcattgattctgtggatgttcctgagccagttcttgattggaataataactctaccaaagcacaacaagtagcagcttcaagagcgcaaatgccttacatgactactgatccgaaagaagtttccggcaagtcattcgattacatcgttgttggaggcggaactgcggggtgttccttagctgctactctgtctgagaaatactctgttctggtcattgaacgcggtggctcgccttttggagatccattagtagaagataaaaagtactatggatactcattgataaatacagatgaatactcatccgttgcgcaaagttttacctccgtagatggaatcaaaaaccacagaggacgtgttcttggaggatcgagcgctatcaatggcggattttacagccgagctagcgatgagtttgtgaagaaagctggttgggacaaggatctggttcaagaatcttataaatgggttgagtctaaggttgtcttcatgccggagttgactcgatggcaatccattgtgcagttcggatttcttgaagcagggttttatccgtataacggatatagtttggagcacacgcaagggacaaagatcggtggaagcatatttgatcagtgtgggaaaagacatacatctgcagatcttttgggatatggtaaaccaaattgcatcactgttcttctaaacgcaacggtaaagagcataatctttgatgctaacaagactcgcgcagttggagttaggtttatggagagtgatgggaactcaagtaagagctacaaagttcatgttgagcagcatagaggcgaggttatacttgcggctggggctttaggtagtccgcagattctcctcttaagcggtattggacccgagaatcatctcaatgatttcgacattcctgtgattgtcaatctcaaagaagtcggaaaacaaatgtcagataatccagcgatctctcttctcgttgatagattctcgcaaaacctcacagtcgatccacctcaagttgtagcgataacagaaggttttaaattcatactccaatccctggttcttccaactaacattaccacaacaagaaccgctatatcagccaaaatcgcattccctaaatccaaaggaagactcaagcttaacaacactaaccctagggagaatccgtcagtgacgttcaactacttggaaaacaaggcagaccttgacgcatgccaagagatggttttgcatcttcaacacgtggctaggtcaaagactgtgacgtttttcttggggacacaagctcaggataagctagtggcaggtgacgaagagcttaagaagttctgcataaagaatgtgagaacttattatcattaccatgggggttgcgttgtgggatctgtcgtgaatgaggaatataaagtgaatggtgtgaagcgtttaagagtcgttgatggttcaacgtttgaagaatcaccaggaacaaaccctatggcaacagtattaatgctgggaagatatcaaggaatcaagatactcaaagaacattag

SEQ ID NO: 2175 - DNA, 3552 bp, Arabidopsis thaliana
atggggacagagctaatgagaatctgtgtgaaagaagatagtgatgatttgccatctgttcctcctggttttgaatcatatgcaacttttaccttaaaaagagtagtccctgctactacttctgataaagccaagactcctgcaattgaaagtgtttctgcaaccgaacaagctaagatggaagttgaatctgatgaagccaaagctgctcgggctctacgccgtagaccttggattaatcatagcggatgtgatgatgatggtgattgtgctgcaaacaatgacaatgctgcatctcaaaatcctgatcaaaattgtgatgtgaagccagctcttccaaagggtgtggtcaggggatgtgaagaatgtaaagattgtcagaaggagtttgaagacactttaaattatatcgctaaaataagaccggaggctgaaaagtatggaatctgtcgcattgttcctcctccttcctggaaaccgccgtgcccactgaaagaaaagcaagtatgggagggttctaaatttacaacacgtgtccaaagagttgataaacttcagaatcggagttcaatgaagaagatttcaaagcttcctaatcaaatgagaaagaagaaaagaaagtgcatgaaaatgggaatggattctgtcactaatggtatgggcgatccctgttctgcaagcactggaatgaatgaacttgagacgtttgggtttgaacctggtccagggttcacactaaaagacttccaaaaatatgctgatgagttcaaggctcagtactttaaaaagagtgaaacttctacagacgataaatgtaaagttgataattcaatagactgctgggagccagcacttgaggatgttgaaggtgaatattggcggatagtagataaagcaactgaagagatagaggtgctatatggtgctgaccttgaaactggggtatttggtagcggattccccaagatatcatcaagtcacaatgcttcttcttcagaagataaatatgcaaaatcaggctggaacttaaataactttccaaggcttccgggatccctccttaagtacgagggcagtgatatttccggtgtccttgtgccgtggctgtatattgggatgtgcttttcttctttctgctggcatgttgaagatcaccacttgtattcgttgaattatatgcactggggtgcaccgaaattgtggtatggtgttggggggaaggatgctgttaaactcgaggaggcaatgaggaagcatttgcctgacctttttgaagaacagcctgacttacttcataagctagttacacaactctccccgtcaaaactgaaaaccgcaggagtacctgtgcaccgttgcgtccagcatgctggagagtttgtcttgacttttcctcgggcatatcatgctggatttaattctggtttcaactgtgctgaagctgtgaatgtagcacccgttgactggttacctcatgggcagattgccatagagttatactgtcaacagggtagaaaaacgtccatctcgcatgataaattgttgcttggggcagcaagggaagtagtgaaagccgactgggagctgaacttactaaggaaaaatactgtagataacttaaggtggaaagcattcagtgcgaaggatggaattttggcaaaaacattaaaggcacgcattgacatggaacgtacgagaagagaatttctgtgcaactcttcacttgcattgaaaatgcacagtaatttcgatgctaccaacgagagagagtgctgtatatgcttctttgatttgcacctgtctgctgctggctgtcgttgttccccggagaagtattcatgtttgactcatgtgaaggagttgtgttcatgtccatgggttactaaatattttctatttcgctatgatatcgatgaactgaatgttcttgttgaggcagtggaaggaaaactgagttctgtatatagatgggcgcgtcaagatttaggattggcattaagtacagacgtctcaggaagcaagatggagatagatgaagaaggaaaagtccacaaggacccgactccacaaacaactgcactttcagggaaggatttgcagttgaaagtaacatcgaaagaagtaagtaaagagttagaaaagactagtaaattatctcatgttaatttacttctgaaagaaaaggaggagcaaataacgtcaagtcactgtatgaagcctgtcaaagaagaaactgtttgtgattcttctgatccaaacgtttcagcttgccaaccatctgaaggaggcataatctgtatgacagctgttaagtccgcaagtggtaaaaagaattcacagagtctacccaatgatgtgatactcctcagcgatgatgagtatgacatacctaggaaacgaggttctgtgagaagagatgcaatttcttctggcaagaaattagaaatacgagagagaccgacccacgttttggcgttagaagcttctgccaaaattgctgctccaatttgccaaagggaaggagattcgctgcgtgatacacgaaacactatatcattgcctactaatgaccaaaaaacaatgagaagggatgtaccgagttctacttcgcacgcggaagttaatgcggaggctactgggcttactcaagatatatgtaacagaatggcaactaacagccacggtggtggaaaacctactagttgtaaatccaaaaactctggaggtttggctatagtggatgttgtggatgggacaagaagtagttcaggtacaccgtcttgttcgcaaaataatagtccggataggttcatccgccaaaagggtccccgcattgcaaaggtcgtgaggagaatcaattgcaatgtagagcctttaagttatggatgtgtgctgtctggaaaatcatggtgcagccggcgagcaatttttcctaaaggatttcgtagccgggttaagtacataaacattttggatccaacaaatatgtgcttctacatttcagaaattctggatgctggacgcaacagtccattgttcatggtttacttggagagtaatcccagtgaggtgttcgttcatatgtcgcctacaagatgctgggagatggtaagagagagagtaaatcaagagataactaagcagcacaaagctggaaaatcagatcttcctcctttgcaaccctctgggagtcccgacggttttgaaatgtttggatattcgtcacccgcaatcgtacaggctatcgaagcattagacgtgaatcgagtttgcacagactattgggattccaggccttattcccggccacaagttcagttccctgcaaatcctcttctcagagaagccaacacaagtggcagatcgaatgtgggaaatctccagctaaaccctggacaccatatatcgcctactggaataaattctattcttaaagttctgttcaagaaagctagcatggaggaactaagctcacttcaagaggttttaagtgagactaactcagatatggtgaccgaacttgtgaaggaagagatccagaaccgtcgctga

SEQ ID NO: 2176 - DNA, 270 bp, Arabidopsis thaliana
atggcaaaggctatcgtttccatcttcgttgtctttttcatcttcttcttagtcatttccgatgtgccggagatagaagcgcaaggtaacgagtgcttgaaagaatacggaggtgatgttggtttcggcttttgtgcgcctcggatatttccgacgatttgttacacaagatgccgtgagaacaagggagctaaaggtggaagatgccgttggggacagggcagtaacgtcaaatgcttatgcgacttctgcgacgatactccacagtaa

SEQ ID NO: 2177 - DNA, 1476 bp, Arabidopsis thaliana
atggaatccaattgtgttcaatttctcggtaacaagaccattctcatcacaggagctcctggttttcttgccaaggttttggtagagaaaatactaaggttgcaaccaaatgtgaagaagatataccttctgttgagagctcccgacgaaaaatcagccatgcaacgcctacgtagtgaggttatggagatcgacctttttaaagtgttgaggaacaatctaggagaagacaatttgaatgccttgatgcgggaaaaaattgtgccggttccaggtgatatatcgatcgataatttgggattgaaagacactgatctcatacaacgtatgtggagtgagattgatatcataatcaacatagcagccacaacaaatttcgatgaaagatatgatattggtcttggcatcaacacatttggagccctgaatgttctcaacttcgccaaaaagtgtgttaaaggacaattgcttctccatgtctcaaccgcgtatataagcggtgaacaacctggattgttactagagaaaccattcaagatgggggagactctcagcggggatcgggaactagacatcaatatagaacatgatctaatgaaacaaaaattgaaagagcttcaagattgttctgatgaagagatctcgcaaacaatgaaagattttggaatggcaagggcaaagcttcatggatggccaaatacatatgtattcaccaaagcaatgggagagatgctaatgggaaaatacagagaaaatttgccacttgttatcatacgtccaacaatgattactagtactattgccgaaccattccccggttggattgaagggttgaaaacattagacagtgtgattgttgcatatggtaaaggaaggcttaaatgttttcttgcggattcaaactcagtctttgaccttataccggcagacatggtagtaaatgcgatggttgcagccgcgacagctcattcgggagacaccgggattcaggcaatatatcatgttggttcgtcttgtaagaatccagtcacgtttggacaacttcacgatttcacggctcgttacttcgctaaacgtcctttgattggtcggaatggctcgccaatcatagtggtcaaaggaaccattctgtccactatggctcaattcagcctctacatgacccttcgttacaagcttcctctacagatacttcgattgatcaatatagtttatccatggagtcacggagataactacagtgacctaagccgcaaaatcaagctagctatgcgactagttgagctttaccagccttacttactcttcaagggcatatttgatgatttaaataccgaaagactgcgaatgaaaagaaaggagaatatcaaagagttagatggatcgttcgagttcgatcccaagtccattgattgggacaattatatcacaaacacccacattcctggcctcatcacccatgtgcttaaacaataa

SEQ ID NO: 2178 - DNA, 1440 bp, Arabidopsis thaliana
atggctagtactctgaggaacattcatggtaagagatctaatttgcaatctgagtttactggaaatggaggaagtaagagaagaaatcttcatgatgaaacagatcaaaatgttattgcttcagaagacactgtataccgctacttgtgtcccgtgaaaaagaccgggagcattatcgggaaaggcggcgagattgctaagcagataaggtctgagactaaatcaaacatgaggataaacgaggctttacctggttgtgaggagcgtgttgttaccatgtattccactaatgaggagttgaatcattttggagatgatggtgagcttgtttgtcctgctttggatgctcttttcaaggttcatgacatggttgtagcggacgctgatcaagatgatggtactgatgatgataatgatcttggtgaaaagcaaacggtaaccgtgaggatgcttgtaccgtctgaccaaattggttgcgttattgggaaaggaggtcaagtaatccagaatcttcgtaacgacaccaatgctcagattcgtgttatcaaagatcatcttcctgcttgtgctttgactttgagtcatgatgagcttcttctgataattggagagcctttggttgttagagaagctctttatcaagttgcttcactgcttcatgataatccttcaagatttcaacacttactcctgtcttcttcaagttcttccatgcatcaacctggtgcaatgttaatgtctgcagcactgacgagctctcacagaaactacgctgtgcgtagagatatagcagatgcaagagaattttgtgtttgcttcatctgtccagctgaaaacgttggaggtgtgattggaaaaggcggtggtttcattaatcagatcaggcaagaaactggtgctactattagagtcaatacctcagaaactgatgatgatgattgcatcattttcatatcatcaaaagagttctacgaagatcaatctccagcggtgaatgcagcaatacgcttacaacagcgatgcagtgagaaagttggtaaagatgcaaatgatttagcaatctctacgcgtttacttgtatcgagttcccaaatcgggtgtctcattggaaaaggtggagcagttatatctgagatgaggagtgtaacaagagctaatattcgtattcttcaaaaagaagatgtaccaaaaattgctcgtgaagatgaagagatggttcagattacaggaagtcctgatgccgctatgaaagctctcacgcaagtaatcttgcgattaagagctaactctttcgacatggatcatggacttgtcttgctaccaacatcttttccatatatccctcaagtgactgaaagttcgagcaaatccaaatacgcaaaacgcgatgaccacagtaaactgaattcgaattctaagagaagaaaccatgtttcttaa

SEQ ID NO: 2179 - DNA, 648 bp, Arabidopsis thaliana
atgggaatggtttttggtaaaatcgctgtagagactcctaaatacacggtgactaaatccggtgacggttatgagatccgtgaatatccaccagcggttgcggcggaggttacatacgatgcgtcggagttcaaaggtgataaagacggaggctttcagcttttggctaagtacataggtgtgtttggcaaaccggagaatgagaaaccggagaaaattgctatgactgcaccggtgatcactaaggaaggtgagaagattgcgatgactgctccggtgattactaaggagagtgagaagattgagatgacttctccggttgtaactaaggaaggtggtggagaaggaaggaagaagttggtgacgatgcagtttttgttgccgtcgatgtataagaaggcggaggaggcaccacgtccaacggatgagagggttgtgattaaggaggaaggagggaggaagtatggtgtgattaagtttagtggtatagcgtcggagagtgtggtgagtgagaaggtgaagaagctgagtagtcatcttgagaaagatgggtttaagatcaccggagatttcgttcttgctaggtataatcctccatggacgttaccaccgtttaggaccaatgaggtcatgattcctgttgaatga

SEQ ID NO: 2180 - DNA, 594 bp, Arabidopsis thaliana
atggccagagagaagattgtggtggctggtggtaccacaaagagctggaaactactcttggggctgagaatatttgcattcatggctactttagctgcagccattgtaatgtcactaaacaaagagacaaagaccttggttgtggccaccattggtactgttcctattaaagccactttaaccgctaagtttcagcacacaccggcttttgtgttctttgttatagctaatgtaatggtgagcttccacaacttgttgatgattgtggttcagattttcagccggaaactggagtacaaaggtcttcgtctcctctctatcgccattcttgacatgctaaacgcaacactagtatctgcggctgcaaacgcggcggtgttcgtggcagagctagggaagaacggaaacaagcacgccaagtggaacaaagtctgcgacaggttcaccacttactgtgatcacggcgcaggagcaatcatcgcagcattcgccggagtcattctaatgctcctcgtgtccgccgtctctatttcccgcctcttaatcaattctaaaaacttctccaccaccgccaccacaacctccgtcgtctaa

SEQ ID NO: 2181 - DNA, 1116 bp, Arabidopsis thaliana
atgtctgtctctattccggtcttaatgaagagactttgtctgtataactctctctctctctttctttttcacctctttccctcaccctctctggctctctcattctctgttgagttgaacttactaaaagcacaaatggtttgggcaaatgctaagatgaggctagctttgtctcttgttacggttttcttcggcatctctcttgctaatcttgaagtcggattttactccaatacatgccctcaagccgagtcaatcgttaagagggttgtctcaggggctgctctttccgaccctaacctcccagccatacttctacggctccatttccatgattgctttgttgagggatgtgatggctcgatcctcgtgaacaacggagcaatctctgaaaagaatgcatttggacatgaaggcgttagaggatttgagatagtagaagccgtcaaagccgagcttgaagctgcatgccccggtgttgtctcctgctcagacattgttgccttggctgcacgtgatgccatatctttggcgaatggaccggcgtatgaggtgccaactgggcggagagatggtcgggtttcgaacatgtcattggctaaggacatgccggaggtgagtgactcgattgagatactaaaggctaagttcatgcagaaaggactcaacgccaaagacctcgtgcttctcagtgctgctcacactatcggaacaacggcctgcttcttcatgtccaaacggctctatgatttcttacctggtggccaacctgacccgactatcaatccaacattcctacccgaattaaccactcagtgcccacaaaatggtgacataaacgtccgtttaccaattgaccggttcagcgaacggctattcgacaagcagattctgcaaaacataaaggatggttttgctgtgcttcagaccgacgcaggtctttacgaggatgtaacgaccagacaggtcgtggattcctatcttgggatgctaaatccattctttgggccaacattcgagtctgatttcgttaaggcgatcgtaaagatggggaagattggtgtgaagactggtttcaaaggggagattcgacgggtttgctcggccttcaattga

SEQ ID NO: 2182 - DNA, 1569 bp, Arabidopsis thaliana
atgaagacgcaacatcaatggtgggaagttcttgatccattcttgacacaacacgaagctcttattgcattcttgacttttgcagcggttgtaattgtgatttacttgtaccgaccctcctggtccgtatgcaatgttcccggtccaaccgctatgcctctagttggtcacttgcccttgatggctaagtatggtcctgatgtcttctccgttcttgctaagcaatatggccctattttcagatttcagatggggaggcaaccactgataataatagcagaagcagagctttgcagagaagttgggataaagaagttcaaagatcttccaaacagaagcattccttccccaatctcagcttctcctcttcacaagaaaggcctcttcttcaccagggacaagagatggtctaaaatgagaaacaccatcctatctctctatcagccttcacatttaacaagtcttatccctacaatgcatagtttcatcacttctgctactcataatcttgattctaaaccgcgagatatcgttttctccaacctcttcctcaaacttaccactgatatcatcggacaagcggcttttggagtcgacttcggtctttccgggaagaaaccaatcaaagatgtggaggtgactgatttcataaaccagcatgtctactctacaacacaactcaagatggatttatcaggatcactctctatcatcttaggcttactgattccgattcttcaagagccgtttaggcaggtgttgaagaggataccgggaacaatggactggagagtcgagaagactaatgcaagactgagtggacaacttaatgagattgtgtcaaagcgagccaaggaggctgagactgactcaaaagacttcttgtcattgattttgaaagctcgagagtccgatcctttcgccaaaaacatcttcacatcggattatattagtgctgtgacttatgagcatcttcttgctggctctgcaaccactgctttcacactatcctctgttctttacttagtctctggtcatcttgatgttgagaaacgtctgcttcaagaaattgacgggtttgggaaccgtgatctgatcccgactgctcatgacttacaacacaagtttccatacctcgatcaggtcattaaagaggctatgagattctacatggtttctcctttggttgcaagggaaactgctaaagaagtggagataggaggttatttactcccaaaggggacatgggtttggttagcactaggagttctagcaaaggaccctaaaaactttccagaaccggagaagttcaagccggaaagatttgatccgaacggagaagaggagaaacatagacatccatacgctttcatcccattcggtatcggtccacgagcctgtgttggacagagatttgccctgcaagagatcaaactcacattactgcatctctaccgtaattacattttcagacattccctagaaatggagataccactgcagcttgattatggtataattctcagcttcaagaacggggttaagctcagaaccatcaaaagattctga

SEQ ID NO: 2183 - DNA, 1701 bp, Arabidopsis thaliana
atgcagaaacaattagcatatattacaaaacacatactaattgtttctccttctccttcttccttgcaaatggatactttagcttcaaactcttcggatctcacgaccaagtcaagtctcggaatgtcgtcgtttaccaacatgtatctcctcacaacgcttcaagcccttgcggccctttgcttcttgatgattctcaacaaaataaagtcatcttcacgaaacaagaagttgcatcctctcccgccaggacccaccggttttccaattgttggaatgattccggcgatgcttaaaaaccgtccagttttccggtggctccacagcctcatgaaggagcttaacacggagatagcttgtgtgcgtctaggaaacactcacgtgatccctgtgacatgtcctaagattgcacgtgagatcttcaagcaacaagacgcactctttgcgtcaagaccactcacttatgctcaaaagattctctctaacggctacaaaacctgcgtgatcacaccgtttggcgaacaattcaagaagatgaggaaagtgatcatgacagagattgtttgtccagcgagacaccgttggctacacgacaatagagctgaggaaaccgatcacttgaccgcttggctctacaacatggttaagaactctgaaccagtcgatctccgttttgttacgaggcattattgtggaaatgcaatcaagaggcttatgttcgggacgaggacgttctcggagaaaaccgaagccgatggtggaccgactttggaagatatcgagcatatggatgctatgttcgaggggttagggtttacgtttgcgttttgtatatcggattatctaccgatgcttacgggattggatctaaacggacatgaaaagattatgagagaatccagtgcaattatggataaatatcacgatcctataattgatgagaggattaagatgtggagagaaggtaagagaactcagatcgaagattttctagacattttcatctctatcaaggacgaagctggccagcctttgcttaccgctgatgaaatcaaaccaaccattaaggaacttgtaatggcggcgccagacaacccatcaaacgccgtggaatgggccattgcggagatgataaacaaaccggagatcctccacaaagctatggaagagatcgatagagtcgtcggaaaagaaagattcgtccaagaatccgatataccaaaacttaactatgttaaagctattatccgagaagctttccgtcttcatcccgtcgccgccttcaacctcccacacgtggcactctctgatacgaccgtcgcaggttaccatattcctaaaggaagtcaagttttacttagccgttacggtcttggtcgtaaccccaaggtttggtctgatccacttagcttcaaaccagaaaggcatctcaatgagtgttcggaagtgactttgacggagaatgatctccgttttatctcgtttagtaccggaaagagaggatgtgctgctccggcgttaggtacggcgataacgaccatgatgctagcgaggcttttgcaagggtttaagtggaaactagcaggaagtgagacacgtgtcgagcttatggaatcgagtcatgatatgtttctttcgaagcctttggtgttggtcggagaattgagattgtcggaggacctttacccaatggtgaagtga

SEQ ID NO: 2184 - DNA, 990 bp, Arabidopsis thaliana
atggctcgcttcgatattgttctactcataggtctttgcctcataatctctgtctttcccgatacaaccaccgcacaactaagccgcggtttctactccaaaacttgccccaatgtcgaacaaatcgtgagaaatgctgtccaaaagaaaataaagaagacattcgtcgccgtccctgccactctccgtctcttcttccacgactgctttgtcaatggttgtgatgcatctgtcatgatccaatcaacgcctaagaacaaggcagagaaggatcatccagataacatttcgctagctggagatggatttgatgtggtgatccaagctaagaaagcccttgactctaaccctagttgccggaacaaggtctcatgtgccgatattcttactttggccacccgagatgttgttgttgcggctggaggaccgtcctatgaagttgaacttggtaggttcgatggtttggtatcaaccgcgtcaagtgtcgaagggaacttaccaggaccttcggacaatgtagacaaacttaatgctcttttcacgaaaaacaaacttacccaagaagatatgattgctctttcagcggctcacacccttggattcgcacattgtggcaaggtctttaaaagaatccacaaattcaacggcatcaactccgtggacccaactttaaacaaggcttacgctattgagcttcaaaaggcttgtcctaagaatgtggacccaagaattgcaatcaacatggacccagtcacgcccaagacgtttgacaacacttacttcaagaatcttcaacaaggcaaaggtctcttcacctccgatcaagttctcttcacggatggtcgctctaggcccaccgttaatgcttgggcctcaaactctacggcctttaaccgcgcttttgtgatagccatgaccaaacttggccgtgttggagttaagaatagcagcaatggaaacatccgtcgtgattgtggtgcgtttaactag

SEQ ID NO: 2185 - DNA, 2397 bp, Arabidopsis thaliana
atgaagttcggaaaagagttctcgtctcagatggtgccagagtggcaacaagcttacatggattacgattttctcaaaactcttctcaaagaaatcatcacattcaaacgaagaaccaacaatgcaccttctcatggtggtgccaagaccggcggaggattaaaccggaaattgactctataccgtgcgtttagcggtcttgtctcaacgccaaggcataaacgtagtaatagctctcatgatgttgaagaaggtgtacagttgacgggatcgatgaggtcggggccgattcttgtgaacacgaccgcgagtcatggttatgagacgacgtttctgatggccgcggaagaaggaggagagtacgaactagtgtttttccggcgactagacgatgagttcaataaggttgataagttttacagaaagaaagttgaagaagtgttgaaagaagcggcgatgcttaataaacagatggacgctttgatcgcgtttcgtgttaaagttgagaacccagatggatggagatgggaggaacggacggtggagatgactcgattagcttccgatattgctacttctgcggcggctctctctgcttctactccagccggagctaaatccatgaaagttagaagtcaagagcacatggaagcaatccaagaaggaggctcgagcagagctgggctaatggaagatgatgaagaagacgaagacgaacaaaacgaaacctctgtggtatctaccggagcaatcgataatgagactactacgagcaggatgagaggagcgagaccatctccgatcgatgtacttggtcgagttaagatcaacaacacaaaagagacacctcgttccaccattaaaggagttctcaaagtatcaaaacagacagatttaaaattcagcagagagaatctgatgaaagtcgaagagagtctcaagcgtgctttcatcgagttttatcagaagcttcgacttctcaagagctatagttttttgaatgtattggcgttctcgaagatattgaagaagtatgataagataacttcgagagatgcaacgaagccttacatgaaagtggttgatagttcatacttgggaagctctgatgaggtaatgagactcatggagcgtgttgaagcaacattcattaagcattttgctaacgctaatcgggcaaaagcaatgaacattttacgacctaaagcgaaacgagagagacatagaattacattttccacaggtttctcggctggttgcgttttttctcttatagtggctcttgttgctatcatccgtacccgaaatctcttggaaatggaaggccagaaggaatacatgaatactatgttccctctttatagcttgttcgggtttatcgtgctgcatatcatcgtgtatgctgctaatatatactactggaggcgatatcgagtaaactattccttcatatttgggttcaagcaaggaactgaacttggatacagacaagtcctgcttgttggtttcagcatcggagtcttggcattgctttgtgttcttgccaatcttgacatggaggcagaccccaaaacgaaagcctatcaagctagaactgaaattcttcctcttatcctacttgctgctatgttcattgttctagtcctgccattcaactacttttaccgctcgagtcgctttttcttcctcacttgtctgtttcactgcctcgcagctccactttacaaggttacattgcctgatttcttcttgggagatcagttaactagccaggttcaagcgattcgaagcatcgagttctatatatgttactatggttggggagacttcagacacagaaaaagcacttgcaaagaatctgatgtctacaacactttcttcttcattgttgctgtcatcccttatgtctctcgcctccttcagtgcctgcgacggctgtttgaggaaaaaaacccggaacaagggtacaacggactcaagtatttcttgactatagtggcggtttgcttgagaacggcttacagtatccaaaaagctgcaatattctgtacttactgggactttgtccatgattggggtcttctaaaccggacatccaaaaaccgttggcttcgagataaactccttgttcctcaaaagaaagtatacttcatagcgatggttttgaatgtcctgttgagatttgcgtggatccagacagttttagatttcaacttttctttcatgcatagacagacgatggttgccattgtcgctagtcttgagatcattcgtcgtggtatatggaatttcttcagattggagaacgagcatttgaacaatgtcgggaaataccgagccttcaagtccgtcccattaccgttcaactacgatgaagatgacgataaagataactag

SEQ ID NO: 2186 - DNA, 675 bp, Arabidopsis thaliana
atggcggagaaagaagagagtgtgaagcttctagggttttgggcaagcccttttagtcgtcgagtcgagatggctctcaaactcaaaggcgtgccatacgaatacttggaagaagatttgcccaacaagacccctttgcttctggagctaaacccgcttcacaagaaagttccggttcttgtccacaatgacaaaatattactcgagtcacatctgattctcgaatacatcgatcagacgtggaagaacagtccaattcttcctcaagatccttacgagaaggccatggctcgattttgggccaagttcatcgatgaccagatcctaacactagggtttaggtcccttgtaaaagcagagaaaggaagagaggttgctattgaagagactcgggaactgcttatgtttcttgagaaagaagtcactggaaaagatttcttcggtggcaagacaatcggattcttggacatgatcgcaggaagtatgatcccattttgtctagctagactttggaaaggtattggaattgatatgattccagaggagaagtttccggaattaaatagatggatcaagaatttggaagaagttgaggcagtgaggggatgtattcctccaagagagaaacaaattgagcgcatgaccaaaattgcagagacaattaagtctgcctaa

SEQ ID NO: 2187 - DNA, 483 bp, Arabidopsis thaliana
atgacagcccgttttaatcagcaaatcctgaaacaacgtcatttcagcgagagcaccagactcgtgaagaagagaaaaagaagaagcaggagaaaagtttgcttgctgtgcctgtgttggtcagtctttgaagaaatggtgaaatcgactagtaaggatgctcaggatctcttccattctcttcactctgcttataccgctacaccaacgaatctcaagatcatcgacctttatgtttgtttcgcggtcttcacagctttgattcaggttgcttacatggctcttgttggatcgtttcctttcaactcatttctctctggagttctctcgtgtatcgggacagcggttcttgctgtctgcctccggattcaagtgaacaaagaaaacaaggaatttaaggatttagcaccggagcgagcttttgctgattttgtcctctgcaacttagtcctccacctagtgatcataaacttcttgggataa

SEQ ID NO: 2188 - DNA, 579 bp, Arabidopsis thaliana
atggtgtctatgctgactaatgttgtctctggtgagaccgaaccctcggcatctgcgacatggacgatgggtcataagagagaaagagaagagttttctttgcctcctcaaccattgattaccggttcagctgtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactctatgcaaccttctctgacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaa

SEQ ID NO: 2189 - DNA, 393 bp, Arabidopsis thaliana
atgacggatgattgcaagaaatcgttcatggagatgaaatggaagaaagtgcatagatacgtcgtttacaaactcgaggagaagtctcggaaagtcaccgtcgacaaggttggtgccgccggcgagagctacgacgatctcgctgcttctttgccggaggatgactgtcgttacgccgtgtttgatttcgattacgtcaccgtcgataactgtcgtatgagcaagatcttcttcataacttggtcgccggaggcttcaaggataagggagaagatgatgtacgcgacgtcgaagagcggactgagaagagtgttggatggtgttcactacgagcttcaagccaccgacccaaccgagatgggatttgataaaatccaggaccgggccaaatga

SEQ ID NO: 2190 - DNA, 855 bp, Arabidopsis thaliana
atgacttgcagccaaacactcggaaacaacaacaccaacaaataccagatctgcgaggagatcggccgtggccgtttcggcaccgtctctcgcgtctacgctccggccaccggtgatttcttcgcttgcaaaaccatcgacaaagcctctctctccgacgaccttgaccgtgcctgtctcgacaacgagcctaagctcatggctctcttgtcctatcaccctaacatcgttcaaatccatgatctcatcgacactgattcgactctctccatcttcatggagctcgtccatccctctgtttcgatctacgaccgtctcgtctcttctggaaccttctttgagcctcagacggcgtcgttcgctaaacagattctccaggcgctttcgcattgtcaccgatacggcgtcgttcacagggatattaaaccggagaacattctggtagatctacgaaacgatacggttaagatctgcgatttcggttcagggatttggttaggtgagggagagaccaccgaaggagtcgtcggaacgccgtattacgtggcgccggaggttttaatgggatattcttacggagagaaggtcgatctatggagcgccggcgtcgttttgtacacgatgctcgctggaactccaccgttttacggcgagacagctgaagagatattcgaagcggtactcagaggaaatctccgttttccgacgaagatattccggggggtttcatctatggctaaagatttcctaaggaaattgatatgcaaagatgcttctagaagattctcagccgaacaagcattaaggcacccatggatccaaagagcaggagaaacagaggagagattcatctag

SEQ ID NO: 2191 - DNA, 3090 bp, Arabidopsis thaliana
atgaataaactagttgtagaaatcgttgacgctagcgatttgatgccaaaagacggacaaggctcagcgagtcctttcgtagaagttgaattcgacgaacagcgtcagagaacgcaaacgcggtttaaagatctaaaccctcagtggaacgagaagttggtttttaacgtcggtgacttgaagcgtttgaataacaagactgtcgacgtcactgtttacgatgaccgccgtgataatcagcctgggaagtttctcggccgtgttaaaattgccggtgcggttgttccgttatcggaatctgaatccggtgttcagagatatcctcttgataaacgaggtttgttttctaacattaaaggtgatatcgctttgagaatctacgccgctcctatcgacggcggcgatttcgtctctcctccgccggattttgctgagaaagtgatgaaagaagataagagattcgaatctcaggagtttcaatttcaaaatcagaatcagaatcagaatcactacgagcagtttgaagatgagattaataacatggagacgttgaagccgacgaagaagaaagagaaagagtcgagaacttttcactcaatcggtgctcacgccggaggaggaggaggagctccaccgatgtcacaagcgaaacaagcttatcctccacctccgaatcaaccggagtttaggtcagatttcatgagagctccaggaccaccgactggagcagtaatgcagatgcaacctccgagacagcagaatccggagtttcagctaattgaaactagtcctcctttagcagctcgtatgagacaatcttactattacagaagcagtggagataaaacgtcgagcacatacgatctcgttgagcagatgcattacctctacgttagcgtcgtgaaagctcgagatcttcctgtcatggatgtttccggtagcttagatccttacgttgaagtgaagctagggaactacaaaggtttaacgaagcatttggagaagaattcgaatccgatctggaaacagatctttgccttctctaaagagagattacaatcgaatcttcttgaagtcactgtgaaagataaagatcttttgactaaagacgatttcgttggaagagttcatattgatctcactgaagttcctcttagagttcctccagatagtcctttggctccacagtggtacaggttagaggataagaaaggtatgaagacgaacagaggagagattatgcttgctgtttggatgggaactcaagctgatgagtcgtttccagatgcttggcactcggatgcgcaccgagtgagccattcgaatctttcaaatacgcggtccaaagtttacttctcgccgaagctgtattacttgagaattcacgtaatggaagctcaggatcttgttccgtctgataaaggtagagtacctgatgcgattgtgaagattcaagcggggaatcagatgagagcgacgaggacgcctcagatgcggacgatgaatccgcagtggcatgaggagcttatgtttgttgtgtctgagccgtttgaggatatggtgattgtttctgttgatgataggattggtccagggaaagatgaaatattggggagggtgtttatacctgtgagggatgttccggtcaggcaagaggttgggaaaatgcctgatccacggtggtttaatctacaaagacattcaatgtctatggaggaagagaatgagaaaagaaaagagaagttctctagtaagattctgcttcgggtttgtatagaagcagggtaccatgtccttgacgagtccactcatttcagcagcgatcttcaaccttcttcaaagcatttgaggaagccgagtattgggattcttgagcttgggattctcagtgctaggaacttgatgcctatgaaaggtaaagatgggagaatgactgatccctattgtgtggcgaaatatggtaacaaatgggtcagaaccaggactcttttagacgcacttgcgcctaagtggaacgagcaatatacttgggaagttcatgatccttgcacggtcataacaattggagtctttgacaatagtcatgtcaacgatggtggtgactttaaggaccagaggattgggaaagttagagtcaggctatctacgctggagacagaccgggtttacactcatttctacccgttgctggttcttacacctggtggtttaaagaagaatggtgaacttcagctagctctgaggtacacctgcaccggctttgttaacatgatggcacagtatggaagaccgttgttgcccaaaatgcattatattcaaccaataccagtcaggcatattgacttgcttaggcatcaggcgatgcaaatagttgcaacaagactatcaaggtccgagccacctctgagacgagaggttgtggagtacatgcttgatgtagactaccatatgttcagtctcaggagaagcaaagctaatttcagcagaatcatgtcgcttctctcctcggtcactctggtctgcaagtggttcaacgatatctgcacatggagaaacccgatcacaacgtgtctggttcacgttctgttcctgattcttgtctgctacccagaactgattttacccacagtcttcctctacctctttgtgataggcatgtggaattaccggtacagaccaagacacccacctcacatggacgctcgagtgtcccaagcagacaatgcacacccagacgagctagacgaagagttcgacactttcccgaccagcagaccggcagacattgtcagaatgaggtatgataggcttaggagcgtcggtggtagagttcagacagtcgtaggcgatctggcgactcaaggggagagaattcaagctcttcttagctggagagacccgagagcaactgctttattcatcgtcttcgcattgatctgggccgtgtttatctatgtcacaccgttccaggtgattgcaatcataatcggtctgttcatgctgcgtcatccacggttcaggagcagaatgccttcagtacctgccaatttcttcaagagattaccagccaagtcagatatgctactgtaa

SEQ ID NO: 2192 - DNA, 1776 bp, Arabidopsis thaliana
atggcagagataaacaaacaaagcaacaaatgggaacaagaagaggttagtaatgaaaataattgggaattggctgaagaagaaagtgttgactggagagggagaccttccaaccctaacaagcatggtggaatgagagctgctctctttgttcttggactacaagcctttgagataatggggatagcagcagtagggaacaaccttataacttatgtaataaacgaaatgcatttccctttgtctaaagcggccaatattgttaccaactttgtcggtaccatctttatctttgcccttctcggcggctatctctcggacgcctttctaggcagcttctggaccattatcatattcggcttcgtcgagctttctggtttcatactactatcagtacaagcacatttaccccaactaaagccaccaaaatgtaacccattgatagaccaaacatgtgaagaagccaaaggtttcaaggcaatgatcttcttcatggcactctacttggtggctttaggaagtggctgcgtgaaaccaaacatgatagctcacggtgcggaccagttctctcagtcgcatcctaaacaatctaaaagactgtcatcttacttcaatgctgcctattttgcattctcaatgggcgagcttatcgctctaactctccttgtttgggttcaaactcattcgggcatggacattggatttggagtctctgctgcagcgatgactatgggcatcattagcttagtctccggtactatgtattttcgtaacaaacgtccacgtcgaagcatcttcactcccattgcccatgttattgtggctgccatattaaaaagaaagcttgcgtctccctctgacccaagaatgctccatggagaccaccatgtcgcaaacgacgtcgtaccctcctccactttaccacacactcctcgtttcaggttcttggacaaggcatgcatcaaaatccaagacacaaacacaaaggagagtccatggaggctatgcacagtaacacaagtagagcaagtaaaaaccctaatctcacttgtccctatctttgcaagcaccatagtcttcaacaccatcttggcacagctccaaacgttttcagtccaacaaggaagttccatgaacactcgtctctcaaattccttccacatccctccggcttcactccaggccatcccttacataatgctcatattccttgtccctctctacgactctttcttagtcccttttgcacgtaagctcacaggacataactcaggtattcctccattgactcggataggaattggactcttcctctccactttctccatggtttcagctgccatgctcgagaagaaacgtagagactcttcggttcttgacggtagaatcttgagtatcttctggatcacgccacagttcttgatctttggtatctccgagatgtttacagctgttggattaatcgagtttttttacaagcaatctgcaaagggcatggaatcattcttgatggcattgacttattgttcctactcctttgggttttacttcagctcggtgctcgtttcggtcgtaaacaagatcacttccacgtcagtcgactctaaagggtggctcggggagaacgacctaaataaggacaggctcgatctattttactggcttttagcggttcttagtctcttgaactttcttagctatctcttttggtctcgttggaacattaagtcttcgagacgcaacaacactaatgttgtgggtgatgagaacatttag

SEQ ID NO: 2193 - DNA, 975 bp, Arabidopsis thaliana
atggcggataagctcactgacgatcagattacagaatacagggaatctttcaggttattcgacaagaatggtgatggttccattacgaaaaaggagctcggtaccatgatgcgttcaatcggtgaaaaaccgacaaaagctgatcttcaggacttgatgaacgaagcggatttagatggtgatggaaccatcgatttccctgagttcttgtgcgtaatggctaagaatcaaggtcatgatcaagcgccgcgtcacactaaaaaaacaatggcggataagctcactgacgatcagattacagagtacagggaatctttcaggttattcgacaagaatggtgatggttccattacgaaaaaggagctccgtaccgtgatgttttccctcggtaaaaaccggacaaaagctgatcttcaggacatgatgaacgaagtggatttagatggtgatggaaccatcgatttccctgagttcttgtacctaatggctaagaatcaaggtcatgatcaagcgccgcgtcacactaaaaaaacaatggtggattatcagctcactgacgatcagatcttagaattcagggaagccttccgcgtattcgacaagaatggtgatggttacattaccgtgaatgagctccgtactactatgcgctcccttggtgaaacccaaacaaaagctgagctccaggacatgatcaacgaagcggatgcagatggtgacggaaccatcagtttctctgagtttgtgtgtgtaatgactggtaaaatgattgacactcagtctaagaaagaaacgtacagagttgtgaatcaaggtcagggtcaagtgcagcgtcacactagaaatgacagagctggtggcaccaattgggagagggacatagcggtcggggttgccagcaatatcatcgcttcgccaatttccgacttcatgaaagataggtttaaagatttgttcgaagcgctgttatcttga

SEQ ID NO: 2194 - DNA, 222 bp, Arabidopsis thaliana
atgaattttatgaaggacagtttggtcatttttaactcgtggccggagcttacgggaacaaatggtgactatgcggccgtggtgatagagagagagaaccccaccgtcaatgctgccgtgattttggatgggagtccggtgaccgcagacttcaggtgcgaccgggtcagagtttttgttgatggaaaccgtatcgtcgtcaaaacccccaaatccggctag

SEQ ID NO: 2195 - DNA, 1644 bp, Arabidopsis thaliana
atggagatttcttctgcttccgatgattcgatcgcttacgttgagacagatccttctggtcgctacggacgtttcagagaagtacttggcaaaggggcgatgaagacggtttataaagcatttgaccaggttttaggaatggaagttgcttggaatcaagttaagctcaatgaggttttccgatcacctgagcctttacaacgcctctactctgaggttcatctcctcaagaatctcaatcacgaatccattattcgttactgcacgtcttggatcgatgtcaaccgcagaacattcaacttcattactgagctgtttacatcaggcacccttagagagtatagaaggaagtatcaaaaggttgatatccgggcaatcaagagctgggcacgtcagatcttgaatggtcttgcttatctccatggacatgatcctcctgtcattcacagagacctcaaatgcgataatatcttcgttaatggacaccttgggcaagttaagattggtgacctgggcttagctgcaattcttcgtggatcacagaatgcgcacagcgtcataggaacgcctgaatttatggcaccagagctatatgaagaagattacaacgagcttgtagacatttattcgtttggtatgtgtgtcctagagatgcttaccggtgagtatccttatagtgaatgcaccaaccctgcccaaatatacaagaaagttacatcggggaagttgcctgactcattccatctaatccaacacacggaggcccaacgttttgttggtaaatgcttggaaactgtgtcaagaagattgcctgcaaaggagctcttagcggacccattccttgccgcaactgatgagagagatttggcgcctctttttagattgccgcaacaattggcaatccagaatttggctgcaaatggaacggtggtagagcatctgccgtcaacgactgatccaactagaacaacagatatgtcaataacaggaaagatgaactcagaagaccacaccatcttccttcaagtacagattctagatggcgatggtcacatgaggaacattcagttcccgttcaacattttaagtgacacacctctagaagtagctttggagatggtgaaggagcttgagatcactgattgggatcctttggagatcgctgcaatgatagaaaatgagatatctttgctcgtccccaactggagggccaatgactcttctatccggcacgaaagctttggtcatgaagatgatgaggacaatggcgacacagagggaagaacgcgccttttctcctctgcttcttcctctcacgactctcctgtagcagttagagagaacaatgacgattctagtaacgatgtgatcccagatatggatgatggcaatagaagctctaacaggttgctgaattcttcaacataccactactcacctgccattgatgatgatcaaaatcagcaacaacggagacgagtaaggctacaacagaaaatgagatcgctggtggacacgagaacacaggtgctacaccgatcgctcatggagttgatcaacaagcgtcgtgggcgtggctttgacccgaacacaaacgagctacaacctcaaccgtcgtccactgatttcattcgacgatgttga

SEQ ID NO: 2196 - DNA, 786 bp, Arabidopsis thaliana
atgtcacgtagttgctcacagtgtggaaacaacggccacaactctcgcacatgtccgacggacataactaccaccggtgacaacaacgacaaaggcggcggggagaaagccatcatgctttttggcgtccgcgtcacggaagcttcatcatcttgttttagaaaaagtgttagtatgaacaatctctctcaattcgatcaaactcctgatcccaacccaaccgatgacggtggttacgcttcagacgacgtcgttcacgcctccggtagaaaccgtgaacgcaaacgaggaactccatggacagaggaagaacatagattgtttcttactggattgcataaagttggaaaaggtgattggagaggaatctctagaaactttgttaaaactcgaacacctactcaggtagcgagtcatgctcagaaatattttctccggcggactaatcagaatcgtcgtcgtcgtagatcaagcctcttcgatatcactcccgattcgtttataggatcatcaaaagaagagaatcagttacagactccattggagctaatccgtccagttccgattcctattccgattccaccgtcgcggaagatggctgatttgaatcttaacaagaaaaaaactccagcgacaacggagatgtttccgctgtcgctgaatttgcagaggccgtcttcgtcgacatcgtcatcgtccaatgaacagaaggcacgtggctcacgtgcctcctcggggttcgaggcgatgtcgagtaatggagatagtataatgggagtggcttga

SEQ ID NO: 2197 - DNA, 546 bp, Arabidopsis thaliana
atggaagaggtgaagaaggatgtatactcggtttgggcattaccagatgaggaatcggagccccgattcaaaaagctaatggaagctttgagatccgaattcactggcccaagattcgttcctcacgtcaccgtcgccgtatctgcttatctgacggcagacgaagccaagaagatgttcgaatcagcttgcgacggtcttaaagcttacaccgccaccgttgatcgcgtctccaccggaactttcttctttcaatgcgttttcttgcttctccaaaccacccctgaggtaatggaagctggtgaacactgtaagaaccatttcaattgttccactaccacaccttacatgccgcatttgagcctgctttacgctgagttgacagaggaagagaagaagaatgcgcaggagaaagcttacacgctcgatagcagcctcgatggactcagtttccggttaaaccgacttgctctatgcaaaaccgataccgaggacaagactctagagacatgggagacagtggctgtatgcaatctcaatccttaa

SEQ ID NO: 2198 - DNA, 1866 bp, Arabidopsis thaliana
atggaggtttcgtcttcactcaagctctcatcgtcgttatctccttccatcatcaaacttcagggttcttcatcaagtattgatataaaattctctaagtacacttcacttcctaaaccgtttcttcaacttgatgataaaagccgacgtcttcgtgaccaacaagtttcacattctctcgagctaaggtcttacagaaaacgggtcactgcgaaatcaggttctcaaggttgggactttggtagattcgtcaaaacattgtactttttcaatggaccaccatctcctctaaagtttgtttcatcggtgtttgagaaacttactaacggagcaacggaggaaccggttgctgaaatgggaacttctggaatcatacttgtggctggagctactggtggtgtaggaagaaggattgttgatatcttgaggaaaagagggttgcctgttaaagcattggttagaaatgaagagaaggctcggaagatgttaggacctgagattgacttgattgttgcagatattacaaaggagaatacattggttcctgaaaagttcaaaggagtgaggaaagtgatcaatgctgtttctgttattgttggtccaaaggaaggagatacacctgagagacaaaaatataatcagataaaaggcgactctcccgagttagtggaatacattggaatgaagaacttaatcaatgctgttagagatggtgttggacttgagaatgggaagcttatttttggtgtcggggataacacgtttaaggatctaccttggggagcattggatgatgttgtaatgggaggtgtcagcgaaagtaacttcatagtagatctaaccgctggtgaaaacggtggacctaccggaatttttaaaggaattgtttccacaacaaataatggcggatttacgagtgtccgaaccaagaactttcccgaggcggagaatgtctctgcatatgatggtctagagctaagactaaaaggtgatggactccgttataagctaatcgtccgaacaagccaagattgggatactgttggttacaccgccagttttgacacttcaccaggccaatggcaatctgtacgcttacctttctcgtctttaagacctgtatttcgcgcacgtacagttacagatgcaccaccttttaatgcaagcagtatcatttcactacagcttatgtttagcaaatttgagtatgatggtaagcttaaccctacattcaaagaaggacctttcgagcttcctttatctagcattcgagcttatatccaagaccccgtcactccaaggtttgttcacgttggctctgcgggagttactcgaccagagagacccggtttggatctaagcaaacaacctccggccgtgagattaaacaaagagcttgatttcattctcacttacaagttaaagggagaggatctgatacgcgacagcgggattccatttgcaattgtacggccatgtgctttaacagaagagcctgccggagctgatctcattttcgaacaaggagacaacattacggggaaggtatcaagagacgaagtagcgcgtatatgcatcgctgctttagaaagcccgtatgctcttaacaagaccttcgaggtttttaaagaatcatcaatttttcgatttttccgggttgctattcaaaaagttaaatttctgaattgggctgttttgtgtgttgtttgtttgtttcaggttaaaagtacggttccgtttagcgagcctttcacggtagatcctgagaatcctccaccggagaaagactacaatgagtatttcaagactctgaaagatggaatcaccggtaaagaagctttagaacagagcactgttgcagtttaa

SEQ ID NO: 2199 - DNA, 1593 bp, Arabidopsis thaliana
atggaggaagagcttcgtgttcggctgaatgaccatcaagtgtcaaaggttttccctgtgaagcccaaatcaacggcgaaacctgtttccgaatcggagactccggaatcgaggtactggtcctccttcaaaaatcattccacacctaatctcgtctcctccgtagccgctttggctttctctccggtccaccctcactccttggccgtcgctcactccgccaccgtctccctcttttcctcgcagtcgctttcctcctcccgccgtttctccttccgcgatgttgtctcctccgtctgtttccgttccgacggagctcttttcgcggcatgcgatctctccggtgtggtccaggtcttcgacatcaaggaacgaatggctctccgtactctccgctcccacagcgcccccgctcgattcgtcaagtatccagttcaggacaagctccacttggtctccggaggcgacgatggagtcgtcaagtactgggatgtcgccggagcaacagtcatctcagatctgctaggccacaaggattatgtccgctgcggtgattgctcgcccgtcaacgattcaatgttggtaacaggctcttacgatcacacggtgaaggtgtgggacgccagagtccacacgtccaattggattgccgagatcaaccacggactcccagtggaggacgtcgtatacctgccttccggtggattgatcgcaaccgctggtggcaacagcgtcaaggtatgggatttgatcggaggcgggaagatggtttgctccatggagagtcacaacaagaccgtcacgtctctccgcgttgcgagaatggaatcggctgagagtcgacttgtgagcgttgctttggacggatacatgaaagtcttcgattacgggagagcaaaggtgacttactctatgaggtttcctgctcctctcatgtctcttggcctttcccccgatggttccactcgggtaatcggagggtctaatggcatggtgtttgccggtaagaagaaggtgagagatgttgttggaggacagaagaaaagtttgaatctctggagtctgataagcgatgtggatgagagtaggagaagggcactgaggcctacgtatttcaggtacttccagagagggcagagcgagaagccatccaaagatgattacttggtcaaggagaagaaaggattgaagctgacgagacacgataagctcttgaagaagttcaggcataaggaagctctggtctcggtgttggaggagaagaaaccggccaatgttgtggcagtgatggaagaattagtggcgaggaggaagctgatgaagtgcgtgtcgaatatggaggaaggcgagttgggaatgctgctaggcttcttacaaaggtactgcactgtgcagaggtattcaggattgttgatgggattgacgaagaaggttttggagacgagagctgaagacatcaagggtaaaaacgagtttaaagggcttctcaggaacttgaagagggaggttaatcaggagattaggatacaacagtctcttctagagattcagggtgttattgctcctttgatgagaattgcgggtagaagttga

SEQ ID NO: 2200 - DNA, 1041 bp, Arabidopsis thaliana
atggatgctcaacaacggagaactgatattcctcgagcaccaccggtcggagaacccggtggcgatatatcttcgattctcattgctttcggtgttttcgctgcaatcgccgccttggttatgtttccctcatcgttggtgcaccaagttcctgaaggtcacgttggagcgtattggagaggtggtgctcttctaaatataatcacagagccaggttttcatctgaagctgcctttcataaccaactatgagcctgttcaagttactctacagacagatcaagtgagggatataccatgtggtaccaaaggaggtgtcttgattacctttgagaagatagaagttgttaatcgactacgtaaggattttgtttatgacactttgcttaactatggtgtgaactatgataacacatggatttatgacaagattcatcatgagatcaaccagttctgtagctctcattcacttcagcaagtctacattgacatctttgaccagattgatgaacgaatgaaagatgctcttcaagctgattgtacacgttatgctccaggaattgagattcttagtgtgcgtgtcaccaagccgaaaattccagagagtgtaaggcgtaactttgagcaaatggaagaggaacgtaccaaggtcttgattgctattgagaaacaaagagttgctgagaaagaggcagagacaaagaaaataatggccattagtgaagctgagaagaacgccaatgtaagcaagattctgatgcaacagaagttgactgagaaagacagttcaaggagagaagctgatatcgagaatcagatgtaccttgaccgtcaaaagagtctcgcggatgcagattactaccgtgtactgagagaagctgaagcaaataagttgaagctcacccctgaatttcttgaactcaaattcatcgatgccattgctcgtaacaccaaaatattcttcggggacaaggttttactcgactctatctcatttctgaattcacatatctcgtgtcttatctctgttctgctgttctga

SEQ ID NO: 2201 - DNA, 207 bp, Arabidopsis thaliana
atgacaacctcaaaaagactagcagacaggaagattgagaaattcgacaaaaacattttaaagagaggatttgttcctgagaccaccaccaagaagggcaaggattatcccgttggtcccatccttcttggcttctttgtctttgttgtcattggatcatctctctttcagatcattaggactgcaactagcggaggcatggcataa

SEQ ID NO: 2202 - DNA, 672 bp, Arabidopsis thaliana
atggggaagaagtgtgatttatgtaacggtgttgcaagaatgtattgcgagtcagatcaagctagtttatgttgggattgcgacggtaaagttcacggcgctaatttcttggtagctaaacacacgcgttgtcttctctgtagcgcttgtcagtctcttacgccgtggaaagctactgggcttcgtcttggcccaactttctccgtctgcgagtcatgcgtcgctcttaaaaacgccggcggtggccgtggaaacagagttttatcggagaatcgtggtcaggaggaggttaatagtttcgagtccgaagaagatcggattagagaagatcacggtgacggtgacgacgcggagtcttacgatgatgatgaggaagaagatgaggatgaagagtacagcgacgatgaggatgaggatgatgatgaggatggtgatgatgaggaagcggagaatcaagttgtgccgtggtctgcggcggcgcaagttcctccggtgatgagttcttcatcttctgacggaggaagcggaggttcagtgacgaagaggacgagggctagagagaattcagatcttctctgctccgatgatgagatcggaagctcttcagctcaagggtcaaactattctcggccgttgaagcgatcggcgtttaaatcaacggttgttgtttaa

SEQ ID NO: 2203 - DNA, 393 bp, Arabidopsis thaliana
atggaagagatcaccgatggagtgaacaacatgaacttagccaccgattcgcagaagaaaaaccggattcaggtttccaacactaagaaaccattgttcttctatgtcaatctcgccaagaggtatatgcagcagtacaatgatgttgaattgtctgcccttggcatggccattgcaactgttgttactgttactgaaatactgaagaacaatggttttgctgttgagaagaagatcatgacttcaactgttgatattaaggatgatgcaagaggacgtcctgtgcagaaagctaagattgagattacgcttgtgaagtcagagaagtttgatgaactaatggctgcagccaatgaagaaaaagaagatgcagaagctcaggtgcagaactga

SEQ ID NO: 2204 - DNA, 1815 bp, Arabidopsis thaliana
atgggagcagaagaatttccgagtgttccgttcaactcaaatgcaatggacaacgctgaatataccgacacagatttggtgtttgccgttagaaaggcccttgcatctgtccaaaatggagataccgacgattatagtcagcttaaaacagtgatgtgccttacagaagacgctgatttcgatgcagtggcacagcttgagacagtcttgaaaagtctatcagtttccgttgcttggatagatttagttcatcataaagatcttcttgaagctatgagcttgtggtatcatagtcacagacctagtgtaatggatgcattggtggacctaatcatatcactggccgctactagtggaaaatatctggatccttgtttgaatatgctcgtaagaaatttcagtcaacctacttttaagcataaagtttcacaaacccaattagtcaaaaagatgcaggaagttcatccacgggtgcatgcagcccttcacaagatttcttatttaattcctcttgctccctggaatttagtgtctatacttgcgcagaacatgcgtaaaattgacaaaaaggacccttctatagtgacatatgtggataacctgttgaggttggagaatagctcaatcggagaagttgttggcagcgtgattcttatgatggtaatggagaggatgctagatttagatttggtaagtggatgtgatgactctaatggaggcatgtttgatatggaacttgaagatgcagttgaaagcactatgaatgaaggagacgagtttccagtgggggctctaaaacaaaatacttcaggtggaaatgtagtctctgaactgttggacaaattgatggtcctattttttcatcatctagaatcctgtcaaaactctgatcgtttggatgaggtatttgaaatcctctttaagtcgttcgagaactatattctgaacacatacaaaacaaaattttcacagtttctgatgttctatgcatgctcactagatcctgaaaattgtggtgtgagatttgccagtaagctgttggacatatatctctccagcaacacatgtcgacttactaggatgagtgcagtggcttatctagctagctatttgtctcgtggaaagtttttgcctgcttcttttgtggctagcatgttgaaaagattggtggacgagtgtgcggaatattgcggaacatgcaatgatgatgtgaagccagaagcacatcaagtgttctattctggatgtcaggcaatcttgtatgtgctatgcttccgaatgagatccatagtggagattcctcgctttcaatcgcagtttagatcattggagtcaattttatctcacaaactaaacccactactggtgtgtcttccatctgtagtttccgagttccttaaacaagccaaagctggtggtctgttcattgtctcagaatccttcattttcgatgacctacacgagtctgagctctctcgtgcttttggtggctttgaaaggcttgacacattcttcccgtttgacccgtgcttgttgaaaatgtctagcagctacatctccccgaacttcaacttctggtcaatggtgaaaacgacttatggagaagatggtgacgaagagctttgtgatgaggtcatagtgaatggagatgcagacagtgcggaggaacctgacgatgacgttgaacttgatagtgagatgaacacgatgtctacaactccgaaacactctttcatgcgagaaacagagaggctcttgaagatgccttcaagaatcagaccatccactagtcctcctgaatccttcttaatctaa

SEQ ID NO: 2205 - DNA, 1443 bp, Arabidopsis thaliana
atggaagatccacttttattgggagacaatcagataatcaccggaagtcttaagccgacgccgacatggaggatgaatttcacggcggagctcaagaacctcagccgcatggcgctgcctatggccaccgtgactgttgctcaatatctattacccgttatctcagtcatggtcgccggccaccgcagcgaactccagctctcaggcgttgctcttgccacttcttttacaaacgtatccggcttcagtgtcatgtttggtttagcgggtgcacttgaaactctatgtggccaagcttatggagcaaaacaatacgcgaaaatcggaacttacactttctctgcaatagtctcaaacgtacctatagttgttctcatatcgattctctggttttacatggacaaactctttgtttcacttggacaagatcctgacatctccaaggtagctggttcttacgcggtttgtcttataccggcattgttagctcaagcggtgcaacaacctttgactcggtttctccagactcagggtttggttcttcctcttctctactgtgccataaccacccttttgttccatataccagtttgtttgattctggtttacgcgtttggtcttggaagcaatggagccgccttggctattggtttgtcttactggtttaacgtcttgattcttgctttatatgtgagattttcaagttcttgcgagaagactcgcggctttgtgtctgatgatttcgtgttgagtgtcaagcagttttttcagtatggaataccttcggcagcaatgacaaccatagagtggtcattgtttgagttccttatattatcttcaggactcctcccaaacccgaaactcgagacctctgttctttccatttgtcttacaacctcatctctccactatgtcattccaatgggtattggggcggctggaagattagtcatactatttacccttggcagtatacgggtttcaaacgaattgggagcgggtaatcccgaggttgcgaggctggcagtgtttgccggtatattcctttggttcctagaggctaccatttgtagcacacttctcttcatttgtagagatatcttcggctacgcctttagcaatagcaaagaagttgtggactatgtcacagagctatctcctttgctttgtatctcatttttggttgatggattttctgcagtgcttggtggggttgctaggggaagtggatggcaacatattggagcttgggcaaatgtggtggcttactatctcctaggagctccggttggacttttcttaggattttggtgtcacatgaatggtaaagggctatggatcggtgtggtggttgggtctacggcgcaaggaatcatactagctatagtcactgcttgcatgagttggaacgagcaggttaatatcaatctgaaatatttatga

SEQ ID NO: 2206 - DNA, 861 bp, Arabidopsis thaliana
atggagctactcacaagcttgaccaactggttaactccgacgactctcttcctcctcctcaatttcacgatcgccaccattttcatcaccaaccggttcagttcctgttcaagaaaacacaaccaacatcaagatggttacgggtcgtcgggtcatgaccaaaatcaggcacggtttggcagacctccttcgctcatagacagagtaaagtccatcaacttccatctgtacaattctccttcaccagaatccgagatccactactccgggtcggatcctaacccgaacccacctccttctctcttgcaacgggtcaaatccatcaacatgccttacttcaagttcccacaacacaattctgaaggagattacgctgcttacgagctcatgacccaacccgacgagactaaccgggtcgacccgatcgacaagatcccggaggatgacgtcacgaccgaacctagattcggagctccatcactcttgcagcgggtgaaatccataaagcttccttctttatacagatccgacccagatccaacaccagaagtgcaaacacatacgaggacgaagtcggagtcgagtaaaccggcgacgaagaagaagaagaaagctacaaagaagatgatgaaatctgctagcgagagacacatcggccgggaagaggaggagacagttgaggccgtggagaagagaaggccggagacgatgagagttgagagaacgacgtcgataggagacggaggagaagaaggtgtcgacgataaagcttcaaatttcatcaacaagtttaagcaacagcttaagctacagaggctagattcgtttctaaggtacagagagatgctcaagaacgattaa

SEQ ID NO: 2207 - DNA, 528 bp, Arabidopsis thaliana
atggtgaatcaaagaaagctacaagaagaagaagaggaaaaggagaattatcctctcattacaaccaaagtagttgagtatttgcagccagtaatgtgtcgagagcttctctgcaaatttccagataactctgcttttggattcgactactcacagagctctctttggtctcctctcttgcctcgaaattacgccagtccttcagatctagactccgacagttgcgtttgtcggaatcttaagctaagggagtttcaagtaggcaagaagaagaagatgaagatgatgtcaatgaagaagaacaagaagaagagtaaattactgaaactagacataccttcaatgaagaatgatgattcttcccctaaaattggctgttttccctctccctacccaaggtatgttatatcatataacatagataatggatggaatggtgtgttaaaggcagcttcaaaacatttcaagaaatcgaaaaagaagagagattcattcgctgatgccaagcttctcgacttcaaatactaa

SEQ ID NO: 2208 - DNA, 576 bp, Arabidopsis thaliana
atggatcacacgttgtgcaagcaagttgttcagccagttactaggaaagtgaagaagcatggtaaagatgaatttgatcgtatcaaacaagctgagaagaaaaagagacgtttggagaaagctcttgctacttctgcagccattcgggctgagcttgaaaagaagaagcagaagagattggaagaacaacaaaggttagatgaagaaggagctgcaattgcagaagctgtcgctctgcacgtcctactgggcgaagattctgatgattcatctcgagtcaagtttggcgaagaaacgggtttcggaatggatctgtttagagatgaaagaaccaactatgttcctcgccaaagttgtgctagctatgcggttcaagggattgggtttgtgtcaaatggttatggactaggagatagtaactggtcagtgtcatataagccattcatgaaggatgtctgggataacaacatggtaatatctgcagatttgattgctgctcaggctgtttcgtcactacagatatctgaggacgctgataggaacgcttatgtcttcgagacgatgttcgggggatga

SEQ ID NO: 2209 - DNA, 990 bp, Arabidopsis thaliana
atggcgcggttcagtctggttgtagtcgtgactcttagtcttgccatctctatgttccctgacacaaccactgctcaactcaaaaccaatttctacggaaactcatgtccgaatgttgaacaaatcgtgaaaaaagtcgtccaagaaaaaatcaaacagaccttcgtcaccatcccagctactctccgcctcttcttccacgattgcttcgtcaatggatgtgatgcgtcggtcatgattcaatcaacgcctaccaacaaagccgagaaggatcatccagacaatatttctttggccggagatggatttgacgttgtgatcaaagccaagaaagctcttgacgctatcccaagttgcaaaaacaaagtctcttgtgctgatattcttgctttagccacccgtgatgttgttgtcgccgccaaaggtccgtcgtacgcagtggaactcggaaggtttgatggtttggtgtcgactgcggctagcgttaacggaaacttgcccggaccaaataacaaagttacagaacttaacaagctttttgccaaaaacaaacttacccaagaggacatgatcgctctttcagcggctcacacacttggattcgcccattgtggcaaagtgttcaacagaatctacaacttcaacctcacacacgccgttgacccaactctaaacaaagcctacgctaaagaacttcagttggcttgtcccaagacagttgacccaagaatcgccatcaacatggacccaaccactccaagacaattcgacaacatttacttcaagaatctgcaacaaggcaaaggactcttcacttccgaccaagttctcttcaccgatggtcgctcaaagcccaccgttaacgattgggccaagaattctgttgctttcaacaaggctttcgtaaccgctatgaccaaactcggccgcgttggcgttaagactagacgcaacggtaacattcgtcgtgactgtggtgcctttaactga

SEQ ID NO: 2210 - DNA, 1404 bp, Arabidopsis thaliana
atgcggaatgtagagctcatcttcatccccacaccaaccgttggtcatcttgttccgtttcttgaatttgctaggcgtctcattgagcaagatgataggatccgtatcacaatcctcttgatgaaactacaaggtcagtctcatctagacacttatgttaaatcaattgcctcctctcaaccgtttgttagattcattgatgtccctgagttagaggagaaacctacacttggtagtacacaatctgtggaagcttatgtgtatgatgttattgagagaaatatccctcttgtgaggaatatagtcatggatattttaacttctcttgcattggatggagttaaggtcaagggattagttgttgactttttctgtctccctatgattgacgttgctaaagatataagtctccctttctatgtgttcttgactacaaattccgggttcttagctatgatgcagtatctagcagatcgacatagtagagatacatcggtttttgtaagaaactcggaagaaatgttgtcgatacctggatttgtaaaccctgtcccagccaatgttctgccgtcagctctgtttgttgaagatggttatgatgcttacgttaagctggccatattgtttacaaaggccaatggaatcctagtgaatagctcctttgatattgagccttactctgtgaatcattttcttcaagaacagaattatccttctgtttatgctgttggccccatatttgacttgaaagcccagcctcatccagagcaggacctaacccgtcgtgacgagttgatgaaatggcttgatgatcaacccgaggcatcggttgtattcctttgttttgggagtatggcaaggttaagaggttctctagtgaaggaaatagctcatggacttgagctatgtcaatatagattcctctggtcactccgtaaagaagaggtgacaaaggatgatttgccagaggggttccttgaccgtgtcgatggacgtggaatgatatgtggttggtctcctcaggtagaaatactggcccataaggcagtgggaggctttgtttctcactgtggatggaactcaatagtagagagtttgtggtttggcgtgccaattgtgacatggccaatgtatgcagagcaacaactcaatgcgtttctgatggtgaaggaactgaagctagctgtggagctgaagcttgattacagggtacatagtgatgagatagtaaacgcaaacgagatagagaccgctattcgttatgtaatggacacggataataatgttgtgaggaaacgagtgatggatatctcgcagatgatccagagagctacgaagaatggtggatcttcgtttgccgcaattgagaaattcatatatgacgtgataggaattaagccctag

SEQ ID NO: 2211 - DNA, 1446 bp, Arabidopsis thaliana
atggggaagcaagaagatgcagagctcgtcatcatacctttccctttctccggacacattctcgcaacaatcgaactcgccaaacgtctcataagtcaagacaatcctcggatccacaccatcaccatcctctattggggattaccttttattcctcaagctgacacaatcgctttcctccgatccctagtcaaaaatgagcctcgtatccgtctcgttacgttgcccgaagtccaagaccctccaccaatggaactctttgtggaatttgccgaatcttacattcttgaatacgtcaagaaaatggttcccatcatcagagaagctctctccactctcttgtcttcccgcgatgaatcgggttcagttcgtgtggctggattggttcttgacttcttctgcgtccctatgatcgatgtaggaaacgagtttaatctcccttcttacattttcttgacgtgtagcgcagggttcttgggtatgatgaagtatcttccagagagacaccgcgaaatcaaatcggaattcaaccggagcttcaacgaggagttgaatctcattcctggttatgtcaactctgttcctactaaggttttgccgtcaggtctattcatgaaagagacctacgagccttgggtcgaactagcagagaggtttcctgaagctaagggtattttggttaattcatacacagctctcgagccaaacggttttaaatatttcgatcgttgtccggataactacccaaccatttacccaatcgggccgatattatgctccaacgaccgtccgaatttggactcatcggaacgagatcggatcataacttggctagatgaccaacccgagtcatcggtcgtgttcctctgtttcgggagcttgaagaatctcagcgctactcagatcaacgagatagctcaagccttagagatcgttgactgcaaattcatctggtcgtttcgaaccaacccgaaggagtacgcgagcccttacgaggctctaccacacgggttcatggaccgggtcatggatcaaggcattgtttgtggttgggctcctcaagttgaaatcctagcccataaagctgtgggaggattcgtatctcattgtggttggaactcgatattggagagtttgggtttcggcgttccaatcgccacgtggccgatgtacgcggaacaacaactaaacgcgttcacgatggtgaaggagcttggtttagccttggagatgcggttggattacgtgtcggaagatggagatatagtgaaagctgatgagatcgcaggaaccgttagatctttaatggacggtgtggatgtgccgaagagtaaagtgaaggagattgctgaggcgggaaaagaagctgtggacggtggatcttcgtttcttgcggttaaaagattcatcggtgacttgatcgacggcgtttctataagtaagtag

SEQ ID NO: 2212 - DNA, 3387 bp, Arabidopsis thaliana
atggaaataactcaagtaatctatgtcaatggtaagcaagatgcatctcgtagtgtagattacttgattcttttcgctaacctgttgtttttgatgttttcagatcataacaacatagaagcaaacctaacaggtcaggaggaaatgaataccaccatggaaatcgaatcttcgtccgtacctcaatcgaagaactataagaaatggcttcgtatttccatttacgtagtttactatgaaaatggtgggaagagtacatggatgggaacacttgtccaactaatcggcttccctgttctgtttctcttccgcttcttttcccaaaccaaaaatcccaaaccaacagaagcagatttcagaaagttctcttccttcaccattcttggatcagtttacatcgttactggactattagtgtctgctaactcttatatgtcctctgttggtttactatacttaccagtttctactttctccctcatcttggcctcacaattggccttcactgccttcttctcatattttctaaactcgcagaagttcacacctttcattgtgaattctctgtttctccttactatttcctctgccctcctcgtggtcaacactgattcggaaaacacagcaaaagtgtctagagtaaaatatgtgatagggataatatgtaccattggtgcttctgctgggattggattgctgctatccctggtacaactgatcctcaggaaggttttaaagaagcaaacattctcaacggtcactgacttggtcgcttaccaatctctagttgcaagctgtgtggttctcataggacttttcgcaagcggggagtggaaaactttaacaagtgagatggaaaactacaaactggggaaagtgccatacgttatgactttggcctcgatagctatttcctggcaagtctacaccattggcgtcgtgggactgatctttgagtcatcttctgtgttctccaattccataactgctgtgggattgcctatagttccagttgtagcagtgattgttttccatgataaaatgaacgcgtcaaagatcttctccatcattttagctatctggggattcatttcatttgtctatcagcactacctcgacgaaaagaagttgaagactagccacacaagtcctgtaggagatcctcatctactacctgctgaggaaggtcacacaaacatacatagtgaccagaacttagaagcaaaccttatagatcatgaggtggtaactgaatcatcatcatcagctgtgcctcaaaccgagaactataaaaggtggcttcgtgtctccatatacgtaatctttgtcctcttttgccagccactagctacaattctgggtagattgtactatgaaaatggaggaaatagcacatatgtggtaacacttcttcaactcattggcttccctgtactggttctgttccgcttcttttctcgaatcaggcaacccaaatcaacagatacaaatttcagtcagtccccttccttcaccacccttgcatcggtttacttgtgcactggactgctagtgtccgcttatgcttatttgtctgcattggccttcactgcctttttctcatatttccttaactcgcaaaagttcactcctttgatagtcagttctttgcttctcctcactgtatcctctgctcttcttgtggtcaacactgattcagaaaactcaactaatgtatctagagtacagtatgtgatcgggttcatatgtaccatcggtgcttccgctgggattggactgttactatctctgatacaaatgctcttcaggaaagttttcacgaagcatacatcctcagcagtcacggacttggccatttaccagtctctagttgcgagttgtgtagttctcataggactttttgcaagtggagagtgggaaactttgccaagtgagatgagaaactacaaactcgggaaagtgtcatatgttttgactttagcctcggcagctatttcctggcaagtctacactcttggtcttgtgggattgatcttcgagtcatcctctgtgttctccaattccataacagctgtgggattgcctatagttccagttgcggcagtgatagttttccatgatagaatggacgcatcaaaaatcttctccattattttagctatctgcggcttcctttcattcgtctatcagcactacctcgacgaaaagaagttgaatactagccacacaagtgctgtaggagatcttcatctacctgttgaggaaggtcacacaaacatacaaagtgaccagaacttagaagcaaaccttctagatcatgaggaaactgaatcattttcagtacctcaaacgaagaactgtaagaggtggctccgtgtctccatatacgcaatctttgtcatcttctgccaaccacttgctacagttctgggtagactgtactatgaaaatggagggaaaagcacatatgtggtaacacttcttcaactcattggcttccctgtactgattctcttccgcttcttttctcgaatcaggcaacccaaatcaacagatacaaatttcagtcagtccccttccttcaccacccttgcatcggtttacttgtgcactggactgctagtgtctgcttatgcttatttgtctgcagttgggttgctttacttaccagtctctactttctccctcatcttggcctcacagttggccttcactgcctttttctcatatttccttaactcgcaaaagttcactcctttgatagtcaattctttgtttctccttacggtttcctctgccctcctcgtggtcaacactgattcagaaaacacaacaaatgtatctagagtacaatatgtgattgggttcatctgtaccattggtgcttccgctgggattggattggtactatctctgatacaactgctcttcaggaaagttttcacgaagcatacatcctcagcagtcctggacttggccaattaccagtctctagttgcaacttgtgtggtactcataggactgtttgcaagtggagagtggagaactctgccaagtgagatgagaaactacaaactggggaaagtgtcatatatcttgactttggcctcagcagctattttctggcaagtatacactgttggttgtgtgggattaatcttcgagtcttcttctgtgttctccaattccataactgctgtgggactgcctatagttccagttgtagcagtgatagttttccatgataagatggatgcatcaaagattttctccatcattttagctatctggggcttcctttcatttgtctatcagcactacctcgacgaaaagaagttgaagacttgccagacaaaacctgttgaggaagaaacacaaactttatga

SEQ ID NO: 2213 - DNA, 1380 bp, Arabidopsis thaliana
atgactctcacgttttcctcctccgccgcaaccgttgccgttgctgctgcaaccgtaacctcctccgctagggttccggtttatccactcgcttcgtcgactcttcgtggattagtatctttcagattaaccgcgaagaagctgtttctgccgcctcttcgttctcgcggcggcgttagtgtgagagccatgtctgagcttgttcaggataaagaatcgtccgtcgcggcgagcattgctttcaatgaagccgccggtgagacgccgagtgagcttagtcattcccgtactttcttggatgcgcgaagtgaacaagatcttttatctggtatcaagaaggaagctgaagctggaaggttgccagcaaatgttgcagcaggaatggaagaattgtattggaactacaaaaatgcagttttaagtagtggagcttccagggcagatgaaactgttgtatcaaacatgtctgttgcttttgatcgcatgcttcttggtgtggaggatccttatacttttaatccatatcataaagcagtcagagaaccatttgactactacatgtttgtccatacatacatccgtcctcttattgatttcaaaaattcgtacgttggaaatgcttctatattctctgagctggaagacaagattcgacagggacacaatatcgtgttgatatcaaaccatcaaagtgaagctgatccggctgtcatttctctattgcttgaagcacaatctcctttcataggagagaacattaaatgtgtggctggtgatcgagtcatcactgatcctctttgtaagccgttcagtatgggaaggaacctcatatgtgtttactcgaaaaagcacatgaatgatgatcctgagcttgttgacatgaaaagaaaagcaaacacacgaagcttaaaggagatggctacaatgctaaggtctggcggtcaacttatatggattgcaccaagcggtggaagggaccgcccgaatccttctactggggaatggtttcctgcaccctttgatgcttcttcggtagacaacatgagaagactggttgaacattctggcgctcctggacatatatatccaatgtctttgctttgctatgacatcatgccccctccaccccaggttgagaaagaaatcggagagaaaagattagttgggtttcacggtactggactatcaattgctcctgaaatcaacttctcagacgtcacagcagactgcgagagccctaatgaggcgaaagaagcatacagccaagctttgtacaagtcggtgaatgaacaatacgagatcttaaactctgcgattaaacacagaagaggagtagaagcatcaacttcaagggtctctttgtcacaaccttggaattag

SEQ ID NO: 2214 - DNA, 1134 bp, Arabidopsis thaliana
atggccacacatagtctctccttcttcttcagagttcttctcctcctctttcttactctctcagagagaattaaagggcaaggtgtgggaatcaactacggccaaatagcaaacaacctcccatctccggcaagagtcgccgtgctccttcgatcactaaacatcacaagagtaaaactctacgacgcagatccaaacgtcctcttctccttctcaaactcacaagtagatttcatgatcggtttaggcaacgagtatcttcaaaacatgtcaacagatccaaccaaagctcaagattggttacaacaaagacttgaaccacatatctcaaaaacacgaataacctcaatagttgtcggcaacgaaatcttcaaaaccaatgatcatgtcctcatccaaagcctattaccggctatgaaatcggtttacgctgctttaaccaatcttggtttagagaaacaagtaaccgtaacttcagctcattctttagacattctttcaacatcttatcctccttcttcaggatcattcaaagaagagtttattcaatatcttcaaccacttcttgattttcattctcaaatcgaatcacctttcttgataaatgcttatcccttttttgcttataaagatagtcctaaagaagttccattagagtatgttttgtttcaacctaatcaaggtatggttgatccaaacactaatcttcattatgacaacatgttgtttgctcaagttgatgcgctttactctgccattaagactttgggacataccgatatcgaggttcggatatcggaaaccggttggccttctaaaggagatgagaatgagattggagcttcgccggagaacgcggctttgtataatgggaatttgttgaagttgattcagcagaggaaaggaactccggcgaagcaatctgttcctattgatgtttatgtgtttgctctgtttaatgagaatcttaaaccgggtccggtttctgagaggaattatggacttttttatccggatggtaaaccggtttacaatgtcggtatgcaaggttatttacctgatattatctatacttcaagggcaactacaattaaggtaaattcctcttttcattttttatatttacatttttaa

SEQ ID NO: 2215 - DNA, 681 bp, Arabidopsis thaliana
atgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataa

SEQ ID NO: 2216 - DNA, 714 bp, Arabidopsis thaliana
atgaagatacaatgtgatgtgtgtgagaaagctccggccacgcttatatgttgtgctgatgaagctgctctctgcgctaaatgtgacgttgaggttcatgctgctaataaactcgctagcaaacaccaacgcctttttcttgactctctctcaactaaattccctccctgcgacatctgccttgagaaggcagctttcatattctgtgtagaggatagggctctgctctgcagagattgcgatgaggcgacccatgcgccaaatactcgctctgctaatcaccagaggttcttagccactggaatccgagttgctcttagttccactagttgcaatcaagaagtggaaaagaatcactttgacccatctaatcagcagagtctctctaaaccgccaactcagcaacccgctgctccatctcctttgtgggctaccgatgaattcttcagctactctgatcttgactgcagtaataagaaagagcaactcgatctcggggagctggattggcttgcagagatgggtctgtttggtgaccagcctgatcaagaggctctaccggtagccgaagttcccgagctttccttttcacatttggctcatgctcattcctacaacagacctatgaagtccaatgtacccaacaagaagcagaggcttgagtaccggtatgatgatgaagaagagcacttcctagtccccgacctaggctaa

SEQ ID NO: 2217 - DNA, 2436 bp, Arabidopsis thaliana
atgggaaagccaacggcgaagaagaaaaatccggagacgccaaaagatgcttccggcggcggcggcggcggtggaggcaagtcagggaaaacttaccatcgttctacttcgagggtatttgacgaagatatggagattttcattagcagagcacttgagctcaaagaagaaggtaacaagttgttccagaaacgcgaccacgaaggtgcgatgttgagtttcgacaaagccttgaagctcttgcccaaagatcatatcgatgtagcttatcttagaacgagtatggcttcttgttatatgcaaatgggattaggtgagtatccgaatgcgattagcgaatgtaatttggctcttgaagcttctcctaggtacagtaaggctttagtcagacgttctcggtgttacgaggctttgaataagttagattacgcgtttagggatgctcgtattgttttgaatatggagccaggaaatgtgtctgcaaatgaaatctttgatagggtgaagaaagtgttggtggataaaggtattgatgtggatgaaatggagaaggactttgtcgatgtacagcctgtttgcgctgctcgtttgaagaagattgtgaaggagaggttgaggaagagtaagaagaagaaaaagagtggtgggaaggatgaggaactgaagagtccaaaggttgttgttgttgacaagggagacgaagcagagggcagaaataagccgaaggaggaaaagagcgataagtctgacattgatggaaagattggtggcaagagagaagaaaagaaaacaagtttcaagagtgataaaggacagaaaaagaaaagtggtggtaataaagcaggagaagagaggaaggtggaggataaggtcgttgttatggacaaagaggtcattgcttccgagattgttgatggaggaggaagcaaaaaagaaggggcaacggttactaggactatcaagctggtacatggagatgatataaggtgggcacaattgccgttggattctactgttagacttgtgagagatgtaatcagggatcgctttcctgctcttaggggtttcctcattaaatatagggatacagaaggtgacttggtaaccattaccacaactgatgagctgaggctagctgcttctactcatgataaacttggctcccttagattatatatagcagaagttaaccctgaccaagaaccaacctatgatggcatgagcaatactgaatcaactgacaaggtttccaagagattaagtagccttgcggacaatggtagtgttggagaatacgtgggatctgacaaagcatctgggtgctttgagaactggattttccagtttgcgcaattgtttaagaaccatgttgggtttgattctgattcgtacgtggaccttcatgaccttgggatgaagctgtatacggaagcaatggaggatgctgtcactggtgaagatgcgcaggaactctttcaaatcgctgctgataagttccaagaaatgggggcactagctttgttgaactggggtaacgttcacatgtccaaggcaaggaagcaagtctgtatacccgaggatgcctctagagaagctataatagaagcagttgaggctgcatttgtgtggacacagaacgagtacaacaaagctgcagagaaatatgaagaagcaattaaggttaaacctgatttttacgaagctcttctagcacttgggcaagagcagtttgaacatgcaaagctttgctggtatcatgcactcaaaagcaaggtagacctagaaagtgaggcttctcaagaggtcctgaagctctataacaaagctgaagatagtatggagaggggtatgcagatctgggaagagatggaagaatgtcgtctaaatggaatctccaagttagataaacataaaaacatgttgcggaagttggagttggatgaattgtttagtgaagcttcagaagaggaaactgtggagcagacagctaatatgagttctcagattaacctcttgtggggttcgttgctatatgaacggtcaattgtggagtacaagctcgggctaccaacttgggatgaatgtttggaggttgcagtggagaagtttgagctagctggagcttctgcaactgatatagctgtgatggtaaagaaccattgttcaagcgagagtgcacttgaaggtaatcaattcttggcaagaataccaaactctggacaagttacaacccaatggttttctgtttataacaatcttagaacaaacgcaggtatgggattcaagattgatgaaatagtgcaggcatggaatgagatgtatgatgccaagagatggcagatgggtgtcccatctttccggctagaaccaatgttccggagacgagctccgaaactgcatgatatcttagagaatgtattttcagggcctgtttga

SEQ ID NO: 2218 - DNA, 4983 bp, Arabidopsis thaliana
atgaagcaaagctcatcggaggcagtgtcatcgtcttcttcatcagccgccgcggaccaatctcatccctccgtttcatcatcatcatcggagaagcctctatcttcctcttcgatttctccagcggaggatcttcaggttggatcgtcgagagatggaagcggaggtgcacaagagatcgtagccgtcgatcgtccaggagagtactcggcgttgtgtagatggacggttgagagcttcacacgtgtcaaagctaaggcactgtggagcaagtacttcgatgtaggaggatacgattgtcgtctcttggtttatcctagaggtgattctcaggctcttcctggttacatcagcatctatcttcagatcatggaccctagaggaaccacttcgtctcgttgggattgtttcgctagctatcgtctctctatcgttaatcttgtcgatgattctttaacaatccataaggattcttggcatagattctctagtaagaagaaatctcatggatggtgtgatttcaccttgaactctagcattttggatcctaagatgggttttttgtttaacaatgattcgttgcttatcactgctgatatcttgattctaaacgagtctgtgagctttagtcgtgataataacaatgaggggcaatctttgtataaggaaaattccatagctggaccaatgccggatgtgttgagtgggaagttcacttggaaggtaaataattttagtttgtttaaggatatgataaagacgcagaagattatgagccctgttttcccagctggggagtgtaatttgaggatcagtgtgtaccagagtgttgttaattcgcaagaatatatatcaatgtgtttggagagtaaagagactgagaagactttggtttcagataggagctgttggtgtttgtttaggatgtcagctttgaatcagaagcctggttgcactcacatgcatagggattcatatggcaggtttgctgctgataataagagtggggacaatacgagcttgggctggaatgattacatgaaaatgtctgagtttgtgaacccggaagctgggtttttactcgatgatatggctgtctttagcacttcgtttcatgttattaaagagttcagtagctttactaagaatggtgggttgattgggggaaggaatggggctggagctaggaagtcagatggacacatgggaaaattcacttggagaattgaaaatttcacaaggttaaaggatcttctaaagaagaggaagataacaggtctttgcatcaaaagtaagaggtttcaaattgggaaccgggattgtcgacttattgtttatccccgagtatttcttgaagtgacagattcacgaagctcaagtgattggagctgttttgttagccaccgactatcagttgtgaaccagagattggaggagaagtcggtgacaaaagaatctcagaatcgctactcgaaagctgcaaaggattggggttggcgtgagtttgtgacacttactagtttgtttgatcaagactctggctttcttgttcaagacactgttgttttctccgctgaggttcttattttgaaagagacatctgctacaaaagagtatgtggaggcagactcaactaattcagtttctccgactgataacagcgtcaaaaaaagttcatttacttggaaagtggaaaatttcttagccttcaaagagataatggaaacacgaaagatttttagcaaattctttcaggctggtggatgtgaactccggattggtgtatatgagtcctttgacaccatatgcatatatttagagagtgatcaatctgcgggtacagatgtggacaataatttctgggttaagtacaagatgggtattctgaaccaaaagaatccggccaaaagtgtgtggaaggagtcatctatatgtaccaagacatggaataattccgttctacagtttatgaaggtgtctgacatgttggaggctgatgctgggtttcttgtgcgtgacacagttgtgtttgtgtgtgaaatattggattgttgtccttggtttgagttttcagacctagaggtactggcttcagatgatgaccaagatgccttaaccactgatcctgatgaaattattgattctgaggaaagtgagggcataagcggagatgaggaagacacatttcgagattttctttcccgagctggattccatctcacgtttggggagaatccttcacaaccacaagttactctccgtgagaagcttctaatggatgcgggtgcaattgctgggtttcttactggcttgcgtgtatatcttgatgacccaactaaagtaaagcgtttacttcttccgactaaaatatcttgtaatgatagaagcaagctaataaagagtgatgaatcttcccctagcctaatgaatttgctgatgggtgttaaagttctacagcaagccattattgatttacttctagatattatggttgagtgttgccaaccttcagaggaaggctctcactctgagccgtctttattatccccaaagacagatggttgcgtggctgcaacttcatcggagtcaacaagggaacgaggagcagcagaaccttcgcaacatcttgttgacgaaagatttaaatctgatacagatgctaccctcagtacctcagctgtaccaagctcagagatgaatgggatcgatttgcttgagaaagcccttgcaatagagcctatgtctcctcctaccacatctgctgggcaatcttctgatgcttcagtccaatcaaagacaaaatggccggaacagtctgaggagctattgggactgattgtgaattcacttaaaacccttgatgcggctgttccacaaggttgtccagagcctagacgacgaccacactctgctcaaaagattgctcttgttttagacagagcacccaaacatttgcaaccagatttagttagtctggttcccaaattggttgagcattcagagcacccactggctgctttagcacttatagaacggcttcaaaagcctgaagctgaaccagcgttgcgtgaaccagtatacaatgctcttagccagttagaatgcgacagtgaagtgtgggaggacattctatctcagtcttttgagcttttgagcgacttaaatgaggaatctcttgtggcggccattcatttcacatttaagactgcctcccagtgccaacacctacctgaagccgtaaatgcagtccgtgaacggcttaaaagtctgggtgctgatgtgtctctttgtgtccttgactatttgagtaaaaccgtacacagttggcctggtattgccgaaatgatacttagggatatcaacactgacgacagtgtaggtgccaattttgcaacattaccctgcgggccttttctgattggtgaaaatgagactgcctccgaaatggcggatttgatggaagaacatatattctatgcaaataggcagttttttgatgtctacattctgctggaaatgttgtccatatcgtgcctagctgaagaggcatctcaaacatttgaaagagctgttgctcgtggagccattgttgctcaggctgttgccatggtccttgaaaaacaacgtgttcagagcccaaatctgaatgctacaagtggggatgcttctcttaagcatcaagatcctgtattggagggagaagccagtgagcaaccagccactggagggactgagttcaggataatccttaatcttgctgagacattaactcattctagagatcctcaagtgaggggatttgtgaaaatgctatacacaatattattcaagtggtttccggatcagccctttagggttcaaatactgaggagactcgtagacagattcaccagccctacgagtagcagccacgatttagacttagagttggagattctagctattctgatttttcaggagcaagaggttgcgagacctgttttagccatgctgaagaaggttgtggaacatgcaaatattgacagggcggccctgtggcaccaattgcgtgcaaacaaggaagaacttgtccggttgaaggaagaaaagaagatagagattcaatctatgacaaaggagaaatctagcatcacccaaaaattaagtgaatctgaggctgcaaatacccgtcttaagtctgaaatgaaagctgaggcggaccggttttctcgagaaaagaaggatctggtagaacagtttagggatgtggagagtcagctggaatggatccgatcagaacgtcaagatgagatagataagctctcgtctgaaaagaaaactcttttggatcgccttcacgaagcagagacgcaacttgctttgcaaaaaacccgaaagcgtgatgaactcaagaaggtaggaaaagagaaaaatgctctaaccgagaagctaaaggtaacagaggcagctcggaaaagatttgaagaagagttgaaacggtatgccactgagaatgtaactcgggaggaattacgcaagtcacttgaggatcaaatcaggcaattgacacagacagtaggacagacaaaagaagagaaacgagagaaagaagatcagattgctcggtgtgaagcttacattgatggaatggaatccaaactccaagcttgccagcaatacatccacacactagaatcctcgctccgagaggagatttcaagacatgcgcctctgtacggtgccaatttagagtctctatcgatgaaggaactggatacaatagctcgtatccatgaggaagggctaagacagatccatgcccttcaacaacgtaagggccatacattatcacacggtctccctcagggtcacacactttacccgactacaccgcctcagcttccaccaatggcaatcggtttgccacctcagcttatacctaatggttcaggggttcactcaaacggtcatatcaacggttcggaagactacacaaaagaatga

SEQ ID NO: 2219 - DNA, 1107 bp, Arabidopsis thaliana
atggatttaaactcaaaccacaaatcctctgttcttaaagatccttcaccatcagttaaccaatcaagactcggcgtgtctagtagatttatgatgagtcaatggaagaaacctgcgaaactcgatgatgttagatccaatggttggttagatgcaatgatttcatcttctccaccgcgtaagaagcttgtcaaagattttaatgttgaagttgctcctgaagatgattttgctcaacgtgcttggatggtgaaatatccttcggcgattagctcgtttgcgcatattgcagctcaagcaaagaagaaaaagattgctgtatttctagattatgatggtactctttctccaatagttgatgatcctgatcgtgccatcatgtctgatgcaatgcgttctgcggttaaagatgtcgcgagttacttcccaaccgcaataattagcggtagaagccgtgacaaggtttatcagttggtaggactaacagaactttattacgcgggtagtcatggaatggacataatgacttcttctgatggtccgaattgtttcaaatccactgaccaacagggtaaggaagtgaatctgtttcagcccgcgagagaattcataccggttatcgacgaggtttttagaacccttgttgagaaaatgaaagatatcaaaggtgcaaaagtagagaaccacaagttctgtgcatctgtacattaccgtaacgttgacgaaaaggattggcctattattgctcagcgtgttcatgaccacttgaaacaataccctcgtttgcgtctaactcatgggaggaaggttttagaggttcgtcctgtgatagactggaacaaaggaagagcggtcgagtttctattagaatctctcggattaagcaataaagacgatttgcttcctatctacattggtgatgacacaaccgatgaagatgcgttcaaggtactgagagatgggaaccgaggtttcggcatcctagtatcgtctataccgaaagaaagcaatgcgttttactcccttagagatccatccgaggtgaagaagtttctaaagactttggtgaaatgggcaaagttggagaagaattctactggtttttga

SEQ ID NO: 2220 - DNA, 1497 bp, Arabidopsis thaliana
atgccaggaggatacaaagcgtttgagatctgtgccaagttttgctatgggatgactgttacgctcaatgcttacaacataaccgcggtgcgatgtgcagctgagtatcttgaaatgactgaagatgctgaccgcggtaacctcatatacaagatcgaagttttcctcaactcaggcatattcagaagctggaaagactcaatcattgtgcttcagacaacaagatctcttcttccttggtctgaagatctgaagcttgttggtagatgcatagattctgtttcagctaagatcttggtgaaccctgagactatcacttggtcttatacattcaacaggaagttatctggacctgataagatagtcgaatatcatcgggagaagagagaagagaatgtgattccgaaagattggtgggtcgaagatgtatgtgagctagagattgatatgttcaagagggtgataagtgttgtgaaatctagtggaaggatgaataatggcgtaattgctgaagctcttagatactatgttgcaaggtggttaccagaatctatggagtctttgacatcagaagcttcttcaaacaaagatctcgttgagacggttgttttcttgttgccgaaggtaaacagagcaatgagctactcttcttgcagcttcttgctaaaactccttaaagtttcgatcttggttggagctgatgagacggtgagagaagatttggttgagaacgtgagtttgaagcttcatgaagcgtccgttaaagatttgctgatccatgaagtcgaattagtccatcggattgttgatcagttcatggcggatgagaaacgtgtatctgaagatgaccggtacaaggagtttgttttaggaaatggaattttgttgagtgtaggaagattgattgatgcttatctcgctcttaactctgaacttacactctctagctttgttgagttatctgagttagtcccggaatcagctaggccgatacacgacggtctctacaaagccattgacactttcatgaaggaacatcccgaactaacaaaatccgaaaagaagaggctttgtgggttaatggacgtgaggaaactgacaaatgaagcatcaacgcacgctgcacagaacgagagacttccactacgagtggtggtgcaagttctctactttgagcagctccgagcaaatcacagccccgtggcgtctgttgcggcttcgtcacactcgccggttgagaagacggaggagaacaaaggagaagaagcgacgaagaaggtggagctgagcaagaaaagcagaggaagcaagagcacgaggagtggtggtggtgcacagctgatgccgtcgaggtcaaggaggatctttgagaagatatggcctgggaaaggagagattagcaacaagagctctgaggtttcttctggaagctcacaaagtccgccagccaagtcttctagctcgtcttcccgacgccgcagacattcgatatcgtga

SEQ ID NO: 2221 - DNA, 957 bp, Arabidopsis thaliana
atgaaggcagttaaaagatggagtatagggaacttagcggacattcccgtgtctttgcctggagctcgataccgtgctcctcctccaggaagaagacgagtatggatcatcatggtgctttcactgatcaccatgttctttattatggcttacatgtatcctcatcatagtaaacgtgcttgttatatgatttcatcaagaggatgcaaggctttagctgattggcttccaccttctctgagggaatattcagatgatgagattgcagctcgtgtagtcattagagaaatattgagttcacctcctgttattagaaagaactctaaaattgctttcatgtttttaactcctggtacattgccttttgagaggctttgggacagatttttcctgggccatgaagggaaattctctgtttatatacatgcatcaaaggaaaggccagttcactacagtcgttactttctcaaccgcgaaattcgtagtgatgaggtggtgtggggaaggatatcaatggttgacgcagagagacggttgttagctaatgctcttagagacacttctaaccagcaatttgttttactctctgatagctttgacgatccaggtcaacatggagcaggcaggcatatgaatcacatgttgcctgaaatcccaaagaaggattttcgaaagggtgcacagtggttcaccatgaagcgacaacacgctgtagcaactatggcagacagtctttactactctaaattccgagattactgcgggccaggtatagagaacaacaagaactgcatagctgatgaacactatctgccaacattctttcatatgcttgatcccggtggcattgctaactggactgtaacacaagttgattggtctgagagaaagtggcatcccaaaacatatatgcctgaggatatcacacacgagttactaaacaacctcacggtatag

SEQ ID NO: 2222 - DNA, 1542 bp, Arabidopsis thaliana
atgccaccgcttgagacctttaaactgaccaaagaattgtttggggaaagagtgaaggacaatgttattatagtgacctttgggaactatgcttttatggatttcattttgacttgggttaaacacttgactgatttagatctctccaatattcttgttggtgcgatggatacaaagttattagaggctttgtactggaaaggcgttccagtttttgacatgggaagccatatgagcacagtggatgtcgggtggggttctccaacattccacaaaatgggaagagaaaaagttattctcatagattctgtcttgccttttggttacgagctacttatgtgtgacactgacatgaaccctatgccttatttggctcgattcccagatgctgatgttttgacttcaagcgatcaagttgtgcctaccgtcatagatgacagtttggacatatggcaacaaggaatttttcattggcggccgacagaatctgcgaaaaagttggcaaaagaatggaaagaaattctcttagctgacgataaggtttgggatcaaaatgggttcaatgagattgttaggagacagctaggtccatctgtggaaggggatagtggacttttctatgcttatgatggaaatctcaaggctatgtatcaacaactcaggctagaaccatatgccgtgcatacaacattccagtatgcaggtaccgaaggaaaacgccacaggcttcgagaggggatggttttctatgacccaccagaatattatgattcaccagattcttcaacattaatcttgttaatggggaaagccaaaatcaacattgtaaactccaacacaatgcaggagatgaaacagatcagatcagctctagccattgcatctcttcttaatcgtacactggtgatgccaccaatatggtgcaggttagataggctttggtttgggcatcctggtactcttcagggatctatgacccgacaacctttcatctgcccacttgatcatgtctttgagggatctatgacccgacaacctttcatctgcccacttgatcatgtctttgaggtcaatatcatgcttaaggagctaccagaggaagagtttggccctgggattggtatcagagagtattcttttctagataacccattgctgccaaaacaagtgaaagagtcatggcttgatgttcagctttgtcaagaaggaaaagaaggatgcgaggcatcaaataacactagcccctctcgggttcttaagttcccaaagcggagcaatgaagatacgtttaaggcgatattctcttccttcgacgatgtcaaagtgatcaagttttcttcaattgaagatgctttcatcggattctctgacaaggagcgagaagaaagatttagaagacgggtaaagagatatgtgggaatatggtgttgtgaggagaacaagactccaggacacatttactacgatatgtattgggacgagaaacctggttggaaaccggttccaccacagacaccagaagaagatcatcctcctctctga

SEQ ID NO: 2223 - DNA, 1083 bp, Arabidopsis thaliana
atggtgagtgaaggagcaacaagaaaagaacttaacctctgtttcgagaatatgaagatggaaggagttttgatctctgagtggaaagatatccctgtggagcttctcatgaagattttaaaccttgttgatgatcggactgtgatcattgcttcttgtatttgtagtggctggagagatgctgtttcccttggcctcactcgcctctccctctcttggtgcaagaagaatatgaacagtttggttctatctcttgctcccaaattcgtaaagcttcagactttagtactgcgacaggacaaaccgcagcttgaggacaacgcggtggaagccatagcaaatcactgtcatgagctacaagatttggacttaagcaaaagctcgaaaatcactgaccattccctatattcacttgctcgtggttgtactaacctgactaaactcaaccttagcggctgcacttcgttcagcgacactgctcttgcgcatttgacaagattttgcaggaagctcaaaattctgaatctttgtggttgtgttgaagctgtatctgacaatacattgcaggctattggagaaaactgcaatcagttgcagtcactaaacttgggatggtgtgagaatataagtgatgatggagttatgagtttagcttatggttgtcctgatttaagaactcttgatctttgtagctgtgttctaatcacagatgagagtgttgtggctttggcgaatcggtgcattcacttgaggtcattggggttatactactgcagaaacattacagacagagcaatgtactctttagctcagagcggagtcaagaacaaacacgagatgtggcgagcggtaaagaaaggaaaattcgatgaagaaggactaagaagccttaacattagtcaatgcacttacctaacaccttcagctgttcaagctgtctgtgatacattccctgctctccacacttgttcaggcagacattcacttgtcatgagcggttgtttgaatctacaatctgttcattgtgcttgtatccttcaagctcaccgcactcacaccgtttaccctcacccggcgcattga

SEQ ID NO: 2224 - DNA, 132 bp, Arabidopsis thaliana
atggtgtcaaggactagcgatttcaggccatcaacaaagacctttagctttgctgaagaattggttatttcaaaatccagaatttctcccaagtctacgccaatagctttgagcatatcctggtgccagtaa

SEQ ID NO: 2225 - DNA, 1416 bp, Arabidopsis thaliana
atgcatctgaagaattctactgtagcagaacggcggtacatcggaaaagaaaccgccggttatttaacttcttcctccgatttggatccgaaacctaagattaaacatcatcgtcctcttcaggtacctgagattttgactccagacattggtgctggtgctggattcagtgtgtataataatcaagttcaagctcagagtcgtcatcatctgacggttgaaatcccagattcatcgtctcacaatcttacatctaagagacctgtggtggttcaatcttctaatccgttcaacgttgacgatttccgaagacaacaacgcgcaagcttgggtccgatttcatcttattgtccgtcgtatcttttatcgtggttttcttcttctcttccatcgatccatcggccactaatcagaagcttctccgtcatgttcttagaattcttccttctctttgtcttctcgattatcgctttttctttcgtcctttcgatctctctcaaattcgctcttcctcacttaccatcgattcgtttgattatcgctcggttactttctctcaagcttacccctaccagatcatcctcttcatctcaggagaacactaaacatgttatttggtcaattgggtctaagcctgtgactgagaagaagaccagctctggctcatgggttcagaagtacagctctggtgatgtatacgagggagagtttcatagggggaagtgttcaggaagtggagtttattactattctatgaagggtaaatacgaaggggattggattgatgggaagtatgatggatatggagttgaaacttgggctaaagggagtaggtaccgaggtcaatacaggcaagggatgagacatggaactggtatctacagattttatacaggggatgtatatgctggtgagtggtctaatggacagagccatggctgtggtgtgtatacctctgaggatggtagtcgttttgttggagagtttaaatggggtgtcaaacatggccttggtcattatcatttcaggatgcatggttttggagtgtatcaatttggaaacgggcatcggtatgaaggagcctggcatgaggggagaaggcaaggacttggtatgtacacgttcaggaatggtgagacacaggcaggccattgggaagacggagttcttaactgtcctaccgagcagaccactcgccctgattcatcgttttccatcagtcattccaaggttgtcgacactgtccagcaagcaaggaaagcagccaagaaagcacgcgaagttgtgaaagttgaagagagagtgaacagagcagtgatggtcgcaaaccgagcagcaaatgctgctagagttgctgctacaaaggctgtccaaacccaaacatttcattgtagtagtggtgacgatcccttgtga

SEQ ID NO: 2226 - DNA, 459 bp, Arabidopsis thaliana
atgggagctctcaattatctttctgagtatttctctaaccatttctacgtctcaatacgaaaacggaagaaacgtaaagtcatgcagacggtgaatattaaggtgaagatcgactgtgacggatgcgaacgcaaaatcaagaacgctgtttcctccatcaaaggagcaaaatcagtggaagtgaacagaaagatgcacaaagtaacggtgagtggctacgttgatcccaagaaagtgctgaagacagtgcagagcactgggaaaaagaaagctgagctgtggccgtatgttccatacacaatggtggcttatccatatgccgccggagcttacgacaagagagccccgccgggttttgtgaggaagtcggagcaggctcaggcgcagccgggaagtactgacgataagctcatgtccctctttagcgacgagaaccctaacgcctgcaccgttatgtga

SEQ ID NO: 2227 - DNA, 1599 bp, Arabidopsis thaliana
atgtcgtcgttgtgtgcatctaattgctatccttcatcttcttctatcaatctcttctccaacaacaacaacccaactaaaccctttcttctctccctcagattcgcctcctccaattctcttccatttgttgctcctctcaaattctctactaccaatcacgtccttagtaactctcgtttctcttcgaaccgaatccaaagacgcctttttttgctccgatgcgtttcagaagaatctcagccgtctctttctatcggtaacggcggctctgaagagagagtgaatgttcttgtaattggtggaggagggagagaacacgccctttgccacgccttgaagcggtctccttcttgtgattctgtgttatgcgcacctggaaacgccggtatatccagttccggagatgccacttgtgtacctgaccttgacatatcagacagtttagctgtcatctctttctgtcagaaatggaatgttggtttagtggttgttggccctgaagtgcctcttgttgctggtctcgctaatgaccttgttaaggccggtatcctcacctttggcccttcttctcaagctgctgctttggaaggttccaagaactttatgaagaatctttgccacaagtacaatatccctactgctaagtataaaacattttctgatgcatctgccgcgaaagaatacattcaagaacaaggggcaccgattgtgattaaagcggatggattagcagctggaaaaggagtcactgttgccatggaactagaggaggcttttgaagctgttgattctatgctggtcaaaggtgtgtttggttctgcaggatgtcaggtggtcgttgaggagtttctcgagggagaagaagcgtccttcttcgcacttgtggatggagaaaacgccattcctctagaatctgctcaggaccacaagcgtgttggagatggagataccggtcctaacacaggcggcatgggagcgtattctcctgcaccggtcttgaccaaggagcttcaggattttgtgatggagtctataatccatcccactgttaaaggaatggctgaagaaggatgtaagtttgtcggcgttctgtttgcgggtctcatgatcgagaagaaatccggtttgcctaagcttattgagttcaatgtacggtttggagatccagaatgtcaggtattgatgatgcgtctagagtctgacctagcaaaagttttgctagcggcttgtaaaggcgagctaagtggtgtatcacttgattggtcaaaagattcagcaatggtggttgtaatggcaagcaatggttatcctggttcttatgagaaaggatcaatcatcaaaaaccttgaagaagctgaaagagttgctcctggagtgaaggttttccacgcaggaacgggtctagattcagaggggaatgttgtagcaactgggggacgtgttcttggggtcacggcgaagggtaaagacttggaagaggcgcgtgaaagagcgtactcggcagtacaacagatcaactggcctggaggtttctttaggcatgatattggttggagagctcttcgccagaaacaagtggcgaccaaagaagagtga

SEQ ID NO: 2228 - DNA, 408 bp, Arabidopsis thaliana
atggcggagggtaaacccgacgagcagctctttcagcttctttcgggtcttcttcaacaggtagaatcattgacaaatacagaagaggttgagctacgttctaagattgaagctcttggtttagaagtcactaaagtgccatcaaagtctgctcaacacctcaatgaggtggagatagctaaggaattggacaagttatcagcaaagttagatgatgtggatgagatgatatcatcagctatagcttctgatccacaggttcagacgcttcttagcggcacagctgatgtttggatgccggttatcactgccggcgccgaagagagactcaacttcacagcctctcttgctgatgatgatgacctttctaacaaggagactactaccgacaataccagcagctcttaa

SEQ ID NO: 2229 - DNA, 927 bp, Arabidopsis thaliana
atggaggaaggtctaaagattcaatctttggtcatttatccgatcaaatcttgccgtggaatctctgttcctcaggctaccgttactcatactggttttcagtgggaccggtattggttagttgttaactataaaggaagagcatacactcaaagagttgagccaacccttgctcttgttgaatcggagttgcctaaggaagccttcttggaagattgggagccaacaaatgactcattgttggtgataagagctcctggtatgagtccgttaaagataccgttgactaggccaagctcggtagcagaaggtgtgtcgatgtgggaatggtctggctctgcttttgatgaaggagaagaagctgcgaaatggttttcagattatcttggaaaacaaagccgtttggttcggtttaataaagatactgaaactagaccttcacctcctgagtttgcagcgggttactctacaacattcatggatatgtttccgtttttggttgcatctcagggttctttagaccatttgaatacccttctgccagaaccggtgcctataaaccgttttagacccaacattcttgttgataattgtgatcctttcggtgaagatctttgggatgaaatcaaaataaacgatttagtcttccaaggagttaggctatgtagccgctgcaaggtaccaactgtgaatcaagaaaccggggttatgggtaaagcagaaccaactgaaactctgatgaaattcagatcagacaatgtcttaatgcctgacaagaaaccgcgtggaaaggttttctttggcaaggagatggtttggaattggaacttaaccaacactgaaggcgaaggaaagaaaacaatcaaagttggtgataccatctcagtcataaggaagatcccttccagagctgaagcagctgtttaa

SEQ ID NO: 2230 - DNA, 861 bp, Arabidopsis thaliana
atggtagcttctctttcctttcattccatcgccaccgttaatccaatcttctccggcgatggtggtcgttcaatcttccggactaatcgccgattcgaagcaactggagtgagttgccgaggacagaatcctactgacgagccacagacaagtaaaggacccgagccggataatgttctactcaaaatcgcttggtacggatctgagctactcggaatagctgcttctgttttccgatctccggagacttctccgattgtgacaggctttgaggttcctgttgattgttctggtcgagccgttcgtgtagctgtcgtggactcgattaaacaagactttaaacgatcctacttcgtcacaggtaatttgacgccggaggtttatgaggagaagtgtgaattcgctgatccggctggatccttcaagggtcttgctcgtttcaaaaggaattgcactaatttcggaagccttatcgagaaatccaatatgaagctcatgaaatgggagaattttgaggtacggtcaactactaaaagatgtcggagtaaaagtttcgttttttgtttctcaccagagctccatcatgagttttgcaggataaaggaattggacattggaaatttagctgtgtcatgtcgtttccatggaaacccattctttcagcaactggttacacggagtattatttcgacacagaatccgggaaaatttgcaggtaaaaagattacttatgagctcattaatataaaccccactaatctcttttcaactttgaaatcttttgtgaagaagaagaagctggttaaacatattttgatgaatgttggcttgcaggcacgtggagcattggaatgtccctaa

SEQ ID NO: 2231 - DNA, 315 bp, Arabidopsis thaliana
atggcttcccagacaaatcaaaccgtggtggataccaagaaaatcgaaaccgagaacccgccaaaaccgcaagtgcctgcatcatcatgcaggaagagggtgaaggatgataacgccactttctttgcaaacctcaaggatcacatggatgaattcatacatgcctcaatggatgaacacaagacttgtttcaaaaacaccatggacaagatattcgggagcttctccaaggcggaggcagttgcagagaagcaaattgaggctaaggaagtggtcgagattcactctcctcttcagacagcagtgactaagtag

SEQ ID NO: 2232 - DNA, 2688 bp, Arabidopsis thaliana
atggcagagtcaattcgaactttttcgcttcaatggcggatactgtcactgatcatcgctttacttgtgtactttccgattctgtcgggaagttactttaaaccgttcaatgtgagctacgatcaccgggctttaatcatcgccggcaagaggcgcatgctcgtctcagctggaattcactaccctcgagccactcctgagatgtggtctgatctcatcgcaaagagtaaagaaggtggagctgatgtggttcaaacttatgtgttttggaatgggcacgagcctgtaaagggtcagtataactttgaaggaagatatgaccttgtcaaatttgtgaagcttattggatcaagtggtctttatctccatctacggataggtccttatgtttgtgctgagtggaactttggggggttcccagtgtggctgcgggatattcctggcattgagtttcgaacagataatgaaccttttaagaaagagatgcaaaagtttgtaacaaagattgtggatttgatgcgagaagcaaagctcttctgttggcaaggaggtcccataatcatgctgcagatcgagaatgaatatggggatgttgaaaaatcttacgggcagaagggaaaggattacgtcaaatgggcagctagcatggctctagggcttggtgctggagttccgtgggttatgtgcaaacaaacggacgctccagagaatattattgatgcatgcaatggatactattgtgatggttttaaaccaaattcgcggacgaagccagtactttggacagaggattgggatggatggtacacgaagtggggtggaagtttgcctcaccgacctgctgaagatcttgcatttgcagttgcaagattttatcagcgtggaggaagctttcaaaattattatatgtattttggtggaacaaactttggtcgaacttctggtggtcctttctacattacaagctatgattatgatgctcctcttgatgaatatggtctgaggagcgagccaaaatgggggcatctaaaggaccttcatgctgccataaaactttgtgaacctgctcttgtcgcggcggatgcacctcaatatagaaaattgggatcaaagcaggaggtgttatcctactctcaaatgctagcacacatttatcatggagatggtgagactggaggaaaggtgtgcgctgcatttctcgcaaacattgatgagcataaatctgcacatgtgaaatttaatggccagtcatatactttaccaccttggtcagtgagtatattgccagactgtcgacatgtggccttcaacactgccaaggtaggagcacaaacttctgttaaaacggttgagtctgcaaggccatctttaggtagtatgtctatactgcaaaaagtcgtgaggcaggataatgtttcttatatctcaaaatcatggatggctctgaaagaacctattggcatatggggtgaaaacaatttcactttccaaggattattggagcatttgaatgttacaaaagaccggtctgattacctgtggcataagacaagaataagcgtatctgaagatgatatctcgttctggaagaaaaatggacctaactcaacagtgtcgattgatagcatgagggatgtgttacgtgtgtttgttaacaaacaactcgcaggcagtattgttggtcactgggtgaaggcagtgcagcctgtacgatttatacagggaaacaatgatttacttctgttgactcaaacagttggtttacagaattatggtgctttcttggagaaggatggagccggttttagaggcaaagctaagcttactggattcaagaatggagatttagacctgtcaaaatcgtcatggacgtatcaggtgggattgaagggcgaggctgataaaatatatactgttgaacacaatgaaaaagctgagtggagtactttggagaccgatgcttcaccttcgatcttcatgtggtacaagacatactttgaccccccggccggaacagatcctgttgttcttaatctggaaagtatgggaagggggcaagcttgggtcaatggacaacatattggaaggtattggaatatcatttcccaaaaggatggatgtgacagaacctgtgattatcgtggagcctacaattcagataagtgcacaacaaattgtggaaagcctacacaaaccaggtaccatgtaccgcgttcgtggttaaagccgtcaagtaatctacttgtgctctttgaagagactgggggaaacccatttaagatatcggttaagacagttactgctgggattctgtgcggtcaagtctcggaatcgcattatccacctctgcggaaatggtccacaccagattacataaacggaacaatgtcgataaacagtgtggcaccagaagtgcatctgcattgtgaagatggacatgtcatatcctccatagaatttgctagctatgggactccaagaggtagctgcgacgggttttctatcgggaaatgtcatgcatccaactcattatcaatcgtctctgaggcttgtaaaggacgcaacagctgcttcatcgaggtatcaaatactgcttttatcagtgacccatgtagcggaactttaaagactttagcggttatgtcacgatgttccccgtctcaaaacatgagtgacctcagtttttag

SEQ ID NO: 2233 - DNA, 1098 bp, Arabidopsis thaliana
atgagttgctttgggtgttgtggggaggatgatgatatgcataaaactgctgattatggaggtcgtcataaccaagccaaacactttcctccaggaaatgatgcaaggcaccaccaagcctctgaaactgcacagaagggtcctccagttgtgaagttgcagcctattgaagtacctattatcccttttagtgaactcaaagaagcaactgatgattttggatcgaattctctcatcggtgaaggctcttatggaagagtatactacggggtattaaacaatgatctgccttcagcgattaaaaagttggattctaacaaacagcctgacaatgaattccttgctcaggtttccatggtttctaggcttaaacatgataactttgttcaacttcttggctactgtgttgatgggaattcacggatactttcttatgaatttgccaataatggatctcttcatgatattcttcatgggagaaaaggtgtgaaaggagcacagccaggtcctgtcttgtcgtggtatcaacgagtcaaaattgcagttggagctgcaagaggccttgagtacttgcatgaaaaagctaatcctcacatcattcaccgtgacattaaatccagcaatgtcctcctctttgaagatgatgttgccaaaattgctgactttgatctctctaatcaagctcctgatatggcagctcgccttcattccacccgagttcttgggacttttggttaccatgcccctgaatatgcaatgaccgggcagttaaatgccaagagtgatgtctacagctttggagttgtcttactcgaacttcttacaggtcgaaagcctgttgatcatagactacccagaggccagcaaagtttagtcacatgggctacacctaaactgagtgaagacaaggttaaacaatgcgttgatgcaagactcggtggcgattaccctccaaaagctgttgctaagttagccgcggttgctgcgttgtgtgtgcaatatgaagcagattttaggccgaatatgagtatcgttgtcaaagctcttcaacctttgttgaatgctcgagccgtagctccaggggaaggagtacattag

SEQ ID NO: 2234 - DNA, 2061 bp, Arabidopsis thaliana
atggaacctcagagaaaacactcgacagccctccacacgtgtcatccctgccggcgaaccattccatacagaatctacgccgtatttcacacgtgtggcatcatagctctcatgtatcaccatgtacactcaattgtcaacgcaaacaacactctaataacatgtcttcttctcctctccgatattgttctcgccttcatgtgggcaaccacaacttccctccggttaaacccgattcatcggaccgagtaccctgaaaaatatgctgctaaaccggaggactttccaaagctggacgtttttatatgcacggctgatccgtacaaggagcctccgatgatggtggttaacaccgctttatcggtgatggcttacgagtatccgtctcataagatctcagtgtacgtatcggacgatggaggatcttccttgactttgtttgctcttatggaggctgccaagttctctaagcattggttgcccttttgcaagaataacaatgttcaagatcgctctcctgaagtttatttttcttcaaagtcacattcttcgagtgatgaagctgaaaatcttaagatgatgtacgaagacatgaagagtagagtcgaacatgtggtcgagagcggaaaagttgagactgcgtttatcgcatgcgatcaatttagttgtgtgttcgatctgtggacagataaattcactcgtcatgaccatcctaccattattatgttacgtgtatctgccgtgatgacaaactcaccaatcattctaacactagattgtgacatgtactcaaacaatcctacaacaccacttcatgctctgtgctatttgtcagaccctaaaatcaattttgatttaggatttgtgcaatttcctcaaaaatttcaaggagtaaacaaaaatgatatttatgcatccgagctcaaacgcccatttgacatcaacacggttgggtttgatggacttatgggaccagttcatatgggaactgggtgtttcttcaatcgacgggcgttttatgggcctccgactactttgattttgcctgagatagaaacatttgggccaaatcggattgccgataagcccattaaagcccaagatattttggcgttggcacacgatgtagcaggatgtaactacgagtgcaacaccaattggggatccaagataggtttcagatatgggtcattagtagaagactacttcacaggatttatgctccattgtgaaggatggagatcaattttttgcagcccgacaaaagctgcattttatggagactccccaaaatgcctaacggatgtaataggccaacaaatccgatggtccgttggacttcttgaagtagctttttcaagatacaatccacttacctatggaatcaagccattgagcctattaatgagcttaggttattgccactatgcattttggccattttggtgtattcctctcgttgtctatggaattttaccccaagttgccctcatacatggagttagcgtctttcccaaggcatcggatccatggttttggctttacattatcttgtttctcggtgggtacgcgcaagatctatcagactttttattagaaggaggaacttatcggaaatggtggaacgatcaaagaatgtggatggtgagaggactctcttctttcttctttggttttacagagttcactctcaaaaccctaaacctctccactcaaggatataatgtcacgagtaaatccaacgacgataatgaacaaatgaagcggtatgagcaagagatcttcgattttgggccctcttcgtccatgttcttgcccattactacggtcgccatcatgaatctgctagcttttatgcgtggcctatatggtattttcacttggggagaaggacccgtccttgaactgatgctagcgagtttcgcggtggtgaattgcttaccgatctatgaagccatggtgttgaggatcgatgacggaaaattaccaaaaaggatttgtttcttagctgggctcctcagttttgttcttaccgggtcaggctacttcttcctcaagtaa

SEQ ID NO: 2235 - DNA, 1089 bp, Arabidopsis thaliana
atggccgagatatgttacgaagtagtgaccgacgcatgtccgtcgtcggtttatgaatcaacgccggcacattcacggcggaggccgagattccaaacggtgatgcatgaagattgggagaagaattgtaagcgtagtaaacaggaggctttagctacgagatactcttcaattcctcgaagctctcgggaggatttctctgaccaaaatgtcgacgtatccagtccaagatacggtgtttcttcggtgtgcggtagaagaagagagatggaagatgcggtggcaattcatccttcattttcttctccgaagaattcggaatttcctcaacactactttggtgtgtatgacggccatggttgttcccacgttgcagcaaggtgtagagagaggcttcacaagctggtgcaagaagaactaagttcagatatggaagatgaagaagaatggaaaacgacgatggagcgtagcttcacacgcatggataaggaagttgtatcgtggggtgattccgtcgtgactgcaaattgcaagtgtgatctacaaacaccggcttgtgattccgtcggatcaaccgctgttgtctcagtcattacgccagataagatcgttgtcgccaattgtggcgattccagagcagttctctgccgcaatgggaaaccagtccctttatcaaccgatcacaagcctgatcggccagacgaattggatcgaatcgaaggagctggtggacgagtcatatattgggactgtccaagagttctcggagtcttagcaatgtcacgagcaataggagacaactatttgaaaccttacgtgagttgcgagccggaggtaaccataacggacaggagagacgatgactgcctcatactagctagtgatggtttatgggatgttgtgtcaaacgagaccgcctgctctgtagcgcgtatgtgtctccgtggtggtgggagaagacaagataatgaggatccggcgatttcggacaaggcttgtacggaagcgtcagtattgctaacaaagctggcgttggcaaggaacagtagtgacaacgtcagtgtcgttgtgattgatctcagaagataa

SEQ ID NO: 2236 - DNA, 1884 bp, Arabidopsis thaliana
atgggacaagaaagacctaacgacgaagagagacccgagtcacgtgatcttggggtctacggatgttcaccgcctcattcgccgcgtctcggtccgaccaggttctacgtctttgctggagacccgaatccaaaacaaacgataaagcgatgcaagaggaagagaatccaagcttgtaacgatcaaagaacggctaaaacagctattggcgttatggcgattttgggtttcttttgcctcgttaattggttcatgctctctcgccttcacgaaggtcgggtctggcttcgaagaggactctctgagaacccaaaacatgtttctgcacagaatgaagagcgtaaaaagtttgaaaaacagaagatgaaatataatggaacatatggtagaatgttgagtttggctactgatgctttggcagagggaatgcgtgataaccgttattgtaatggttttgattttgagcagaacaaacttgagaccaaagacttatggcaggagccgaaggaacaagcttcggcgtggaagccttgtgcggatcaacgttctttgactcctgacgatggcaaaaatggatatattatggtaactgcaaacggagggattaatcagcaaagagttgctgtatgtaacattgttgttgtagctcgattgctcaatgcggctctcgtcattcccaaattcatgttaagtgacgtttggacagatgcaagtcagtttggagatatctaccaagaggaacattttatggagtacttgtcgcccgatattcggatagtaaaggagctaccaaaagagcttcaatctcttaatcttgaagaaatcggtagcgtcgtgacagatatagaagtgatgaaagaagccaaaccagacttttatatgacacacattctccctatactactcaagaacagagtaatccattttgtcggattcggaaaccgcttagcctttgatccattaccgtttgagttacagaggcttcggtgcagatgtaactttcatgcgctaaactttgtcccgaggatacaagaaactgcggcattgctcgtgaagagattacggggcagtggatcttacgttgcaccacttgatctacatctcctcggtccaaaatatgcttccttaatcttggacaataagtctgattctccggtgcaggaggaggcggcttcttcttcttcttctaagtaccttgctctccatttacggtttgaaatcgacatggtggctcattctctatgttacttcggaggaggtgaaacagaacagaaagagttggattcttaccgccaaaaacactttccatctctttcaactttaaccagaaaaaaaaaattccgatctgcggatgttttgaggacagaaggactttgtccactaacacccgaagaagccgtgcttatgctcgcggctcttggcttcaaccgcgaaacccgagttttcgtagctggtgcaaacatatatggaggatcaaaacgtttagccgtgttaactagcttatacccgaatctagtcaccaaagaaaagttactaacagaatccgaactacaaccattcaaaaacttttcatctcagctagcggcattagatttcatcgcttgtgctgcagcagacgcttttgcgatgacggattcagggagtcagttatcatctcttgtatcgggttatcggatttattacggaggagggaaattgccgacgataagaccgaacaaacggagactttcggacatattgttgaagaacagtacgattgagtggaacgtgtttgagaaaagagtaagaaaagcgattagacagacgaaacatgtattcgctagacctaatggacgcagcgtttaccgttacccaagatgtaaagaatgtatgtgtcatgcatga

SEQ ID NO: 2237 - DNA, 3861 bp, Arabidopsis thaliana
atggcttcagagagcggcttaaatggagatccaaatatactagaagaggtttctgagaccaaaagagacaaggaagaagaagaagaagtgaagaaaacagagaagaaagacgaggaacatgagaaaaccaaaacggtgccgttttataagctctttgcttttgcagattcctttgatttcctcttgatgatcctcgggacgcttggatctattggaaatggtcttggcttccctcttatgaccttactgttcggagatctcattgatgcttttggagagaatcagactaatacaacagacaaagtctccaaagttgctctgaagtttgtatggcttggaatcggtactttcgcagctgcttttctccaattgtctggctggatgatttctggagagagacaagcagcgagaataaggagtttgtatctaaagacaatcttaagacaagatatagcctttttcgacatcgatacaaatacaggagaagttgttggaagaatgtccggtgacactgtgctaatccaagatgccatgggagaaaaggtgggaaaagctatacaacttctagcaacatttgtaggaggctttgtgatagctttcgtaagaggatggcttctaacgttggtcatgttatcttcaattcctctacttgtaatggctggtgcacttctggctatcgtcattgctaaaacagcttctcgtggacaaactgcttacgccaaagctgccactgtagttgagcaaacaattggttctataagaacggttgcatcatttacaggagagaaacaagcgataagcaattacaataaacatcttgtcactgcttataaagcaggagtcattgaaggtggttcaactggattgggtcttggaacgctctttcttgtagtcttttgtagctacgctttagcagtatggtatggaggaaagttgatattggataaaggctacacaggaggacaagttctcaatatcatcatcgctgttttaactggatccatgtcgttaggtcaaacatcgccttgcttaagcgcatttgcagctggacaagccgcggcttacaagatgtttgagacaattgagagaagacctaacatagattcttatagtacaaatggtaaagttttggatgacattaagggagatattgagctcaaagatgtttactttacttacccagcgagacccgatgagcaaatatttcgcggattctctctgtttatctcgagtggtacaacggtggctttagttggacaaagtgggagcgggaaatctactgttgtgagtctgattgagaggttttacgatccacaagctggtgacgttctcatagatggtattaacttaaaagagtttcagctaaaatggattagaagcaagattggacttgtgagtcaagaaccagttttgttcactgcaagcatcaaggataacattgcgtacggcaaagaagacgcaacaaccgaagagattaaagcagctgcagagctagcaaacgcatctaaatttgtggataagctaccacagggtttggatacaatggttggagaacatggtactcagctttccggtggacaaaaacagagaatcgcggtggctagagcaatcttaaaagatccaagaatcttacttttagatgaagctacaagcgcgcttgatgcagaatctgagagagtggttcaagaagcgcttgatagaattatggttaaccggactactgttgtggtcgctcatcggttaagcactgtgcgaaatgcggatatgatcgctgtgatccaccaaggcaagatcgtcgagaaaggttctcacacggaactactaaaggacccggaaggagcttattctcagctgattcgtctacaagaagagaagaaatctgatgagaatgcagcggaggagcaaaagatgtcatcaattgaatcattcaaacaatctagtctgagaaaatcgtctctaggccggtctctaagcaaaggaggatcatccagaggaaacagcagccgccattctttcaatatgtttggttttccagcaggaattgacggaaacgtcgttcaagatcaagaagaggatgatactacacaaccaaaaaccgaaccaaaaaaagtctccattttcagaattgctgctctaaacaaaccagagattccggtgctaatacttggatcaatatccgcagcagcaaatggcgttatccttccaatctttggcatactaatctccagcgtaatcaaagcgtttttccaaccacctaaaaagctaaaagaagatacaagcttctgggcaatcatattcatggttcttggtttcgcatccatcattgcatacccagcacaaaccttcttctttgccatagctggatgtaaactagtgcagaggatcagaagtatgtgttttgagaaagtggttcacatggaagttggatggttcgacgagccagagaattctagtggaaccataggagcaaggctatcagcagatgctgccacaatccgtggtctagttggagactctttggctcagacagttcagaatctttcatctatattggctggtttgatcattgcatttttggcttgttggcaattagctttcgtggtcctcgcgatgctcccgcttatcgcactcaatggatttctttatatgaagttcatgaaaggtttcagcgctgatgcaaagaaaatgtacggggaagcaagccaagtagcgaatgacgcggtagggagcataagaaccgttgcttcattctgtgcagaagacaaggtgatgaacatgtactcaaagaaatgtgaaggtccaatgaagaatgggattcgtcaaggcatagtcagtggtattggtttcggcttctctttcttcgtcctcttctcttcttacgctgccagtttctacgttggagcacgccttgtcgatgatggcaaaacaaccttcgactctgttttcagggttttctttgctttgacaatggcggcaatggcgatatctcaatcgagttcgttatctccagattccagcaaagccgatgtagctgctgcctcgattttcgcaataatggacagggaatcaaagattgacccaagtgtggaatcaggaagagtgttggataatgttaaaggagacattgagcttcgtcatgttagtttcaaatacccagcaagaccagatgttcaaatcttccaagacctctgtctaagcattcgagctggaaagacagttgctttggttggagaaagcggtagcgggaaatcaacggtgattgcattgttgcagaggttttacgatccagattcaggtgagatcactcttgacggtgtagagatcaagagcctaagactaaaatggctaagacaacaaacgggacttgtgagccaagaaccaatcttgttcaacgagacaattagagccaacattgcttatggcaaaggaggagacgcgagtgaatccgaaatcgtatcttcagctgaattatcaaacgcccatggattcatcagtggtctgcaacagggttatgatacgatggtgggagaaagaggaattcaattatcaggcggacaaaagcaacgagtagctatagccagagccatcgtcaaagatccaaaggtgttgctgctcgacgaagccacgagtgctcttgacgctgagtctgagcgtgtggttcaggacgcgctagaccgtgttatggtaaaccggactacgattgtggtagctcaccggttatcgacgattaagaatgctgacgtaattgccgtcgttaagaacggcgtcatcgttgagaaaggaaagcacgacacgttgatcaatatcaaagacggagtttatgcttcgttagttcagcttcatctaaccgcggcttcttga

SEQ ID NO: 2238 - DNA, 2340 bp, Arabidopsis thaliana
atggatgatcggcacgaaggagaccatcatgatatagaggttgaaggaggagctttacatggtttcgagaggaagatatctgggattctagacgatggatctgtcggatttcgacagcctcttctcgctaggaatcgaaagaacacaacttctcagatcgctattgtcggagctaatacttgtcccatcgaaagccttgattacgagatcttcgaaaatgattttttcaagcaagactggaggtctaggaagaagattgagatacttcagtatacgtttctcaaatgggcgcttgcttttcttattggtttagctactggacttgttggctttttgaataaccttggtgttgagaatatagctggatttaaactcttgctcatcggtaatctcatgctcaaggaaaaatatttccaggcattttttgcatttgctggttgtaacttaattttggcaactgctgctgcttcactctgtgcttttattgctcctgcggcggcaggatctggcatacctgaggttaaagcatatctcaatggtatagatgcttattcaatattagctccaagcaccctctttgttaagatctttggctctatatttggagttgctgccggatttgtagttggaaaagaagggcctatggttcatactggtgcttgcattgctaatttacttggacaaggtggttccaaaaagtaccggttgacttggaagtggctcagattcttcaaaaacgatagagacagaagagacctgatcacttgcggggctgctgctggtgtagcagctgccttccgtgctccagttggaggagtgcttttcgcccttgaagaagctgcttcatggtggaggaatgcccttctctggaggacattcttcactaccgcagttgtagcagtggtcttacgaagtttgattgagttctgtcgctctgggagatgtggactgtttgggaaaggaggtctcatcatgtttgatgtaaactcgggaccagtgctatatagcactccagatttgctagcaatagtattccttggagttattggtggtgtgcttggaagcctttacaactaccttgtggacaaagtcctccgcacatatagcattataaacgagaaaggtccgagatttaaaattatgcttgtaatggcagtttccattttgagctcgtgttgcgcatttggtctcccatggctttcacagtgtactccatgtcctattggcatagaggagggaaagtgccctagtgtaggtcgatccagcatctataagagtttccagtgtcctccaaaccattacaatgacctttcctccctacttctcaacaccaatgatgatgcaatccgtaatcttttcacatccagatctgaaaatgaattccatatctctacccttgccatcttctttgtcgcagtgtactgccttggcatcataacatacggcatagccataccctctgggcttttcattcctgtcattcttgctggagcctcttatggacgactagtgggtagactgctgggtccagtatctcagcttgatgtaggtctgttttctctgctcggagctgcttccttccttggaggcacaatgagaatgacggtctctctatgtgttatactgctcgaacttacaaataatctcctaatgctgccactggtgatgcttgtactccttatatcaaaaacggttgcagattgtttcaacaggggggtctatgaccagattgtaacaatgaaaggactgccttacatggaagaccatgcagagccgtacatgcgcaatttggttgcaaaggacgtagtttctggagctttgatatccttttcgagagttgaaaaggttggggtaatatggcaggctttaaaaatgacaagacataatggtttccctgtaattgatgagccacctttcacagaagcttctgagctatgtgggattgccttgagatctcatctccttgtgcttctccaagggaagaaattctcgaagcagagaacaacttttggttcacaaattctgagaagttgcaaagcccgtgactttggtaaagcagggttaggtaaggggctcaagattgaagatttggatctaagtgaggaggagatggagatgtatgttgatctccatcccatcactaacacatctccttacactgtgcttgagactctgtctctagctaaggcggctattcttttccggcaacttggtcttcgccacttgtgtgtggtgcctaaaacaccagggagaccgcctattgttggaatactgacaaggcatgatttcatgccggaacatgtcctgggactctaccctcacattgatcccctcaagtga

SEQ ID NO: 2239 - DNA, 465 bp, Arabidopsis thaliana
atgctgcaaaggcaaactaggagttttaaggaagcattattctcgaataatcataagttttgtacatctttcagcactacctctgagaaaggtggcgaaaaaacagaaaagataaacgttacctttgttgataaagatggagaggaaattcatatcaaggttccagtaggaatgaacatccttgaagctgctcatgaaaatgatatagaactcgaaggggcatgtgaaggttctctagcgtgttcaacctgccatgtgattgttatggacaccaaatactacaacaaactcgaagaaccaacagatgaagagaatgatatgctagatctcgctttcgggttaacagcaacgtcgcgattgggatgtcaagtcatcgcaaaaccagagctagatggagtacgcctagccattccttcagctactagaaattttgcggttgatgggtttgttccaaaacctcactag

SEQ ID NO: 2240 - DNA, 951 bp, Arabidopsis thaliana
atggaacaaggagatcatcagcagcataagaaagaagaagaagctttgccaccgggtttcagatttcatccgacggatgaggagctaatctcatattacttggttaataagattgccgatcaaaacttcaccgggaaagcaatcgctgacgttgatcttaacaagtccgagccatgggagcttcctgagaaggcgaaaatgggaggaaaagaatggtacttttttagcctccgggaccggaagtacccgacgggagtgaggacgaatagggcgacgaatacaggatattggaaaaccacaggaaaagacaaagagatattcaatagcacaacctcggagttggtcgggatgaagaagactttggtcttttacagaggacgagctcctcgtggggagaagacttgttgggtcatgcatgagtatcgacttcactccaagtcctcatatagaacctccaagcaagacgagtgggtagtgtgtagagtgttcaagaaaacagaagcaaccaagaaatacataagcaccagtagcagcagcacaagtcatcaccacaacaaccacacaagagcctcaatactatcaaccaacaacaataatcctaattactcatcagacctccttcaactcccaccgcatctacaaccacacccgagcctcaatattaaccaatccctcatggcaaacgccgttcacctagctgagctctcaagagtcttccgtgcctctacaagcaccaccatggactcttctcatcagcagctaatgaactacacccacatgcctgtctcagggctcaacctcaaccttggcggtgcactggtccagccgcctcctgttgtgtctcttgaggatgttgccgcggttagtgcttcgtacaatggcgaaaacgggtttggaaatgtggagatgagccagtgcatggacttggatggatactggccatcttattga

SEQ ID NO: 2241 - DNA, 849 bp, Arabidopsis thaliana
atgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaa

SEQ ID NO: 2242 - DNA, 771 bp, Arabidopsis thaliana
atgatgcaagaggagggaaaccgaaaaggtccatggacagaacaggaagacatacttctggtaaattttgttcacttatttggagatcgacgatgggattttatagcaaaagtatcaggtttgaacagaacaggaaagagttgcaggctaagatgggttaattacctacatcctggtctcaaacgtggcaagatgacgcctcaagaagagcgcctcgtccttgagcttcacgctaagtggggaaacaggtggtcgaaaatagcccgaaaattgccgggacgaacggataacgagataaagaactactggaggactcatatgaggaagaaagctcaagaaaagaagcgtcctgtttccccaacttcctcattttccaactgcagctcgtcatctgtgaccactaccaccaccaatactcaagatacatcgtgccactcgcgtaaatcttcaggggaagtgagcttttacgacactggaggttcccgatccactagagagatgaatcaagaaaacgaagacgtgtactcgttggatgatatatggagagagattgatcactcagcagtaaacataataaaaccggttaaagacatctactcagaacaaagccattgcttaagttacccaaatctagcttcaccatcatgggaaagctcattggattctatatggaacatggatgcagataaaagtaagatatcgtcttactttgcaaatgatcagtttcctttctgtttccaacacagtagatcaccatggtcgtcaggttaa

SEQ ID NO: 2243 - DNA, 933 bp, Arabidopsis thaliana
atgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcatgaatcaaaccaactcgttttgcgaccaagaagatgttaagccagtgctcatcaagaacatggtcaagatcgaagatcaagaactggagaaaacaaaccctcatcatcatcaagattcaatgacaaacgcttttgatcatctctctttctctcaactcttgttagatcctaatcataaccacttaggatcaggcgagggtttctccatgaactctatcttgagcgccaacacaaactctccattgcttaatacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaa

SEQ ID NO: 2244 - DNA, 798 bp, Arabidopsis thaliana
atggcttcctcaaccatggctttgtcctcccctgccttcgccggaaaggctgtgaagcctgccgcatcagatgtcctcggaagcggccgtgtgaccatgaggaagactgtcgccaagccaaagggtccatcaggcagcccatggtacggatctgaccgagtcaagtacttgggtccattctccggcgagcccccgagctaccttaccggtgagttccccggtgactacggatgggacaccgctggtctatccgccgacccagagaccttcgccaggaaccgtgagctagaagttatccacagcagatgggccatgctcggagccctaggctgcgttttccctgagctattggctaggaacggagtgaagttcggagaagcggtttggttcaaggccggttcacagatcttcagcgacggaggattggactacttgggcaacccgagcttggtccacgctcagagcatcttagccatttgggctactcaagttatcctcatgggagctgttgaaggctacagagtcgccggagatggtccattgggagaagcagaggacttgctttacccaggtggcagcttcgacccattgggcctcgctactgaccccgaggctttcgcagagttgaaggtgaaggagctcaagaacggaaggttggctatgttctctatgtttggattcttcgttcaagccatcgtcaccggaaagggacctttggagaacctcgccgaccatttggccgacccagtcaacaacaacgcttgggccttcgccaccaacttcgtccccggaaagtga

SEQ ID NO: 2245 - DNA, 1521 bp, Arabidopsis thaliana
atgaagatatactctagaacggttgctgtttcactcattgtgtcattcctcctgtgtttctctgcctttgctgagcgcaatgacgggaccttcagagttggactgaaaaaactcaagttggattcgaaaaatcggcttgcagcacgcgtcgaatccaagcaagaaaagcccctgagagcttacagacttggagattctggagatgctgatgttgttgtgcttaagaattatctagatgctcagtactatggtgagatcgccattggtactccacctcagaagttcactgtggtttttgacactgggagctctaacctctgggtgccatcatcaaaatgctatttctcacttgcatgtctcttgcatcccaaatacaagtcgtctcgttcaagcacatatgagaagaatggaaaagctgccgcaattcattacggcactggagcaattgctggtttttttagtaatgatgctgtcacagttggcgatttagttgtcaaggatcaggagtttatcgaggcaaccaaggagcctggtataacatttgttgtagctaaatttgatggtatccttggtcttggattccaagagatctctgttggaaaagctgctcctgtttggtacaacatgctcaagcaaggccttatcaaggagccggttttttcattttggcttaaccgtaatgcagatgaagaagaaggtggtgaacttgtatttggaggtgttgatccaaatcatttcaagggcaaacatacatatgttcctgtgacacaaaagggctactggcagtttgacatgggtgatgttcttattggcggtgcacccactgggttctgtgaaagtggctgttctgcgatagcagattctggtacatctttgcttgccggtccaacgactataatcaccatgataaaccatgctattggagcagctggagttgttagccagcagtgcaagactgttgtggatcaatacgggcagaccattttggatttacttttgtctgagacccaaccgaagaaaatctgctcgcagattggtctgtgtacttttgatggtacccgtggtgtcagtatgggcattgagtcggtggtggacaaggaaaacgccaaattgtctaatggtgttggagatgctgcgtgttctgcatgtgagatggctgttgtgtggatccagagccagttgaggcaaaacatgactcaagagcgcatattgaactacgtcaacgagctatgtgaacgcctccccagcccaatgggagagtctgcagttgactgtgcacaactgtcaacaatgcccactgtttcacttaccattggaggcaaagtatttgatcttgctccagaagagtatgttctgaaagttggtgagggacctgtggcacagtgcatcagtggttttattgctcttgacgttgctccacctcgtggacctctctggatcttgggagatgtgttcatgggcaaataccacaccgtatttgactttggtaacgaacaggtcgggtttgcagaggcagcctaa

SEQ ID NO: 2246 - DNA, 1026 bp, Arabidopsis thaliana
atggctccgactttgcaaggccagtggatcaaggtggggcagaaaggaggaacgggaccaggacctagaagttcacacggcatagccgcggtcggagacaagctctacagtttcggcggcgagttaacaccaaacaaacacatcgacaaagacctctacgtctttgacttcaacactcaaacttggtcaatcgctcaacccaaaggagacgccccaactgtatcctgcttaggcgtgcgcatggtggccgtgggaactaagatctatatctttggaggccgcgatgagaaccgcaacttcgaaaactttcgctcctacgatacggtgacatccgagtggacattcctgacgaagcttgatgaggtgggaggacccgaggctcgtactttccattcgatggcttcggatgaaaaccatgtgtatgtattcggtggggtgagcaaaggcggtactatgaatactcccacgcggttcaggacaatcgaggcgtataacattgctgatgggaaatgggctcagctaccggatccaggagataacttcgagaaaagaggaggagcgggattcgctgtggtacaagggaagatttgggtggtttatgggtttgcgacctcgattgtgcccggaggcaaagatgactatgagtctaatgctgtgcaattctatgatccggcttccaaaaagtggaccgaagtagagactacaggagcgaaaccttccgcaaggagcgtgtttgcccatgcggtagtgggaaagtatataataatatttgcaggtgaggtatggcctgatctcaatgggcattatggtcccgggacgctgtccaatgagggatatgcgttggacaccgagacactggtgtgggaaaagttgggagaagaaggtgcaccagccataccacgaggttggactgcctatactgctgccactgtcgatggaaagaatggcctcctcatgcatggcggaaagcttccgaccaacgagcgaactgatgatctctacttctatgcggtcaattcagcttaa

SEQ ID NO: 2247 - DNA, 1530 bp, Arabidopsis thaliana
atggcttctgttatctcttcctctccttttctatgcaaatcatcctccaagagtgatttggggatttcttcgtttcctaaatcttctcagatttcgattcatcgatgtcagaagaaatcgatctcacggaagattgtttccgttatggctcctcaaaaggatcggtctcctggaactacaggatcggtgaaaactgggatgacaatgacggagaagattctagctagagcttcggagaagtcattagtggttcctggtgataacatttgggttaatgttgatgttcttatgactcatgatgtttgtggtcctggtgcttttggtatcttcaagagagagtttggtgaaaaagccaaggtttgggatccggagaagattgttgtgattccggatcattatattttcactgctgataagcgtgcaaaccggaatgttgacatcatgagggagcattgcagggaacagaatattaagtatttctatgatatcactgaccttggaaattttaaggctaatcctgactacaaaggtgtttgccatgttgcacttgcacaagaaggtcattgcaggccaggagaggttttgttaggaacagactcacacacttgtactgctggagcatttggtcaatttgctacagggattggaaacactgatgcaggttttgtgttaggcactggaaaaatcctccttaaggttccaccaacgatgaggtttatcttggatggtgagatgcctagttatttgcaagcaaaggatctgattttacaaattattggtgaaatatctgttgctggtgcaacttacaagacgatggagttcagtggtacaactatcgaaagtctgagtatggaagaaagaatgacattgtgcaacatggttgtggaagctgggggaaagaatggtgtcatccctcctgatgcgacgacattaaattatgttgaggcatgtatactgtcttgttttcttccagtatatagtgatggaaatgcaagctttgtcgcagattatagatttgacgtgtcaaagctggagcctgtggtggctaagcctcattctcctgacaaccgagctctagctagagaatgcaaagacgtgaaaattgacagagtatacatcggttcttgtactggtgggaagacagaggattttatggctgcagctaaacttttccacgcagcaggaagaaaggtcaaagttccaactttccttgtcccggctactcagaaggtgtggatggatgtgtatgctctcccggtacctggagcaggtggaaagacatgtgcgcagatctttgaagaagctggctgtgacacaccagccagccctagctgtggtgcttgccttggtggcccagcagacacctacgctcgcttgaatgaacctcaagtgtgtgtctcaacgacaaacaggaacttccccggtcggatgggacacaaagaagggcaaatttacttagcgtctccttacactgctgcagcctcggctttaaccggccgtgtcgctgacccaagggagttcttgcagtag

SEQ ID NO: 2248 - DNA, 4240 bp, Arabidopsis thaliana
gctcctaccgattgaatgatccggtgaagtgttcggatcgcggcgacgtgggtggttcgccgcccgcgacgtcgcgagaagtccactaaaccttatcatttagaggaaggagaagtcgtaacaaggtttccgtaggtgaacctgcggaaggatcattgtcgatacctgtccaaaacagaacgacccgcgaaccaaagatcaccactctcggtgggccggtttcttagccgattccttgcccgccggatccgtggtttcgcgtatcggcatgatcgggagcttttatctcggtcttgtcgtgcgcgttgcttccggatatcacaaaaccccggcacgaaaagtgtcaaggaacatgcaaacgaacggctggcattcgcctccccggagacggagtgtgggcggatgctgtgctgcgaactgaagtctaaaacgactctcggcaacggatatctcggctctcgcatcgatgaagaacgtagcgaaatgcgatacttggtgtgaattgcagaatcccgtgaaccatcgagtctttgaacgcaagttgcgccccaagccttctggccgagggcacgtctgcctgggtgtcacaaatcgtcgtccctcaccatcctttgctgatgcgggacggaagctggtctcccgtgtgttaccgcacgcgttggcctaaatccgagccaaggacgcctggagcgtaccgacatgcggtggtgaacttgatccattacattttatcggtcgctcttgtccggaagctgtagatgacccaaagtccatatagcgaccccaggtcaggcgggattacccgctgagtttaagcatatcaataagcggaggaaaagaaactaacaaggattcccttagtaacggcgagcgaaccgggaagagcccagcttgaaaatcggacgtcttcggcgttcgaattgtagtctggagaagcgtcctcagcgacggaccgggcctaagttccctggaaaggggcgccagagagggtgagagcccgtcgtgcccggaccctgtcgcaccacgaggcgctgtctacgagtcgggttgtttgggaatgcagccccaatcgggcggtaaattccgtccaaggctaaatacgggcgagagaccgatagcgaacaagtaccgcgaggtaaagatgaaaaggactttgaaaagagagtcaaagagtgcttgaaattgtcgggagggaagcggatgggggccggcgatgcgtcctggtcggatgcggaacggagcaatccggtccgccgatcgattcggggcgtggaccgacgcggattacggtggcggcctaagcccgggcttttgatacgcttgtggagacgtcgctgccgtgatcgtggtctgcagcacgcgcctaacggcgtgcctcggcatcagcgtgctccgggcgtcggcctgtgggctccccattcgacccgtcttgaaacacggaccaaggagtctgacatgtgtgcgagtcaacgggtgagtaaacccgtaaggcgcaaggaagctgattggcgggatcctcgcgggtgcaccgccgaccgaccttgatcttctgagaagggttcgagtgtgagcatgcctgtcgggacccgaaagatggtgaactatgcctgagcggggtaaagccagaggaaactctggtggaagcccgcagcgatactgacgtgcaaatcgttcgtctgacttgggtataggggcgaaagactaatcgaaccatctagtagctggttccctccgaagtttccctcaggatagctggagctcggacgcgagttctatcgggtaaagccaatgattagaggcattgggggcgcaacgcctcgacctattctcaaactttaaataggtaggacgtgtcggctgctttgttgagccgtcacacggaatcgagagctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgcttaagcgcgacctatacccggccgtcggggcaagagccaggcctcgatgagtaggagggcgcggcggtcgctgcaaaacctagggcgcgaggcgcggagcggccgtcggtgcagatcttggtggtagtagcaaatattcaaatgagaactttgaaggccgaagaggggaaaggttccatgtgaacggcacttgcacatgggttagtcgatcctaagagtcgggggaaacccgtctgatagcgcttaagcgaacttcgaaaggggatccggttaaaattccggaaccgggacgtggcggttgacggcaacgttagggagtccggagacgtcggcgggggcctcgggaagagttatcttttctgtttaacagcctgcccaccctggaaacggctcagccggaggtagggtccagcggctggaagagcaccgcacgtcgcgtggtgtccggtgcgcccccgggcgcccttgaaaatccggaggaccgagtgccgctcacgcccggtcgtactcataaccgcatcaggtctccaaggtgaacagcctctggtcgatggaacaatgtaggcaagggaagtcggcaaaatggatccgtaacttcgggaaaaggattggctctgagggctgggctcgggggtcccagttccgaacccgtcggctgtcagcggactgctcgagctgcttccgcggcgagagcgggtcgccggctgccggccgggggacgactgggaacggctctctcgggagctttccccgggcgtcgaacagtcagctcagaactggtacggacaaggggaatccgactgtttaattaaaacaaagcattgcgatggtccctgcggatgctaacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagcttcggcgcaagtgaaataccactacttttaacgttattttacttactccgtgaatcggaggccggggtacaacccctgtttttggtcccaaggctcgcttcggcgggtcgatccgggcggaggacattgtcaggtggggagtttggctggggcggcacatctgttaaaagataacgcaggtgtcctaagatgagctcaacgagaacagaaatctcgtgtggaacaaaagggtaaaagctcgtttgattctgattttcagtacgaatacgaaccgtgaaagcgtggcctatcgatcctttagacttcggaatttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgcccgcgtcgcgatagtaattcaacctagtacgagaggaaccgttgattcgcacaattggtcatcgcgcttggttgaaaagccagtggcgcgaagctaccgtgcgctggattatgactgaacgcctctaagtcagaatccgggctagaagcgacgcatgcgcccgccgcccgattgccgaccctcagtaggagcttaggctccaaaggcacgtgtcgttggctaagtccgttcggcggaacggtcgttcggaccgccttgaattataattaccaccgagcggcgggtagaatcctttgcagacgacttaaatacgcgacggggtattgtaagtggcagagtggccttgctgccacgatccactgagattcagccctttgtcgctaagattcgaccctcccctaaatcactccaaaaaaaacaatccccaattctacacaagtgtttctacactaacaaagcaacagctccttaacgaattc

SEQ ID NO: 2249 - DNA, 1365 bp, Arabidopsis thaliana
atggaacccaatgggtacaggaaagaaagaagaaaggaacaacatttggggagaatgaatggtggtggtggtgatgttgagactgatcttgatccatggactgcatgggcttacaagcctcgcactatctctcttctccttattggcgcttgttttctcatttgggctagtggagctcttgatcctgacagcactacatctgatgatcttgtcacttctgtcaaaaggggagtgtgggctatgatcgctgtctttcttgcttactctttgctccaggccccttcaacggttctaatcaggccccatcctgcaatctggcgcttagttcatggaatggccgtcatttacttagttgcacttacttttttgctctttcagagacgtgatgatgcacggcagttcatgaagtttctccaccctgaccttggaatagaacttcctgagaaatcatacggtgctgattgccgtatatatgtgcctgatcacccaacaaacaggtttaagaatctttatgacacagtatttgatgagtttttcttggctcacatctttggttggtgggggaaagcaattctgatccggaaccagccgcttctttgggtgctttcaattggttttgagttattggaggttacttttcggcatatgttaccaaatttcaacgagtgctggtgggacagtattgttcttgatatcttgatatgcaactggtttggtatctgggcaggaatgtatacagttcgatattttgatggaaaaacatatgagtgggttggcattagccgccagcctaacattattggcaaagtgaaaaggacactggggcagttcacaccagctcactgggacaaagacgagtggcatccgctgcagggaccttggcgttttattcaagtactcactctttgcatcatattcttgacagtggagctgaacacattctttctcaagtttagcctgtggatcccccctcgaaacccagtgattctctataggctgatcttgtggtggctcatagcgataccaacaacacgggagtacaattcatatcttcaagacagaaaacctgtgaaaaaggtgggagcattctgttggctgtcactggggatatgcatagtagaacttctcatctgcatcaagtttggaagtggtaggtggattgtacccaacagaaatgccattgtgggtagtgacactatggggaagtgtgggacttggacttgtggccttcttgctgtcttggacatggaagatccagaagatcctcgcgcaaaagagacgttaagcgcatcattattgttgcagcagagacgagagagaaatagaggtgagacagtgaaatgccattgtggtttttttttgtaa

SEQ ID NO: 2250 - DNA, 963 bp, Arabidopsis thaliana
atgggttgccaagacgaacaattggtgcaaacaatatgcgatctctacgaaaagatctcaaagcttgagagtctaaaaccatccgaagatgtcaacattctcttcaagcagctcgtttccacatgcataccaccaaaccctaacatcgatgtcaccaagatgtgtgacagagtccaagagattcgacttaatctcatcaagatttgtggtctagccgaaggtcacttagaaaaccatttctcttcgatcttgacctcttaccaagacaacccacttcatcatttaaacattttcccttattacaacaactatttgaaactcggaaagctcgagttcgacctcctcgaacaaaacctaaatggctttgtcccaaagagtgtggctttcattggatctggtcctcttcctctcacttccatcgttcttgcttcattccatctcaaagacacaatctttcacaactttgacatcgacccatcagcgaactcactcgcttctcttctggtttcctctgatccagacatctctcaacgcatgttcttccacaccgttgatataatggacgtgacagagagcttaaagagctttgatgtcgtgtttctagctgctcttgttggaatgaacaaagaggagaaagttaaagtgatcgagcatctgcagaaacacatggctcctggtgctgtgctcatgcttaggagtgctcatggtccgagagcgtttctttatccgatcgttgagccgtgtgatcttcaggggttcgaggttttgtctatttatcacccaacagatgatgttatcaactccgtggtgatctctaaaaagcatccagttgtttcaattgggaatgttggtggtcctaattcatgcttgctcaagccttgcaactgttccaagacccacgcgaaaatgaacaagaacatgatgatcgaggagttcggagctagggaggaacagttgtcttaa

SEQ ID NO: 2251 - DNA, 1560 bp, Arabidopsis thaliana
atggacgaaagacccgagacagagctaatatcaataccagccacaccacgagtttcaacaccggagattctaactccctccggtcaaagatcacctcgtccggccaccaaaccatcgtcggcgacatggactccgacttcgttcatatcaccgaggttcttgagtccgattggtacaccaatgaaacgagttcttgtgaacatgaaagggtatcttgaagaagttggtcatctcactaagctaaacccacaagatgcttggcttccaatcactgaatctcgtaatggaaacgctcattacgctgcttttcacaatctcaacgctggtgttggttttcaagcccttgttcttcccgtcgcgtttgcgtttcttggctggagttggggaatactgtctttaacaatagcatattgctggcaactctacacactgtggattctggttcagttgcacgaagctgtccccgggaaacgctacaatcgatatgtcgagcttgcacaagctgcttttggagaaaggttaggagtatggcttgcattgtttcctacggtttacttatcagcaggaaccgcgacagcgctgattctgatcggtggagagacaatgaaactcttcttccagatagtttgcggtccattatgcacctcgaatccgttaacaacagttgaatggtatttggtgtttacatctctctgcatcgttctgtctcagctaccaaacctcaattctattgcgggactctccttaataggagcagtgactgcaataacttactccacaatggtttgggttctctctgtgagccaaccaagaccagccactatctcatacgagcctctttctatgccttcgacttctggttcactcttcgctgttttgaatgctcttggcattatagcttttgccttcagaggtcacaacttggttttggaaattcagtcgacgatgccatcaacgtttaagcatcctgctcacgtaccaatgtggagaggagccaaaatctcttacttcctcattgctctgtgtatctttccaatctccatcggaggcttttgggcttatgggaaccttatgccttcaggaggtatgcttgctgctttgtatgcattccacattcacgatatcccgagaggcttattagcgacggcatttctcctagtagtcttcagctgcttgagcagttttcagatatactccatgcctgcctttgacagctttgaagctggctacacaagcagaaccaacaagccgtgttcgatttgggtcagatcaggtttccgagtcttttttggttttgtctcgtttttcatcggtgttgctctcccttttctgtctagtcttgcggggttgctcggtggactcactctcccggtcacatttgcttatccttgcttcatgtgggtcttgattaagaaaccggcgaaatacagtttcaattggtatttccattggggattaggttggttgggagttgcattcagcttggcattctccataggtgggatctggagtatggttaccaatggacttaagctcaagttcttcaagccgcctaactaa

SEQ ID NO: 2252 - DNA, 1035 bp, Arabidopsis thaliana
atggataattgtactggagaaaatcccatggcttctcagttgaacattctccgatgcccgttcttgaggaacatcaatgagcccactaacctctctttctcttcatccttgccttttcccatccctgcaagagctgggaaaggacctatatttgaagatggtcccaattttgatacggcgtttaggcttttccatggccaagatggagttgtccctctctctgacaccgctcgaactgaagcccagaagcctgtgcctgtattccatccacttgctgctaaggcggccactattagtctctcatcctttggatctggagggccttttggatttgatgcattttctgacatgtttaaaaatcaaaagaagaagtcagattcatccaaaaataagggaggaaaccacgaagccatgggcgacgaatggcttaaaacaggaaactgcccaatagcaaaatcatatcgagctgtaagtggtgtggcaccacttgtggcaaagatcctgcaaccccctccaggcatgaaatttaaatgccctcaagcaatagtcacagctcgagcagcgatatcaaaaacacctttcgccaagaacctccgtccacaacctttaccagctaaagtactagtgatcgggatgctgggcatggcgttaaatgtgcctttaggggtctggagagagcacactgaaaagttttcggcatcttggtttatagctcttcacgcagcggttccattcataggaatactgagaaagtcagtgttgatgcctaaaacagctatggtattcaccatagcagcatcagttttgggacaggtgattgggtcaagagcagagaggcggagactcaagtctgtagctgagaagaagttgacattggaggtaccaaatccgtcttctgttgaagcagatcagatgcaatttgccggagtttcatcagatggaagatgcggtgataaagtggtgatgaagtggaatcccatgatgcttgatgttgcaagccctgtgtcttccggagcagctactgttgtctgctaa

SEQ ID NO: 2253 - DNA, 405 bp, Arabidopsis thaliana
atgtttccagattctggtgccctaaagctagccacaatcacaaacccaacttctacatgtcgggttcatgttccgcaacttgctggaatccgatccaccttcgcttctggttctcctctcttgccattgaagttgagtatgacccgtagaggaggaaacagagcagcatcagtttccataagaagtgagcaaagtacagaaggaagcagtggtttggatatatggcttggtcgtggcgccatggttggttttgcagttgccattactgttgagatttccactggaaaaggacttcttgagaattttggagtagcaagtccattgcctacggttgctttagctgttacagcattggttggtgttctagctgcggttttcatcttccaatcttcttctaaaaactga

SEQ ID NO: 2254 - DNA, 2205 bp, Arabidopsis thaliana
atgaagggagcgactctcgttgctctcgccgccacaatcggcaatttcttacaaggatgggacaatgccaccattgctggagctatggtttatatcaacaaagacttgaatctaccaacctctgttcaaggtcttgtcgttgctatgtcattgatcggtgcaacggtcatcacgacttgctcaggaccgatatctgattggctcggcagacgccccatgctcattttatcatcagttatgtatttcgtctgcggtttgataatgttgtggtctcccaatgtctatgttctgtgctttgctaggcttcttaatgggtttggtgccgggctcgcggttacacttgtccctgtttacatttctgaaaccgctcctccggagatcagaggacagttaaatactctccctcagtttcttggctctggtggaatgtttttgtcatactgtatggttttcactatgtccctgagtgactcccctagctggagagccatgctcggtgtcctctcgatcccttctcttctttatttgtttctcacggtgttttatttgcccgagtctcctcgttggctggttagtaaaggaagaatggacgaggctaagcgagttcttcaacagttatgtggcagagaagatgttaccgatgagatggctttactagttgaaggactagatataggaggagaaaaaacaatggaagatctcttagtaactttggaggatcatgaaggtgatgatacacttgaaaccgttgatgaggatggacaaatgcggctttatggaacccacgagaatcaatcgtaccttgctagacctgtcccagaacaaaatagctcacttgggctacgctctcgccacggaagcttagcaaaccaaagcatgatccttaaagatccgctcgtcaatctttttggcagtctccacgagaagatgccagaagcaggcggaaacactcggagtgggattttccctcatttcggaagcatgttcagtactactgccgatgcgcctcacggtaaaccggctcattgggaaaaggacatagagagccattacaacaaagacaatgatgactatgcgactgatgatggtgcgggtgatgatgatgactcggacaacgatttgcgtagccccttaatgtcgcgccagaccacaagcatggacaaggatatgatcccacatcctacaagtggaagcactttaagcatgagacgacacagtacgcttatgcaaggcaacggcgaaagtagcatgggaattggtggtggttggcatatgggatatagatacgaaaacgatgaatacaagaggtattatcttaaagaagatggagctgaatctcgccgtggctcgatcatctctattcccggaggtccggatggtggaggcagctacattcacgcttctgcccttgtaagcagatctgttcttggtcctaaatcagttcatggatccgccatggttcccccggagaaaattgctgcctctggaccactctggtctgctcttcttgaacctggtgttaagcgtgccttggttgttggtgtcggcattcaaatactgcagcagttttcaggtatcaatggagttctctactacactcctcagattctcgaacgggctggcgtagatattcttctttcgagcctcggactaagttccatctctgcgtcattcctcatcagcggtttaacaacattactcatgctcccagccattgtcgttgccatgagactcatggatgtatccggaagaaggtcattacttctctggacaatcccagttctcattgtctcacttgtcgtccttgtcatcagcgagctcatccacatcagcaaagtcgtgaacgcagcactctccacaggttgtgtcgtgctctacttctgcttcttcgtgatgggttacggtcccattccaaacatcctctgttctgaaatcttcccaacaagagtccgtggtctctgcatcgccatatgtgctatggtcttttggattggagacattattgtcacgtactcacttcccgttctcctcagctcgatcggactagttggtgttttcagcatttacgctgcggtttgcgttatctcatggatcttcgtttacatgaaagtcccggagactaaaggcatgcctttggaagttatcacagactactttgcctttggagctcaagctcaagcttctgctccttctaaggatatataa

SEQ ID NO: 2255 - DNA, 1575 bp, Arabidopsis thaliana
atggttaagctcagcaatctcctcgttgcaaccttcggggttctcctcgtccttaacggctgccttgcgaggcagtcacttggggttcctcctcagctacagaacgagtgtaacctcgacaacctagatgttctccaagccaccgaaactatcaagagtgaagccggtcagatcgagtactgggaccacaaccaccctcagctccgatgtgttggtgtttccgttgctcgttatgtaattgaacaaggcggtctttacttgcccaccttcttcacttccccaaaaatttcctacgtcgttcaaggaacgggtatcagcggaagagtggtccctggatgtgccgagaccttcatggactcgcagccgatgcaaggacaacaacaaggccaaccatggcaaggacgacagggacaacaaggccaaccatgggaaggacagggacaacagggacaacaaggaagacaaggccaaccatgggaaggacagggacaacagggacaacaaggacgacagggacaacaaggccaaccatgggaaggacagggacagcagggacaacaagggttccgtgacatgcaccagaaggtggaacatgtgagacgcggagacgtctttgccaacactccaggctctgcccactggatctacaactcaggagaacagccacttgtcatcatcgctcttctcgacatcgccaactaccaaaaccaactcgaccgcaaccctagagtgttccatttggccggaaacaaccagcagggaggctttggcggttcacagcaacaacaagaacagaaaaacttgtggagcgggttcgacgcacaggtcatagctcaagcattgaaaattgacgttcagttggctcagcagcttcagaaccaacaagacagcagaggaaacatcgttcgtgttaagggacctttccaggtcgtgaggccacctctaagacagccctacgagagcgaggagtggagacacccacgtagcccacagggcaacggccttgaggagactatctgcagcatgaggtcccacgagaacattgacgaccctgctcgtgctgacgtgtacaagcccagcctaggtcgcgtgaccagcgtcaacagctataccttgcccatcttggagtatgtcaggctcagtgccactcgtggcgttctccagggtaatgcgatggtgcttcctaaatacaacatgaacgctaacgagatcttgtactgcactggaggacaaggaaggatccaagtggtcaacgacaacggacagaacgtgttggaccaacaggtgcagaagggacagctcgtggtcatcccacaagggttcgcatacgttgtccagtcccacggaaacaagttcgagtggatctctttcaaaactaatgaaaacgcaatgatcagcactttggcgggtagaacctcgctcttgagggcattgccattggaggtcatatcaaatggtttccagatctctcccgaggaagctaggaagatcaagttcaacacacttgagaccactttgacccgcgctgccggtaggcaacaacaacagttgatcgaggagattgtcgaggcttaa

SEQ ID NO: 2256 - DNA, 690 bp, Arabidopsis thaliana
atgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttga

SEQ ID NO: 2257 - DNA, 1086 bp, Arabidopsis thaliana
atggctgagaatcttgcttgtggtgaaaccagcgagtcatggatcattgacaacgacgatgatgatatcaactatggcggcggatttacgaacgagattgattacaatcaccaactttttgctaaagacgacaactttggcggcaacggatcaattccgatgatgggttcttcttcatcgtccttgagtgaagacagaatcaaagagatgttggtgagagagattgagttttgccctggaactgattatgttaagagattgctttctggtgatttggatttgtctgttcgaaaccaagctcttgattggattctaaaggtttgtgctcattaccattttggacatctgtgcatatgcctatccatgaactacttggatcggttcttaacatcctatgaattgccgaaagacaaggattgggctgctcagttactagctgtgtcttgcttatcattagcatccaaaatggaagaaactgatgtgcctcacattgttgatttacaggtggaagatcccaagtttgtttttgaggccaaaacaataaaaaggatggagcttttggttgtcaccactttgaattggagattgcaagctctaactccattctccttcattgattatttcgttgacaagatcagtggtcacgtgtcggagaatttgatctatagatcgtcaagattcatcttaaacaccaccaaagcaattgaattcttagacttcaggccttctgagatagctgcagctgctgcagtgtctgtttccatttcaggagaaacagaatgcattgatgaggaaaaggcactgtctagtctcatatatgtaaaacaggagagggtgaagagatgtttgaatctgatgagaagtctcactggggaggagaatgtgcggggaactagtttatcgcaggagcaggcgcgagttgcggtaagagctgtacctgcaagtccagttggagtgttggaagcaacatgtttgagctataggagtgaagagagaacagttgagtcatgtacaaattcctcacagagtagtccagacaacaacaacaacaacaacaacagcaacaagaggaggagaaaacaatga

SEQ ID NO: 2258 - DNA, 1155 bp, Arabidopsis thaliana
atgagtgtgagttgttgttgtaggaatctgggcaagacaataaaaaaggcaataccttcacatcatttgcatctgagaagtcttggtgggagtctctatcgtcgtcgtatccaaagctcttcaatggagaccgatctcaagtcaacctttctcaacgtttattctgttctcaagtctgaccttcttcatgacccttccttcgaattcaccaatgaatctcgtctctgggttgatcggatgctggactacaatgtacgtggagggaaactcaatcggggtctctctgttgttgacagtttcaaacttttgaagcaaggcaatgatttgactgagcaagaggttttcctctcttgtgctctcggttggtgcattgaatggctccaagcttatttccttgtgcttgatgatattatggataactctgtcactcgccgtggtcaaccttgctggttcagagttcctcaggttggtatggttgccatcaatgatgggattctacttcgcaatcacatccacaggattctcaaaaagcatttccgtgataagccttactatgttgaccttgttgatttgtttaatgaggttgagttgcaaacagcttgtggccagatgatagatttgatcaccacctttgaaggagaaaaggatttggccaagtactcattgtcaatccaccgtcgtattgtccagtacaaaacggcttattactcattttatctccctgttgcttgtgcgttgcttatggccggcgaaaatttggaaaaccatattgatgtgaagaatgttcttgttgacatgggaatctacttccaagtgcaggatgattatctggattgttttgctgatcccgagacgcttggcaagataggaacagatatagaagatttcaaatgctcgtggttggtggttaaggcattagagcgctgcagcgaagaacaaactaagatattatatgagaactatggtaaacccgacccatcgaacgttgctaaagtgaaggatctctacaaagagctggatcttgagggagttttcatggagtatgagagcaaaagctacgagaagctgactggagcgattgagggacaccaaagtaaagcaatccaagcagtgctaaaatccttcttggctaagatctacaagaggcagaagtag

SEQ ID NO: 2259 - DNA, 2409 bp, Arabidopsis thaliana
atggatattcaaatccaactcaatatcactcttgaaagtaaaattactgctgataggagaaacaggtgtaaccagatcctccttttagcataccagagttttggcttagtgtttggagatttgagtatttctcctctctatgtgtataaatgtacattctacggaggattgagacatcaccaaacagaagatacgatatttggcgcgttttctttgatattttggaccatcactctcctttcactcatcaagtacatggtttttgtgttaagtgcagatgacaatggtgaaggtatgtgcatcggagggatctttgctttgtatgctttgctctgcagacacgcaagattttctttgcttccaaatcagcaagctgctgatgaagaaatctctacatactatggtcctggagatgcaagtagaaatttgcctagttctgctttcaaaagccttatagaacgaaataaaagatcaaaaactgctttgcttgttttagtcttggtaggaacttccatggtaataaccatcggtgtccttacaccagcaatttcagcatctaacgtttatcttcttgtagtctcttcgtctattgatggccttgtggccaagacaagtctgaagcacagtactgtggtcatgatagcatgcgctttactggttggactttttgttctgcagcaccgtgggacaaataaagttgcctttctatttgcacctataatgattttgtggttgttgataattgcaactgctggtgtgtacaatattgtgacttggaaccccagtgtatacaaagccttatctccctactatatctatgtattctttagagatacgggaatagatggatggctatcccttggaggcattcttttatgcatcacaggaacggaggctatctttgctgaacttggccaatttacagccacatctataaggtttgcgttttgttgtgttgtttacccgtgtctggtgcttcaatacatgggccaagctgcgtttttatcaaagaatttttctgctctaccttcaagcttttattcttccattccagacccatttttctggccggttctcatgatggctatgctagctgcaatggtcgctagtcaagcagtcatatttgccacgttctcgattgtcaaacaatgctatgcattgggatgcttcccgcgtgtgaagattgttcacaaaccaagatgggtccttggccagatttacatccctgagatcaattgggttgtcatgatcctcacccttgctgtcaccatttgtttccgagacactcgacacatagcttttgcttttgggctcgcctgcatgactctagcctttgtgactacttggttgatgcctctcatcatcaactttgtctggaaccgtaatatcgtcttctccgtcctcttcatcctcttcttcgggaccatagaacttatcttcgttgcatcagccttagtcaaaatccctaaaggaggctggatcactctgctcctttccctcttcttcaccttcatcacatacgtatggcattacggcagcagaaagaagtacctatgcgaccagcacaacaaggtccctatgaaatcaatactaagccttggcccgagcctcgggatcatcaaagtccccgggatgggtcttatctacacagagctcgccagcggtgttcctgccacatttaagcactttctaacaaacttaccggcgttctaccaagttgtcgtctttgtctgctgcaaaactgtccctatcccgtatgtgccgcagaaagaacggtaccttatcggccggattggaccaaaaacatacaggatgtaccgatgcattatccgagctggctacaaagacgtgaacaaagacggagacgactttgaagacgagctggtgatgagcatcgccgagtttatccagctagaatccgaaggctatggtggctcaaacactgaccgttcgattgacggtcggctcgctgttgtgaaagcctcaaacaagtttgggacaaggctgtctcggtctatatccgaagccaacatcgcaggcagctcgagatcacagacaacagtaacaaacagcaagtctccggctctacttaaactgagagcagagtatgagcaagagcttccgaggctgagcatgagaaggatgtttcagttcagaccaatggacaccaagttcaggcaaccgcaggtgaaggaagagctgtttgatctggtgaatgctaaggacgctgaagtggcttacattgtcggacacggtcacgtgaaggcaaagcggaactcagtgtttgtaaaacagctggtggtaaacgtagcgtactcgttcttgaggaagaattgccggagcccaggcgtgatgttgaatattcctcacatttgtttgatcaaagtgggcatgaactattacttgtaa

SEQ ID NO: 2260 - DNA, 1020 bp, Arabidopsis thaliana
atgaattggactagaggaaaaactttaggccgtggctcaacggccaccgtttccgccgccacttgtcacgaatccggcgaaacactcgccgtaaaatccgccgagtttcaccggtcggagttcttgcaaagagaagccaagattctctcctcattaaactctccgtacgtcatcggatacagaggatgcgaaattacgagagagcccttccacaacaacggagaagctacgacttacagtcttcttatggagtacgcgccgtacggaacgttgaccgacgtagcgaccaagaacggcggcttcattgacgaggctcgggtcgtgaagtacacgcgccagatacttcttgggttggagtacattcataactcaaagggaattgcgcattgcgacattaagggaagcaacgtgttggtcggagagaacggagaagccaagatcgctgatttcgggtgtgcgaaatgggttgaaccggaaataaccgaaccggttagaggaacgccggcgttcatggctccagaagcggcgcgtggagagagacaagggaaagagagtgatatatgggcggtgggttgtacggtgatagagatggttaccgggtctcagccgtggattggggcggattttaccgacccggtttcggttctttaccgggtcggatatttaggtgagttaccagagctgccttgctcgcttacggaacaagcaaaggattttttaggaaagtgtttgaaaaaagaagcgacggagagatggacagcgagtcaactactaaaccatccgttcttggttaataaagaaccggaattggtaaccggtttggttacgaactcaccgacaagtgtgacggatcaaatgttctggagatcagtggaagaggaggtgtcagaggaccgttcaagctggtgggaatgtcacgaggatgagagaattggagtgctaagctggattggtcatgttgtggtggagtccacatgggacttggacggtgaggattggatcacggttcgacggaattag

SEQ ID NO: 2261 - DNA, 915 bp, Arabidopsis thaliana
atggggatgaagaaggtaaagctatctttgatagctaatgaaatatcaagggaaacatccttcatgaagaggaaaaatgggataatgaagaaactctacgagttgtcaactctatgtggtgtccaagcttgtactctcatctacagtccattcattccggttccagagtttctggagatgtcgccgacagcccgaacaaggaagatgatgaatcaagaaacgtatctaatggagaggattaccaaagcaaaagagcaactacagaacctggttggtgcgaaccaagagttacaggttagacgatttatgtttgattgtgttgaaggcaaaatgtcgcagtatcgttatgatgcaaaagaccttcaagatttgttatcttgtataaatctatatctcgatcagcttaacggaaggatcgagatccttaaagaacacggtgactcgttgccttccgtctctccttttcctactagaattggtgttgaagaaactggtgatgagtcgtcttccgactctcctattcttgctacaactggggttgtagatactcctaatgctacaaatcctcgtgttcttgtggccgatacgactcattttcttgatgcgaatgcaactgcgaatatgaatcaggttcaataccaggctcctcctaatgatatgtttaatcagattcaacgagagttctacaacattaatttgaatcagaaatcaaatcagtatatgaatcaacaacaaccattcatgaatccgatggtggaacaacatatgagtcatgttggagggcgtgagagcattcctttcatggacggaaactactacaactacaatcaactaccagtcgttgatcatggttccacaagttacatgccttccaccaccggtgtttatgatccttacttcaacaataatctctaa

SEQ ID NO: 2262 - DNA, 2223 bp, Arabidopsis thaliana
atggctcgtattgtagcagctaatgatgatgattccatggagctaaacaccatctcctctatacacgattcaactttagggcaacttctgaagaacgttagtgacgtcagaaaaatggctattggagacgagactccagttcacgagtccttaaaccaagactacaacgatggttacatgcgtacagttccattcgttctctcattcgacaatctcacatacaacgtctctgttcgtccaaaactagacttccgcaatctctttccacgtaggagaacagaggatccggagatagctcaaacggcgaggccaaaaactaaaacccttctcaataatatctctggcgagacacgagatggagaaatcatggctgttctaggcgctagcggctcgggaaaatcaacactgatcgatgcattagcgaatcggattgccaaaggaagcttaaaaggaacagtgaagctaaacggagaaacacttcaatctcgaatgctcaaagttatatcagcttacgtgatgcaagatgaccttctcttcccaatgcttaccgttgaagaaacactaatgttcgcagctgagtttcgtctcccgagaagtttacctaaatctaaaaagaagcttcgtgtgcaagctttgattgatcaactaggtatcagaaacgcggctaaaactattataggagacgaaggtcaccgtggaatctccggtggtgaaagaagacgtgtttccatcggaattgatataattcacgatccgattcttctcttcctcgatgaaccaacctctggtttggattcaacgagtgctttcatggtggttaaagtattgaagaggattgctcagagtggtagtatcgtaattatgtcgattcatcaacctagtcatcgtgttctcggtttgcttgaccggttaatcttcttgtcacgtggccacaccgtgtatagtggatctccggcgagtcttccacgttttttcaccgaattcgggagtccgataccggagaacgagaatcgaacggagtttgcgttagatctcatccgtgagcttgaaggatccgccggaggaacgagaggattaatcgaattcaacaaaaaatggcaagagatgaagaaacagagcaatcgtcaaccaccgttgactccaccgtcatcaccgtacccaaatctaacactaaaagaagcaatcgccgcaagtatcagcagaggaaagctagtttccggcggtgaatccgtcgctcacggcggagcaaccaccaacaccacaaccctagccgttcctgcattcgcgaatccaatgtggatcgaaatcaaaactctctcgaaacgatcaatgctcaattcacgaagacaaccagagctattcggaatcagaatcgcctctgttgttatcaccggattcattctcgccaccgtgttctggcgattagataattcgcctaaaggagttcaagagcggttagggttcttcgccttcgcgatgtcgacaatgttctacacttgcgccgatgcgttaccagtttttctccaggaacgttatatcttcatgagagaaactgcttacaacgcttaccggagatcctcatacgttctctctcacgccatcgtctcattcccgtcgctcatcttcctctctgtagctttcgcggcgacgacgtattgggcagtgggcttagatggaggcctaacgggccttttgttctactgtctgatcattttagcctcgttctggtcaggaagctcctttgtcacgtttctatcaggtgtggttcctagtgtgatgttgggttacacaatcgtcgttgctattttggcttacttcttgttgttcagtggattcttcatcaacagaaaccgaatcccggattactggatttggtttcattacatgtcattggtgaagtacccgtatgaagcggttttacagaacgagttctctgatgcgaccaagtgttttgtgagaggagttcagattttcgacaacacgccattaggggaactaccggaagtgatgaagctgaagcttcttggtacagtgagcaagtccctcggggtaacgatatcgagcacgacttgtttaactactggttcagatattctgaggcagcaaggtgtggttcagctgagtaaatggaattgcttgttcatcacagttgcttttgggttcttttttaggattttgttctacttcactttgttactaggaagcaagaacaagcggaggtga

SEQ ID NO: 2263 - DNA, 321 bp, Arabidopsis thaliana
atggagttttgtcccacatgtgggaatctgttgcgctacgagggaggtgggagttcgagattcttctgttccacatgtccatacgttgccaatatcgaaagacgggttgagataaagaagaagcaacttctggttaagaaatctatagaacctgttgttactaaagatgatatacccacagctgctgaaacagaagctccatgtccaaggtgtggccacgacaaggcgtacttcaaatcaatgcagattcgttcagcagatgagccagaatcaagattttatagatgcttgaagtgcgagttcacttggcgtgaggaatga

SEQ ID NO: 2264 - DNA, 267 bp, Arabidopsis thaliana
atggcgagcaccaaagttcaaaggattatgacccaacctatcaacttgatttttaggtttcttcaaagtaaagctaggatccagatttggctatttgagcagaaagatttgaggattgaaggaagaatcactggttttgacgaatacatgaatctagttttggatgaggctgaagaagtgagcatcaagaagaacaccaggaaaccacttggaaggattttactcaaaggagacaacataactctgatgatgaacacgggaaagtga

SEQ ID NO: 2265 - DNA, 1812 bp, Arabidopsis thaliana
atggcatttacttcctctccttcgtatggttccctaaatgctgcattttggcgcaccattttcgtagtacactgtatatctacactagtcttcactacgatctcaacaccacccgaagatcctgtcaaatgtgtgtcgggaaacacgaactgtacagttacaaactcatatggagccttcccagaccgttccacgtgtcgagccgccaatgtggcttatccaacaaccgaagccgagcttatctctgtcgtggctgcagccactaaagccgggcggaaaatgcgtgtaaccacccgatattcccatagcatcactaagcttgcgtgtaccgacgggaccgacggtttgcttataagtacaaagtttctaaaccacacggtgcgaaccgatgcaacggccatgaccttgacggttgagagcggtgtgacacttaggcagctaatcgctgaagcggctaaagttggattggcgttgccttatgcaccatattggtggggtctaaccgtgggtggtatgatggggaccggtgctcacgggagctcattatggggtaaaggaagtgcggtccatgattacgtgaccgagatcaggattgttagtcctggttcggtcaatgacggctttgccaaggttagagttttaagagagactacaacgcctaaagaatttaacgccgctaaggtttctcttggcgttcttggggttatctctcaggtaacccttaaattgcaaccgatgtttaagagatcgttaaggtatgtcatgagaaatgattcggattttggggatcaagccgtaacatttgggatgaaacatgagtttgcggatttcatatggttaccaagccaaggcaaagtggtgtatcgaatggacgaccgagtagcggtcaacacatcaggcaacggtttgctcgatttcatgccgttccgttcgcaactttctgccgcattagccatcataagatcctcagaggagacgcaagagaggttcagagatgcgaatgggaagtgtgcgggagccacattaattacgtctacactgtttgctacatcatacggtttgaccaacaatggcatgatatttaccggttatccggttattggaagccagaaccgtatgatgtcgtcaggatcatgcctagacagtcttcatgatggattaatcacagcgtgtccatgggactcacgtataaaaagtgaattcttccaccaaacaactttcagtattccgctcacgcaagtcaaaagtttcatcaacgacatcaaatctcttgtcaagatagagtcgaaatctttgtgcgtgcttgagctatacgatggtattctaatgcgttatgtcacatcttctccggcgtatctcgggaaagaaacagaggctttggactttgacctcacgtattaccgagccaaagatccgttatcaccgcgactatacgaagattttatcgaagaaatcgagcaaattgcgttgttcaagtataacgccttgccgcattggggtaagaacaggaacttagcgtttgatggagtgattaaaaagtacaagaatgtgccggcattcttgaaagtaaaagaaagctatgatccaatgggtttattctcaagcgaatggactgatcagatcttaggaatcaaaggaaatgtgacgataataaaagatggatgcgcattagagggtttgtgcgtatgttcggaggatgctcattgtgctccgaccaaaggatatttttgtcgaccaggaaaagtctacaaagaagctagggtatgtacacgtgctgatgacataagtgtgattcaatcactaagttactaa

SEQ ID NO: 2266 - DNA, 1620 bp, Arabidopsis thaliana
atgattgcaacacaaacctttgtctctgtctttttctttgtcttcttcctcgtatctctccctttcttctcatccgcagcacctccgtcttctgattctatctacgaatcattcgttcaatgtttctccgacaagacaaaatctccacaagcccaaatcaccgacaatgtcttctctcggacaaacccttctttctcctccgtccttcgtgcttacattcgaaatggcaggttcaacacttcatctacgccaaaaccagctatcatcgtcactcctcgctccgatatccacgtcagcgccgccgtcacttgctcaaaaagtttaaatttccttctcaaaatccgaagtggtggccatgattacgaaggtctctcttacatctctgataaaccattttttatactcgacatgtcgaatctccgtgatgtctctgttgatatcgccgatcaatcagcttggatctccgccggagcaactcttggtgaggtttattacagaatttgggagaaaagcaaagtccatggatttcccgccggagtttgtcccacggttggtgttggtggacatataagcggtggtggttacggtaatatgttgaggaaattcggattatcagttgataacttgatcgatgcgaagatcgttgatgttaacggtcaaattttagaccggaaatcgatgggtgaggatcttttttgggctatttccggtggaggaggggctagcttcggcgtcgttttgggttacaaggtcaagctcgttcctgtgccagaaactgttacagtctttagggtggagaagtatatggattcaggagcggtggatatggttcacaaatggcaatccgttggtccaaaaaccgaccggaatctatttttgagaatgttgattcaaccggtgacgaggaagaaggtaaagactgtgagagctactgtggtggctctgtttttaggcagagcagaggaagttgttgctttgcttggtaaggagtttcctgaattgagtttaaagaaggagaactgttcggagatgacttggtttcagtcagctttatggtgggataatcgtgttaaccctactcagattgatcctaaagtgtttctcgatcggaatcttgatagagcgaatttcggaaagaggaaatcggattacgttgcgagtgagattcctagagatgggattgagtctttgttcaagaagatgactgagctggggaaaatcgggcttgtttttaatccgtatggtgggaaaatggcggaggttacggttaacgcgacgccgtttccgcaccgaagcaagctttttaagattcagtactcggtgacttggcaagaaaactctgtcgagatagagaagggtttcttgaatcaggctaacgttctttatagtttcatgaccgggtttgtgagcaagaaccctagaaatgcttacttgaattaccgagatgtcgatataggtgtgaatgatcatggtacgaatagttatgaggaaggagaagtgtatggaaggaagtattttggagataattttgatcgattagtaaaggttaaaacagcggctgatccagataatttcttcaggaatgaacagagtatacctaccgtgcttagcaaggcatag

SEQ ID NO: 2267 - DNA, 1083 bp, Arabidopsis thaliana
atggagaccaaagaattcgactcttacagtgagcgcaaagctttcgacgagacgaaaacaggtgtgaaaggtctcattgatgctcacatcactgagattcctcgaattttctgtctccctcaaggttccttatccgacaagaaaccttttgtttctaccactgattttgcgatccctatcatcgacttcgaaggcctccacgtctcccgtgaagatatcgttgggaagatcaaagacgctgcatcgaattggggattcttccaggtgatcaatcatggtgttcctttaaacgttcttcaagagattcaagatggagttcgtaggtttcatgaggaagctcctgaggttaagaaaacctacttcactcgtgacgccactaaaagatttgtctacaatagtaatttcgatctctatagttcttcttcatgtgttaactggagagactctttcgcttgttacatggctcctgatcctccaaaccctgaggatctccctgtggcttgcagggttgctatgttcgaatactcaaagcatatgatgagattaggtgatttgctctttgagcttctctcagaagctcttggtttgagatctgataagcttaaaagcatggattgcatgaagggtttgcttttgctctgccattattatcctccatgtccacaacctgatctaaccatcggcacaaataatcattcagacaactccttcctcaccattcttctccaggaccaaatcggtggtcttcaaatctttcatcaagactgttgggtcgatgtctctcctattccaggggctctagtcatcaacatgggagatttcttgcagctaataacgaatgacaaagtcataagtgtggagcacagggtgctagcgaacagggcagctacaccgaggatatcagtagctagctttttcagcacaagtatgcgtccgaattcaactgtttatggaccaatcaaagagcttctctctgaagaaaacccttcaaaatacagagtcatcgacttgaaagaatacacagagggatacttcaagaaaggcctcgatggaacatcgtatctgtcgcattacaagatatga

SEQ ID NO: 2268 - DNA, 1491 bp, Arabidopsis thaliana
atggcgggaggaggaacgaccttagagtacacaccaacttgggtggttgctctcgtctgctccgtcattgtctctatctcttttgccgtcgagcgtctcattcaccgtgccggaaagcactttaagaacaacgatcagaagcagctttttggggcattacaaaagatcaaagaagaactcatgctagtagggttcatatcgttgctattatcggtcggccagtctaaaatcgcaaagatttgcatatcaaaggagttaagtgaaaagtttctcccttgtacgaaacctgcaggggctgagaagtcccttaaagactcctcccatttccagttcagcttcaccggccgtcatctcctcgccggagatgcccccgccggtgactactgctccctaaagggaaaagtaccaataatgtcattatcagctctgcacgagcttcatatattcatcttcgtattagctgttgcccacattattttctgcctcttaaccattgtttttggtaccatgaagataaagcaatggaaaaaatgggaggataaggttttagagaaggacttcgacacagaccaaagtataaagaaattcacacacgttcaagaacacgaattcatcaggtcacgatttcttggggttggaaaagctgatgcttccttgggatgggtgcaatcgtttatgaaacagtttcttgcgtcagtcaatgaatcagattacatcacaatgaggctaggctttgtcacgactcattgcaagaccaacccaaaattcaatttccataagtatttaatgcgtgcccttaattctgatttcaagaaagtcgtcggtatcagttggtacctttgggtatttgtggttctcttcttgcttctaaacattgttgcatggcatgtttacttctggctagcttttattcctttgatccttttacttgccgtggggacgaagttagagcatatcatcacagatttggctcatgaagttgcagagaaacacattgctgtggaaggagatttggttgtccgaccatcagatgatttgttctggtttcaaagtccccggctagttctcttcttgatccatttcattcttttccaaaactccttcgaaatcgcctacttcttctttatcctttttcaatttggttgggattcatgcatcatggatcatgtcaagttcgtaattccaagactcgtcatcggggtaataattcagcttctctgcagttacagtaccttaccgctctatgcactcgtaactcagatgggaagttcattcaaaggtgcaatattcaacgagcagacacaggaacatcttgttggatgggcaaaaatggctaaaaggggagtgaagaaaggcgcaacacaagtaggtaccagtcatgatgctactagtccaagaccgtctattcagttgaactccttgctaggaaaaggctcctctcaacaaaatcagaaccccaaggaaaaatcagagattgctcaccatgattaa

SEQ ID NO: 2269 - DNA, 2097 bp, Arabidopsis thaliana
atggaatttgcttcgccggaacaacgtcgtctcgaaaccattcgatctcacatcgatacttctccgaccaacgatcaatcatcatctctattcctcaacgccaccgcttcttctgcttcacctttctttaaagaggatagctacagtgttgtgcttccagaaaagcttgatactggaaaatggaatgtctacagatctaaaagatcgcctacgaaactcgttagtaggttcccggatcatcctgaaatcgggactttacatgacaattttgtacatgctgttgaaacatatgctgaaaacaagtatcttggtacacgagttcggtccgatggaaccattggagagtattcatggatgacatatggagaagcagcgtctgagcgacaagccattggttcaggactcttgtttcatggagttaaccaaggagattgcgttggactctattttattaacagaccagagtggttggttgtggatcatgcttgtgcagcatattcatttgtctctgttcctttatatgatacacttggtccagacgctgttaagtttgtggtgaatcatgctaatctgcaagctatattttgtgtaccacaaaccttgaatattgtaattgctaagcttcctagcggaaatcccatccattcgtctcattgtggggctgatgagcatttgccatcacttcctcgaggaactggagtcacaattgtatcataccaaaagctattgagtcagggtcgaagtagcttacatccattttcgcctccaaagccagaagacattgcaaccatatgctacacaagtggaaccacaggaacaccaaagggtgttgtgttgactcatggaaacttgatcgcgaatgtcgctggttccagtgtggaagcagaattctttccttcagatgtttacatatcatatcttcctttggcgcacatatatgaacgtgcaaatcagattatgggggtgtatggtggtgttgctgtcggtttctatcagggggatgtcttcaagctgatggatgattttgctgtgttaagaccaacaatattctgtagtgtccctcgcttatataatcgaatatatgatggcattacaagtgccgtaaaatcatctggggttgtgaaaaaaaggcttttcgaaattgcctataactcaaagaagcaagcgatcattaatgggcggactccttctgcattttgggacaagctggtgttcaacaaaataaaagaaaagcttggtggacgggttcggtttatggggtctggtgcttctcctttgtcacctgatgtcatggatttcttgagaatatgctttggatgttcggtgcgtgaagggtatggtatgaccgagacttcttgtgtcataagtgctatggatgatggtgacaatttatctggccatgtcggttcccctaatccagcttgcgaggtaaaacttgtggatgttcccgaaatgaattacacatcagacgatcaaccatacccacgtggtgaaatctgtgtaagaggaccaatcatcttcaaaggctactacaaagatgaagaacaaacgagagaaattcttgatggagatggctggctacacacaggagatatcgggttgtggttacctggtggtcggctcaagatcatagacaggaagaagaacatatttaagttggcgcaaggagaatatatagcaccagagaagatcgaaaatgtttataccaaatgtagattcgtttcgcagtgtttcattcacggtgatagcttcaattcctctctagtagctatagtttcagtcgaccccgaagttatgaaagattgggctgcatcagaaggcatcaagtatgagcatctaggacagctctgtaacgatccaagagtgcgaaagactgttcttgctgagatggatgaccttggaagagaagctcagttgagagggtttgagtttgcaaaggctgtgactttggtgccagaaccattcaccttggagaatggacttctcacaccaacattcaagataaagagacctcaagcaaaagcctactttgcagaagcaattagcaaaatgtatgcggaaatcgcagcctcgaaccccattccttctaaactgtga

SEQ ID NO: 2270 - DNA, 1992 bp, Arabidopsis thaliana
atgagtgaagcttttgtagcgagtgatgagggactgacatatgtagaaaatggagaagatgtgttccctgttgaagctgttgcagcagatgtttctcctgttgaagctgttgtaccagatgtttcccccattgaatgcctttctgctgagactttaaccgataagaccagtagccttatagactctgttgaatcgggaaccaatgcgactgttaaaatatctccggatagttcagtctcacttcctgatgcgaaagctagctttgatgacttttcttctgggctcaagcagtccttcagctcttcacttcctgatgcgaaagctagcgttgatgacttttcttctggggtcaaggagtccttcagctcttcacttaaccaaggagaaaatgctgtaaagaacactttggagtccttctcctcgtctgtgacatccattacaaagaatgcttctgaagttgtagatagtgcagttaacagagcgttttctacgctagaccaaacgggagatgtagctggagacaagttttcgagtttttctactggcttgaaggaagcttcaaacagagcagctgttattgccattgatctgctgaggcaatcagttagtcttggagagagatctgtaacaaatggagtttcttttgttgtgtactcttatggatcagcaaaagaattacttcctccagatgtaaagagtgcccttaactcgtcagaagatgttgctctaaaagtattgagtcccgtgggagctgtattgcagcagtatcatgatgaacaggtatctgttgccattggaggtttggagagaaatatcggtttggatccagatgacccaatccttcacctttttctcttcgtaggcaccacaggaaccttttgggttctatatcgggtttggacatatggtggatatgctggagatttgtctcccaagtcaactctggaccttttaaaatcaagagacaagtcagtgctcatagatgtcaggcctgaagccttgagagagaaagatggaatacctgatctgcggagatcagctcgatttcgatattctagcgtgacactgcctgaggttggttttagcatcctcattgttgttgaccacagcgaatatagaaactctacacatgtaatctatgaacacaacgaggtttcagcaatcagtgcaacagaagttgacggtgatgtcaaacggctactgaaaggtggaagtgaagtagatgatatcttgacagcagtaatcatcaagaacttgaaaatagttcaggacaggtccaaggttgttgttatggatgctgatggaactcgttcaaagggtgggtatagatcatgggtacaggaaggtcttcgtgtgaaagagccaaaacctgagacaacacttaccatcctcaacgaggaagctgaggcgatttttgaggacataaatccctctccattgcaactatttggagttgaatatctcatattctccacaacacacaagctcctcacatccacgttttgcactaacatgattgctctatctctcgcagagtgggagaaaacactgcaactcatagctgtcatcggccttagtctgtttcaaacattatgcagactatatacctacgactttcttcatatgatgactccgaagacttcaaacaagacgtcaggtataaaagcgccatcattagaccctttttccatagcaaaaactcagcgaaacctctgttctgtcttaacaaagattgtttcatcttcttcttcaaggctgttgcttgcacctgtgaaactcggagctcaggctttctcgtgggctgcaggaaaactagaaacaaatggtgttggcctcccaacttcgccttcttcttcagatgttcgaagccgggttttgcaagctgctgctaagcatgaatcgaaaccctctgatgaaacttctgaaagtctccaagatgcatcatcgtcaccagaagaagctttgaacaacgttgatgtctccgaagcgtaa

SEQ ID NO: 2271 - DNA, 3192 bp, Arabidopsis thaliana
gctagagcttcgaagcgggaagtttcttcagacgaggcttactcgtcggaggaagaggagcaagttaacgatcaggccaatgtggaagaagatgatgacgagctcgaggccgtcgctcgctctgcgggctctgacgaggaagatgttgcgcccgacgaagcacctgtctctgacgacgaggttgtccccgtagaagatgacgctgaagaggtagaagaagacgaggagaaagctgagatcagcaaacgtgagaaggctagactcaaagaaatgcagaagatgaagaagcagaaaattcagcaaatcttagactcccaaaatgcttccatagatgctgatatggtaactgagttatttgcacattttgctaaaagtgacccgtctccgtcccagaagaagggaaaaggaaggtgtcgccattcttccaaactaaccgaggaagaggaagatgaagagtgtttaaaagaagaagagggtggtatagttggatctggaggcacacggttgctcactcagcccgcttgtattcaggggaagttaagagattaccaattagctggtttaaactggctcattcggctgtatgagaacggcataaatgggattcttgcagatgaaatggtactggggaagacgcttcaaaccatttctttgttggcttacctgcatgagtacaggggaattaatggccctcatatggtagttgctccaaaatcaacccttggtaactggatgaatgaaattcgccgattttgtcctgtcctgcgtgctgtgaaatttctcggtaatcccgaggaaagagtacatattcgtgaagaactgctagttgcagggaaattcgacatttgtgtaacaagctttgagatggctatcaaagagaagacaacattgcgccgttttagctggcgatatataatcattgatgaagcacatcgaattaaaaatgagaattcactcctttcgaaaaccatgagacttttcagcaccaactatcggcttcttatcacgggaaccccccttcaggtaaatctccatgaattgtgggcccttctcaattttcttctccctgaggtttttagttcagcagaaacttttgacgagtggtttcaaatttctggtgaaaacgaccagcaagaagttgttcaacaacttcacaaggtactgcgaccatttcttcttcggaggttaaaatcagatgtagagaaaggcttacctccaaaaaaggagacaatactcaaagttggcatgtctcaaatgcaaaaacagtactacaaggctttactgcagaaggatcttgaagtggttaatggtggtggagaacgcaaacgtctgttgaacatagcaatgcaattgcggaaatgctgcaatcacccttatctcttccagggtgcggagcctggtcccccatatactacaggagatcaccttgtaacaaacgcaggtaagatggttctcttagataaattgctacctaagttgaaggatcgagattcaagggttctgatattttctcaggtaacaaggcttttggatattctcgaggattacctaatgtatcgtggttaccagtactgccgtattgatggaaatactggtggtgacgaacgagatgcttccatagaagcctataacaagccaggaagtgagaaattcgttttcttgttatccactagagctggaggacttggtatcaatcttgctactgcagatgttgtgatcctctatgatagtgactggtaccctcaagttgacttgcaagctcaggatcgtgcacataggattggtcaaaaaaaagaagttcaagtgttccggttctgcaccgaggttgctattgaggctaaagtcattgagagagcttacaagaagttggcacttgatgctctggttattcagcaagggagattggcagaacagaaaagtattaataaggatgagttgcttcaaatggtgagatatggtgctgaaatggtgtttagttctaaagatagcacaattacggatgaggatattgacagaatcattgccaaaggagaagaggcaacggctgaacttgatgccaagatgaagaaatttactgaagatgcaatacagtttaaaatggatgacagtactgacttttatgattttgacgatgacaacaaggtagagagcaaggtggattttaaaaagattgtgagtgaaaattggaatgatccaccaaaaagagagagaaagcgcaagtactctgaagttgaatacttcaagcaaacgttgcgacaaggtgctccagctaaacctaaagagcctagaattccacgcatgccccaattgtgtgattttcagttctttaacattcagaggctgactgagctgtatgaaaaagaagtgcgataccttatggtggcacatcagaaaactcaaatgaaagacacaattgaggttgatgaacctgaaggtcttggagatcccttaactgctgaagaagtggaagaaaaggagctattgctggaagaggcaagccaaaccattcgaccttactgtgggttaagagacttcaatgccttcattagggcttgtgagaagtatggccggaacgacataaagagtattgcctctgagatggaagggaaaactgaggaagaggttgaacgatatgctcaagttttccaagtgcgatataaagagctgaatggttacgacagaatcatcaagaatattgagagaggggaagcaagaatctctaggaaagatgaaatcatgaaagctattgggaagaaactggatcgctacagaaacccgtggctggaactgaagattcaatatggtcagaacaaagggaagctgtacaatgaagagtgcgaccgtttcatggtatgcatggtccataaacttgggtatggaaactgggatgagctaaaggcagcgtttcggacatcccccttgtttaggtttgactggtttgtaaaatcccgcacaactcaggaacttgcaaggagatgtgacacactaatcaggttgattgagaaagagaatcaagaatttgatgagagagagaggcaagcccgaaaagagaagaagctttcaaaggtggcaacgccatcaaaacgaccttcgggtaggcaagcaaatgagagcccttcatctcttctgaagaaacgaaagcagctgtcaatggatgattatgtgagctcggtaaagcgtaggaaataagaa

SEQ ID NO: 2272 - DNA, 2829 bp, Arabidopsis thaliana
atgaagagtaactccaaggtcaacatcaacaacaacggagataatcataatcaaacgaagaataatggtactaatggctttttgcccaattcgttaaaattcatctctacttgcatcagaactgcttcctccggtgttcgctcagctagcgcctccgtcgctgcttccctctcttctgattctcacgagcttaaagatcaggtgttgtggtcttcatttgatagattgcacacaagtgaatcatctttcaagaacgttctattactaggttatacaaacgggtttcaagttcttgatatcgatgattcaaatgatgttaccgaattcgtgtcgaggcgggatgatccggttacatttttacagatgcagccattacctgctaaatgtgatggagttgaagggtttagatcatcacatcctatacttttagctgttgctgatgaagctaaaggttcaggtcctattgttactagtagagatggatctgttagaaatggttatgaggatcctcttgcactctctcccacggttgtgcgattttattcgcttagatcgcataactatgttcatgttttgaggtttagatctactgtttatatggttagatgcagtcctcggattgtcgctgttggcctcggttcgcagatatattgttttgatgcgctaactcttgaaaacaaattcagtgtcctctcgtatcctgtacctcagcttggaaaccaagggatatctggggttaatgttggatatggtccaatggctgtcggggctagatggttagcgtatgcttccaatagtcccttgtcttctagtataggtcgtctgagccctcagaatgttactcctcctggtgtcagtccatctacctcgccaaataatggtaatctggtggcaagatacgctatggaatctagtaagcatttggcagctgggttactcaatttgggtgacaagggttacaaaactatatctaaatactgtcaagatctcaagcatgacggtcctggtccttctctttcgtccagccctggccggaaagttggtcgggtcggttctcattcagctgagtcagatgttgttggaacggtaattgtcaaagattttgagtcccgagctattatagcacaattcagggctcacactagtccaatctctgctctctgtttcgaccctagtggcactttactagtaacagcctcaatccacggtaacaatattaacgttttccggattatgccgacacctacaaagaatggaccgggtgctcaaagctatgattggagctcttcccatgtgcctctttacaaactacatcgtggcatgacatcagctgtgatacaagatatttgctttagtagctacagtcagtggattgcaattgtttcatctaagagcacctgccatatttatgttttatccccgttcgggggagaaaatgttcttgaaatacgaaactctcaattcgatggaccgacgcttgctccaacattatccctgccatggtggtcaagtccgtcgtttatgaccacccatttttcatatccaccaccagcgtcagttactctttctgtggttagccgaatcaaatgcaacaatttcttccatgctgcaagttccgttgtaggaaaacccaccttcccctctggctgtcttgctgctgttttccatcaatctgtgccacaagaatcgcagtcgtcatctcctgccttggactacttactggtttacactccatcaggtcatgtagttcaatacaaactcattccatctcttggaggagaccaggctgagagcaatacgcgaaatggagcaacttctgggctgacctctgaagaggaactgagagtgaaagttgaaccagttcagtgttgggatgtctgtcgaagagcggattggccagagagggaggagaacatatgcgggcttacttatggtggacgaaaaaatgctgagttaactgttgatacttctgatagtgaagatcaaacaaagcctctggagaaacaccatgtttatcttgccaatgcagaggtgctgataaactccggaagaaaaccaatctggcaaaattcagaggtgccatctacgtctctgctgatatctttctatccgatgtatccaccagactctgatggcaagaacctgaattcgcatcaaggtggtggggagacagaaatcgggaaagtatctgcgaacgaggttgacattaggcgaaaggatcttctgccggtatatgataattttcacagtgtgtataccagtatgcgcaacagaggattttctggggaaagagattcagattcttcttcttcttctgaccctggacaagttaaagaaatgcatccattcaatggtatggtttaccccgaagatgaggaaagaagagggagtgcccattttgcactaactccaaaccaaaatcctcataccggaattgtaacatttaaacagcctgtagtttccatttcttctgctgtgaaagacactgattatatagacgacgacgctcatgtcttgccaaagaacgcctccctgcccgctgaaacaaaaattgaaaacagcagtgggataagtggagattcaaatgtaagttctaaccgttctgatatgagcatgaatgcagcagacgagggtgaaggacccattgacggctccccaaacttcgagcagtttttcgaggaggtggtctccaatgaaactgttacagaaactgagcataaggatgctccatctgatggaaaactcgatgatgatgaggacgatgacatgcttggtggtgttttcgctttctccgaagaaggtaagaagaatacatcccatagcctgtaa

SEQ ID NO: 2273 - DNA, 1140 bp, Arabidopsis thaliana
atgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcattggttcctcctctcatgattaaaacacatacacaggcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctag

SEQ ID NO: 2274 - DNA, 1206 bp, Arabidopsis thaliana
gagctcatccctcaagaggacctaatcgtcaaacacgtccttgactctctccgtccttatagcacagaaactggtggtggtcctctggtgatcaatcatgtcgcgtatcattcaggtagaggtaatctcatcgttgagtacccaggatctgttcccggaaagatcttgtctttcgtcggaatgcatatggacgtcgtcactgcgaatcctgatgattgggaatttgatcctttctcgctaagcatagatggtgataagcttcgtggtcgtgggacaacagattgtcttggtcacgttgctcttgtcactgaactcatgaagaaactcgggcaagccaaaccggcgttgaaatcaacggtggtggcggttttcatcgctagcgaagagaactcttccattcctggtgttggtgtggacatgctggtgaaagacaaacttcttgataagctcaaatccggacccttgtattggattgatacagcggataagcagccgtgtgttggaactgggggtatgataccatggaagcttcagtttactggaaagcttttccatagcggtttagctcacaaggcgattaacgcgatggagttagcaatggaagggcttaaggaaatccaagctcggttctacagagactttccgcctcacccacaagaggaagtttatggttttgcaacaccatccaccatgaagccaacacagtggtgttatccagcaggtggaatcaaccaaatccccggagaatgtactgtttcgggtgatgtcaggttgactcctttctatgacgtgaaggaagtgataacgaagttgcaagagtatgttgacgacataaacggtaacatagagaggctcgaaacccgtggtcctgtttcaaaatatgtcttaccagatgagaatttacggggaaggctcacgttaagttttgatgaagcatcagctggagttgcgtgtaatcttgattctcccggctttcacgttctatgcaaagcaaccgaagaagttgttggacacgtgaagccttactcgatcaccggtactttacctctaatccgagacctccaggatgaaggttttgatgtgcaaacttcaggatacggtctcatggctacatatcatgcaaagaacgaatactgccttcttacagacatgtgccaaggctttgatgtcttcatcaggatcatttctcaacttgaacaagtataa

SEQ ID NO: 2275 - DNA, 1266 bp, Arabidopsis thaliana
atggaaaacttccaaggagacttaaccgacgtcgtacgaggaatcggaggccacgtgttatcaccggagactcctccctcgaacatctggcctcttcctctgtcacatccaacaccatcaccgtcagatcttaacataaaccccttcggagatccctttgtgagcatggacgatccactcctccaagaactaaactccatcacaaactccggctatttctccaccgtaggagataacaacaacaacattcacaacaacaatggtttcttggttccaaaggtatttgaggaggatcatataaagagtcaatgtagtatcttcccaagaatccggatctcgcatagtaacatcatccacgattcttctccgtgtaattctccggccatgtcggctcacgttgtcgcagccgcagcagccgcctcgccgagaggcatcatcaacgtagacacaaacagtcctagaaactgtctattggttgatggtaccacgttctcctcgcagattcagatatcttcccctcggaatctaggccttaaaagaaggaagagtcaggcaaagaaggtggtgtgtattccggccccggctgcaatgaacagccgatcaagcggagaagtggttccatcggatctatgggcttggcgtaaatacggtcaaaaacctatcaaaggctctccttttccaaggggttattatagatgcagcagctcaaaaggttgttcagcaagaaagcaagtcgaaagaagccgaaccgatccaaacatgttggtgattacatatacctccgaacataaccatccttggcccatccaacgcaacgctctcgccggctccacacgctcctccacctcctcctcatctaaccctaatccttccaaaccctcaaccgcaaacgtaaactcctcatccattggctcccaaaacaccatctacttgccttcctccaccactcctcctcctaccctctcatcctccgccatcaaagatgaacgaggggacgatatggagttggaaaacgtagatgatgatgatgataaccagattgctccatacagaccggagcttcatgatcatcagcaccaaccagatgatttctttgcagatcttgaagagctagaaggagattctctaagcatgttgctttctcatggctgtggcggcgacgggaaggataaaacgaccgcgtccgatgggatcagcaatttcttcgggtggtcgggagataataattataataattacgacgaccaagactcaaggtcgttatag

SEQ ID NO: 2276 - DNA, 1302 bp, Arabidopsis thaliana
atgggatccttagttcatgtgaaagaagccacagttattactccttccgaccaaacaccttcttctgttctgtctctctccgctttagattctcagcttttcctccgattcaccattgaatacctcctcgtttacccacccgtttccgacccggagtattctctctccggtcgtctcaaatccgctctctctcgcgctctcgttccttacttccctttctccggccgcgtccgagaaaaacccgacggcggcggaggtctcgaggtcaattgccgtggccaaggtgctctgtttcttgaagccgtctctgacatcctcacgtgccttgactttcagaaacctccccggcacgtgactagctggagaaagcttctttcgctccacgtcatcgatgtcctcgctggtgctccacctctcgtcgttcagctcacttggctccgtgacggtggtgctgctttagccgtcggtgttaaccactgcgtctccgatggaatcggtagcgccgagtttctcactttattcgccgagttatctaaagactcactgagtcaaaccgagttaaaacggaaacatctctgggatcgtcaattgcttatgccgtctccgattcgtgactcgttgagtcatcccgagttcaaccgtgttcccgatctatgcggattcgttaaccgattcaacgccgagcgactcgttcctacatcggttgtcttcgagagacagaaacttaacgagctaaagaaactcgcgagtcgactcggtgagttcaattctaaacacacatcgttcgaggtactctctgcacatgtatggcggagctgggcgagatcactgaacttgccatcgaatcaggtccttaagcttttgtttagcgtcaacattagagaccgagtcaaaccgagtctacccagtgggttctacgggaacgcattcgtcgtcggatgtgctcaaaccaccgtgaaagacttgacggagaaaggattaagctacgcgacgatgctcgtgaaacaagcgaaggagcgagtcggtgacgagtacgtcagatcggtggtggaagctgtgagcaaggagagagcgagtcctgactcggttggagtcttgatattgtcgcaatggtcacgtctcggtttagagaagcttgattttggtttgggtaaaccggttcatgttggatcggtctgttgcgaccgttactgtttgttgcttccgattcctgaacaaaatgacgccgttaaagtaatggtcgccgttccgtcaagctctgttgacacgtacgagaatcttgtgacgagtcctaacgcttag

SEQ ID NO: 2277 - DNA, 975 bp, Arabidopsis thaliana
atggatccagtacaatctcatggatcacaaagctctctacctcctcctttccacgcaagagactttcaattacatcttcaacaacagcaacaagagttcttcctccaccatcaccagcaacaaagaaaccaaaccgatggtgaccaacaaggaggatcaggaggaaaccgacaaatcaagatggatcgtgaagagacaagcgacaacatagacaacatagctaacaacagcggtagtgaaggtaaagacatagatatacacggtggttcaggagaaggaggtggtggctccggaggagatcatcagatgacaagaagaccaagaggaagaccagcgggatccaagaacaaaccaaaaccaccgattatcatcacacgggacagcgcaaacgcgcttagaacccacgtgatggagatcggagatggctgcgacttagtcgaaagcgttgccacttttgcacgaagacgccaacgcggcgtttgcgttatgagcggtactggaaatgttactaacgtcactatacgtcagcctggatctcatccttctcctggctcggtagttagtcttcacggaaggttcgagattctatctctctcaggatcttttctccctcctccggctcctcctacagccaccggattgagtgtttacctcgctggaggacaaggacaggtggttggaggaagcgtagttggtccgttgttatgtgctggtcctgtcgttgtcatggctgcgtcttttagcaatgcggcgtacgaaaggttgcctttagaggaagatgagatgcagacgccggttcatggcggaggaggaggaggatcattggagtcgccgccaatgatgggacaacaactgcaacatcagcaacaagctatgtcaggtcatcaagggttaccacctaatcttcttggttcggttcagttgcagcagcaacatgatcagtcttattggtcaacgggacgaccaccgtattga

SEQ ID NO: 2278 - DNA, 1494 bp, Arabidopsis thaliana
atggaaaccaaaaccctaattttctcaattctcttcgttgttctctctctcatttacttaattggaaaactcaagcgaaagccaaatctacctccgagtccggcatggtcattaccggtgattggtcatctccgccttctcaaaccaccgattcatcgcacattcctctccctctctcaatccctaaacaatgctccgatcttctccctccgactcggtaaccgactcgttttcgtgaactcgtcacactcgatcgccgaggaatgtttcaccaaaaacgacgtcgtactggcgaacagaccaaacttcatcctcgctaaacacgttgcgtacgattacacaaccatgatcgcagcttcctacggtgaccactggcgtaacctccgccgcatcggctccgtcgagatattctccaatcaccgtctcaatagctttttgtctattcgtaaagacgagatccgacgacttgtgtttcgtctttctcggaacttttcacaagagtttgtgaaagtggatatgaaatcaatgttatctgacttaacattcaacaacattttaagaatggtggccggaaaacgttactacggagacggtgttgaggatgatccggaggctaaacgtgtccggcagcttatagcggatgtggtggcttgtgctggtgctggaaacgctgttgattacttaccggttttgcggttggtttcagattacgagacacgggttaagaagttggcgggtaggctcgacgagttcttgcaaggattggttgatgagaaacgagaagctaaggagaaaggaaacactatgatcgatcacttgcttactctgcaagaatcccaaccggattacttcacggatcgtatcattaaaggaaacatgctcgctttgatactagcagggaccgacacatcagcggttacgttagaatgggcattgtcgaacgtgttgaaccatccggatgtattgaacaaggcgagagatgaaatcgatagaaagataggtttagacaggcttatggatgaatcagatatctcaaacctgccttatctccaaaacattgtgtctgaaacgttgcgcctttatcctgcggctcccatgcttcttcctcacgttgcctcggaagattgtaaagttgcaggatacgatatgccgcgtggcacgatactattgaccaatgtgtgggctatacacagagatcctcagctatgggatgatccaatgagcttcaagccagagaggtttgagaaagaaggagaagctcagaagctaatgccgtttgggttaggaagaagggcgtgtcctggttctggactggctcatcggcttataaacctgactcttggatcattgattcagtgtttggaatgggagaagattggagaagaagtggatatgagtgaaggcaaaggtgttacaatgcctaaagccaagcctttggaagccatgtgcagagcacgtccctctgttgttaaaatcttcaacgagtccgtttga

SEQ ID NO: 2279 - DNA, 1545 bp, Arabidopsis thaliana
atgtcggaaaaggaagaagctccgtcgacatcgaagtccaccggagctccgtcgcgtccgactttatctcttcctccacggccgtttagtgagatgttctttaacggtggcgttggattcagtcctggtccgatgactctggtctctaatatgttccctgattccgatgagtttaggtctttctctcagcttctcgctggagccatgtcttctccagcgactgcagctgctgctgctgctgctgcgacggctagtgattaccagagacttggtgaagggactaatagctctagtggtgatgttgacccgagattcaagcaaaacagaccaaccggtttgatgatttctcaatctcaatcgccgtcgatgttcaccgtaccgcctggtttaagtccagctatgttgctcgattcaccaagctttttgggtcttttctctcccgttcagggatcatatggaatgacacatcagcaagctctagctcaagtcactgctcaagcagttcaagccaatgccaatatgcaaccacaaacagagtaccctcctccctctcaagttcaatcattttcatcgggtcaagcgcagatcccgacctcggctccactaccagctcaaagagaaacctcagatgtaaccatcatagagcacaggtcacaacagcctctaaatgttgacaaaccagctgatgatggctataactggcgaaaatatgggcaaaagcaagttaaaggtagcgagtttccacgaagctattacaagtgtactaatccaggatgtcctgtcaagaagaaggttgagagatctcttgatggacaagtaacggagattatctacaaaggtcagcacaatcatgaacctcctcaaaacactaagcgaggtaacaaagataacaccgcgaatataaatgggagttcgataaataacaatcgcgggagttctgaattgggggcatcacagtttcaaactaatagctccaacaagactaagagagagcaacatgaagcagtaagtcaagctacgacaacagagcacttgtctgaggcaagtgacggtgaagaagttggtaatggagaaactgatgtgagagagaaagatgagaatgagcctgatcccaagagaagaagtacagaagttcggatttcagaaccagctcctgctgcttcacatagaactgtgacagagcctagaattattgtccaaacgacgagtgaagttgatcttctagatgatggatataggtggcgtaaatatggacagaaagttgtcaaagggaatccttatccgaggagctactacaagtgcacaacaccaggatgtggtgtgaggaaacatgtagagagagcagcaacagatccaaaagctgtagtaacaacatatgaaggaaaacataaccatgaccttcccgctgctaaatcaagcagccatgccgctgcagcggcacagttaaggccagataatcgacctggcggtttggctaacttaaatcaacagcagcagcaacagcccgttgcgcggctaaggcttaaagaagagcaaacaacttga

SEQ ID NO: 2280 - DNA, 1911 bp, Arabidopsis thaliana
atgaagagcagagtcattcttaaccatagagacagaagagataagaatcataacaacaacaacaccaatcattacacacaggttgatactatggagagaaagcctcttgaggttgagccatctactacgacgactaacaccgatgtggtcgattctttcgaggaagagcagagaaaaatcgtttatagaggatggaaagtcatgccttttatcattggtaatgagacatttgagaagcttgggatcatagggacattatcaaaccttcttgtgtacctaacttctgtattcaaccttaagagctacacagctgcaactatcatcaatgcctttagtggtacaatcaatttcgggacttttattgctgcctttctttgcgacacttactttggtcgctacaagactctcagtgtcgctgtcatcgcttgttttctgggatcgtttgtgatactacttactgctgcaattccgtcgttgcaccccgttgcttgcggaaacaaaatctcgtgcgaagggccaagtgtgggacagatactgtttctgctcatgggtttaggctttcttgtggtaggcgctggtggtatcagaccgtgtaatttagcgtttggtgctgatcagttcaaccccaaatccgaatcaggaaagaaagggatcaacagtttcttcaactggtatttcttcactttcacgttcgcgcagatcatctcgctcacagcagttgtgtatatccagtcaaatgtgagttggacaatcggtttgatcattccggtggctcttatgttcttggcgtgtgtgattttctttgctggcgatagattgtatgtaaaagtgaaagcctcgggtagtccattggctggtattgctcgtgttatagcagccgcgatcaagaaacgaggtttgaagccggttaagcagccttgggtcaatctttacaaccatatcccgtctaactatgcaaatactactctaaaatacaccgaccagttcagatttctagacaaagcagcaattatgacccccgaggagaagttgaactccgatggaacggcttccgatccatggaaactatgcacgttgcagcaagtggaagaagtgaaatgcattgtaagagtgattccaatctggtttgcatccacgatatactaccttgcaataactatacaaatgacttatccggtcttccaagcgctccagagcgaccgacgattaggttctggtggcttcaggattcctgcggccacctatgtagtgttcttgatgactggcatgacagttttcatcatattctacgaccgtgtacttgtcccgtcgctcagaagagtgaccgggttagaaaccggtatatcactcttacaaagaatcggagctgggtttacatttgcgataatgagtttattagtttccgggtttatagaggaaaggagaagaaactttgcattgaccaaaccgacactcgggatggcgcctcggacaggagaaatctcatcaatgtcagcgttgtggctgattccgcagcttacacttgcaggcatagcagaagcttttgctgccattggacaaatggagttttactacaagcagtttcctgaaaacatgaagagcttcgcgggttctatcttttatgtcggtgcaggggtttcgagctacctcgctagcttcttgatatcaactgttcatcgaacaaccgcgcattcaccttcagggaattggttagctgaggatctgaacaaagcgaaattggattacttctacttcatgctcacaggactcatggttgttaacatggcttacttcttgttgatggctagatggtatagatacaaaggaggtaatgatgaagacatcactgagattgagaccaatgaagaagaaaccaagcaacagcagctacaagacaagaactctgtctga

SEQ ID NO: 2281 - DNA, 1293 bp, Arabidopsis thaliana
atggcgtttgtattaatgaataacacaaacgcgtttcttgtaacgctactattactatccctttcttacattccattgtctttttccacaatccaacaagacttcgtgatgtgtctagtcgacaactccgacgcttcctttccaatggactcatcgttcttcactcacgacctaaacgcctcttcctttaaactcgccttagagacgtcagctcaaaatctccgttacttgatgccttcaaatcctaagccagagttcattttcgagccgctttacgaaacgcacgttcaggccgccgttctttgcgccaagaagctgaagcttcacttgcggttaagaagcggtggtcatgactacgaaggcctctcttacgtctcggagatggaaacggcgtttgtgatcgtcgacttgtccaagcttagacagatcagtgttgatatagaaagtaacagcgcgtgggttcacgctggtgcttctattggagaggtttattacaggatccaagagaaaagcaaaatccacggttttccggcgggtttatgcaccagcctaggcatcggcggtcacataatcggcggagcctatggttcaatgatgcgtaagtttggtctcggagctgataacgtcctcgatgctaggatcgttgacgctgacggcaaaatcttgaatcgcgcggcgatgggagaagacgttttctgggcgattcgaggaggtggaggaggaagcttcggcgtaatacttgcctggaaaataaagctcgttccggtgccagagattgttacggtgtttaccgtcacgaggacgcttgagcaagacggaactaagcttttgtacaagtggcaacaagtcgctgataagctcgacgaagatctctttatccgtgtgattattcagccgacgagcaaaactccgaagagcaaagaaagaactatctcgacttcgtaccaaggccaatttctcggcgacgctaatcgtttgttgcaggtgatgcaaaggagtttcccacagcttggactaacgaagaaagattgtttagagacaagctggatcaaatcggtgatgtacattgcaggttttccaagcactgccccatcagaagctttactcgatgggaaatcgttgttcaagaattacttcaaagccaagtcagactatgtggaagagccaattccagtagagggattagaagggttgtgggagaagcttctagaagaggactcaccattgactatatggaatccttatggaggaatgatggcaaaaattcccgagacagagacacctttcccacat

SEQ ID NO: 2282 - DNA, 339 bp, Arabidopsis thaliana
atgcaggtaagagcagcaaagaagcaaactttcaactcttttgatgatttgttgcagaactctgataaacctgtacttgtagacttctatgctacttggtgtggtccatgtcagcttatggtacctatactcaatgaagtgagtgaaacactgaaagatataattgcagttgtgaaaattgatactgagaagtacccaagtcttgctaacaaataccagattgaggctttgcccacattcatcttattcaaagacggcaaactctgggaccgtttcgtaagttttctatcacgcatgaatacggcatatctactccttgcatcaaaggctcaattgtag

SEQ ID NO: 2283 - DNA, 1143 bp, Arabidopsis thaliana
atggaggaagtaaagaagagggattgtatggagaaggcaaggccattcatttcaatggtagtgttgcaagtagggctagcaggaatggatattctctcaaaggctgttctaaacaaaggcatgagcaattacgtccttgttgtttaccgtcacgccgttgcaaccatcgttatggccccgttcgccttctatttcgacaagaaggtgagaccgaagatgacactgatgatattcttcaagatatcactccttggtttactcgagccagtgatcgaccagaacttatactatctcgggatgaaatatacgacagctacatttgcaaccgccatgtacaacgtcctacccgcaatcactttcgtccttgcctatatatttggcctcgaaagagtaaagctacggtgcattaggagcacgggtaaggtggttggaacattggctactgttggaggagccatgatcatgacacttgtcaaaggcccagttctcgatctgttttggaccaaaggagtctctgcacataacacagctgggaccgacattcatagcgccatcaaaggcgcagtattggtcacgattggttgttttagctatgcatgtttcatgattctccaagcgataacattaaggacttaccctgctgagctctctctcacagcatggatatgtcttatggggacaatagaaggaaccgccgtggcattagtgatggagaaaggaaatcccagcgcatgggccattggttgggacactaaacttcttacagccacctatagtgggatagtgtgctcagcattggcttactacgttggaggagtggtgatgaaaaccagaggtcctgtgtttgtgacagctttcagtcctctttgtatgatcatagtagcgattatgtcgaccatcatctttgctgagcaaatgtaccttggaagggttcttggtgctgtagttatatgtgcaggattataccttgtgatatggggcaaaggaaaagattacaaatataattccacgctgcaattagatgacgaatcagcacaaccaaagctagaactaagcggaaacgggaaggataatgttgatcatgaagtcattactataagcaagcaaggagaacaaagaagaacagctgtagaaacagtctaa

SEQ ID NO: 2284 - DNA, 309 bp, Arabidopsis thaliana
atggctttcaatgctgttgctatagtgatccaagattttgatgccgttgcaaataagggattcttccatggttactccttcatcacattactcatgattcttaaccatgctctcagtggcattgctgtgtcgatggtgatgaaatatgcagacaatatcgtgaaggtttattcgacatcagtggcgatgcttctcaccgcagttgtctctgtattcctcttcaattttcatctttccttagccttcttcttgggttcaacggtcgtctctgtttcagtatatttacattccgcagggaagctacgatag

SEQ ID NO: 2285 - DNA, 1131 bp, Arabidopsis thaliana
atggctacgctcttcaccgtcgctcgtccttcttcactcctctatgtttcctccataaatccaagcaagaccttctctccttctatctccctaaaacttaactctctctctttctcttttggttatcgtcccaagccactccggttttctaaaatccgatcttctctgccctcggaatctgaatcggaatccgacctagatgcgtctgcagttacagatgaatggggtgagaaacctggagatgcaaatgagcccgactctcagccagataatgtgaccgtgaatgtgattacggacgaatggggcgagaaatccggacccgaacttgaggaatccgggacccggtttatggaatcggatcctccaaggaacgaagacgagtggggaggagaaattggaggagaaactgaagccgacgctggaaatggaagtgcggtgtctgacccgacttgggagctgaaaaggtgtttggcggattcggtgtacggaactgaattaggtttcaaagctgggtcagaagtccgagcggaggttttggagcttgtgaatcaactggaagctctgaatcctactccggctccgttagagaatccagaacttctcgacggcaactgggttttgctgtacactgctttctctgagttgattcctctactagctgcgggttcgacacctttgttgaaagttaaaagcataagtcagtcaatagacacaaacaatctcattatcgacaactccactacactctccagcccttttgcagacttctccttcagtgctactgcttcatttgaagttcgaagcccttcaagaattgaggtttctttcaaagaaggcacgctaaaacccccggtgatcaaatcaagtgtagatctcccagagagtgtgggcgtctttgggcagcagattagcctttcgttgttaaagcagtctttgaaccccttacaagatgtggcagcaaacatttcacgggcactctctggtcagccacctctcaagcttccgtttccaggaaaccgaggcagctcttggctcttgaccacttatctcgacaaggatctcaggatttctagaggagatggtggccttttcgtgcttgccagagaaggaagctctctgcttgagctctga

SEQ ID NO: 2286 - DNA, 3129 bp, Arabidopsis thaliana
atgttggacaaatactctcagaagcacgacatcgatggcttcgtcctcctgaaatctgtgaaattttacagaattaccaaagatttcaaatttctactgagccacctactacaccatcaagtacagctaaagtttttcataaacattcagtgtagaatggaacttaaaagttctaagactgatgttcatggtgggtctgtttttatgtttgatcgaaaggtgctcagatacttcaggaaagacggtcacaattggaggaagaaaaaagatggaaagactgtgaaggaagctcatgagaggttgaaggcgggaagcgttgatgttctacattgttactatgcgcatggacaggacaatgaaaactttcaaagacgcagttactggttgcttcaggaagaactttcccacatagtttttgttcactacctcgaagttaagggtagtagagtttctacttcttttaaccggatgcaaaggactgaagacgcggctcggtctcctcaagaaactggggacgccttgaccagtgaacatgatggttatgcttcttgcagcttcaatcaaaatgatcatagcaatcattcacaaactactgactcagcaagtgtcaatggttttcactctccagaacttgaagatgctgaatcagcatacaatcagcatggaagttccacagcttactctcatcaagaacttcagcagcctgcaacaggaggaaaccttactggttttgatccttactatcaaatctctttgacgcccagggatagttatcaaaaagagcttcgcacaatccccgtaactgattcttcaattatggtagacaaaagcaaaactatcaacagtcctggagtaacaaatgggttaaaaaacagaaaatccattgattcccaaacctgggaagagattctgggaaattgtggttctggagttgaagccttacctttgcagcctaacagtgagcatgaagtgctggaccaaatactcgaaagctcttttacaatgcaagattttgctagtctacaagagtccatggtcaaaagccagaatcaggagttaaattcaggacttacatctgatcgtaccgtgtggttccaaggacaagatatggagctaaatgctataagcaatctagcttcgaatgaaaaagctccatatctatctacgatgaaacaacatctgttacacggtgcattgggcgaagaaggtctgaaaaagatggacagtttcaatcgctggatgagcaaagaacttggagatgttggtgttatagctgatgcaaacgagtcctttactcaatcaagttcaagaacctactgggaagaagttgagagtgaggatgggtccaatggtcacaactctaggagggacatggatggatatgttatgagtccttccctctcaaaggaacagctctttagcatcaatgacttctctccaagctgggcttatgtgggttgtgaagtggtggtttttgtcactggaaaattcttaaagactcgggaggagactgaaattggcgagtggtcttgcatgtttgggcaaacagaagttccagcagatgttatatctaatggtattctccaatgtgttgctcctatgcatgaggctggaagagttcccttttatgtaacatgttccaacagattggcatgcagtgaagtgcgtgaattcgagtataaggttgccgagtctcaagtttttgatagagaagcagatgatgagtctactattgacattcttgaggcaagatttgttaaactgttgtgctcgaaatctgaaaatacaagccctgtttctgggaatgacagtgatttgtcacaattgagcgagaagattagtttactacttttcgagaacgatgaccagttggatcagatgctcatgaatgaaatctcccaagaaaatatgaaaaacaaccttttgcaggaatttctgaaagaaagcttacactcatggcttttacaaaagatagcagaaggtggaaaaggtccaagtgttttggatgaaggtggccaaggtgtattacattttgcagcttctcttggttacaactgggccttagaaccaacaataatcgctggtgtaagcgttgattttcgcgatgtaaatggttggaccgcacttcattgggcagctttctttggcagggagaggataattggttcactcatagctcttggtgctgctcctggaactttaactgacccaaatccagatttcccatcaggaagcacaccttctgatctagcctatgctaatggtcacaaaggaattgctggttatctctcagaatatgccttaagagctcatgtttctttgctcagtctaaatgataaaaatgccgaaactgttgagatggctcctagcccatccagctcatcattgacagactcgttgacagctgtacgtaacgctactcaggcagcagctcggattcatcaggttttcagggctcagtctttccagaagaagcaactaaaagaatttggagataaaaagcttggaatgtcggaggagcgtgctctttcgatgcttgctcctaaaacacacaaatcaggaagggcacatagtgatgattccgtgcaagccgctgctattcggattcagaacaagttccgaggttacaagggaagaaaagactatttgattaccagacaaagaatcatcaaaatacaggctcatgtgagaggttatcagtttaggaaaaactacagaaagataatttggtcagtgggggtattagagaaggtgatattacgttggagacggaaaggagctggtttgcgcgggtttaagtcagaagcacttgttgagaagatgcaagacggaacagagaaagaagaagatgatgattttttcaaacaaggaagaaagcaaacagaggataggctacaaaaagctcttgcaagagtgaaatccatggttcaatatcctgaagctagagatcaataccgtagattgctaaatgttgtcaacgacatccaagaaagcaaggttgaaaaagctcttgaaaattcagaagcaacttgttttgatgatgatgatgatctgatagatattgaagcattgttggaagatgatgacacattgatgttgcctatgtcctcatctttgtggaccagttaa

SEQ ID NO: 2287 - DNA, 747 bp, Arabidopsis thaliana
atgagagaagataatccaaattggttccttagatgggaagaagagcttccatctccagaagaactcatccctatctctcaaaccttaatcactcctcatctagctctcgctttccaaatcggaagtcctaatcatcatctcggatcaaagagaaccaccgcgatttatcaccagaagcttcaatcctccaccactccaacaactccaactccaactcctccaccgatgatgatgaattctgatttcggcggtggcgattccacggatcttggttcaggatcaataggaggagagccagcaagaacgttgaaacggccgcgtctagtgtggacgcctcagctacacaaacgtttcgtggatgcggttggacacttagggatcaaaaacgcagttccaaagactataatgcagcttatgagcgttgaaggattgactagagagaacgttgcgagtcatcttcagaaatatcgtctttaccttaggagaatgcaaggcgggaacggtaacggaatcactggaggacacgtcatcgtctctgattcggctactgatcggctatttgctagctcaccggttccagctcatttcttgagcccggattacttgatgccgccattagagcattcgtatatggggaaacatgtgattacgcagcaaaaccaagtggttcgtaatctgaggtatgaagattcggaatatggtcatggtagtatgaagatgcttaagctcttccctgccggaaattaa

SEQ ID NO: 2288 - DNA, 627 bp, Arabidopsis thaliana
atggatcaaaacgtaccaataagcaagaagctatggaacatcgtacgttttctcttgtacatgatccgcaaaggcgtctcaaaaaacaaactcatcgctgacttcaacgccactctcaaacgtggcaagaacctcatgttccaccaacgtcgtcgtgtccacgccggttccaccgcctcagccgctctaaacgctacttcagccaccgcgtcatcgcgacaagagtacgagtttagctgcagcaacactccaaactattcattccctttctctaatatggctttcatgaggaaaaagagtcacaataatctcttcacgtgtggtcaaacgcctcagacgcttgacgacgacgtagccgccgctagagccgttcttgagcttcttaacggcgttggagagaaaggaaacgtcacgccggcagatttaacggtggctttgtctccttatttccccggttttggacagactccattggttagaccgttaagagtaacggactcaccgtttccgttaacgccggaaaatggtgatgtggctaatggacacgttgacaaagcagctgatgattttataaagaagttttataagaacttgaatcagcagaaaaaaatgattgagttcagctaa

SEQ ID NO: 2289 - DNA, 714 bp, Arabidopsis thaliana
atggcttcacttacttcaatagccacgccttacccatcttcatcgcaggctttgcgtctgaaatcctccggaaacactcttttctctgccggagttcgatcggcagcaatggtttccggtcacaaaacgcttaagattcaatgcacttcaaccaaacctgccaaacctgcaggtatacaacttgtagagcgagagcgatcttgtggtttagctgaagtcgattggagacagaagagagagcttctattggagaaaagggtgagaagtgtggacgtgaaggaagctcaacggttacaaaaagaaaacaactttgtgattcttgatgtaagaccagaggcagagtacaaggcgggtcatcctccgggagctatcaatgtggagatgtacagactcataagggaatggacggcatgggacatagctcgccgtcttggctttgctttctttggtatcttctctggcacagaagagaaccctgagtttattcaaagtgtagaagctaaacttgacaaagaggcaaagatcatagtagcttgttcatccgcgggtacaatgaagccgacacaaaatcttcccgaaggccaacaatcgaggtctctcatagctgcttatcttctggtccttaacggctataagaacgtatttcacctagaaggtggaatctacacatggggcaaggaaggtcttcctgttgaaacaattgaagaagactaa

SEQ ID NO: 2290 - DNA, 1191 bp, Arabidopsis thaliana
atggcttcggttactttctctgtccccaagggtttcactgaattctcaggattgcgaagctcctctgcttctcttcccttcggcaagaaactttcttccgatgagttcgtttccatcgtctccttccagacttctgcaatgggaagcagtggtggatacaggaaaggtgtgactgaggccaagcttaaggtggccattaatggattcggtaggatcgggaggaacttcctgagatgttggcatggtcgcaaggactctcctcttgatatcattgccattaatgacactggtggcgtcaagcaggcttcgcatttacttaaatacgactctactctcggaatctttgatgctgatgtcaaaccttctggagagactgcaatctctgttgatggaaagatcatccaagttgtctctaaccgaaacccgtctcttctcccttggaaggagctaggaattgacattgtcatcgaaggaaccggagtgtttgtggatagagaaggtgcagggaaacacattgaagctggtgccaagaaggttatcattactgctccaggcaaaggagatattccaacttatgtcgttggtgtcaatgcagatgcttacagtcatgatgaacctatcatcagcaatgcatcttgcactaccaactgtcttgctccctttgtcaaagttcttgaccagaaattcggtatcataaagggtacaatgacgactactcactcttacaccggtgaccagaggttgctagacgcgagtcaccgtgatctaaggagagcaagagcagctgctttgaacattgttcctacttctacaggagcagctaaagctgtggctcttgtgctccctaacctcaaaggaaaactcaacgggatcgctctccgtgtaccaacaccaaacgtatcagtggttgatctcgttgtgcaggtctcaaagaagacatttgctgaggaagtcaacgctgctttcagagattctgcagagaaagagcttaaaggtatactcgatgtctgcgatgagccactagtgtccgttgatttcagatgctcagatttttcaacgaccattgattcatcactcactatggttatgggagatgatatggttaaggtgattgcttggtatgataatgaatggggttactcacagagagttgttgacttggctgacattgttgccaacaactggaagtga

SEQ ID NO: 2291 - DNA, 639 bp, Arabidopsis thaliana
atggcgctcgcgctctcgctgtcggcatgttctcctccactccgccgcactcgtcgtgccggttttcgaacaagctgctcgatcttcgcgaatccagcacagcgagccaagaggaagctgcttgagctgatctccgaggaggatcgaggtctgagaacccagaaagaccccaagaagcgagatgaaatcgtgaacgccatcgaatccatgacggttatcgggcgcagctccatcaccacagacgactctctatctgccacgtggcggctcttgtggacgacggagaaggaacagttgttcatcatagaaaaggcaggcttgtttgggacgaccgccggagacgttttgcaggtgatcgatgtgaataaacggatcctcaataacgtcatcactttcccgccggacggggttttcttcgtacgctccgatatcgatatcgcttccccgcagagagtcaatttcagattcaatagtgcggtattgagagggaagaactgggagctcccactgccaccatttgggaagggctggtttgagaatgtgtatatggacggtgagatcagagtggccaaggacatcagaggagactacttaattgttgatcgtgctccttataactggactgaatcatttgtataa

SEQ ID NO: 2292 - DNA, 3948 bp, Arabidopsis thaliana
atgatttcgatttcgattccaatggtgagattctgtctctgtttcgcgttcgtcatcctcgtatctgcaaatccgaaattaatcaattcgtgggatgagactgcgattagattcgaaccactgtcaccttctccggcgccggagccttccccggatgatgatgattcgtcggtttcatgtgtagatgacctaggaggtgttggctctttagattccacgtgtaagctcgtcgctgatttgaatctcacacgtgacctaaacatcaccggtaaaggtaatctccacgttttgcctggtgttagattggtttgccagtttccgggatgttcgattagtgtcaatatctccggcaatttctcattggctgagaattcttcggttatcgccgggactttccgtctcgcggcggaaaacgctgaatttgggctaagctcggccgttgataccactggattggctggagaacctccgccggatactagcggtacgccggagggagtggaaggtgccggtggtggatacggtggaagaggtgcatgttgtttgtcggatactactacgaagattccggaagatgtgttcggtggtgatgtttatggttggtcgtctttggagaagccggagatttatggcagtagaggtggttcgacgagtaatgaggttgattacggtggaggtggcggcggaacggtggcgatagagatattagggtatattagtttaaacggcagcgttttagctgatggggccagtggtggtgttaaaggtggtggaaatggtcgtttaagtgcatctggaggtgatgggtatgctggtggaggtggtggacgggtatccgtcgatatatacagccgccattctgatccaaaaatctttttcaatggaggtcgtagttttggttgtccagaaaatgctggagctgctgggactctgtatgatgttatttcagagagcttaaccattgacaaccacaataagacaacatatacagacactcttctcctggagttccctaaccaccgccttttcactaatttgtatatccggaatatggcaaaggttgctgttcccttgcgttggagccgtgttcaggttcaaggattgataagtttgtcaaatggtggagagttgaactttggtcttccacgttatgcttcctctgaatttgaattatttgctgaggaactcttgatgagtaattctgcaatcaaggtttacggggctttacgtatgacagtcaaggtgttcttgatgttgaagtcaagaatgtttatagatggcggtggtgtgacaatattgggaacttcaatgcttgaaattagtaatctgttggtgctcaaggagtcatctgtgatacaatccaatggaaacctcggagtacatgggcagggcctgttgaatctaacaggcacaggagatacaattgaagcacagcgtctgattttgtctctattttatagcatccagatctgccgagttgaggatattactgttgaaggtctcattaaaggatctgtaatccaattccatctggcaagaacggtacttgtccgctcttctggaacaatatccgcggacgggatgggctgcaaaggtggagttgggacaggtaggtttctgagaagcggtattgggagtggtggtggacatggtggtaaaggcggaagcggatgttacaatcatacttgcattgagggtggcgagtcttatggaaatgcagacctaccatgtgaacttggcagcggaagtggaaatgaagagtcaacggattcagttgctgggggaggaatcattgtgcttggttcacttgagcacccactttcaagcttgtcactggaaggctcaataacaactgatggcgaaagtcccaggaagacgctgaaaggcctaagtaattcaagtctaggacctggtggtggttcaggtggaaccgtacttttattcttgcgcacacttgagatagggaggtctgcgattctctctagtattggaggaaatggtagcctgaagggaggtggaggaggaagtggtggaaggattcattttcattggtcagacattcccactggtgatgtctatcatcccgttgccatagttaagggaagagtttatgtaagaggagggatgggtatcattgaagataatattggagggaatggaactttgactggcaaagcttgtccagaagggctctatggtttattttgcgaggaatgtccatctggcacttataagaacgttactggatctgataaagctctttgtcatctttgtccggctaatgatattccccatcgtgctgtatatgtcactgttcgaggtggtgttgcagaaacgccttgtccatataaatgcatttcggatagataccacatgccacactgttatactacgcttgaagagttaatatacacatttggtggaccctggctgtttggtgttcttttagtagttgtgctcctcctactagcacttgttttcagcgtcgccagaatgaaatttgtgagcggtgacgaattgcatgggtctgccccgacccagcatggctctcagattgatcactcatttccattcctcgagtcgttgaatgaggtgatggagacgagcagagtggaggagtcacagggccacatgcataggatctatttcttaggtcctaatactttcagtgaaccttggcatctttctcatacacccccagaggaaataaaagagattgtgtacgaggctgcgtttaatgggtttgttgatgaagtcaatgttatagctgcatatcagtggtgggagggtgcgatttacattatgctttcagttctagtctatcctcttgcatggtcatggcagcaatcacgccggaggctgaaatttcagaaactccgtgactttgttagatcagaatatgaccattcttgtctacgctcgtgtcgttcaagggcattatatgaagggctaaaggtagctgctactcctgatttgatgttagctcatctagatttcttccttggtggcgatgaaaagagaagcgatcttcctcctcaggttcatcaaagacttccaatgcctttaatatttggaggcgacggaagttacatggcctattactcactccaaagtgacgatattctgaccagtcttctgagccagttggtcccaccaaccacttggtaccgctttgtcgctggtctgaacgctcagctacgtctggttcagcaagggaaactgaggtccacgtttcgctctgttatgagatggattgaaactcatggaaaccctgctttgaaaagacatggtgtacgtgttgacctagctaggtttcaggcattgtcttcgtcgtcttgccagtatggaatccttgttcacaccattgcagatgaagtcgcatcaacaagaagtgatgatgaaacagaacagcagcatccatgggagaattttcaacctctaagaagcgaaatcaaccacgtgaggcatcaagagtgtggagaaatcatagacattggaagcttacaatttcttaaagaagaaaaagatgtcctttccctcatctccttcttgattcataacacaaaacctgttggtcatcaggatctggtcggtttggttatctcggtgctactcctaggagatttaactctaacgttactcacactactccaactctactcgatatcattgctggaagtctttctcgctatgtttattttacctctcagcatcatttttccattccctgctggggtcagcgctttgtttagccacggaccaaggcgctctgctagtcgcacacgcgtttatgcattgtggaatgtcacatccttggtcaatgtcggacgagaacgaatggtggatattcccagtcgctttgtttctatgcaaagtcttgcaatcccaactcgtaaactggcacgttgcaaacctcgagatacaagattactccttgtacagcgatga

SEQ ID NO: 2293 - DNA, 264 bp, Arabidopsis thaliana
atgatgaagggaagcaagtcttacacggagtattcgtcatctttctcaacagatgaatttggttatgatcagaaccgttcaaactcctataacttcaatgggccttgtatcaacacagatccggagatgaaaagaaagaagagagttgcttcttataatctttttgccacggaggaaaagctcaagagtactctcaagaacagtttcaaatggatcaagaacaaattctcaggcgatgataatagtatccggtacaacgtctag

SEQ ID NO: 2294 - DNA, 786 bp, Arabidopsis thaliana
atggtggaagaagtttggagaaagggtccatggaccgccgaagaagaccgtcttttgatcgaatacgtccgtgttcacggtgaaggtcgttggaactctgtctctaaactcgcaggattgaaaaggaatggcaaaagctgcagactaagatgggtgaattaccttagaccagacctcaagagaggacagatcactccacatgaagaaagtataatacttgagctacacgctaagtggggaaataggtggtcaacaattgcacgtagtttaccaggaagaacagacaatgagatcaagaactattggagaacccatttcaagaaaaaggcaaagcctacgactaacaatgcggagaagataaagagtcgtctcctaaaaaggcaacacttcaaggaacagagagaaatagagttgcaacaagaacagcagttgtttcagttcgaccaactcggtatgaaaaagatcatctctttactcgaagaaaacaatagcagtagcagtagcgatggcggtggtgatgtgttctattatcctgatcaaataacacattcatcaaaaccctttggctataactctaattcattagaggagcagttacaaggtagattttctcctgtaaacatacctgatgctaatactatgaacgaagacaatgccatatgggacgggttttggaacatggatgttgtaaatggacatggtgggaacttgggtgttgtggctgctactgctgcttgtggcccaaggaagccctatttccataacttggtgattccattttgttaa

SEQ ID NO: 2295 - DNA, 1053 bp, Arabidopsis thaliana
atgagttccaccgcggcatcttccaccgtcggaggaggcggatcgtctgagatttccggtgtcaaaaaaacctccaagcgaccaaaatattctaggtttactcagcaagagcttccagcgtgcaagccaattcttactccaagatgggtgatcttgacatttcttgtcgctggggttgtcttcattccccttggagtgatctgcttatttgcttctcagggagtagtcgagattgttgatcgatatgacacagactgtattccaacatcttctagaaacaacatggtcgcttacatacagggtgaaggagataagatctgtaagagaacaataacggtgacaaaagctatgaagcatcctgtctatgtatactaccaacttgagaatttctaccaaaaccatagacggtatgtgaaaagtcgaaacgatgcacaactaagaagtccaaaagaagagcatgatgtgaagacctgtgcacctgaggataatgtgggtggagaaccaattgtgccatgtggtcttgttgcttggagtttgttcaacgatacttatagcttttcaagaaatagccaacaacttcttgtgaataagaaaggtatctcatggaagagtgacagagaaaacaagtttgggaaaaatgtcttccctaaaaattttcagaaaggagcaccaataggcggtggaactcttaatatttctaaaccgttgagtgagcaagaagacctcatagtctggatgcgaaccgcggctttgccaacgtttaggaagctgtatgggaagattgagacagacctacacgcgggtgataccataacggtcttgttgcagaacaactacaacacttacagcttcaatgggcagaagaagctagtgctgtcaacaactagctggctcggcggaaggaatgatttcctcgggattgcttatctgactgtaggcagtatttgcttgttcttggctgttacatttgccgtattgtatctagttaagccaaggcaactcggagacccctcgtacctttcgtggaacagaagtgctggaggtttacagtaa

SEQ ID NO: 2296 - DNA, 2202 bp, Arabidopsis thaliana
atgaagcgaacaatcaacgaagtcgtcggatctacctccgtcaatactctcgattcctccattgctaagaagcctgtcttcctcaccaaaaaacagcgggaagagttagccctaaaacgccgccaggatcaaatctccgagcaacgtgtccgtcgtgagcaacttggtcgccccgagcccgagacggaagatgtctccaatggagataccaatcgggataaggatcgagatagagatcgggaccgagaccgagaacgtgaccgagatagggagagagatagagggcgagatcgagaccgcgatagggatagagacagggatagggatagagagcgagagagagaccgtgagcgtgaccgtcgtgaacgagatcgtgaaccggatcggagaaatagagaaaaggagagggaagaggaggttaaggctagggagaaggcgcgtgttgagaaattagttgagagagagaaggagaaggaacttgacgccattaaagagcagtatcttggaggtaagaagccgaagaagagagtcattaggccaagcgagaagtttcgtttctcttttgattgggaaaacactgaggatacttctagggatatgaacgttctttaccaaaaccctcatgaagctcagcttctctttgggagagggtttcgtgctggtatggaccgtcgtgagcagaagaaacaagcggctaagcatgagaaagagatgcgagacgagattcgtaagaaagatggtattgtagagaaaccagaggaagctgctgctcagagagtgagagaagaagctgctgatacttatgactcgtttgatatgagggttgacaggcattggagtgataagagattagaggagatgactgaaagggattggcgtattttcagagaagatttcaatatctcttacaagggttcgaggattcctcgtccgatgaggagctgggaagagagtaagcttacttctgagcttttgaaagctgtggagagagctggatacaagaaaccttctcctattcaaatggcagctataccacttggactgcaacagcgtgatgttatcggcattgcagagactggttctggtaagactgctgcttttgttttacccatgttagcttacatctctagattgccaccgatgagcgaagagaatgagactgaggggccttatgctgttgttatggcccctactagagagcttgctcagcagattgaggaggaaactgttaagtttgcgcattatctagggtttagggtgacttctattgtgggtggtcagtcgattgaggaacaggggttgaagataacacaagggtgtgagattgtgattgctactccgggtcgtctgattgattgccttgagaggcgttatgcggtgttgaaccagtgtaactatgtggttcttgatgaggcagatcggatgattgacatgggtttcgagccacaggttgcaggtgtgttagatgcgatgccttcaagtaatttgaaacctgagaacgaagaagaagagcttgatgaaaagaagatttatagaactacatatatgtttagtgctacaatgcctcctggggtagagcggctagctcggaagtacttgaggaacccggttgttgtcaccattggtactgctggaaagactacggatttgatttcgcaacatgttattatgatgaaagaatcagagaaattcttcagattgcagaaactgctcgatgagctcggcgagaagactgccattgtgtttgttaacacaaagaaaaattgtgactcgattgctaagaatctggataaggcagggtaccgtgtcacgaccttgcacggtgggaaatcacaagagcagagagaaatcagcttagaaggattcagagcaaagagatacaacgttcttgttgcaacagatgttgtaggacgtggaattgatattccggatgtggctcatgtcataaactacgacatgcctaaacatatagagatgtacacacatcgtatcggacgtacaggacgtgctgggaaaagtggtgttgcgacttcgttcttgacacttcatgataccgaagtcttctatgatctgaagcagatgcttgttcagagcaacagtgcggtgcctcctgagctggcgagacatgaagcgtccagattcaaaccaggtacggttcctgatagacccccaagacatagtgacactgtctatataaattga

SEQ ID NO: 2297 - DNA, 1344 bp, Arabidopsis thaliana
atgctattaaacatttcttcttctccaatctctcatcgaaaccctcacttcctctccaatttcaacaaccccatctcttatttccctcgacgatccaaaacccatctctcaaaatctcattttttccccaagttcactcctttatccaaccaaagtctcaaaaacagagtcttgttcggaaacaagaggtacccagatggagaaaggtttgattttagatcaagagctatctccgggattgatttgggaagctttgaatctgttcttgaagctattgctgttctcacaacgatcatcgtcgtccatgaatcaggtcatttccttgcggcttctctccaagggatccatgtgagtaaattcgcaattgggtttggtccgattctagctaagttcgattacaacaatgttgagtattcgcttagggcttttcctttaggtgggtttgttggtttccctgataatgatccagatagtgagattcctattgacgatgagaatcttcttaagaacagaccaactctagatagatcaattgttgtttcagctggaattatcgccaatgtgatctttgcttatgctataatctttgttcaagtgttatctgttggtttacctgtacaagaagcgtttcctggtgttcttgttcctgaagttaagaccttttctgctgcttctcgtgatgggttgctttctggtgatgtaattctcgctgtggacggtactgagctgtctaaaaccgggcctgacgctgtttcgaagattgttgacattgttaaaagaaacccgaagagtaatgtggtgtttagaatcgaaagagggggtgaagatttcgatattcgggttacaccggataagaactttgatgggacggggaagatcggtgttcagttgtctccaaatgttagaatcactaaggtgagaccgaggaacattccggaaacgtttagatttgtgggaagggagtttatggggctatcttctaatgttttggacggtttaaaacaaacattctttaacttctctcagacagcaagtaaagtagcaggtcctgtggcaattattgcagtgggagcagaagtggcaagatcaaatatcgacgggctttaccaattcgcagcgttgctgaatatcaaccttgcggtgatcaatctcttgccgttaccggctcttgacggtggaacattggcattgatattgttggaagctgttagaggagggaagaagcttcctgtagaggtagaacaagggataatgtcttcagggatcatgcttgtgatattccttggattgtttctcatcgttaaggacacacttagccttgatttcatcaaagaaatgttgtag

SEQ ID NO: 2298 - DNA, 1074 bp, Arabidopsis thaliana
atgggaataatggaggcagagaggaaaacaacaggctgggctgccagagacccatctgggatcctctctccttacacttacactcttagagagactggaccagaggatgtgaacataagaatcatttgctgtggaatctgccacaccgatcttcatcaaactaaaaatgatcttggcatgtctaattaccccatggttcctgggcatgaagtggtaggggaagtagtggaggtgggatcagatgtgagcaagttcaccgtaggggacatagttggagttggttgcctcgttggatgttgcggaggttgtagcccctgcgagagagatctggaacagtattgtccaaagaagatttggagctacaatgatgtttacatcaatggtcaacctacacaaggcggcttcgctaaagccaccgtcgttcaccaaaagtttgtggtcaagattccagaaggaatggcggttgagcaggctgcgccgctactgtgcgctggtgtgactgtgtacagtccactgagccactttggtctgaaacaaccaggcctaagaggaggtatactagggttaggtggagtcggtcacatgggtgtgaaaatagccaaagcaatgggtcaccatgtgactgtcataagctcatcaaacaagaagagagaagaggcattgcaagatcttggagctgatgattacgtgatcggatccgaccaagcgaagatgagcgaattggctgattcgttggattacgtaattgacacggtgcctgttcatcatgcacttgagccatatttgtctctgcttaagcttgatggtaaactcattctcatgggagttatcaacaatccattacagtttctcactcctctgcttatgcttgggaggaaagtgataacggggagcttcatagggagcatgaaggagacagaggagatgcttgagttctgtaaagaaaagggtttgagttcgattatcgaagttgtgaagatggattatgttaacactgcgtttgagagactcgagaagaacgatgtgcgttataggttcgtcgttgatgtcgaaggaagcaatctcgacgcttga

SEQ ID NO: 2299 - DNA, 498 bp, Arabidopsis thaliana
atggctttctcacgcctctcatttgcagcttctctcatcgtcttctcatctctaatcatatcttcagttgcttattacggcaatgaagctgacccggagaccggaaaattgattcccatcgccgttgaagggatcatcaagtgcaagtccggtggcaaaacttacccaattcaaggtgcaacggcaagaattgcgtgtgtgaaggtcgatgcatatgggaatgagttagttccaatatcgatattgagcagcaaaactgatgctaaaggttacttcatcgccacgatattcccttcgcagcttcgtgcaggaaggacagtgaccaaatgcaaaacttacctttacaaatctccactcgctgattgcgattttccgaccgatgtgaacaaaggtgttagaggacagccattgagcacgtaccgtattcttcaagacaagagcttcaagctttactgggctggtcctttcttctacacgtctgaacctacttactactaa

SEQ ID NO: 2300 - DNA, 843 bp, Arabidopsis thaliana
atggcttctacttttaggctctctattagcttcctcactctcatcctcttctctctgtgggtagtggaggcacacacgtctagaaagttgatatcaatcaaggaaaaagaaggtcaagatattagtcatttgctcaaagatggtgaatttgatgacccttcgttgtacatgtatttcacactcaatgatctcaaactaggaaccaaattgctgatttacttctacaaaaacgatcttcaaaagcttcctccacttctcacaagacaacaagccgatctcattcctttcactaagtcaaagcttgacttccttctcgaccacttctctatcaccaaagactctcctcaagggaaagccataaaggagactttgggacattgtgatgctaaagctattgaaggagagcataagttttgtggaacttctttggagtcattgatcgatcttgtgaagaaaacaatggggtataatgttgacctcaaggtcatgacgactaaagtaatggtaccggcccaaaattcgataagctacgctttgcataactacacattcgtcgaggctccaaaggaacttgttgggattaagatgttgggatgtcacagaatgccttacccttatgctgtttactattgccatggacataaaggtggaagtagagtctttgaagttaatttggtgacggatgatgggagacaacgggtagtaggacccgctgtctgccacatggacacatccacgtgggacgcggatcatgtagcttttaaggtgttgaagatggagccgaggtcagcaccggtttgccatttcttccctcttgataacattgtgtgggtaacaaagtaa

SEQ ID NO: 2301 - DNA, 798 bp, Arabidopsis thaliana
atggcaacatcagctatccagcaatcctccttcgccggccaaacggctctcaagccctccaacgaactcctccgcaaggttggtgtatccggtggtggccgtgtgaccatgcgtcgtaccgtcaagtctactcctcaaagcatctggtacggaccagaccgtcccaagtacttaggaccattctcggagaatacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggttctcagattttctcagaaggaggtcttgattacctcggaaaccctaacttgatccacgcgcaaagcatcttagccatctgggctgttcaagttgtgctcatggggttcattgaaggctacagaatcggaggtggacctctcggagaagggcttgacccgctttaccccggaggtgcgttcgacccattgaacttggctgaggatccagaggctttctctgagctgaaggtgaaggagcttaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaattaa

SEQ ID NO: 2302 - DNA, 888 bp, Arabidopsis thaliana
atggaaggcaaagaagaagatgtacgagtgggagctaacaagttcccggagaggcaacccatcggtacatcggctcagtccaccgacaaggactacaaagagccacctcctgcgccactgttcgagcccggcgagctcagctcatggtctttctacagagccggaatagctgagtttatcgctactttcttgtttctctacatcactgttttgactgtaatgggagttaagagagcaccaaacatgtgtgcttctgttggaatccaaggtatcgcttgggcttttggtggcatgatctttgctcttgtctactgtactgctggaatttcaggtggacacatcaaccctgctgtaacattcggtctgttcttggctcggaagttatctctgaccagagcagtgttctacatgattatgcaatgtcttggagccatctgtggtgccggagtcgtcaaaggtttccagccaacgccgtaccagactctcggtggtggtgctaacaccgttgctcatggctacaccaaaggttctggccttggtgctgaaatcatcggaacattcgttctcgtctacactgtcttctccgccaccgacgccaagagaagcgcccgtgactcacacgtcccggtatggacccctctcttagttccgattttggcgccgctcccaatcggatttgcagtgttcttggtacacttggcaacaataccgatcaccgggaccggaatcaacccagctagaagtcttggagccgcaattatctacaacaaggaccactcttgggatgaccattggattttctgggttggaccattcattggagcagctctagcagcactatatcaccagattgtcatcagagcgattcctttcaagagcaagagttag

SEQ ID NO: 2303 - DNA, 1509 bp, Arabidopsis thaliana
atgggtaaagtggcagttgcaacgacggtagtgtgttcggtggcggtatgtgcggcggcggcgttgatagtacggaggagaatgaaaagcgcagggaaatgggcaagagtgatagagatattgaaagcctttgaagaagattgtgcaacgccaattgccaaattgagacaagtggctgatgctatgactgttgagatgcatgctggtcttgcttctgaaggtggcagcaagcttaagatgcttattagctacgttgataatcttccttctggggatgagactggttttttctatgcgttggatctaggcggaacaaacttccgtgttatgcgtgtgcttcttggtgggaagcacgaccgtgttgttaaacgagaattcaaagaagaatctattcctcctcatttgatgaccgggaagtcacatgaattattcgattttatcgttgatgttcttgccaagtttgtcgctacagaaggcgaggactttcatctcccacctggtagacaacgggaactaggttttactttctcatttccggttaagcagctatctttatcctctggcactctcatcaactggacgaagggcttttccattgacgatacagttgataaagatgttgttggagaacttgttaaagctatggaaagagttgggctggacatgcttgtcgcagcgcttgttaatgataccattggaacacttgcgggtggtagatacactaacccggatgtcgttgtcgcagttattttgggcaccggcacaaatgcagcctatgtcgaacgtgcacatgcaattcccaaatggcatggtttgctacccaaatcaggagaaatggtgatcaacatggaatggggaaacttcaggtcatcacatcttccattgacagagtacgaccactctctagatgtcgatagtttgaatcctggtgaacagattcttgagaaaatcatttccggaatgtatctgggagaaatcttgcgtagagttcttctgaagatggctgaagaagctgccttctttggcgatatcgtcccacctaagctgaaaataccattcatcataaggaccccgaacatgtctgctatgcacagtgatacttccccggatttgaaggttgtaggaagcaagttaaaagacatattggaggtccagactagttctctgaagatgaggaaagttgtgatcagcctatgtaacatcattgcaagccgaggagctcgtttatctgctgcggggatctatggaatcctcaagaaaataggaagagacgcaacaaaagatggagaagctcagaaatctgtgatagcgatggacggtgggctattcgagcattacactcagttcagtgagtcgatgaagagttcattgaaagagttgcttggagatgaagtttcagagagtgttgaagtgatactgtcgaatgatggttcaggtgttggagctgcattacttgctgcttctcactctcagtatctcgaacttgaagatgactctgaaacaagttaa

SEQ ID NO: 2304 - DNA, 1602 bp, Arabidopsis thaliana
atgggaaattgttgtgcgagcccgggttcggagactgggagtaagaaggggaaaccaaagatcaaaagtaacccgttttatagtgaagcatacactacgaatggatctggaactgggttcaagctctctgttttgaaagatccaacaggacatgatatatctcttatgtatgatctggggcgtgaggttggtcgcggagagtttggtattacttacttgtgcactgatatcaaaacgggcgagaagtatgcgtgcaagtctatatcaaagaagaagcttagaacagctgtggatatagaggatgttaggagggaagttgagataatgaaacatatgcctagacacccaaatatcgtgtcgctgaaggatgcctttgaggatgatgatgcagtgcatatagttatggagttgtgtgaaggaggtgagctgtttgatcggattgttgctagaggtcattatactgagcgagctgctgctgcagtgatgaagactattcttgaagttgttcagatatgccataagcatggagtgatgcatcgggatctaaagcctgagaactttctctttgcaaataaaaaagagacatcagcccttaaagccatagattttggattatcagtcttcttcaagcctggtgagggattcaacgagattgttggaagtccttattacatggcaccagaggtacttaggcgaaattacggacctgaggttgatatctggagtgctggagttatcctttatatcctgctctgtggtgtcccaccattttgggccgagactgagcaaggggtggctcaggcgatcattaggtcagttatcgactttaagagggatccatggccgagagtttctgagactgccaaagaccttgtgaggaagatgctcgaacctgaccccaaaaaacggctttctgctgcacaagtactcgaacattcttggatacaaaatgcgaagaaggctccaaatgtttcactcggcgagacggtgaaagcaagactcaaacagttttctgttatgaacaagctcaagaaaagagcgctacgggtgatagccgaacacttatcagtggaggaagtagctggcatcaaggaagcatttgagatgatggacagtaaaaagacgggaaagataaacctcgaggagcttaaatttggacttcataaactcggacagcagcagatacctgatactgatctacagattctgatggaagctgctgatgttgatggggatgggactttaaattatggggagtttgtggctgtctctgtgcatcttaagaaaatggcgaacgacgaacacttgcataaggcttttagcttttttgaccagaatcagagcgattacatagagattgaggagctgcgtgaggctttaaatgatgaggtggatactaacagtgaagaagttgttgcagctattatgcaagatgttgacacagacaaggacggacgaataagctatgaagagtttgcggcgatgatgaaagctggaacagattggaggaaagcgtcgaggcagtattcccgggaaagattcaacagtttgagcctcaagttaatgagagaaggttcattgcaattagaaggcgaaaattaa

SEQ ID NO: 2305 - DNA, 1365 bp, Arabidopsis thaliana
atggctttagctgttacttcttcttcaactgcaatctctggatcgagtttctctcgttctggagcttcttctgaatctaaagctcttcaaatatgttcgattaggttatctgatcgaacccatttgtctcagagacgttactctatgaaacctttaaacgctgagtcacattcacgaagcgaatcttgggttactcgtgcttcaactctaattgctcctgaagttgaagagaaaggaggagaagttgaagactttgagcaacttgctaaaaagcttgaagatgcttctccacttgaaatcatggataaagctcttgagagattcggagaccaaatcgcaattgcttttagtggagctgaagatgttgcattgattgaatatgcacgtttaactggaaagccatttagggtttttagtttagatacagggagattaaaccctgaaacgtacaggctctttgacgcagtcgagaagcagtacgggattcgaattgagtacatgtttcctgatgcagttgaggttcaagctttagtgaggaacaagggtttgttctcattctatgaagatggtcatcaagagtgttgccgtgtgaggaaagttagacctttgcgtcgtgctcttaagggtcttaaagcttggattacaggacagaggaaagaccaatctccgggtacgagatctgagatccctattgttcaggttgatccagtgtttgaagggttagatggcggtgttggaagtcttgtgaagtggaatcctttggctaatgttgaaggagctgatgtgtggaactttctgagaactatggatgttccggtgaatgcattgcacgcacaagggtatgtgtcaatcgggtgtgagccgtgtactaggccggtgcttccaggccaacatgagagagaaggaaggtggtggtgggaagatgctaaagctaaagaatgtggtctacacaaagggaacatcaaggaggaagatggtgctgcagactcaaagcctgctgctgtgcaagagatatttgaaagcaacaatgtggttgcattgagcaaaggaggggttgagaatcttttgaagctagagaaccgtaaagaggcgtggttggtcgtactttacgctccttggtgccctttctgccaggcgatggaagcatcgtacatcgaattggctgagaaacttgcgggaaaaggagttaaagtggcgaaattccgagctgacggtgagcagaaggagtttgctaagcaagagcttcagttagggagcttcccgacgatacttctctttccgaaaagagctccacgggctattaagtacccttcagagcatagagatgttgattcactcatgtcgtttgtgaatcttcttcggtga

SEQ ID NO: 2306 - DNA, 2838 bp, Arabidopsis thaliana
atggaggtgttatctacttcctcacctctaacgcttcactcccaccgactcctctctgcttcttcttcttcttcacatgtcacctccatcgccgcttcttcactttcttcattcgcttcttcatatctcggaatctccctttctaaccgcacgatccaccgcttctccacaactccgacgaacttaagacgatttcctcaaagaaaacggaagaaattcactccgatttcagcggttttcgaacggttcaccgaacgagcgatcagagctataatcttctctcagaaggaagctaaatcgttgggaaaagatatggtttacacgcagcatcttctcttaggtttgatcgctgaggatcgtgatcctcaaggcttccttggatccggtatcaccatcgacaaggctcgtgaagctgtttggagtatttgggacgaagctaattccgattcgaaacaggaggaagcttcttctacttcgtattcaaaatcgacggacatgcctttctctatcagcacgaaacgagtctttgaagctgcggttgagtactctaggactatggattgtcaatatatcgcaccggagcatatagccgttggactcttcaccgttgatgatggtagcgccggcagagttctcaagagattgggagcaaatatgaatttgctcacagctgcagcacttacaagacttaaaggagagattgctaaagatggaagagagccatcttcttcatctaaagggagcttcgagtctcctcctagtggtcgaattgctggttctggacctggtggaaaaaaagcgaaaaatgtactggaacagttctgtgtggatctgacagcacgtgctagtgagggtcttattgatcctgttattggtcgggaaaaagaggttcaaagagttatccagatactttgccgcagaactaaaaacaacccaattcttcttggtgaagctggtgttgggaagactgccattgctgaaggactagcgattagtattgcagaagccagtgctcctggatttctcttgacgaaacgcatcatgtccctggatataggattgctaatggccggtgcaaaagaaaggggagagctggaggctcgagtcactgctttgataagcgaggttaaaaaatcaggtaaggtcattctcttcatagatgaagtgcatacacttattgggtctggcacagttggaagagggaacaaagggtctgggcttgacattgctaacctcttgaaaccatcacttggaaggggtgaacttcagtgcattgcatccacaacccttgacgaatttaggagtcagtttgagaaggacaaagcccttgcaaggagatttcagccagtgttgattaacgagccaagcgaggaagatgcggtgaagattttgttgggccttcgtgaaaaatatgaagcccatcacaattgcaaatatactatggaagccatagatgctgcagtgtacctttcatcacgatatatcgctgatagatttcttccagataaagctattgatctcattgacgaggcaggaagcagagctcgtattgaagcttttaggaagaaaaaggaggatgcaatctgtatcctatcgaagccacctaatgattactggcaagagatcaaaacagttcaggccatgcacgaagtggttctctcaagcaggcaaaagcaggatgacggtgatgccatttcagatgagtctggtgaactagttgaagagtcttctttgccacctgcagcaggcgacgatgagcctatactggtgggacctgatgatattgcagccgttgcatcggtttggtctggaattccagttcagcagatcactgcagatgaaagaatgcttcttatgagtctagaagatcagcttagaggcagagttgttggtcaagatgaggcggtagctgccatatctagagctgtgaagaggtcccgggttggcttaaaagatcccgaccgtccaattgctgctatgcttttctgtggaccaacaggggttggaaaaacggagcttacaaaagctctggcagcaaattattttggctcggaagaatccatgctgagattggacatgagtgaatacatggagcgtcatactgtgagcaagctgataggctctcctcctggttatgttggctttgaagaaggtggaatgcttacagaagctatcaggagacgtccttttacagtggttttgttcgatgaaatagagaaagcacatccggatatcttcaatattcttctccagctgttcgaagatggccatctaactgattcacagggaaggagagtatcttttaagaacgcattgatcataatgacctctaatgtcggatcattggccattgcaaagggaagacatggttcaatagggtttatcctcgatgatgatgaagaggcagcatcttataccggaatgaaagctttggtagtcgaagaactcaagaactatttccgtccagagttgttgaaccgaatagacgaaatcgtcattttccgacagctagagaaggctcagatgatggagatcttgaacctgatgctacaagacttgaagtcgaggctcgtggcactcggagttggtttagaggtgtctgaacccgtcaaggagctcatatgcaaacaaggctatgatccagcttacggtgcacgaccactccggagaactgtcacagagattgttgaagatccactcagtgaagcctttcttgccgggagcttcaagcctggtgatacggcttttgtagttcttgatgataccggaaacccatcggttcggaccaaaccagattcttccactatacgagttacagacaaaacatcgatcgcatag

SEQ ID NO: 2307 - DNA, 243 bp, Arabidopsis thaliana
atggagtcagctaccggcccgtctgctctaggagcgggggccggagctggtgttggacctgatgggcctggagccaaagcatatggtttaggaggagaagcgacaggggaagttgtgggcgacgtggtcgggggtgagacgggggtgaagcaacgagccggtggttctgcagttggtgtaacaactggagaaggagactctaccggagggagaaacgtgataggtgccggagccggagcttga

SEQ ID NO: 2308 - DNA, 1785 bp, Arabidopsis thaliana
atggatgattattttagcgcggaggaagaggcttgctattactcctccgatcaagattctttggatggaattgataatgaagagtctgaattgcagcctctgtcctctaaaagatcaaacactcaggtcatcactcaggaatcgcttctagcagcacagagagaagatttgctaagggtgatggaattgttatcaataaaggagcaccatgcacggactcttcttattcattaccagtgggatgtggagaagttgtttgctgtgtttgttgagaaaggaaaagatagcttgttttctggagctggtgtcactgtcttcgattatcaatatggcaactcttcctttcctcagtcttcacagatgagttgtgatgtttgcatggaggatttaccaggtgatcacatgacaagaatggactgtggccattgcttttgcaataattgttggacggagcattttactgtgcagataaatgaaggtcagagcaaaaggattagatgcatggctcatcaatgtaatgctatttgtgatgaagatattgtcaggagtctagtcagtaaaaagcgtccagatctagctgcgaagtttgatcgttaccttcttgagtcgtacatcgaagataacagaatggtcaagtggtgtcctagcactccgcattgtgggaatgctatacgagctgaggatgacaagttgtgcgaagttgaatgttcttgtggtcttcagttctgtttcagttgtctgtgtcaagcccactccccttgctcttgtttgatgtgggagttatggagaaagaagtgtcgagatgagtctgagacaatcaactggataaccgttcacacaaagctgtgtcccaaatgttacaaacctgtggaaaagaatggtggatgcaatctcgtgaggtgtatttgtgggcagtgtttttgttggctatgtggtggagctactggaagtgatcacacttataggagtatcgctggtcacagttgtggtcggtaccaagatgacaaagagaagcagatggaaagagcgaagagagatttaaacaggtatacgcattatcatcaccgatacaaagctcatacagattcatcaaagctagaagataaacttagggatactatccatgagaaagtgtcgaaatcagaaaagagggagttgaagcttaaagacttcagctgggtcaccaatggactcgaccggttattcagatcaaggcgagttctttcatattcgtatgcttttgcatattatatgtttggtgaagagatgtttaaagatgagatgacccctgaggagagagagataaagaagaatttgtttgaggatcagcagcaacaacttgaaagtaatgtggagaaactttcgcagttccttgaggagccctttgatgaatttagtaatgataaagttatggcgataaggattcaaatcatcaatttgtctgtcgccgtcgatacactctgcaagaaaatgtacgagtgcattgagaatgacttactcggatctctccaacttggcatccacaacatctcaccttacagatcgaagggaatcgaacaagcagctcagttttatgcttcctggaattccaaagatgctgacaaattccaacctttggatagtggagtgacatcgaggcctgagcaagcttcaggatcaaggagctcggaagacaccatttgctcatcttcacagaaacgtcccaaaaaagaaggaagtttcttaaacaacaaagtcactttattggatttgaacttgccagctgatttcgtcgaccagaactga

SEQ ID NO: 2309 - DNA, 357 bp, Arabidopsis thaliana
atggatatctcgggtcatccaaaaacccgaacccgaaccattttcgatgaagttgacgaacctgtctggttttgttgcgttcttccgatttgggttggagaggaaatggcgtcgggatggggaataacgggaaacaaagggagatgctacgatttctggatggatttcagtgaatgtatgtctcactgcagagagcccaaagattgtacccttcttcgtgaagattacctcgagtgtctccaccattccaaagagtttcaaagaaggaacaggatatacaaggaggagcagcgtaaactaagagcagcttcgaggaaaggtgaagaagccggagatgggactcacaaccatcactag

SEQ ID NO: 2310 - DNA, 1605 bp, Arabidopsis thaliana
atgagctcctctgactcttcttccgccgaatcccgtctagccacggctaagacggttctcaccaccgcggcttcggtggctgcgaccgcaatgctagctcgatctttagtccaagattatttgcctgacgaggtgcatcactacatttcctatggattccgttccatctttggttacttctcatcccaaatgacgataatcatcgaagaatttgaaggttttgctcacaatgaagtctttgaagctgcagaggcctatctagccaccaagatctctccttctaacaaaagaatcaaagtgagtaaacatgagaaagaaaacaactacaatgtcaccgtggagcgtgacgaagaagttgttgacacctacaatggcgtcaaattccagtggatcctccattgtcgtcatgtcgagtccaagcacttccacaacccacgggatctaaactccacactgagatctgaggtccgatcattcgaactcaacttccacaagaaattcaaagacgtagctcttgaatcttacttgccattcatggtgaaaagagccacgttgatgaagcaagagaagaaaacactcaagatcttcactctctccccagaaaacatgtatgggaactactctgacgcgtggacctctgttactcttgaccatccttctaccttcaaaactctagcaatggattcagatgtcaagacaagtgtgatggaagatctagacaaattcgtaaagcgaagagacttctataaaagggttggtaaagcttggaagagaggttacttgctgtacggtccaccaggcacagggaagtcaagcttgatcgcagccatggccaatcatctcaactttgatatatacgacctagagttgaccgcggttaacaacaattctgagctccggcgattattgattgccactgctaatcgttcgattcttatcgtagaagatatcgattgttcactagaattgaaagataggactagcgatgaacctcctcgggaatctgacgatatagaagatccacggtataaaaaagtgacactctctggactgttgaatttcatagatggtctatggtcaagctgcggtgacgaaaggatcataatcttcacaaccaattacaaagagaaactcgacgcggccttgctgagaccaggacgtatggatatgcacatccacatgtcgtattgcacaccaagtactttcaaagctcttgctttgaactatcttgagatcaaagagcaccgccttttcagcaagatcgaggaaggtattgaggcgacagaggtcactccagcagaagtagctgaacagcttatgagaaatgactctgtagacaaggttcttgagggtttgattgagttcttgaaagtcaagaagatcgaaaacgaacaagataaggccaaaacagagaagcaagagttggagaacaagaaaaagaccaaggagggaacagattccgtagtcaagaaagaggttgatgaacagctagtgaggaatgaccgtgttgataaggttcttgagggtttggtcgagttgttaaaagccaagaagatcgaggacgaccaagataaagccaaacatgaggaggttgaacaacattaa

SEQ ID NO: 2311 - DNA, 258 bp, Arabidopsis thaliana
atggaaatggacaagagggacggtaagttcgggccacagccaatggcagtgcctccggctcagcaaatgtcacggtttgatcaagccaccccacccgcagtcggttatcctccacaacaaggttatccaccttctggttatcctcaacaccctccacaaggttatccaccttctggctatcctcaaaaccctcctccctcagcttattctcaataccctcctggggcttatcctcctcctcccgcttacccaaagtga

SEQ ID NO: 2312 - DNA, 1143 bp, Arabidopsis thaliana
atgtcggcggtctcgtgctccacggcgagttctagcggaggatgtgcatttaggtttcgatcaaagacatcaatccattctcctaatttcatcagaattgggacaaattctcagagtgacagattctgtaatcatcgtttggaattggtacatggaactcgtaaagtgaaaggagcatctgtacgtatggcattagttgaggagagacaatcaacgagcaaagatgttgctgagcctcctcgggtcctggcgtatgatcttgttcaaggagcacttgtgaaatggagatggaaggatgacaaatctgttccagatacacctactgctgttctcctacacggaattttagggagcgggaaaaactggggcacttttgctcgtagattggctcatgaattcccaacgtggcagtttctattggtagacctgcgttgccatggggattcaacatctctcaagaagagaggtccacactcggttgctactactgcttctgatgttctaaaacttgttggtcagttgaggttaacacctcgggtccttgttggtcatagctttggggggaaagttgtattaagcatggtagagcaagcagctaagcctcttccacgaccagtccgagcttgggtattggatgctactcctggtaaagttcgtgcaggaggagatggagaagatcatccacgagagcttatatcatttctacgtaaattgccaaaagtggtcttgtcaaagcgcgaggttcttaaagctcttataaatgaagggttttccaatgatgtcgcacagtgggtcattaccaatctcagacctactggaccatcagcttctagcttctcgtggacatttgacctagacgggatcgctgaactttaccagtcttacgaagagacaaatctatggaactttgttgagaatcttccaagaggagtacatgtgaattttctgaaagcggaaagaagcttgcaccgttgggccctagaagaccttcagcgaatccacgccgctgaagagctagcctctgaagaaggcggtggtgtagaaatgcatgtcttggaagatgccggtcattgggttcacacggataacccggatggtctcttcaggatcttgtcatcttctttccaggttctcagagcctag

SEQ ID NO: 2313 - DNA, 1326 bp, Arabidopsis thaliana
atggtcggagcaaaaccggtggagaatggatctgacggtggtagtagtacggggctgcttcacggccgttacgagctagggcgtcttctaggtcacggaacattcgcgaaggtgtaccacgctcgtaacatacaaaccggaaaaagcgtggcgatgaaagtcgtcggaaaagagaaagtggtgaaagttggtatggttgatcagatcaaacgagagatctctgtgatgaggatggtgaaacatccaaacatcgtcgagcttcacgaagtcatggcgagtaaatccaagatctatttcgccatggagcttgtacgaggcggtgagttattcgctaaggtggctaaaggaagactacgtgaagacgtagctcgtgtttatttccagcaattgatctcagccgttgatttctgtcatagccgtggtgtttatcaccgagatctgaaaccggagaatctcttgttagatgaagaaggtaatctcaaggtgactgattttggtctctctgctttcactgagcatttgaaacaagacggacttcttcatacaacttgtggaactccggcttatgttgcgccggaggttatattgaagaaaggatacgacggagctaaggcggatctgtggtcttgtggtgttatactttttgtgcttcttgctggttatttgccgtttcaagatgataatcttgtgaatatgtataggaagatttacagaggagatttcaaatgtcctggttggctttcttctgatgctagacggcttgtgactaagcttcttgatccgaatccgaatacgaggattactattgagaaggttatggattcgccttggttcaagaaacaagcaacgagatcaagaaacgaaccagtggctgccacaatcacaaccacggaagaggatgttgatttcttggtgcacaagtcgaaggaagagacggagacgttaaacgcgtttcatataatcgcgttatcggaagggtttgatttgtcgccgttgtttgaggagaagaagaaagaggagaaaagagagatgagattcgcgacgtctcggccagcgagtagcgtgatttcgagtttggaagaagcggcgagagttgggaataagtttgatgtgaggaagagtgagagtagagtaaggattgaaggtaaacagaatggtcggaaagggaaattggcggtggaagcggagatattcgcggtggctccgtcgtttgttgtcgtggaagtgaagaaagatcatggagatacgcttgagtacaacaacttctgcagtactgctcttagaccagctctcaaggacattttctggacctctacacctgcttga

SEQ ID NO: 2314 - DNA, 732 bp, Arabidopsis thaliana
atgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttga

SEQ ID NO: 2315 - DNA, 1740 bp, Arabidopsis thaliana
atggccgcagctttaaggtcgaatacgtcaagagaaaccgcttctcttacactttctcattttagatactttatcttcaaccgtatccacaccgctcgaaccgccacaagtcctcctcactgtaatcaccgttctaaatccgatgagaaattcccctataaaatttcctctcttggaacgagtttcttggataatcgaggaggaggagagagacgtaattcgactaagtgttatgctgctcagaagaagctcagcggtgttggttcttctgttgttattctgagctcacaaggagacccaccggatctatggcagcctcctggtgatggagtttccgttagggttaatgggtccagtgttaatctcggtcgtggtggtggtggtggtggaagtagtcctggtggtcctggtaacggaacagggtcgaattcgaaagaagattgttggggtggatccaatcttgggtctgattttccgacaccaaaggagatatgtaagggtttgaacaagttcgtgattggtcaggaaagagccaaaaaggtactttcagtggcagtttacaatcactacaagaggatatatcacgaatcatcacagaaacggtctgcgggagaaacagatagcactgcagcgaaaccagcagatgatgatatggtagaactagagaagagtaacattctcctgatgggaccaactgggtcagggaagacactacttgcgaaaaccttggcacgatttgtaaatgttccttttgtcattgcggatgcaaccaccctgactcaggctggttatgtgggagaggacgtcgagtctatattatacaaacttctcacagttgcagattataatgttgcagctgcacagcaagggattgtttacattgatgaagtcgacaagataacaaagaaggcagaaagccttaacatcagcagagatgtatcaggagaaggtgttcaacaagcattgctaaaaatgctggaaggaacaattgtaaatgtacctgagaaaggcgctaggaaacaccctagaggtgacaatatccagatagacacaaaggacatactcttcatatgtggtggtgcttttgtagacattgaaaagactatctcagagaggcgccatgattcttcaatagggtttggtgctcctgtacgtgccaacatgagggctggtggtgttacaaacgccgctgttgcatcaaacctaatggaaactgtggaaagcagtgacctgattgcttatggtttgattcctgaatttgttggacgatttccagttctcgtcagtttgtctgctttgactgagaaccagcttatgcaggtgttgacagaacccaagaacgctcttggaaagcaatacaaaaagatgtaccagatgaatagtgtaaagctgcatttcacagaaagcgcactgcggcttatagctagaaaagcaataacgaaaaacacgggtgctcgtggcttaagagctcttctagaaagcatcctcatggactctatgtacgagattccggacgagggtacaggcagcgatatgatagaagcggttgtggtggatgaagaagcagttgaaggagaagggcgtcgaggctctggagctaagattctccgtggtaaaggagcattggctcggtatctctctgaaaccaattccaaagattccccacagacgacaaaggagggatcggatggagaaactgaagtggaggcagagattccatctgttgtagcaagtatgtaa

SEQ ID NO: 2316 - DNA, 1035 bp, Arabidopsis thaliana
atggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaa

SEQ ID NO: 2317 - DNA, 1953 bp, Arabidopsis thaliana
atgggttcttctcacattcctcttgatccgtctctaaatccgtcaccttcactgatcccaaagcttgaaccagtcactgaatcaacccaaaacttggcctttcaacttccaaacacaaacccacaagccctaatttcatcagccgtctccgatttcaacgaagccacagacttttcctcagattacaacaccgtcgccgagtcagcccggtctgctttcgctcaacggcttcaacgtcacgatgatgttgcggttcttgattccttaaccggagcaatcgtaccggttgaggagaatccggaaccggaaccgaatccttactcaaccagtgactcttcaccgtcggttgctactcaacgacctagaccgcagccacgttcgtcggagctagtgaggatcactgatgttggacctgaaagtgagagacagtttcgtgaacatgtgaggaagacgagaatgatttatgattctcttaggatgtttttgatgatggaagaagctaaacgtaatggggttggtggaagaagagctagagctgatggtaaagctggtaaagctggttcaatgatgagagattgtatgttgtggatgaatcgtgataaacgaatcgtcggttcgattcccggtgttcaagttggggatatcttcttctttaggtttgagttatgtgtcatgggcttacatggacaccctcaatctgggatcgattttcttacagggagtcttagttctaatggggagccaatagctactagtgtgattgtttctggtgggtatgaggatgatgatgatcaaggagatgtgattatgtatacaggtcagggtggacaagataggcttggaaggcaagctgaacatcagaggctggaaggtggaaaccttgcgatggaacggagtatgtattatgggattgaagtgagagttattagagggttgaagtatgagaatgaggtttctagtagagtttatgtttatgatgggttgtttaggattgttgattcttggtttgatgttgggaagtctggtttcggtgtgtttaaatatcggttggagaggattgaaggacaggctgagatgggtagttcggtgttgaagtttgctaggactcttaagactaatccattgtctgtgagaccgagaggttacatcaatttcgatatctcgaatgggaaggagaatgttcctgtctatttgtttaacgacattgacagcgatcaagaacctttgtattatgagtatcttgcgcaaacttcgtttcctcctggcttatttgttcagcaaagtggtaatgcaagtggatgtgactgtgtcaatggttgtggcagtggctgcctttgtgaagccaagaattcaggtgagattgcttatgattataatgggacgctaataagacagaaaccgttgatacatgaatgtggatcagcgtgtcagtgccctccaagctgtcgaaaccgtgtgactcaaaagggtttgaggaataggctagaagtgtttaggtcactggaaacgggttggggagttcggtctttggatgtattacatgctggtgcttttatttgtgagtatgctggggttgctttgacaagggaacaagccaacattctgaccatgaacggtgatacattggtatatcctgctcgtttctcttctgcgagatgggaagattggggagatctgtctcaggtccttgctgatttcgagcggccttcttatcctgatattcctccggttgatttcgcaatggatgtgtccaagatgaggaatgttgcttgttacataagccacagtactgatccgaatgtcattgtccagtttgtactccatgatcacaacagtctcatgttccctagagtcatgcttttcgctgctgaaaacatccctcccatgactgagctcagccttgattacggagtagttgatgattggaacgccaagcttgccatttgtaattaa

SEQ ID NO: 2318 - DNA, 912 bp, Arabidopsis thaliana
atgggtttcaaactcaactctcttttccttcttctttcgcttctcatactcacaatcttgtccggagccgaccaagccttggcttacgtcaagaaaccacatgtgagccaacgcaacaaaacggcgttagcagccgtcgccggaagaggaggaggaaaagagatgttgaaagggaggaagcagacgagtggttgtaacttgtttcaagggagatgggttttcgatgcttcttaccctttctacgattcatccacgtgccctttcatcgacggtgagttcgactgtctcaaattcggccgaccagacaaacagttccttaagtactcttggcagcctgattcatgcaccgtcccaaggtttgatggggaagcgtttttgaagaaatggagagggaaacgagtgatgttcgtgggtgactcactgagtctaaacatgtgggaatcgttggcatgtatgatacattcgtgggattttataagagatgggtcttcactgatgagagacatggaccgccttgatgctttcaacaaaggactcaccacttggggtcaatgggttgatcaaaatgttaatgtttcgcaaacccgagtcttcttccaaggcatttctcccactcactacatgggaagggaatggaacgagccgaggaaaacttgcaacgggcagatgcaaccgttgaccggatcaacatacccaggtggttcacttcctgcagcaagcattgtgtctcgagtattaagcacgatgagaacgcccgtttacttactcgacatcacaactctatctcaactgagaaaagatgctcatccatctacatatggaggcgatggcggaacggattgcagtcactggtgccttcctggcttgccggatacttggaaccagcttctctatgcagctctttcgatgtga

SEQ ID NO: 2319 - DNA, 186 bp, Arabidopsis thaliana
atggcgaaagctggagggatcacgaacgcagtaaacgtaggaatcgctgttcaagcagattgggagaatcgagaatttatctcacatatctctcttaatgttcgtcgtctcttcgaattccttgttcaatttggtaaacctcactctctcacttatttctctgtgttgggttttgaattcaattga

SEQ ID NO: 2320 - DNA, 237 bp, Arabidopsis thaliana
atgggatctaaacctagctcgctggctgatgaagtagccattattgttgagcaagtagacaaggttatggggatggttttttggtgccccctctactgggaatctatagaactccttgcaaaagatgaggtttcacgagccatattttatggactaacagaaggatgtaagcttgattatcttaaatacaagacaaaagcttccatggtcccagaaatgacacggttttatagttaa

SEQ ID NO: 2321 - DNA, 870 bp, Arabidopsis thaliana
atgtcaacggctctgattaactctattacctacttcctctccgaacatccatacatcgtcggattccgttggagtaacagccaatcatggggctccacgtggtctttcctcttcacatcaatctccctctatatcgccgtctcatcctccctccacatcctcctctccgccgtacgccgaagtaaccgttccgttcctttaggtcacatccccgaaatccacagccttctcatgtcgatcctctccgccaccattttcgccggaatcctcctctccgctgccgcagagatccgtgacacacggtggttatggcggcggagcaaaaccgccactcctctccaatggcttctctgtttccctctcgggactcgtccctctggtcgtgtcttcttttggtcatacgtgttttacctcacgcgctttctccacatgttccgtacgattttcgccgttttacgtagccggaggctcgccgtgtctcagctcttttgtaactccgtcatggccttcacgtctttcctctggctagaattctcgcagtcgtaccagattctagcgattctatcgacgactctggtttactcggtggtttacggttatagattctggaccgggtttggtttacccggttcggctttcccttcgtttgtggtgaattgtcagttggttctcgtgggctgtaatctcgtgtctcacgctggggttcttacgatgcacctctttaaaggtggatgcaatgggattggcgcgtggggtttaaactcggttctcaacggtgcgattttgttgctttttcttaacttttatgtgagaatgcattcgccaatgcgacgccatattaataaaatgaatagccaacgtaacgcttaa

SEQ ID NO: 2322 - DNA, 1608 bp, Arabidopsis thaliana
atggctgcgtctcccaagataggcatcggtattgcctccgtctcatcgcctcaccgtgtctccgccgcctcatccgctctttctcctcctcctcatctcttctttctcactactactactaccacacgtcacggcggctcctatctcctccgtcaaccaacccgaactcgctcttctgattccctccgcctcagagtctccgccaccgccaattctccgtcttcttcttcttcaggaggcgagattatcgagaatgtagtgattataggctccggtcccgccggttatacggcggcgatatatgcagcgcgcgccaatttgaagccggtggtttttgaagggtatcagatgggcggagttcccggtggacagttgatgacaactactgaagttgagaattttccgggattcccagacggtatcacgggtcccgatttaatggagaaaatgagaaagcaagcagagaggtggggagcagagttgtatccagaagatgttgaatctcttagtgtcacaactgctccttttactgtgcaaactagtgaacgtaaggtcaagtgccatagtattatatatgccactggcgctacagcaaggaggttaaggttacctcgagaggaagaattctggagtagggggataagtgcttgtgctatctgtgatggagcttcgcctttatttaaggggcaagtacttgccgtggttggaggaggagatacggctacagaggaagccttgtatctcacgaaatatgcccgtcatgttcatttgcttgttcgcagagatcagttgagagcttccaaggctatgcaagatagagtgatcaacaatccaaacatcacagtgcattacaacacggaaaccgtggacgtattgagcaacaccaagggacagatgtctggcattctactcagaagacttgatacgggtgaagaaactgagctggaggcaaaaggattgttttatggaatagggcattcgccaaacagtcagttattggaaggccaagtcgaactcgacagctccgggtacgtcttggttcgggaaggaacatcaaatacatcagttgaaggtgtatttgctgcaggagatgtgcaggaccacgaatggagacaagctgtaactgctgctggatcaggatgcatagctgctttgtcagccgagagatacctcacaagtaacaatcttcttgttgaatttcaccagcctcaaactgaagaggccaagaaagaattcacacaacgggatgtccaagaaaagtttgacatcactcttacaaagcacaagggacagtatgctcttagaaaactataccatgagagtccaagagttatattggtactatacacttcaccaacatgtggcccctgtaggactctgaagcctattttgaacaaggtggtcgatgagtataaccatgatgtgcattttgttgagattgacatcgaggaagatcaagaaattgctgaagcagctggaattatgggaaccccatgtgtgcagttcttcaagaacaaggaaatgctcaggttaggaaacgttctctcagttttaaaattgcatagattattgtgttcaggtttggctaaagattccgagtctgtgtag

SEQ ID NO: 2323 - DNA, 489 bp, Arabidopsis thaliana
atgggacaagtctttaacaagctccgaggtaaagagtggagacataagcaggtacaagcgatatgtgatcgtgttttcgatcggttcaagatgcaaaccggaagagccaatcttacgtttgaagagttatacatcgctgttcttctcgtttacaatgacataaacaagagattgcctggtcctcatttcgatccaccttctaaggatctagtcaatagcattatgacggactgtgatatcaacttggatggagaacttgatagggaagagtttgtgaagtttattgagcagattacggctgagacgtttaacgtggttagtcagggtttgatcatagctttgattgttgctcccactgtggctattgcgacgaagaaggccacggaaggtgtccctggagttggcaaagttgtgcagaagctgcctacttcaatctatgcttctcttgtgactcttgcagttatgtgggtgaattctgattcaagttaa

SEQ ID NO: 2324 - DNA, 2118 bp, Arabidopsis thaliana
atgtcttgggacgatggatcacacgcaaaggtgaagaaagtgcagctaaccttcgatgagatcatctactcaatccaggtcacgtacgacggagccaccgctcttcaatcccagcttcgcggctccgttggtcccaaatctgctgagttcactttggctccggacgagtacataacggccctttctgcttacggcaaatcgttgagtacgcaagaagttattacggcgttgactttcacaaccaacaagacttcttatggaccttacggtaccaaatccggtttccagatttctgctccggaagccaccggtaaacagatctccggtttccttggtaccagcggcaatgttctcaacaccatcgacgttcactattctcccatacctactggaggaactggcaccggaggaactggcaccggaactggcaccggaactggcactggaactggcactggcaccggaactggcactggaactggcactggaactggcaccggaggaactggcactggaactggcaccggtactggaggaactggcactggaactggcaccggaggaactggcactggaaccggcactgggactggcactggaaccggcactgggactggcactggaaccggcaccggaggaactggcactggaaccggcaccggaggaactggcactggaaccggcactgggaccggcactgggaccggcaccggaggaactggcactggaaccggaactggtaccggttcaggtgctcagaaattggaagcacaaggcaacagtacaggaggtacatcatgggacgatggatccgattacgatggcgtgaccaagatatacgcaagctacggtggggaaggtattcaatacgtcaagttcgactatgtgaaaggtggagtaacaaaacaaggagttctacacggtaaacaacaaagtagacaaaatccaagagagtttgtgattaaccatccggatgagtatcttgtttctgttgagggttggtatgaaaccgtcatgctaggaatccagttcaaaacgaacttgaacacttatgaggtcagcatctatcctttcgaacctagtactgatactaaatttactcttcaagttcaagacaagaagatcattggatttcacggtttcgcgggcaaccatgttaattccattggagcttacttcgttccaaaatcctccaccactcctgttccttcaacccctttgaagctgaccgcagaaggtggtgagacaggagctgtatgggacgatggttctcacgatgatgttaagaaagtttatgtaggacaaggccaagatggtgttgcagctgtcaagtttgaatacaaaaatggttctcaggttgtttttggagatgaacgtggaacgagaacattgctaggattcgaagagttcgagcttgaatcagacgaatatataacatccgtggaaggatactacgaaaaaaactttggagttgatactgtagtgacaacgctgattttcaagactagcaagaacaaaacagctggaccgtttgggattgtatctggcacaaagtttgaattcaagaaggaaggttacaagatcactgggttccacggacgagctggtgagtatgttaatgctattggagcttatttagctccatcaggcaccacccctttgactcctgcaacacaatcccaaaagctagaaggagctggtagtgaggcaggaactttatgggatgatggtgctttcgacggtgtaaggaaagtgtctgtaggacaagcccaagatggtattggagcggtctcgtttgtgtacgacaaagcaggtcaggttgtagaaggaaaagaacatggaaaacccacattgcttggatttgaagagtttgagcttgactatccaagtgaatacatcacggcagttgatggcacctacgatgcaatctttgggaatgaaccaatcgtaaatatgcttaggttcacgactaataagcgagtatctattccttttggaataggagctggcacagccttcgaattcaagaaggacggtcaaaagatagttggtttccatggaagagctggtgatctacttcacaaatttggagtccatgtcgcgccaataaccaaataa

SEQ ID NO: 2325 - DNA, 1059 bp, Arabidopsis thaliana
atgaatttctcttattcttccttgtcaacttggacaaccctaatgacattgggttgtcttctgcttcattcatccatttccagtgctcagctaaccccaactttctatgacaatacatgtccaagcgtctttaccatcgtacgggataccatagtaaacgagctaagatcggatcctcgtatcgctgcaagcatccttcgtcttcacttccacgactgtttcgtcaatggctgtgatgcatcgatcctgttagacaacacaacatcctttcgaacagagaaagatgcggctccaaacgcaaactcggctcgaggatttccagtgatcgatagaatgaaagcagcagtagagacagcatgtccaaggactgtttcatgcgcagatatacttaccatcgcagctcaacaagctgtaaatttggcaggaggtccttcttggagggttcctttggggagaagagatagcttacaagcattctttgctctcgctaatacaaatcttcccgctccattcttcactctcccacaacttaaggccagttttcaaaatgttggacttgaccgtccctctgatctcgttgcactctctggtggtcacacatttggtaaaaaccagtgccaatttattatggatagactatacaactttagcaacactggtttacccgaccctactcttaatactacatacctccagacacttcgtggacaatgtccccgcaatggtaaccagaccgtcttagttgatttcgatctacgcacaccgacggtttttgacaataaatactatgtgaatctgaaagagctaaagggacttatccagacggatcaagagttgttttccagccctaatgccactgacacaatccccttggtgagagaatacgctgatggcactcaaaaattcttcaatgcttttgtggaagcaatgaatagaatgggaaacattacacctctcactggaactcaaggacaaatcagacagaattgtagggtggttaactccaactcgctgctacatgatgtggtcgaaatcgttgactttgtcagctctatgtaa

SEQ ID NO: 2326 - DNA, 1938 bp, Arabidopsis thaliana
atggcgagcacggaagctctcttacccgtcacgtccctacaagatccattatctgagtcaagatccgaccagatcccggagacccgtcggagacgacccatcaaagttcatcttgcagtctattccggtttgctcttgatcgctttgtacgtcactctcatcgtcacacacgacggctccaaggctgaaatagcgacggagtcacgtcctcgtatggccggcgtgtcggagaagagcaacgacggggtttggatatcatccgatgatgggaaagttgaagcgttcccgtggaacaatactattttgtcgtggcaacgcacggcgtttcatttccagcctgagaaaaattggatgaacggtccattgttctataagggatggtaccatttcttctatcaatacaacccaaatgcagctgtgtggggtgacattgtttggggtcacgccgtgtcaaaagaccttatccactggctttatctcccaatagccatggttcctgaccaatggtacgatgcaaacggtgtctggaccggttcagccacttttctagatgatggctccattgtcatgctctacaccggttccactgacgaattcgtacaggttcaaaaccttgcctatcctgaagacccaagcgacccacttttgttgaaatgggtcaagttctccggtaaccctgtcctcgtaccgcctccaggtattggtgcaaaggacttccgtgacccaacaacagcctggaagacatcttctggaaaatggcgaatcaccatcggttccaaaatcaatagaaccggaatatctctcatttatgacactaccgatttcaaaacctacgagaaacacgaaaccttgttgcaccaagtccccaacaccggaatgtgggagtgcgttgatttttacccggtgtcgaagactcagctcaatgggctcgatacttcggtcaacggaccagatgtcaagcatgtcatcaaggctagcatggacgatactagaattgaccattatgccattgggacgtacgatgattcaaacgctacatgggtccccgataatccttctatcgatgtcggaatcagtaccggtttgagatacgattacgggaaatattatgcgtcaaagacgttttacgatcaaaataagggacgaagaatcttatggggttggatcggtgaatctgacagtgaagctgctgatgtacaaaagggttggtcttctgttcagggcatcccaagaactgttgtattggacacaaggacgcataaaaacttagtccagtggccagttgaggaaatcaaatcattgagactaagcagcaagaaatttgacatgactattggaccagggactgtggttccggtcgatgtgggttccgccactcagctagacatagaggctgagttcgagatcaagaccgatgatctcaagttattctttgatgatgactctgtggaggccgacaataaattcagctgcgaaacaaacggaggctccacagcgcgtggtgctttagggccttttggattctcggttctcgctgacgagggcttgtcagaacaaactccggtttacttctatgtgactaagggaaaacattcaaaactcaatactgtcttctgcactgacacctcaaggtcgactttggcaaacgatgtggtgaaaccaatctatggaagcttcgtaccggtcttaaaaggagagaaattgacaatgagaatcttggttgatcattcgatcgtagaaggattcgcacaaggtggaagatcatgtattacctcaagagtatatcccacaaaagctatctatggagctaccaagctcttcttgttcaataacgccattgatgcgaccgttacggcgtcgtttacggtctggcaaatgaacaatgcttttattcatccttactcttcagacgatctcggtgttccttccagcacctga

SEQ ID NO: 2327 - DNA, 873 bp, Arabidopsis thaliana
atggccgcaacatccgccgctgctgcagctgcttcttccatcatgggtactcgggtggctcccggtatccatcccggttcaggtcggttcacagccgtgttcggtttcggaaagaagaaggcagctcccaaaaagagtgccaaaaagacggtgactacggaccggcctctttggtacccaggcgccatttctcctgactggcttgatggttccttggttggagattacggttttgatcccttcggtttaggcaaaccggccgagtatcttcaattcgatatcgattcactagaccagaatctggctaagaacttggccggagacgtgatcggaacccgtacggaagctgccgacgccaaatcgacgccgtttcagccgtacagtgaggtgttcggaatccagagattcagggaatgcgaactcatccacggacggtgggcgatgctcgctactctcggcgctctctccgtcgaatggcttaccggcgttacatggcaagacgctggcaaggtggagcttgtagatggatcgtcctacttggggcagccattacctttctcgatctcgacattgatatggatcgaggtgttagtgatcggctacatcgagttccagcgcaacgccgagcttgattcggagaagcgtttataccccggaggcaagttctttgacccgctaggtttagcggctgacccggagaagactgctcaacttcagttagctgagatcaagcatgcacgtcttgcgatggtcgccttcttgggattcgcggttcaagcggctgcaacaggtaaaggtccactcaacaattgggctactcacctcagtgatccactccacaccaccatcatcgataccttctcctcatcttaa

SEQ ID NO: 2328 - DNA, 432 bp, Arabidopsis thaliana
atggcgatgacgacagcatctacggtatttgttctaccggccaatgtcacctcggtcgccggcgcttcgtcgtccaggagctccgtgtctttcttgccgatgagaaacgccggttctaggctcgtagtcagggcagccgaagatcctgctccggcttcctcttcttcaaaagattctccggcagctgccgctgctccggatggagctactgccaccaaacccaagccaccaccgattggtcctaagagagggtctaaggtcaagattctaaggagagaatcctattggttcaagaacgttggatcagttgttgccgttgatcaggaccctaagactcgatacccggttgtggtccggttcgcaaaagtcaattacgccaacatatcgaccaacaactatgcattggatgaggtcgaagaagttgcagcttaa

SEQ ID NO: 2329 - DNA, 978 bp, Arabidopsis thaliana
atggagaagaatacttctcaaaccatcttctccaacttttttcttctccttctcctttcttcatgtgtctctgctcagctccggacaggtttctaccagaactcatgtccgaacgtggaaaccattgtacgtaacgctgtccgtcagaaattccagcagactttcgttaccgctccggccactcttcgcctcttcttccacgattgcttcgttcgtggatgtgatgcgtcaataatgatagcatcaccatcggagagagaccatccagatgacatgtcattggccggagacggattcgacacggtggtgaaggcgaagcaagccgttgatagcaatcccaattgccgcaacaaagtctcatgtgctgacattttggctctcgccactcgtgaagtcgtcgttttgaccggaggaccaagctacccggtggagctagggaggagagatggcagaatctccacgaaggccagcgttcaaagccaattgcctcagcccgagtttaacctaaaccagctcaacggcatgtttagccgtcacggcctctctcaaaccgatatgattgccctctcaggagcacacactataggatttgcacattgtggaaaaatgtcaaagagaatatacaattttagccctacaacacgtatcgacccgagtataaaccgtggatacgtggttcagcttaagcaaatgtgcccgatcggtgtcgacgtaagaatcgcaatcaacatggatccgaccagtccacgtactttcgataatgcttatttcaagaatctccaacaaggaaagggtttgttcacgtcagatcaaatcttgttcacagatcaacggtcaagatctacagttaattcgtttgccaatagtgaaggagcttttagacaagctttcatcacagcgatcacgaagttaggtcgggttggtgttttgactggtaatgctggtgagattcgaagggattgttcacgtgtcaattag

SEQ ID NO: 2330 - DNA, 1077 bp, Arabidopsis thaliana
atgtcttccttcacctccaaattcgccgatgagctgattgctaacgctgcttacatcggaacacctggaaaaggtatccttgcggcagatgaatcaactggtactattgggaaacgtctcgctagcatcaacgttgagaacgttgaatccaacagacgtgctcttcgtgagcttctcttcactactcctggagctcttccttgcctcagtggtgttatcctctttgaagaaactctttaccagaagagctctgatggtacgccttttgttgatatgttgaagagtgcaggagttttgcctggtattaaggttgataagggtaccgttgagcttgctggaaccaatggtgagactactactcaaggtcttgatggtcttggtgaccgttgcaagaaatactacgaggctggtgctcgtttcgccaagtggcgtgcggttcttaagattggtgttaatgagccatctcagttagctatccatgagaacgcttatggattggctaggtatgctgtcatttgtcaggagaacggtcttgtgccgattgtggagcctgagattcttgttgatggctctcatgacattcagaagtgtgccgcggtgacagagcgtgttcttgcagcttgctacaaggctctgagtgatcaccatgtcttgctagaaggaacactcttgaaacctaacatggttactccaggatcagagagtgcgaaggttgcaccagaggtgattgctgagcacactgtccgtgctcttcagaggacagttccagctgctgttccagccatagtgttcttgtctggtggacagagcgaggaagaggcgacaagaaaccttaacgcgatgaaccagttgaagacaaagaagccttggtcgttgtctttctcctttggaagggcgttgcagcagagcactttgaagacttggggaggaaaagaggagaatgtgaagaaggctcaagaagcgttcttggtcagatgcaaagctaactctgaagcaacacttggtgcttacaagggtgatgctaagctcggtgaaggtgcagctgagagccttcacgttaaggattacaagtactga

SEQ ID NO: 2331 - DNA, 1473 bp, Arabidopsis thaliana
atggaaaaagggttactcaggaagagcttaagcatacgtgagagaaagttccctaacgaagacgctttcttagaatccggtttatcgaggaagtctccgcgagaggtcaagaaacctcaaaacgacgatggtgaatgtcgtgttaccgcctctgttttcctcagcacctttgttgccgtatcaggctccttctgtaccggttgtggcgttggtttttcatcgggtgcacaagcagggattaccaaagatttatctctctccgttgcagaatactcaatgttcgggtcgatcttgacattaggaggcttgatcggtgcagtattcagcggtaaagtcgctgatgtcttgggaagaaaacggacgatgttgttttgcgaattcttctgtatcacaggctggctttgtgtagcattggctcagaatgcaatgtggctggactgtggaagattgttacttggaatcggcgttggtatatttagctacgtgattccggtgtatatagccgaaattgcacctaaacatgtccgaggatcgtttgtgttcgccaatcagttgatgcaaaattgcggaatttcactcttcttcatcattggcaattttattccatggagactactaacagtagtcggattggtgccatgtgtgttccacgtcttttgtttatttttcatccccgaatctccaagatggctggcgaagttaggtcgtgataaagaatgccgatcttcgttgcaacgccttaggggatctgacgtcgatatttctcgtgaagcaaacacaattagagataccattgacatgacagaaaacggtggtgaaactaagatgtctgaattgtttcagagacgatacgcatatccgttaattatcggagttggtttaatgtttttgcaacaattgtgtgggagctccggtgttacctattatgctagtagcctcttcaacaaaggaggatttccaagtgctattggcacatccgtaatagccacaattatggttccaaaagcaatgctggcaacagtcctagtcgataaaatggggaggagaacgctcctaatggcttcttgttctgcaatgggtttgagtgctttgctcttaagtgtttcttacggtttccagtcgtttggcattcttccagaactcactcccatcttcacttgcatcggcgtcttgggtcacattgtgtcatttgccatgggaatgggaggactaccatggattataatggctgagatatttccgatgaatgtgaaagtgtcagctgggaccttagttactgtaaccaattggttatttggttggattatcacatacactttcaattttatgctagaatggaatgcatcaggaatgttcctcatcttctcaatggtctccgccagttcgatcgtatttatatactttttggtacctgagacaaaaggccgatcacttgaagaaatacaagcactgctcaacaactctgtgcaataa

SEQ ID NO: 2332 - DNA, 1161 bp, Arabidopsis thaliana
aagctttcactaaacgacaacaacagagacgacgatgatgatactcttcattttactccgttctccgccgttaaacctttcttcctcctctgtacctccgtcgcgttatcgttttcactcttcgccgcttctcccgccgttgaatctgcctcggcgtttgtagttagtactccgaagaaacttcaaactgatgagctcgcgacggttcgtttgtttcaagagaacactccttccgttgtttacatcactaatctcgccgtgaggcaggacgcgtttacattggacgttcttgaggtacctcaaggctctggttcaggatttgtgtgggataagcaaggtcatattgttaccaattaccatgttattcgtggtgcttctgatctcagggtcactcttgctgatcaaacaacatttgatgcaaaagttgttggatttgaccaagataaggatgttgcagtattacgtattgatgcaccgaaaaacaaattaagacctatacctgttggagtctctgctgatctgcttgttggccagaaagtctttgccattggcaatccatttggacttgatcatactctcacaactggtgttataagtggtttgcgaagagaaattagttctgctgcaactggtcgtccaattcaagatgtgatacagacagatgcagccattaaccctggtaacagcggaggacctcttctagatagctcaggaacgttaattggtataaacacagccatttattctccttctggtgcatcttctggagtgggcttttcgatcccagttgatacagttggtggtatcgttgatcagctggtgagatttggtaaagtcaccagaccaatcttaggtatcaaattcgcaccggaccaatctgttgagcaattgggagtgagcggtgtgctcgtcttggatgctcctccaagtggtccagccggcaaagccggacttcagtcaacaaaacgtgatggttacgggagactagtactaggagacataatcacgtcggtgaacggtacaaaagtctctaacgggagtgatctgtaccggattctcgatcaatgcaaagtcggcgatgaggtgaccgtagaggttctaagaggcgatcacaaggagaaaatctctgtaactctcgaaccaaagccggacgagtcttag

SEQ ID NO: 2333 - DNA, 1125 bp, Arabidopsis thaliana
atgggaagagcaccgtgttgtgataaggccaacgtgaagaaagggccttggtctcctgaggaagacgccaaactcaaagattacatcgagaatagtggcacaggaggcaactggattgctttgcctcagaaaattggtttaaggagatgtgggaagagttgcaggctaaggtggctcaactatttgagaccaaacatcaaacatggtggcttctccgaggaagaagacaacatcatttgtaacctctatgttactattggtagcaggtggtctataattgctgcacaattgccgggaagaaccgacaacgatatcaaaaactattggaacacgaggctgaagaagaagcttctgaacaaacaaaggaaagagttccaagaagcgcgaatgaagcaagagatggtgatgatgaaaaggcaacaacaaggacaaggacaaggtcaaagtaatggtagtacggatctttatcttaacaacatgtttggatcatcaccatggccattactaccacaacttcctcctccacatcatcaaatacctcttggaatgatggaaccaacaagctgtaactactaccaaacgacaccgtcttgtaacctagaacaaaagccattgatcacactcaagaacatggtcaagattgaagaagaacaggaaaggacaaaccctgatcatcatcatcaagattctgtcacaaacccttttgatttctctttctctcagcttttgttagatcccaattactatctgggatcaggagggggaggagaaggagattttgctatcatgagcagcagcacaaactcaccattaccaaacacaagtagtgatcaacatccaagtcaacagcaagagattcttcaatggtttgggagcagtaactttcagacagaagcaatcaacgatatgttcataaacaacaacaacaacatagtgaatcttgagaccatcgagaacacaaaagtctatggagacgcctcagtagccggagccgctgtccgagcagctttgggcggagggacaacgagtacatcggcggatcaaagtacaataagttgggaggatataacttctctagttaattccgaagatgcaagttacttcaatgcgccaaatcatgtgtaa

SEQ ID NO: 2334 - DNA, 1833 bp, Arabidopsis thaliana
atgggtaatacttgtgttggaccaagcagaaatggcttcttgcaatctgtttcagctgcaatgtggcggccaagagatggagatgattcggcttccatgagtaatggagatattgcaagtgaagctgtttcgggagagcttcgatctcgattatctgatgaagtccagaataaacctcctgaacaggtcacaatgccgaagccagggactgacgtcgagaccaaggacagagagattcgaactgaaagcaagcctgaaacgctagaggagataagccttgagtccaaaccagagactaagcaggagaccaagtcagagaccaagccggagtcaaaacctgatcctccagctaaacctaagaagcctaaacacatgaagagagtgtcaagtgcagggcttaggactgagtcagtgttgcagaggaagactgaaaacttcaaggaattctattccttgggaaggaaactcggacaagggcaatttgggacgacttttttatgtgtcgagaagactacggggaaggagtttgcctgcaagtcgattgctaagaggaagctattgactgatgaggacgttgaggatgtgagaagagaaattcagataatgcatcacttggctggtcaccctaatgtcatctccatcaaaggagcttatgaggatgttgtggcagtgcaccttgtaatggagtgttgtgcaggcggcgagctttttgacaggatcattcaacgcggtcactacacagagaggaaagcggctgagctcactagaaccattgttggggttgtagaggcttgccattctcttggtgttatgcatcgagacctcaagcccgagaattttctgtttgtcagtaaacacgaagattccctcttgaagacgattgattttggactctccatgttctttaaaccagacgatgtttttacagatgttgttggtagcccatattatgttgccccagaagttcttcgaaagcgttatggccctgaagctgatgtctggagtgctggagtgattgtgtacattttattaagcggagttcctccattctgggctgaaaccgaacaaggtattttcgaacaggtcctccacggtgatcttgacttttcgtccgatccatggccaagtatatctgaaagtgcaaaggatttagtgaggaaaatgcttgtcagggatcccaagaaaaggttaactgcccaccaagtattatgtcatccatgggttcaagtcgacggtgtggctccagacaagcctttggattctgctgttctgagccgtatgaagcagttttctgcaatgaacaagttcaagaaaatggctcttagagtcattgctgagagcttatctgaagaagaaatcgccggcttgaaagaaatgtttaatatgatagatgcggacaagagtggtcagataactttcgaagaactgaaagcaggactaaaacgagtaggggcgaatctcaaagagtctgaaattctcgacttgatgcaagctgctgatgtggacaacagcggaacaatagattacaaagagttcatagctgcaacattacatctaaacaaaatagagagagaggaccatttgtttgcagcctttacatactttgacaaagatgggagcggctatatcaccccagacgagcttcaacaagcttgtgaggagtttggtgttgaggatgtccgcatagaagaactgatgcgcgatgttgatcaagacaatgacgggcgaatagactacaacgagtttgtggcgatgatgcagaaaggaagcatcacaggaggacctgtgaaaatgggtctagagaaaagctttagcattgctcttaaactctag

SEQ ID NO: 2335 - DNA, 498 bp, Arabidopsis thaliana
atgagacaaaagggtcacagacacggaagaacagtatcgccttgtgccggctgtaaacttctccggcgaaaatgtgtgaaagattcatgcgtctttgctccgtattttccggccaaagagccttacaagtttgccattgtccacaagatttttggtgctagtaatgtcaataagatgttgcaggagctgtcggagaaccaccggagcgacgccgtggattcgatggtgtacgaggccaacgcgaggatacaagatcctgtgtatggatgtgtagggacaatttcgtcgttacacagacaactggaaactctccaaactcagctcgcttttgctcaagccgagttgattcatataaggacgctccaccgtattcataccaaacccccgccgtacacggcaagtaccgttactttcccctcgaacaaagacttctacagtgacatcgacatggctgttgcgtatacggatgatgccggagacttcctttggtcttgctag

SEQ ID NO: 2336 - DNA, 1083 bp, Arabidopsis thaliana
atgctagttggtccgaaaggggctgggaagagtagccttgttaataagattacaagagtgatcgaagacgacgcgtttctcctagatagagctcaagaatcatttggtaccccgtctaaaggaggaacatactttgttcaggagtatatgatctcgagaggaggttccgcttcattttgcctatatgatacgcgtggattgagccgtatatcatcgtctgataacactagtatgattgagcaatggatgacaaggggcgtgcttcacggcgaacctgtcatctgggcatctgatagctcggatttaaaggatagactcatccgagatggtggtaccggttatgagagaaggaaagtgaattcgattatctttgttgttaatgcggtcgaaatcttgaaatcgatggaatgtgaaacgagctatgcttcgatgataaccacggcctttaactctccgatactattgtttaaagatgataagccagcagtcgttatgactcatggagatatgctttcacgcgaggaacgtgcccgagtacgagttttccttggagaacttctcgaaagccgggacacagccaccgcgataacaatctgcaacttgctatgctatagtcttcaacatgctgataagaattttgtgtttcttcccaaaaagaacttcactatatccaaggtgggaggaggaggcctcacaaaatggatcagcttattagacataatatcaattgctctggttttattcatggcattggcgtcaatctggtttgttactcataatcccgtaagcggccaaaaattagctaatgagactcagcaaaaactgcttaaattcccaagtccatggttaaataacctcacacataaggcaaagccgatgcgtcgctttgggcctaagcggatcattaaaggtccaaaccttgcatgcgttcaacatcctaagtctgagtttgtgcctgaaagtgagccaataagcattgatttgcatatagctcgacgcttatggttcaacgaagagcaagtggccgaggccgaaccaagctttgattggcgaactactcgacgcttgtggtatgttgagtga

SEQ ID NO: 2337 - DNA, 1566 bp, Arabidopsis thaliana
atggattcttgttgcaactttagcttggggacaaaaactgtcttggccaaagacagtttcaagaatgtagagaacaaatttttgggtgagaagatcaaaggaagcgtcttgaagcctttttcttcagatttgagttccaagaagttcagaaatcgaaaattgaggcccggtgttgcttacgctattgctacctcaaagaatgctaaagaggctttgaaaaatcaaccttccatgtttgagagaagaagagcagatcctaaaaatgtggctgcaatcattctaggaggaggcgatggagctaaactctttcctcttaccaagcgagcagcaacacctgctgttcctgtgggtggatgctataggatgatcgatatcccgatgagtaattgcattaacagttgcataaacaagattttcgtgctgactcagtttaactcggcttccctcaatcgccatttggctcgtacttattttgggaatggcataaactttggagatggttttgttgaggttctggctgctacacaaactcctggtgaagccgggaaaaagtggtttcaaggcacagctgatgctgtgagaaaatttctgtgggtgtttgaggatgctaagaacaggaacattgagaatataatcatcttgtctggagatcacctatatagaatgaactatatggactttgttcagcaccatgtcgatagtaaagccgatattactctttcgtgcgcgccggttgatgagagccgtgcgtcggagtatggactggtcaatattgatcgaagcgggcgtgtagtccatttctctgagaaaccaactggcatcgatctgaaatcaatgcaaaccgatactactatgcatggactgtctcatcaagaagcagcaaaatctccatacattgcgtcaatgggagtttattgtttcaaaaccgaagctttactgaagcttctgacatggcggtatccgagttccaatgactttgggtctgaaattattcctgcagctataaaagatcacaatgttcaaggatacatctacagagactattgggaagacatcggaactattaagagtttctatgaagctaatattgctcttgtcgaggagcatcccaagtttgagttttacgatcagaatacacctttctacacttctcctcggtttctaccacccaccaaaaccgagaagtgccggattgtaaattcggtaatctcacacggatgtttcttgggagaatgcagcatccaacgttccattattggtgaaagatcacgtcttgactatggtgttgagcttcaggatactcttatgttaggagcggatagttaccaaaccgaatctgagatcgcgtctctgcttgcggaaggaaatgttccaattggcattggccgagatacaaagatcaggaaatgcatcattgacaagaatgcaaagatcgggaaaaacgtggtgatcatgaacaaagatgatgttaaggaggctgataggccagaggaaggattctacattcgatctggaatcactgtggttgtcgaaaaggccaccattaaagacggtactgtgatatga

SEQ ID NO: 2338 - DNA, 792 bp, Arabidopsis thaliana
atggcgtacagtgcgtgtttcctacaccagagcgcattggcttcatcagccgcacgatcatcatcttcctcctcatcccagcgtcacgtgtcgctctccaaacctgttcagatcatctgtaaagctcaacagtctcatgaagacgataactccgccgtctcccgccgtcttgctctcactctcctcgtcggcgccgctgctgttggttccaaagtatctcctgctgatgccgcctacggtgaagctgcaaacgtgtttgggaagccaaagacgaacacagacttcttgccatacaatggagatgggttcaaagtgcaggttccagcaaaatggaacccaagcaaagagattgagtatccaggacaagtccttaggttcgaagacaacttcgatgctactagcaatctcaatgtcatggtcactcctaccgacaagaagtccatcactgattacggttctcccgaagagttcctctctcaggttaattacctcctagggaaacaagcttacttcggtgagactgcctctgagggaggctttgacaacaatgcagtggcaacagcaaacattctggagtcatcatctcaggaagttggtgggaaaccctactattacttgtctgtgttgacaagaacggctgatggagacgaaggtgggaagcatcagctgatcacagcaaccgtgaatggagggaagctttacatctgcaaagcacaagctggagacaagaggtggttcaagggagccaggaaatttgtcgagagcgcagccacttctttcagtgttgcttga

SEQ ID NO: 2339 - DNA, 1245 bp, Arabidopsis thaliana
atggcaggaatggcatctgatggaactcaatatgatcctcgtcagtttgatactaagatgaatgccattctcggcgaggaaggagaggaaacattctacactaactatgacgaagtttgcgacagctttgatgcaatggaattgcaaccagatcttctcaggggtatttatgcttacggtttcgagaagccttctgctattcagcaaagaggaattattccattctgcaagggtcttgatgtgatccagcaagctcaatctggaactggaaagaccgctaccttttgctctggtgttttacagcagctcgatattagtttggttcaatgccaagctcttgttttggcacctacccgagaacttgcccagcaaattgaaaaggttatgagggcacttggtgactaccttggcgtcaaggctcaggcttgtgttggtggaacaagtgttcgtgaggatcaacgtgttcttcagtctggtgttcatgttgttgttggaacccctggtcgtgtctttgacttgttacgcagacaatccctccgtgctgatgcaatcaaaatgtttgttcttgatgaagctgatgaaatgctctctcgtggtttcaaggatcagatatacgacatcttccagcttcttccttccaaggttcaggttggtgttttctctgctacaatgcctcccgaagcccttgagatcacaaggaagttcatgaacaaaccagtcaggattctggtcaagcgagacgagctgactcttgaaggtatcaagcagttttatgtcaatgtagacaaggaagagtggaaactcgagacactatgcgatctctacgagacactggccatcactcaaagcgtcatctttgtgaacacaaggcgtaaggttgattggctaaccgacaaaatgagaagccgtgaccacactgtttcagctacacacggagacatggaccagaacacaagagacatcatcatgcgcgaattccgctctgggtcttcccgtgtcctcataaccactgacctccttgctcgtggtatcgatgttcagcaagtctctctggtcataaactttgacctcccaacccaaccggagaattaccttcatcgtattggaagaagtggaaggtttgggagaaagggagtagcaatcaatttcatgacatcggaggatgagagaatgatggctgatattcagaggttttacaatgtggtcgttgaggagttgccaagcaatgttgctgatcttctctga

SEQ ID NO: 2340 - DNA, 377 bp, Arabidopsis thaliana
tgtcaagcaactgcggaagctgcgactgtgctgacaagacccagtgcgtaaagaagggaaccagctacaccttcgacatcgtcgagactcaggagagctacaaggaggccatgatcatggacgttggtgccgaggagaacaacgcaaattgcaagtgcaagtgcggctcctcttgcagctgcgtcaactgcacttgctgccccaactaatgaagcttctttaatcaaaatgtaatatgaataaaagttgatgtgggctcatctattgagctcatgtctctcttattactactctctagtatggtgtgatgtaatgggttatgacccttctttcccttccctataaaactaaagaaacttgcaagataattgaaaaga

SEQ ID NO: 2341 - DNA, 525 bp, Arabidopsis thaliana
atggcttctctttcagtctcttcctcttcaaccatcatcgattcaagagctcctccttctcgactagcctccgcctccgcctcttctccgtcgtgcatttcacttcccacacttccgattcagtctcatacccgtgccgctaaagccactgcttactgtcggaagattgtgaggaacgttgtgacgagagctactactgaagttggtgaagctcctgccactactaccgaagctgagactactgagttacctgaaatcgtcaagactgctcaagaagcttgggagaaagtggatgacaagtacgctattggttctcttgcctttgctggtgtagtggctctttggggttctgctggaatgatttcggcaatcgataggcttccattggttcctggtgttcttgaacttgtaggcatcggttacacaggatggttcacttacaagaacctggtcttcaaaccagacagggaggctttgtttgagaaggtcaagagcacatacaaagacatattagggagcagctga

SEQ ID NO: 2342 - DNA, 1344 bp, Arabidopsis thaliana
atgagagagatccttcacattcaaggtggtcaatgcggtaaccagattggttccaagttctgggaagtcatctgcgacgagcacggcatcgattccaccggacgttacagtggagacactgcagatctccagcttgaacgtatcaatgtctattacaatgaagcttcaggtggaagatacgttcctcgtgctgttcttatggatcttgagcctggtactatggatagtatcagatccggaccgtttggtcagatcttccgtcctgataactttgtctttggtcagtctggtgctggtaataattgggctaaaggtcattacactgaaggtgctgaacttattgatgctgttcttgatgttgttcgtaaagaagctgagaactgcgattgccttcaagggtttcaggtgtgccattcgttgggaggaggcacaggttcaggaatgggaacactattgatatcgaagatccgagaggagtatccagacagaatgatgctcactttctctgttttcccatctcctaaagtctctgacacagtcgttgagccttacaatgcaactctctctgtccatcagcttgtagagaacgctgatgaatgcatggtcctcgacaatgaagctctctacgatatctgcttccgtaccctcaaactcagcactcctagctacttgaaccatttgatctccgcaacaatgagcggtgtgacttgctccttaaggttccccggacaactaaactctgacctcaggaaactcgcggtgaacctaatcccattccctcgtctccatttcttcatggtgggttttgcgcccctcacttcccgtggctcgcaacaatacatctcactcaccgttcctgagctgactcaacaaatgtgggactccaaaaacatgatgtgtgcagctgatccacgtcacggacgttacctcacagcctctgctattttcagaggacagatgagcacaaaagaagtcgacgagcaaatcctaaacatacagaacaagaactcgtcttacttcgttgagtggatcccaaacaacgtgaaatccagcgtttgtgatatcccaccaaaggggctcaaaatggcggcgacgtttgtgggtaactcgacgtcgattcaagaaatgttcaggagagtgagtgagcagttcacggctatgtttaggcgtaaagcgtttctgcattggtacacaggagaaggaatggacgaaatggagtttacggaagctgagagcaatatgaatgatttggtcgctgaataccaacagtaccaagatgctactgctgatgaggaaggtgagtatgatgttgaagaagaagaggagggagattatgagacttga

SEQ ID NO: 2343 - DNA, 333 bp, Arabidopsis thaliana
atgagctcgtcgccgttatcttcatctctctttcatcctctgtcgaccttgtcgactcattgccatggtcggagacagaacctctgtttcaatcggaagcaacaacctttcgttgtcagagccgcaaaacttcctgaaggggtgatagtgccaaaagcacaacccaaatctcaacctgcgtttctgggattcacacaaacagctgagatatggaactcacgagcttgcatgattggtctcatcggtactttcatcgtcgaactgattctgaacaagggaatacttgaactgatcggtgtagagattgggaaaggactcgatcttcctctataa

SEQ ID NO: 2344 - DNA, 1635 bp, Arabidopsis thaliana
atgggcaattcatgtcgtggttcttttaaggacaaaatctacgagggcaatcatagtaggcccgaggagaattccaaatccaccaccactactgtttcctctgttcattctcctactacagaccaagatttctccaaacagaacaccaatccagctcttgtgattcctgttaaagaacccattatgcggcgtaacgttgacaatcaatcttactatgttcttggtcacaagactcctaacattcgtgatctttacacgttgagtcgtaagttaggacaaggacaattcgggacaacgtatttgtgtactgatattgccacaggtgttgactatgcttgtaagtctatatccaagaggaaattgatatctaaagaagatgttgaggatgttaggagggagattcagattatgcatcatttagctggtcacaagaatattgttactattaaaggagcttatgaggatcctttgtatgttcacattgtgatggagctttgtgctggtggtgagttgtttgataggattattcatagaggtcattacagcgagaggaaagctgctgagttgaccaagatcattgtcggtgttgttgaggcgtgtcattctcttggtgttatgcatagagatttaaagcctgagaatttcttgttggttaataaggatgatgatttctctcttaaggccattgattttggtctctctgttttcttcaaaccaggccaaatattcaaggatgttgttggaagtccatactatgttgctcctgaggttcttctaaaacattatggtccagaagctgatgtgtggactgctggtgttatactctatatcttactaagtggtgtcccgcctttctgggcagaaacacagcaaggaatatttgatgctgtgttgaagggatatattgactttgatacagacccgtggcctgtcatatccgacagtgctaaagatctgatccggaagatgttatgctctagtccttctgaacgtttgactgctcatgaagtcttgcgtcatccatggatctgtgagaatggagttgcaccggatagagcacttgacccggctgttttgtctcgtctaaaacagttttctgcaatgaataaattaaagaagatggctttaaaggtgatagctgagagcctctcagaagaagagattgcgggtttaagagcaatgtttgaggcaatggatactgataacagcggtgcaatcacttttgatgaactcaaagctggcttgagaagatatggatcaaccttgaaagacaccgagatccgagatcttatggaagcggctgatgtggacaacagcggtacaatagattacagcgagtttattgcagcgacgatccatctgaataaactagagagagaagagcatcttgtctctgcatttcagtactttgacaaagatggaagtggttacatcaccattgatgagctgcaacaatcttgcattgaacatgggatgaccgatgtttttcttgaagacataatcaaagaagtagatcaagacaacgatggacggattgattacgaagaatttgttgcgatgatgcaaaagggaaatgctggtgtagggagaagaacaatgaaaaatagtctaaacatcagcatgagagatgtgtag

SEQ ID NO: 2345 - DNA, 636 bp, Arabidopsis thaliana
atgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataa

SEQ ID NO: 2346 - DNA, 810 bp, Arabidopsis thaliana
atgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataa

SEQ ID NO: 2347 - DNA, 1299 bp, Arabidopsis thaliana
atggcgatcaaagacctgacggcgacgaccggtgattcatctcttcctttaataaaatctccgccgtctgaaacaaccggcggtgacagaacctctgctcttcaaacgctcggtaacattatcgtctccatcgtcggtacaggcgtccttggtcttccttacgcattccgcatcgccggttggttagccggatctctcggtgtcattatcgtcggattcgccacctattactgcatgctcctcctcattcagtgcagagataagctagaatcggaagaaggagaagaagaatcgaaaacttatggtgatttaggtttcaaatgtatgggaacaaaaggtcgatacttaaccgaattcctcattttcactgctcaatgtggtggatcagtagcgtatttagtgttcataggtcgaaacttgtcatccatatttagttcgtatgggttaagtatggtttctttcatattgattctggttccaatcgaagttggattgtcgtggatcacttctttatcagctctctcgcctttcagtatctttgctgatatatgcaacatcatagcaatgtgttttgttgtcaaagaaaatgtggaaatggtgattgaaggagacttctcgtttagtgatagaactgctatttcgtctaccattggtggtttaccttttgctggaggagttgcggtgttctgttttgagggttttgcaatgacgttggctttggagagttctatgagggaaagagaagctttccctaaattgttagctaaagtgcttgccgggattacgtttgtctatgtgttgttcgggttttgtggttatatggcttatggtgatcaaacaaaggatatcatcactcttaacctcccaaataattggtctgccattgctgttcagattgggttatgtgtgggattgacgtttacatttccgatcatggtacatccgcttaacgagatcatagagcagaaactgaagaggatagactggcttcaaaagcatcataatgggtacagcaacgaaacaggttcagtctcaaaatttgcaatctttacaacgaggacacttttggtggtaggacttgcagcaatcgcgagtttagtcccagggtttggtacatttgcatctcttgttggaagtactttgtgcgcactcatctcctttgtgttgccggcttcttatcacctcacgctgctcggtccatcactaaatgtatggaacaaatccatcgacgtattcattgtgatttgcgggttgatctttgctgtttatggtacgtacaacacaatcgtcggagtgtga

SEQ ID NO: 2348 - DNA, 2379 bp, Arabidopsis thaliana
atggatctcaatctcggaaaatgctgtggttctcgttcttctaagaaggaatcatggaggtcggttttgcttcttgcttaccagagtcttggtgttgtctatggagacttgagtatctctccgctttatgtctttaagagcacttttgctgaggacattcaacattcagagaccaatgaagagatctacggtgttatgtcttttgttttctggactttaactttggttcctttgcttaagtatgtcttcattgtcctccgagctgatgataacggagaaggtggaacttttgctttgtactcattgatctgccgtcatgtcaaagttagcctcctcccaaaccgacaagtctctgatgaggcactgtccacttataagctggagcatccaccggagaagaaccatgactcgtgtgtgaaaagatatctggagaaacacaagtggttacacactgctttgctgcttcttgttcttcttgggacttgtatggttattggagatggacttctcactccagctatctccgttttctctgctgtgtcaggtcttgagctgaatatgtctaaagaacatcaccaattaattcctattacctgcttcatactagtctgccttttctcgcttcagcattttgggacacatcgtgttgggtttgttttcgcgcctattgtcctcacttggctgctctgtataagtggtattggcttgtacaatataatacagtggaatcctcatatatacaaagctctttctcctacatacatgttcatgttcttgagaaagacgagagtaagcggatggatgtctctaggcgggatcttgttgtgcataactggtgctgaggccatgtttgctgatcttggtcacttcaattacgcagcaattcagattgcgtttaccttcctggtttatccggctcttatattggcatacatggggcaagctgcttacttatcccggcatcaccattctgctcatgcaattgggttttacgtctctgtaccaaaatgtttgcactggcctgtgcttgctgtagcaattcttgcttctgttgtgggaagccaagcgatcatcagtgggactttctcaatcataaaccagagccagtctctcggatgcttccctcgagtcaaagtcattcacacgtccgataagatgcatggtcagatttacataccggagattaactggatgctcatgattctctgcatcgctgttactatcgggtttagagatgtcaaacacctgggaaatgcatcaggtttggctgtaatggcggttatgctagtgacaacatgtcttacctcattagtcattgttctttgctggcacaagcctccaattctagcgctagcgttccttctctttttcggttcaatagaacttctctacttctcggcctcactcaccaaatttcgtgaaggcgcttggcttccgatcctcttatctctaatattcatgatcatcatgttcgtttggcactacaccaccattaagaaatacgagtttgatctccagaataaagtctcgcttgaatggcttcttgcattgggtccaagcctcggaatttctcgagttccaggtatcggtttagtcttcacggatttaacctctggaatccccgccaatttctcccggttcgtcaccaacctccctgccttccaccgtgttcttgtctttgtctgcgtgaaatctgtccctgtcccgttcgttccacctgctgagagatacctcgtgggtcgtgttggtcccgttgaccaccgctcttacagatgcatcgttcggtatggataccgtgacgtccatcaagacgtggactcattcgaaacagagctcgtaagcaagctggcggatttcatccgttacgattggcacaaaagaacacaacaagaagacgacaacgctcgttctgtccagtccaacgaatcctcaagcgagtcaagactagccgtgatcggaacagtagcttacgagatcgaagacaatctccaaccagagagtgtctccatcggattctccacagtcgaaagcatggaagacgtcatacaaatggccgaaccagccccaaccgccaccataagacgggtgaggtttgcggttgaggaaaacagttacgaggacgaaggatcaacatcgtcagcagaagcagatgcggaactgagaagcgagctgagggatttgctggcagcgcaagaagcaggaactgcgtttatattgggacattcacatgtgaaagcgaaacaaggatcatcggtgatgaagagattagcagttaatttcggttataatttcttgagaaggaactgtagaggacctgacgtggctcttaaggttccacctgtttctcttttagaagtcggcatggtttatgttgtttga

SEQ ID NO: 2349 - DNA, 1284 bp, Arabidopsis thaliana
atggagatggagcgtgtgcatgaattccctcatactcacatggatcgtcgtcccagaaagagagcgcgtctcggttgggatgtgttgcctcaggcaaccaaggctcaggtaggaatgttttgtgggcaagagattggaaatatatcaagctttgcatcttccggagctccttcagacaatagtagctctctttgtgttaagggtgtggctcgaaatggttctcccccatggcgagaagatgataaggatggacattacatatttgaactgggagatgacttaactccacgctataaaatttatagcaaaatgggggaaggtacttttggtcaagtgctagaatgttgggatagggagaggaaggaaatggtggcagtaaaaattgtccgtggtgtgaagaaataccgtgaggctgctatgattgaaattgaaatgctgcaacagcttggtaaacatgacaaaggtggcaatcgttgtgtacaaattcggaactggtttgactatcgtaaccatatctgtattgtatttgagaagcttggatcgagtttatacgattttcttcggaaaaacaattatcgctcctttcccattgatcttgtccgtgagattggctggcaactcttggaatgtgtagcatttatgcatgacttgcgcatgattcatacggaccttaaaccagaaaatattctgttagtctcctcagactatgtgaagattcccgagtacaaggggtcccgattacaaagggatgtatgctataaaagagtgcctaaatcaagtgcaataaaggtgattgattttggtagcacaacttatgagcgccaggaccaaacctacattgtatcaaccagacattatagggcaccagaagtcattttaggtcttggctggagttatccgtgtgatgtttggagcgttggatgtatcatagtggagttgtgcacgggtgaagcattgttccaaacacatgaaaacctggagcatctagcgatgatggagcgtgttcttgggccgtttcctcaacaaatgctgaagaaagtggaccggcactcagagaaatatgtgagaagaggtcgtttggattggccagatggggcaacctcaagagatagcctgaaggcagtattgaagcttcctcggcttcagaatttaataatgcaacatgtggaccactcagccggggagttaataaatatggtgcaaggacttctgcgatttgatccgtcagagagaataaccgctcgtgaagctctgaggcatccgtttttcgcaaggagaagatag

SEQ ID NO: 2350 - DNA, 1470 bp, Arabidopsis thaliana
atgaaaggaaaccaaaaagactcatcggagaaacccatatgggatcggagctcatcgggtatatccatgacccgacccggtcgattaataatctggctcatcctcttcatctccgtcacttacatcatctacactctcaagatcgtctccactacacacccttgcgaagatctaacctccgagtcaattctccaacaaagaccggagaaaaaagcggttacagtaacggttaaggcggttccggcggagcaagaagcaacggatctaaaccatgtggttttcggtattgctgcgtcgtcgaagctatggaaacaaaggaaagagtatatcaagatttggtataagccaaagaaaatgagaggctacgtgtggttagacgaagaggtaaagataaaatccgaaaccggagatcaagaaagtctcccgtcggtgagaatctccggtgatacgtcgtcgtttccttatactaacaaacaaggacaccgatcagcgattaggatctcgaggattgtttcggaaacgttgatgagtcttgattctgagtcgaagaagaacgtgaggtggttcgtgatgggtgatgatgatacgatgtattatatagggagcttgtcggaatctcatttgcagaacattattttctcttatggaatggcttatggtggaggaggttttgcgattagttatccattggctgtggctttgagtaagatgcaagatcagtgtattcagaggtatccggctttgtatggttctgatgatcggatgcaagcttgtatggctgagcttggtgttccattgactaaagagatcggttttcaccaatacgacgttcatgggaatctcttcggcctcctagctgcccatccgataacaccgtttgtatcgatgcaccatcttgatgttgtggaaccgatttttccaaacatgactcgtgttcgcgctatcaagaaactaaccacaccgatgaagattgattcggctgcgcttctccaacaatcaatatgctatgacaaacacaaaagctggactatttcagtctcgtggggatttgcggtccaggtgttccgtggatcattctctccccgggaaatggaaatgccatctagaactttcttgaattggtacaaaagagcggattacaccgcctacgcattcaatactaggcccgtgagtcgcaatcattgccaaaaaccgtttgtttttcacatgtcgagtgcaaaatttgacccgcagttgaacacgacggttagcgaatacacgagacatcgggttccgcaaccggcttgtcgatgggatatggctaacccagaggagatcaacactatagtcgtctacaaaaaacccgatcctcacctatggaacagatcacctagaagaaactgttgcagagtattacaaacaaagaggaataatacattatggatcaatgttggtgtatgtagagcaggtgaagtcactgaagtaaagtaa

SEQ ID NO: 2351 - DNA, 1095 bp, Arabidopsis thaliana
atgaaacttttctttattgttctcatctcttttctttccctcctccaagcatcaaaaggattcgatttcgacgaaaaagaattagaaaccgaagagaacgtatggaagctctatgagaggtggagaggccaccactctgtatccagagcctcccacgaggcaataaagcggttcaacgtttttagacacaatgtccttcatgtccacaggactaacaaaaagaacaagccttacaaactcaagatcaatagattcgccgacataacgcaccacgagtttagaagctcctacgctggctctaatgttaagcatcaccgaatgcttcgtggaccgaagcgcggatctggtggtttcatgtatgagaatgtgaccagagttccgagttctgttgattggcgagagaaaggagctgtcactgaggtcaagaatcaacaagattgtggaagttgctgggcgttttcgacggttgcagcagtggaagggataaacaagatcagaacaaacaaactggtttcattgtctgaacaagagcttgtggattgtgacactgaagagaatcaaggttgtgcaggaggtctcatggaacctgcgtttgaatttataaagaacaatggtggcatcaaaaccgaagagacttatccttacgattccagtgacgttcaattctgtagagctaatagtattggtggagaaactgtaaccatcgatggacacgaacacgtccctgagaatgatgaggaagaacttctcaaagctgttgctcaccagcctgtctctgtagctattgatgctgggagctcagatttccagctttactctgagggtgtgtttatcggagaatgcgggactcagttgaaccacggggtggtgattgttgggtatggagagaccaaaaatggaacaaaatattggatagtaaggaactcatggggacctgaatggggagaaggaggctatgttcggatagaaagaggaatatcggagaatgaaggacgttgcggtatagccatggaggcttcttatcccaccaagctctcttcgactccttctactcatgagtcagtagttcgtgatgatgttaaagacgagctctag

SEQ ID NO: 2352 - DNA, 552 bp, Arabidopsis thaliana
atggcgtcgccgagcaaacgtcgagagatggatatgatgaaactgatgatgagtgattacaaggtggatactgtcaacgacgatttgcaaatgttctatgtcacattccatggacccactgacagtctttatcaggggggtgtatggaagataaaagtggaacttcccgaagcttatccatacaaatctccatctgttggatttgtcaacaagatttatcaccctaatgtcgatgaatcttctggtgctgtttgcttagatgttataaaccagacttggagcccaatgtttgatcttataaatgtgttcgaatccttccttccgcaactgcttctatatccaaacccatcagatccatttaatggagaagccgcttctctgttgatgcgagaccgtgcagcctatgagctcaaagtgaaagaatattgtgagaaatatgcaaaaccagaggagattttaagtgatgatgatgatgatgatagcatgagcgaagatggttcggactctgatgatgatgacgacgacgaaatcgttgggaaagccgatccatga

SEQ ID NO: 2353 - DNA, 1788 bp, Arabidopsis thaliana
atgaccgttgattcagctctgcgatctccgatgatgcactcaccgtccactaaggacgtgaaggctctaaggttcattgaggagatgacacgtaacgtcgatttcgttcagaagaaagtgattagagagatacttagtcgtaactcggacactgagtacctgaaacggtttggtctcaagggattcactgaccgtaaaacatttaagaccaaagttccggtggttatctacgatgatcttaaaccggagattcaacgtattgccaatggtgaccggtcaatgatcttgtcttcttaccccatcacagagttcctcacaagctctgggacatcagctggtgaaaggaagttgatgccaaccattgatgaagacatggaccgacgtcagcttttatacagtcttctcatgcctgtgatgaatctctacgtgcccggattagacaaaggcaaggctctatattttttgttcgtgaagacggaatcgaagactcccggtggattaccagcacgtccggtgctcacgagttattacaaaagcgaacaattcaagagacgtcctaacgatccgtacaacgtgtacacgagccctaacgaagccatcctttgtccagactcatcccaaagcatgtacacgcagatgctttgtggtctccttatgcgtcacgaagtcctccgtctcggcgccgtcttcgcttctggtctcctccgtgccattggattccttcaaaccaattggaaagaactcgccgacgatatctccaccggtaccttaagttcaagaatctctgacccggccattaaagagagcatgtccaagatcttgaccaaaccggaccaagaactggctgatttcataacttcggtatgtggtcaagacaatagttgggaaggtattattactaagatttggcctaacactaagtaccttgacgtcatcgttactggagccatggctcagtatatcccgatgcttgagtactatagcggcgggttaccgatggcttgcacgatgtatgcatcgtccgagagttactttgggatcaacttgaaaccaatgtgtaaaccttctgaggtttcttataccattatgccaaacatggcatacttcgagtttctccctcatcatgaagtcccaaccgaaaaatccgaacttgtggagctagctgatgtcgaggtcgggaaagagtacgagcttgtgatcacaacctatgctgggcttaaccgttatagagttggtgatattcttcaggtgactggattctacaattccgctccacagttcaagtttgtgcggaggaagaacgttttgcttagcattgagtcggataaaaccgatgaagctgagctccaaagcgcggttgagaacgcatcgctcttacttggagagcaaggaactcgtgttatcgagtacacgagctatgcagagacgaagactatacctggccattatgtcatttactgggagcttctagtgaaggatcaaaccaatcctccaaatgacgaagtcatggctcggtgctgcttggaaatggaggagtcgttgaactctgtgtatagacaaagtcgggttgcggataagtcgataggaccactcgagatacgtgttgtgaagaatggaacgttcgaggagctcatggactatgccatctccagaggcgcatcgatcaatcagtacaaggtgccgaggtgtgtgagtttcacgccaataatggagcttcttgactcaagggttgtatctacacacttcagcccagctttgccacattggtcaccagaacgtcgtcgttga

SEQ ID NO: 2354 - DNA, 1506 bp, Arabidopsis thaliana
atgtcgattcttctgtatttcttctttctccccgttattttatcgttaatattcatgaagaaattcaaagactcgaaacgaaatcttcctccgagcccaccgaagctaccaattatcggaaacttacaccagcttcgaggattgtttcatagatgtcttcatgatctctccaagaaacacggtccggtgttacttctccgtctaggttttatcgatatggttgtgatctcatcaaaagaagcagcggaagaagttctcaaagtacatgaccttgagtgttgtactagacctaagaccaacgcctcatcaaaattctcgcgtgatggtaaagacatcgcctttgcgccatacggggaggtttcgagagagttgcggaagctttccttaatcaactttttcagcacgcaaaaggttcgatcttttaggtacatcagagaggaagaaaatgatttgatggtcaagaaactaaaggaatcagctaagaagaagaatacagtggatttgagccaaacacttttctatctagttgggagtatcatattcagggctacctttgggcagcgtttagaccagaacaagcatgtcaataaggaaaagatcgaagaactcatgtttgaggtccagaaagttgggtctctaagcagctctgatattttccctgctggtgtgggatggtttatggactttgtgtcaggacgacataagacacttcacaaagttttcgtcgaggttgatactttgctaaatcatgtaattgatggtcacttgaagaatcctgaagacaaaacaaatcaagatcgccctgatatcatcgactcgatcttagagactatttataaacaagaacaagatgaatctttcaaactcaccattgatcatctcaaaggaattatccaaaatatatatcttgctggagtagacacaagtgccatcaccatgatttgggcaatggcagagcttgttaagaacccacgggtaatgaagaaagctcaagaagagatccgaacatgcattggaatcaaacagaaggagagaatcgaagaagaagatgtcgataagcttcagtacttgaagcttgtgatcaaagaaaccttaagactacacccaccagcacctcttttacttccaagagagacaatggctgatatcaagattcaaggctacgacattcctcggaaaaccattcttttggttaatgcatggtcgataggacgaaaccctgaactctgggaaaaccctgaggaatttaacccggagagatttatcgattgtcctatggattacaaaggaaatagttttgagatgttaccatttggttctggtcggaagatatgtccagggatagcttttggaatagcgaccgttgaactgggactattgaacttgctttactactttgattggagattggctgaggaggataaagatattgacatggaagaggctggtgatgccacaattgttaagaaagttcctcttgaacttgtcccaattattcatcattga

SEQ ID NO: 2355 - DNA, 1380 bp, Arabidopsis thaliana
atggcgaaaatctaccggaagttgacaggctacggtggtgaaggagggcgtgaatgggacgatgatgtatatgagggtgtaagaaaagtgtatgtaggacaagatatcaatcgtatcacttacgtcaaattcgagtatgtgaaggaagacggccaagtcgtaacaactgaatatgggaaaatcattcaacaacccaaagagtttgtacttcaatatccggacgaacatatcatagcggtggaaggaaactatcgcggagtggctctatgtgccacagaggtgatcacaaacctcgtcttcaagacctcaaagggtagaaagtcaccactgtttggtccaaacttgcttggaattacgaccggtacaaagttcgttattgaggatggaggaaagaagatcgtagggtttcatggacggtcgggtaatgctctcgacgcgcttggagtttactttgtacatggctctctaacaacgtctccgcctgtttacaagctggatgcccaaggtggtacagacgggcgtgtttgggatgatggttcttacgacggcgttaaatcgctgcgtattggtcaagataattctcgtattacttatttagagttcgagtacgagaaaggcggtaagttagagacatgtcgccatggggtgaaacaagaaagatcactgaagtttgagcttaacccggatgaatacatcaaatcggtggaagcaacctatgataaaccggacattttccgcaatgtcgtcattacatcgcttacatttgaaacatcgaaggggagaacgtcattctctgggtataagggaggtaagaagtttaagctagagcaaaagggtcgtaggcttgtcgggttccatggaaaggaaggttcagctattgatgcccttggagcatattttgcacctattcctactccgactcctataattccagccaagaaactaccagcaataggcggcagcggaggagttgcatgggatgatggtgtctacgatggtgtaaggaagatacttgtaggacaaggtaacgatggtgtagcctttgtcaagtttgaatacaataaaggaaaagatcttgtatctggagatgaccatgggaagatgacattactcggaactgaagagtttgtgcttgaagatggtgaatatctcacggccatagatggctattacgataagattttcggagtcgagacaccaatgattatctgtcttcagtttaagacgaacaaaagggagtcaactccattcggaatggattcgggtgagaagttctcgcttggagagaaaggccacaagatcgtcggattccacggacaagctagtgatgttgttcacagcatcggagtcactgtcgtgcccattaccaacaccaagtga

SEQ ID NO: 2356 - DNA, 1950 bp, Arabidopsis thaliana
atgtctttgattcataaaggagccaccttggctctgtttctagcgttgactatggtggtcaacggagttttcgggagattcatcgttgagaagagtagcgtgacgattctaaaccctttggcaatgcggtctaagcacgacgcagccattgctaacttcggtgttcctaactacggtggttacatgatcggctccgtcgtttacgccggtcaaggagcttatggatgtgactcttttgacaaaactttcaaacccaaattccctcgtcctaccattttgatcatcgatcgtggagagtgttactttgcattaaaggtatggaacggtcaacaatccggtgtagcagcagttttagtagctgataacgtcgatgagccattgataacaatggattcacctgaggaatccaaagaagctgatgactttatagagaaactcaacattccatcggctttaatagacttttctttcgccaatactctcaagcaagctcttaagaaaggtgaggaagtagtcctgaagatagactggagtgagtcattacctcatccggatgagagagttgagtatgagctatggactaacacgaacgatgagtgtggtgcacggtgtgatgagcagatgaatttcgtaaaaaacttcaaaggacatgcgcagattcttgaaaaaggaggatactctttgttcacacctcattacattacatggttttgtcctaaagattatgtttctagcaatcaatgtaagtctcagtgtataaaccaagggaggtattgtgctcctgaccctgaacaagactttggtgatggatacgatggtaaagacattgtcttcgagaacttgagacagttgtgtgttcataaagtagctaaagagaataaccggtcttgggtttggtgggactatgtgactgattttcacattagatgttcaatgaaggagaagaagtatagcaaagaatgtgcagagagagttgttgaatctctaggtttgccacttgacaagatcaagaaatgtattggtgatcctgatgctaatgtggagaatgaagttttgaaagctgagcaagcacttcaggtaggacaaggtgaccgcggagatgtcacaatcttgccaacattgatcgtcaacaatgctcaataccgcggtaaacttgagagaaatgcagtacttaaggctatatgttctggattcaaggaaagaaccgaacccgggatctgtctaagtggagatattgaaacaaatgaatgtctcgaagcaaatggagggtgttgggaggacaagaagtccaatgtaacagcttgcaaggtacttagaaccgatgaacttaagggactacatttttatagatatttggttagttttatacctaaaaatggattctatcaggacacatttagaggaagagtctgtgaatgccctgttgtgaatggtgtacagtataaaggagatggatatacatcatgtgaaccttatggccctgcaagatgctcgattaaccaaggaggttgctggtctgaaaccaaaaagggcttaactttctcggcttgctcgaacttggagacatcgggatgtcgctgccctccagggtttaaaggagatggtcttaaatgtgaagcttgtcaatgtgatggatgcaactgtaagaacaaatggggaggctttgaatgcaaatgctctggaaatcgtctctacatgaaagaacaagacacttgtattgagagaagcggatcaagaatcggatggttccctacatttgtgattctagctgcagttgcaagcatatgtgtaggtggttacgtattctacaagtatcgtctcaggtcttatatggattcagaaatcatggcgattatgtctcagtacatgccattagagagccaaaacacaaccgatccaatgactggtgaatctcaacaccaacagctgagattaacttctgcagcctaa

SEQ ID NO: 2357 - DNA, 1056 bp, Arabidopsis thaliana
atgggttcttctgtggagcagaacattcttgttactggtggtgctggctttatcgggacgcatactgttgttcaacttctcaaagatggttttaaggtttcgatcatcgataattttgataactctgttatcgaagctgttgatagagttagggagcttgttggtcctgatctctccaagaagctcgacttcaatctgggtgatctaagaaacaaaggggacattgagaaactattctccaagcagagatttgatgctgtgattcattttgcgggtcttaaagctgtgggtgagagtgttgaaaaccctcgccgctactttgacaataacttggttggaacaatcaatctatatgagaccatggcaaagtacaactgcaaaatgatggtgttttcatcttctgccactgtttatggacaacctgaaaagattccatgcatggaagactttgaattaaaggctatgaatccttatggtcgtactaagctctttcttgaagaaatagctagagatattcaaaaggcagaaccggaatggagaattattctgctgaggtacttcaatcctgtaggagcacatgagagtggcagtattggtgaggatccaaaaggcatccccaataacctcatgccttacatccaacaagtggccgttggacgtttaccggaactcaatgtctatggacatgactatcccaccgaggatggtagtgcggtaagagactacatccatgtgatggatttagcagatggccatatcgctgcgctcaggaagctatttgctgatccaaagattggttgtactgcttacaatctagggactggtcaaggaacgtctgtgttagaaatggttgcagcttttgaaaaagcttccggcaagaaaatcccgattaagctctgtccgagaaggtcaggagatgcaacagcagtttatgcttcaacagagaaggctgagaaagaacttggctggaaggcaaaatatggagtggatgagatgtgcagagatcagtggaaatgggcaaacaataatccatggggttaccagaataagctttga

SEQ ID NO: 2358 - DNA, 1230 bp, Arabidopsis thaliana
atggcctcggtgggcatagagcctagtgccgcggttagagaatctactggaaacgttactgatgctgatagattacccgaggagatgaaggacatgaaaattcaagatgataaagaaatggaagctacgattgttaatggcaatgtgactgagactggccatataatagtaactactataggaggaagaaatggccagccaaaacagacaatcagttacatggcggagcgagttgttggacatggctcctttggtgttgtgtttcaggccaaatgtttagaaacaggagaaactgttgctataaagaaagttctacaagatcggaggtacaagaatcgtgagcttcaaacaatgaggctacttgaccatccaaatgttgtgtctttgaaacattgtttcttctctacaaccgaaaaagatgagctttatctcaacttggttctggaatacgttccggaaactgtgcaccgcgtcatcaaacactacaacaaacttaaccaacgaatgcctctcgtttacgtcaaactttacacttatcagatttttaggtccttatcctacattcaccgatgtatcggcgtatgtcatcgagacatcaaacctcaaaacttgttggtaaatccacacactcatcaagtgaaactatgcgattttggaagtgcgaaagtattggttaaaggagagccaaacatttcatacatttgctcgaggtattacagagcacctgagctcatttttggagccaccgagtatactacagccattgatgtctggtctgcaggatgtgttctcgccgagcttcttctcgggcagccattgttcccgggtgagagcggtgttgatcaacttgtagagattataaaggttttgggaacaccaacaagggaagaaatcaaatgcatgaacccgaattacacagagttcaaatttcctcagattaaagctcatccatggcataagattttccacaagagaatgcctccagaagctgttgatttggtctcaaggcttcttcaatactctcccaatctccgttgtgctgctcttgattcattggtccacccattctttgacgagctaagagatccgaatgcgcgattacccaacggacgtttccttccaccgctctttaactttaagcctcatgaacttaaaggtgtgcctgtggagatggtggcgaagttagttccagaacatgcgaggaagcaatgtccgtggctcagtttgtga

SEQ ID NO: 2359 - DNA, 948 bp, Arabidopsis thaliana
atggtctcttcggttttatccatccctccacaaacttgtctacttccacgattacccatctctgattctgtcaattgcaaatcgaaaatcgtgtactgtctctccacaagtgtccgaggaagctccgtcaagagacaatccacggccagaactcgcagtttcactgagacaaatcgtcgaacaccttccgtgcaatccaaacatgaattctgggaagatccagatgatggtagcgacagtgaaaacgaatatgaaggagaagaagaagatggtattgggaatgatttagataacgagagtgattgggaagatgactcgagagtacaaaagcttactactacagacaactacgaggaagagcttgcaaaagaggttgaacaacttcttgaacctgaagaaagagtaattcttcagcaaaatgagaaaccaaatctcaagatgatctcaacaaagagttggaagccacttcagacacttgctctgtcaatgcagattcagttaatggataatcttattgaaaacggactagacattgatgatgttgacaaggacaaccaaaccgctcttcacaaagcaatcattggtaaaaaagaagcggtgattagtcatcttttgaggaaaggagctaatccgcatcttcaagatcgggacggtgcagctccgattcattatgcagttcaagttggagccttgcagactgtaaaactactattcaagtacaatgtagacgtcaatgttgcagataatgaaggatggactccgttacatatagctgtacaaagccgaaatcgagacattacaaagatattgttgaccaatggtgctgataaaacaagacgaacaaaggatgggaaattagctttggacttggctctgtgctttggaagagatttcaagtcatatgatctggtcaagctattgaagattatgcccaccggggatatatag

SEQ ID NO: 2360 - DNA, 1434 bp, Arabidopsis thaliana
atgcagagattcgcggcgaaaagatcggtgcaaaacatttccgtctctctatggcgtcgatgtatctcatcgacgtctcaggcagcgacagcttccgttaaggattccgacgagtttcaggcgaggcttcctccttttgcttacactcctccgccgtatactggtccttccgccgatgttatccttagcaaaaggaaggagtttctcagtccttccatgttctgtctctatcggaaaccgttaaacattgtggatgggaaaatgcagtatctatttgatgagagtggtcggagatatttagatgcatttgctgggattgctgttgtgaattgtggacattgtcatccagatgtggttgagccagtgattaatcaaatcaagaggcttcagcatcctactgttctttaccttaaccatgccattgctgatttctctgaggctcttgcttctaaacttcccggtgatctaaaggtggtgtttttcactaactcagggacagaggctaatgaattggcgcttatgatggctaagttgtatactggatgtcaagatattgtggcggttcgaaacgggtatcatggtaatgcagctgcaactatgggggctactggtcagagtatgtggaagtttaatgtggttcagaatagtgttcatcatgctttgaaccctgatccttatagaggtgtgtttggttctgatggagagaagtatgcaaaggatttgcaagatcttattcaatatggtacgactggtcacattgccggttttatttgtgaagctattcagggagttggagggatcgtggaactagcaccgggatatttgtcagcggcttacgatactgttaagaaagctggtggattgttcattgcggatgaagttcagtctggtttcgcacgtactggtaacttttggggatttgaggcacacaatgttgtccctgacatagtaaccatggcaaagggaattgggaatgggtttcctttgggagctgttgtgacaactccagagatagcaggagtgttgactcgccgtagctacttcaatacatttggtggaaattctgtgtctactacagctggtctcgctgttctgaatgtgattgagaaagagaagcttcaggaaaatgctgcaatggttggatcctatctgaaagaaaaactcacacagctgaaagaaaaacacgagattatcggggatgtccggggaagaggactgatgcttggagtggagctggtgagtgatcgcaagcttaagactcctgcaaccgccgagactctgcacattatggatcaaatgaaagaattgggtgtgttgattggaaaaggaggctactttggaaatgtctttagaatcacaccacctctctgcttcaccaaggacgatgcagattttctcgtggaagcgatggactactcaatgtcgaagatgtga

SEQ ID NO: 2361 - DNA, 885 bp, Arabidopsis thaliana
atggcagctccgattcgattctttgaactgaacactggtgccaagttaccttgcgtcggtctaggaacctacgcaatggtcgcgacagcgatcgaacaggcgattaagattggttacaggcatatcgactgtgcttcgatttacggaaacgagaaagagattggtggtgtgttgaagaagctgataggtgatggttttgtgaagcgtgaggagttatttatcacttccaaactctggagcaatgatcatttacctgaagatgtgcctaaggcactggaaaaaacgttacaggacttacagattgactatgttgatttatatctgatacattggcctgcgagcttgaagaaggaatcactaatgccaacacctgagatgctcacaaaacctgatataactagcacatggaaagcaatggaagctctctatgactctggaaaagctcgagcaatcggtgtaagcaatttctcgtcgaagaagcttacagatcttcttaacgtggcacgtgtaaccccggctgttaaccaagttgaatgtcacccagtttggcagcaacaaggtcttcatgagttatgcaaatccaaaggagttcacttatctggttactctcctttgggttcccaaagtaagggagaagtcaggctaaaggttcttcaaaacccgattgttaccgaggttgctgagaaacttggaaagaccaccgcccaagtggctctccgttggggactccaaactggtcatagtgttctaccaaagagctcgagcggggctcggctcaaggagaatcttgatgtttttgactggtccataccggaagatctgtttaccaagttctctaacattccccaggcaagttctttcatctttctttttttttctcgatga

SEQ ID NO: 2362 - DNA, 1977 bp, Arabidopsis thaliana
atggaaagatccaatcttttccacatcccttgttttcttctcttatttcttctcttcaacatcaatggcgttcacactaccttcgtctgcggcgacgaagacttctctccaaacacaagctacgttgaaaacctcgaatctctcttgccttctcttgcttcaaacgtcatacgagaacgtggtttctacaacgtttcgctagacggagtttacgctcttgccctatgtcgaaaacactacgaagttcaagcttgtcgtcgctgcgtcgatagagcaagtaggactctgttaacacaatgccgaggcaaaacagaagcatatcactgggattccgaaaacgatgcaaacgtttcttgtctagtacgctactcaaatatccatagatttggcaaactaaagcttgagccaatagggaatgttcctcactcgagtcttgacccctcttccaatctaacccgaatcagccaagagtttgccgccagggctaatcgaacagttgaggttgcgtccacagctgatgagtcttcggtattgaagtattatggagtctcaagtgcagagtttacagacactcctgaggttaatatgttgatgcaatgcacacctgatttatcttccagtgactgtaatcattgtctgagagaaaatgttaggtataatcaagaacataactgggacagagttggaggaacagttgcccgtcctagttgttatttccgatgggatgattacagattcgcaggagctttcgataacctagagagagttcccgcgcctcctcgatctcctcaaactcgacaagattatcgggtcaagaaaggaagaatgtttcaaccatggagcgttgtggttgttgttttccctacgggcataaatcttgccgtgtttgtcgctttcgtgcttgcttatcgccggatgcggaggaggatttatactgaaatcaataagaattctgattctgatggtcaagctacgttaagatttgatcttggcatgatcttaattgcaaccaatgagttctcccttgaaaataagcttggacaaggtgggtttggatctgtctacaaggggatattaccgagcgggcaagagatagcggtaaagagattagctggaggctcaggacaaggagaactagagtttaagaatgaagtcttactcttgacaagactccaacataggaatctagttaagcttcttggattctgtaatgaaggaaatgaagagattcttgtctacgagcatgtccctaattcaagtcttgatcactttatctttgacgaagacaaacgttggcttcttacatgggatgtgaggtacagaatcatagaaggagttgcaagaggacttctttatctccatgaagattctcagttgaggattattcacagagatttgaaggcaagcaatatccttttagacgcggagatgaaccctaaagttgcagactttgggatggcgaggttgtttaacatggatgagactcgaggagagacaagcagagtagttggaacctacggatatatggctccggagtacgtgagacatggacaattctcagctaaatctgatgtttatagcttcggtgttatgcttttggagatgataagtggtgaaaaaaataagaactttgaaacagaaggacttcctgcttttgcatggaagagatggatagaaggagagcttgagagtataatcgatccttacttaaacgagaatccaagaaacgagatcataaagttgattcagattggtttgttgtgtgttcaagagaatgcagcaaagagaccaaccatgaactctgtaataacttggcttgcaagagacggtacttttacaatacctaaacctacagaagctgctttcgtcactctgcctctctcggtgaaacctgaaaataggtccatgagtgagcgtaaagacaaagatccgttttcagtggatgaggtctcgattacagtcttgtatcctcggtga

SEQ ID NO: 2363 - DNA, 1053 bp, Arabidopsis thaliana
atgatgaactcttctcttctaactccttcttcttcatcttcttcccatatccaaactccatcaacaactttcgaccacgaagacttcctcgatcaaatcttttcctcggccccgtggccctccgtcgtcgatgatgctcatcctcttccctccgatggcttccacggccacgatgtcgactcaaggaatcagccgatcatgatgatgcctttgaatgatggctcctccgtccacgctctttataatggcttctccgtcgccggatctcttcctaactttcaaatccctcagggatcgggaggaggattgatgaaccaacaaggacaaacgcaaacgcaaacgcaacctcaggcgagcgcgtctacagctactggtggtacggtggcggctccgccgcagagtaggactaaaatccgagctaggagaggtcaagcaactgatcctcatagtatcgccgaaaggttacgaagagagagaattgcggaaagaatgaaagctcttcaagaactcgttcctaacggcaataagacagacaaggcatcgatgctcgatgagatcatagattatgtcaagtttttacaactccaagtcaaggtactgagcatgagcagattgggaggtgctgcttccgtttcttctcaaatctccgaggctggtggatcccacgggaacgcatcctccgccatggtcggcggtagccagacggccggaaactccaacgacagcgttacaatgacggaacatcaagtggccaaactaatggaagaagacatgggctcggccatgcaatatcttcaagggaaaggtctttgtctcatgccaatctctttagccaccgccatctcaaccgccacgtgtcactcccgtaaccctttgatccctggagctgttgccgacgtcggaggtccttcccctcccaatctttctggcatgaccatacagtcgacgagtacaaaaatgggtagcggtaatgggaaattaaacggtaacggcgtgaccgagaggtcgtcttctatcgccgttaaagaggccgtatccgtttcgaaagcgtga

SEQ ID NO: 2364 - DNA, 1824 bp, Arabidopsis thaliana
atggtgagagtcaaacaaaagaatcttgaatcttatagatctaacggtacatatccacccacgtggcgaaatccaaccacttcattcgcacccgatcaacatcgagtcagcattcactcatcactcaaatccaaaaccaaaaggagacgcttatacaaagaagcagacgacaacaccaaactccgatcatcatcatcaacaacaacaacaacaacaacgatgctgcttcgaatttctggtaacaatctgagacctttgagaccacaatttctcgctcttcgaagctcttggttatcaacttcgccggagcaatctactcaaccacaaatgcctccgagagtaccaaatcttattggaggttcttttgttgagtctcaatcatcttcgtttatcgatgttataaaccctgctacacaagaggttgtatctaaagttccattgactactaatgaagagtttaaagctgcggtatccgctgcgaagcaagcgtttccgttgtggagaaacacgccgattactacccggcagcgtgttatgctaaagtttcaagagcttatacgcaagaatatggataaacttgctatgaacatcacaaccgagcaagggaagactttaaaggattcacatggtgatatcttccgtgggttagaggttgtggagcatgcgtgtggaatggcaaccttacagatgggtgaatatctccccaatgtgtcgaacggagttgatacatatagtattagagagccattaggtgtttgtgctggcatttgtccttttaactttccagccatgattcctttatggatgtttcctgttgcagtgacatgtggtaatacctttattctgaagccatcagagaaggatcccggtgcttctgtaatacttgccgagttggcaatggaagctggtttacctgatggggttctcaatatcgttcacggaaccaatgatactgtgaatgctatctgtgatgatgaagatataagggctgtttcttttgttggctccaacacggctggaatgcatatatacgcaagagcagcagcaaaaggaaaacgtattcagtcaaatatgggggcgaaaaatcatggacttgtcttgcctgatgccaacatcgatgcaactttaaatgcgctacttgctgctgggtttggtgccgctggacagagatgcatggcactgagtacagtggtttttgttggcgatgcaaaatcatgggaggataaactcgttgagcgagctaaggcccttaaagtcacatgtgggtcagaaccagatgcagacctgggtcctgtgattagtaaacaggcgaaagaacggatatgccggttgattcagtctggtgtagatgatggtgctaaattgctgcttgacggaagagatattgtggttccaggatatgagaaagggaattttatcggtcctaccattctatctggtgttaccccagacatggagtgttacaaggaggaaatatttggccctgttcttgtgtgcatgcaggcaaacagttttgatgaggccatatctataataaataaaaacaagtatgggaacggtgctgcgattttcacgtcgtccggggcagcagcaagaaagttccagatggacatagaagcaggacagatcggtattaatgttccaatcccggttccattaccgttcttttccttcaccgggaacaaggcctcattcgcaggagatcttaacttctatggcaaagcaggagtggactttttcactcagatcaaaactgttacacaacagtggaaagatattccaacttcagtatctctggcaatgccaacgtctcaaaagcaataa

SEQ ID NO: 2365 - DNA, 1974 bp, Arabidopsis thaliana
atggaggaaatcggaatagttatcgtcggcggcggaatcgctggtctcgccacttccattgctcttcataggaaaggaataaagagtgtggtgttggagagagcagagaaagtgagatcggaaggagctggaatcggaactctctccaatggttggagagcccttgatacagcttggcgttgggcacggaccatgttgattgagaatggaaaaaaacgagaattcgtttcaaatatagtagacgaagctcgttgtattaaaaggaacgatcttgttgaggccttatccgatgcccttccgaaaggaaccatccggttcggttctcatattgtttctattgagcaggacaaaactacgttgtttccggttgttcacttagccaatggaaatagcatcaaagccaaggtcctgattggatgcgatggtgccaattctatcgtcagtgattatttgcagttaaacccgaaaaaggcgtttgcttgtcgtgcggtgagagggtttactaagtacccaaacggccatggatttccacaagaggttctaaggataaagcaaggaaatgtcttaataggaaggcttcctttgacggataatcaagtcttttggtttctagtacatatgcaagacaataatcacaatgattggaaagaaatggtaaaaatatgcaatgtggagtcattaacactcacacacttaaggtaccgagcgccatcggaaatcatgttagggaaatttcgtcgtgggacagtgactgtagccggcgatgcgatgcacgtgatgggtccgttcttggcacagggcggctcagcggcgctagaggatgcggttgttttagctaggtgtctagctaggaaagttggtccggaccacggagacttgttaaaggattgttcgatgaaaaacattgaagaagctattgatgagtatgtggatgaacgtaggatgagattactcgggctttcggtgcagacttatttgaccggacgttcgctacaaacgtcatcaaagctaaaatttcttattcttttgtttccatttactcaagaaaacatttactacattttcctacatttagcttatttgactattttaaaaaaacgttataagctagactcgcatagtttatgtcaagctctcatcacagttatggcgaatctaactctagagctaaacatcaactccgcaagaaaccttttaaatgtcaatctcatcactaaaatgaacgttttcactgccatcaccatcaacggcgagaatactcgaaagaaacaaaaggcgaaaaccacggttgatcgttatggtggatctaacccgacttggaatcaaaccatcaaattttccgtggacgagaggtcagcccgtggtggtcattcgtcacttgtcatgagagtaatctctcgtcgagtcctaggcaacaaagaaatcggaagagttaacatcccgttacttgagctcttgaatgcaaccacaccatcatttaacggtgatggtaacgatcatgagatgaaactgatgtcgtatcaggtgagaacttcgtcgggtaaacggtcagtgatcactaaccggagttgtgtagactccgcggcaccatctcaaatcgagcatgcaccttcggctccacccgaattgccaattgagtttcctaagctgcctcagccgccgtatcttttgagacatcctttcgccgccggttctagccgtggtcttcttccaatatcatatggcgctgggatgaccgagcaaaccggtcacgctaataactatgcgcaaaccggtcacgctaacaactatgcgccaccaccgagacaaggatatggaccgtacggttatgtgtcgtcgggatatggatacggaagtccctcgtatcaacaacgtaaggagatggggattgggcttggattgggagccggactttttggtggattaatggtgggagacattgtgtctgatgttgcaaattgttatgatctttga

SEQ ID NO: 2366 - DNA, 969 bp, Arabidopsis thaliana
atggctcgattttccttcttgaatgttgtaaaggatgttgtggctattctaaatgaatcccgcaaactgtttctcaagaacaaaaagttgatgttctcagtcttggtattccctctcttactcaattgtttagtttacttcttgaacatctttgtcatcgtaccggagatcacaaacttgatccttgaagcaagtttgttgccttcgacagatccaacctccccggaatacgcagcccgccttatgagagtctttacagattttcgccaatttgtgggttcttcatacattttcgcggctgtctcctccatcatcaacctcttttctgttctagtcatcgtccacgcatcggctattactcttaaagatgaaaacttcaatatcaaagattttcctgttctgagccttaaatcttggaagggacctcttgtgacatatttctacattgctcttttcagtcttggctttggcttcctcttctttataatcctttgtcctatccttttgttctctataaaatccggttccgtggaaaatatcggtttcttggcggtcgaggctggtgttttattgattatattcaccgtctctcagtcctattttgctatctattggaacttatctatggtcatatcgatactagaggaaagttatgggttccaagctttggggaaagcagcaaagattgttaaagggatgaagacaaaactgtttctcttgaatcttttctttggtttattggcatccggattagctcaaatcttgcagctgatcaatatgggaagatcgttagcggttaccttaaccacaggttttgtccttgtgtgtttggtctttgcggtgaggatgtttcagcttgtgacttacaccgttgcatatttccaatgtaaaagcctccaaggcagagacgttgagtcgctcagggatgtggaatatatggcattgtcttccactactctcacggaatga

SEQ ID NO: 2367 - DNA, 942 bp, Arabidopsis thaliana
atgatgaagggtgccaagttttcatctcttcttgtgcttttctttatttttccgatcgcatttgctcaactgagagtcgggttttatagtcaatcatgccctcaagccgagactatcgtacgcaatctggtgcgccaacggtttggtgttaccccaaccgttaccgccgctttgctccgtatgcatttccacgactgtttcgttaagggctgtgacgcttctctcctcattgattcaaccaattccgagaaaactgctggaccaaacggaagcgtcagggaatttgacctgatagaccggatcaaggctcagctagaagctgcatgcccttccacagtctcatgtgctgacatcgtcacattggccacacgtgactcggtggccttagccggaggcccaagctacagcatccccacgggaaggcgtgacggtagggtctcaaacaatcttgatgtaaccttaccgggtccaacgatctccgtctctggagccgtgagtttattcacgaacaaagggatgaacacgttcgatgcagtagctcttttgggtgcacacactgttggtcaaggaaattgtggtctctttagtgacagaatcactagcttccaaggaactggacgaccggacccgtccatggaccccgctttggttaccagcctaaggaacacatgcagaaatagcgcgacggcggcactagaccagtcgagtccattgagattcgacaaccagttcttcaagcaaatccgtaaaaggagaggagtgttgcaagttgaccaacgcctcgcatccgacccacagactcgtgggattgtggctcggtatgctaataacaacgccttcttcaagcgtcagttcgttagagcaatggtgaagatgggagcagttgatgtgcttactggtcgtaacggtgagatcagaaggaactgcaggagattcaactaa

SEQ ID NO: 2368 - DNA, 711 bp, Arabidopsis thaliana
atggtttccatgactacttcatcttcttcgtacggaacattctctacagtcgtcaacagttctagacctaattcctcagcaacctttctcgtcccttccttgaaattctccaccggaatatcgaatttcgcgaatctgagtaatgggttttctctaaaatctccaattaatcctgggtttctcttcaagtctcgtcctttcactgtccaagctagagctgctgcagaaaaaaccgttcacgatttcaccgttaaggacattgatgggaaggatgttgctttgaacaaattcaaggggaaagttatgttgattgtcaatgttgcttcaagatgtggtttgacatcatcaaattactcagagctttcacatctgtacgagaaatacaaaactcaaggatttgagattctagcttttccctgcaatcagtttggtttccaagagcccgggtcaaactccgagatcaaacaattcgcttgcacccggtttaaagcagagttccctatatttgataaggttgacgtgaatggaccaagcacagcgccgatctacgagttcttgaaatcaaacgcaggaggattcttgggtggtctcattaaatggaactttgagaagttcttgattgataaaaagggaaaggtcgttgagaggtaccctcccaccacatcccctttccaaatcgagaaagacatccagaagttgcttgccgcttaa

SEQ ID NO: 2369 - DNA, 2406 bp, Arabidopsis thaliana
atgtcttctctgtcgcaatcgccaccaccgccggagatggatatccaacccccggcattggttaacgatgatccttccacttattcctccgctttatgggattggggagatctccttgacttcgccgcagacgaacgccttctcgtcgatcaaattcatttccctcccgttctctctcctcctctaccgcctctgattccgacgcaaactccggcggaatctgaattagatccttctccggaagaatcgggttctggttcggatcgggttaggaagcgagacccgaggttgatttgttccaatttcattgaaggtatgcttccttgttcgtgtcctgagcttgatcagaaattggaagacgccgagcttccgaagaagaaacgggttcgcggcgggtcgggcgtggctcgatgtcaggttccggattgtgaagcggatattagcgagctcaaagggtaccataagaggcatagggtttgtctccgttgcgctaccgccagctttgttgtgcttgatggagagaataagagatactgtcaacagtgtggaaagtttcatttgctcccggactttgatgaaggaaaacgcagctgtcggagaaagctagagcgtcacaacaacagacggaaaaggaaacctgtagataaaggaggtgttgctgcagaacaacagcaagtgctttcacagaatgataacagcgtcattgatgttgaggatggaaaagatatcacatgctctagtgaccagagagctgaagaagagccttcattgatttttgaagatcggcatattaccactcagggttctgtaccttttacccgaagcatcaacgcagacaactttgtctctgttacaggttcgggtgaagctcaaccagatgaaggaatgaatgacacaaaatttgaacgttcaccttctaatggcgacaacaaaagtgcttactcaactgtgtgtccaactggtcggatctcttttaagctctacgattggaatccagcggagttcccacggagactacgtcatcaaatatttcaatggttggccaacatgcctgttgagctggagggctatatccgcccaggatgtacaattttgactgtctttatagcaatgccagagattatgtgggcgaagttatctaaagatcctgtggcatatctggatgaatttattcttaaacctggaaagatgctgtttggaagaggctcgatgactgtctatttgaacaacatgattttccgtcttattaaaggtggaacaactttaaagagagtcgatgtaaaattagagtcgccgaaacttcagtttgtgtatcctacatgttttgaagctggaaaaccaattgaactcgttgtatgtggacaaaaccttctgcaacctaaatgccggtttctcgtgtctttttctgggaagtacttgccacataactattctgttgtacctgcaccggaccaggatgggaagcgttcttgtaataacaagttctacaagatcaatattgtgaattctgaccctagtctctttggccctgcctttgtcgaggttgaaaatgaatctggcctatcaaatttcatacctctaattattggagatgcagctgtttgttccgaaatgaaactaatagagcagaagttcaatgctacactctttccagagggacaagaagttactgcttgctcttctttgacttgctgttgcagggattttggggagagacagagcacctttagtggcctcttgttagatattgcatggtcggtgaaggtaccctctgcagaacgcactgagcaacctgtgaaccgatgtcagataaaaagatacaacagagtgttgaattatctgatacagaataactcagcgtcgatcttaggaaacgtactgcacaatttggaaactttggtgaagaaaatggagccagacagtcttgttcactgtacctgtgactgcgacgtgaggcttctacatgaaaatatggatttggcgagtgatattcacagaaagcatcaaagccctatagagtcaaaggtgaatcctccttcgtcaggttgctgttgtgtgagtagtcagaaggacataccatcaagaatattaaacttcaataaggatcctgaagcaggattagattgtaaagagagaatacaggcagactgttcaccagatagcggcggaaaagagactgatcctctgttaaacaaagaggttgtcatgaacgtaaatgacataggagactggccaaggaagtcgtgtataaaaacgcactcagctttagcattcaggtcccgtcaaactatgttcttaatcgctacgttcgctgtctgttttgctgtctgtgcggttctctaccatccaaacaaggtcacacagcttgcagtggcaatccgaatgagattggtacacaaaatttga

SEQ ID NO: 2370 - DNA, 570 bp, Arabidopsis thaliana
atggcagcagctatggcaacagcaaccaagtgcatgtctctaaacccatctcctcctaaactccaaaaccaaaccaaatccaaaccattcatctccctaccaaccccaccaaaaccaaacgtctctctcgccgtcacaagcaccgccctagccggagccgtcttctcttccctcagctactctgagccagctttagccatccaacagatcgctcagctcgctgcagcaaacgccagtagcgacaaccgtggcttagctcttctccttcccatcgtcccagccattgcatgggtcctttacaacatcctccagccagctattaaccaggtcaacaagatgcgtgagagtaaaggtatcgttgttggtctaggtattggtggtggtcttgcagcgtcagggcttttgactccacctccggaggcttatgctgcggcagaagcggcggctgctagttcagacagcagaggacagttgttgttgattgttgtgacaccggcactactttgggttctgtacaatatcttgcagccagctttgaaccaaatcaacaagatgaggtctggggattaa

SEQ ID NO: 2371 - DNA, 86 bp, Arabidopsis thaliana
aaaggcagtgatgaacgagaatgtcatgcaccactctgatattagtgctgataaccatctctaacccatattttctctgagccttt

SEQ ID NO: 2372 - DNA, 393 bp, Arabidopsis thaliana
atggctagcactatgatgactacattgcctcagttcaatggtcttcgagccaccaaaatctctgcagctcctgtacaaggcctggcaagtgttcagcccatgagacgcaagggaaatggagctttgggtgcaaagtgtgacttcatcggttcatcaacaaatctgataatggtaacgtcgacgaccctgatgttgttcgcggggagattcggacttgcgccatcagccaataggaaggcgacagctggacttaggttggaggcacgtgactcaggtctacaaacgggtgacccggccgggttcacgcttgcggacactttggcttgtggcaccgttggtcatatcatcggtgtaggagttgtccttggccttaaaaacattggtgctatttga

SEQ ID NO: 2373 - DNA, 822 bp, Arabidopsis thaliana
atggaagattacgagcgaataaactcaaactctccaacacatgaagaagattctgatgtacggaaaggtccatggaccgaggaagaagatgcaatcctagtcaacttcgtctctatccatggcgatgctcgttggaaccacatcgctcgttcctctgggctaaagcgaactggtaagagttgtagattaagatggcttaattacttacgtccagatgttagaagaggcaacatcactctcgaagaacaatttatgatcctcaaactccattctctttggggcaataggtggtcgaagattgcgcaatatctaccgggaagaacagataatgaaataaagaattattggagaactcgagtccaaaagcaagccaaacacctaagatgcgatgttaacagtaatcttttcaaggagactatgagaaatgtttggatgccgagattagtggaacgaatcaacgcccaatcattacccaccacgtgtgaacaagtggagtcaatgatcaccgacccaagtcaaccagttaacgaaccgagtccggtcgagccgggtttcgttcaattcagccagaatcatcatcagcaattcgtaccggctacggaattgtcagcaacgtcttcgaattctccggctgagacgttttcggacgttcgaggtggggtggtgaacgggtcaggttatgatccgtcgggtcaaacgggtttcggagagttcaacgattggggctgtgttggtggggacaacatgtggactgacgaggagagtttttggttcttgcaggaccagttctgccccgatacgacatcgtattcgtataattaa

SEQ ID NO: 2374 - DNA, 771 bp, Arabidopsis thaliana
atggagggaattactcatccaatacctcgtactgttgaagaggtctttagcgacttcagaggtcgacgagctggtcttattaaagctctcactaatgatatggtgaagttttaccaaacgtgtgatcctgagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggaagaggctgttccagatgattaatgagctgccaaccattttcgaagttgtgagcggcaatgcaaagcagtccaaggatctatctgttaacaacaataatagcaaaagcaaacctagtggcgtcaagtctcgccaatccgaatctctctcaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcgtgtgagaaatggttccatggaaaatgtgtgaagataacacctgcaaaagcagaacacatcaagcattacaaatgcccaacttgcagtaacaagagagctagaccttga

SEQ ID NO: 2375 - DNA, 1083 bp, Arabidopsis thaliana
atggcgtctgtgaaccctttcgatctcttggacgatgacgcagaggatcccagccagattgttgcgtctaagccattgaaggttgtggctccggttcagactgctaagtctggtaagatgccgactaagccgcctcctccttctcaagctgtgagggaggcaaggaacgctcctggtggaggtcgtggtgctggacgtggagggagttatggtcgtggtggacgtggtggaaacaatagggattcaaggaacaatgatggtcctgccaatgaaaacggatatggtggaggctacagacgctcagaagaaggagatggagctagacgtggtgggcctgttggtggataccgtggtgatcgccgtggaagctacagcaatggtggtgattcaggtgactctgaaagaccacgcaagaactatgaccgtcacagtagaacagcgtacgggaatgaggataaacgtgatggagctggccgtgcgaattggggaaccactcaggatgatattactccggtgactgaagaatccacagctgttgtggacaagaatttgactgttgagaagcaagatggtgaaggtgaagcaactgatgcaaagaatgaaacacctgctgagaaagcagaggaaaagcctgaggacaaggagatgactttggaagagtatgagaaggttttggaggagaagaagaaagctctgcaggcgaccaaggttgaggaaaggaaggttgacactaaagcatttgaggccatgcaacagctctcaagcaaaaagagcaacaacgatgaagtcttcatcaaactgggaacagagaaggacaagcgcattactgagagagaagagaagacaaggaagtcattgagcatcaatgagtttctgaaacctgcggatggaaagagttactacagaccaagaggtggttaccaaggtggaagggaaggacgtggaccaagagaaggaaaccagagggacggtggaagaaacctgagggaaggagggagaaaccagagggacggaggagctgcagcacaggcaccaacaccggccattggggacagtgcacagttccctactttgggtaagtaa

SEQ ID NO: 2376 - DNA, 378 bp, Arabidopsis thaliana
atggcgacagcagcagcaccagcagtgatttcatggacaagatcaggcattgtgtccaaatccggacaaacccagaagaaatctgagatgaaagtttcttacataactggacttaactcatatggtggtctcaaggcacagaacaacaaggttgtctcaatgggatcaccactctgcacagaacagtgttttgctaacgttgtgatgtctctcaaaggaagaagaggtaatggaggagccttatccaccacgtgtaacgctgtcggagagattttcaagattgcagcaatcatgaacgctcttactcttgttggtgttgcagttggattcgttcttcttcgaatcgaaacttctgttgaagaagctgaagcagagtaa

SEQ ID NO: 2377 - DNA, 525 bp, Arabidopsis thaliana
atggcttcagcatcagcgacagctactcttctcaaacccaatcttccgccgcataaaccgaccatcatcgcctcctccgtatctccgcctcttcctcctccacgtcgcaaccacctcctccgccgcgatttcctctccctggcggcaacatccacgcttctaacacaatcgattcagtttctagctccggcgccggtctccgccgctgaagatgaagagtatatcaaagatacgtcggcagtgatcagtaaagtaaggagtacgctttcgatgcagaagacagatccgaatgtggctgatgcggtggcggagctgagagaagcgtcgaattcttgggttgccaagtaccggaaagagaaagctcttctcggaaaagcttctttccgggatatatactcggcgttgaatgctgtttcaggtcattatgtgagttttggtccgacggctccgattccggcgaagaggaaggcgaggattcttgaagagatggaaactgctgagaaagctctcacaagaggaagatga

SEQ ID NO: 2378 - DNA, 918 bp, Arabidopsis thaliana
atgacactttatattcgtcgtgaatcttccaagctatggaagagattttgctctgagatatcgacggagattggtcttcttgctgagaactggaaatatcttctcgctggtcttatctgtcagtacattcatggtttagctgctaaaggagttcattatattcatcgcccgggaccgacacttcaggatcttggcttctttcttcttccggagcttggtcaagagagaagctacataagtgaaaccgtgttcactagtgtgtttctttcgtttttcctgtggactttccatccattcattctgaaaaccaaaaagatatacaccgttttgatatggtgcagagttctagcattcttagttgcctgccagtttctccgtgttataactttctattcaactcagcttcctggccctaactatcactgccgtgagggctctaaagtttctaggttgccatggcccaaaagcgctcttgaggttctcgagattaaccctcatggggtgatgtatggatgcggagacctgattttctcatcgcacatgatattcactctagtctttgtccgtacttaccagaaatatggcactaaaaggttcataaagctgtttgggtggctcactgcaattgtgcagagcctcttgatcattgcctctcgtaaacattacagtgtcgatgtagttgttgcatggtatactgtgaatttggtggtgttctgtctagacaagaaattaccagaattaccagatcggactgctgtgttgctcccagtaatctcaaaagacagaacaaaagaagagaaccacaagctgttgaatggaaacggtgttgaccctgctgattggagaccgagggctcaggtgaacgggaagattgacagcaacggagttcacacggataacacaatgaatggcgcgtga

SEQ ID NO: 2379 - DNA, 963 bp, Arabidopsis thaliana
atggagatgaacattaagtttccagttatagacttgtctaagctcaatggtgaagagagagaccaaaccatggctttgatcgacgatgcttgtcaaaactggggcttcttcgagctggtgaaccatggactaccatatgatctaatggacaacattgagaggatgacaaaggaacactacaagaaacatatggaacaaaagttcaaagaaatgcttcgttccaaaggtttagataccctcgagaccgaagttgaagatgtcgattgggaaagcactttctacctccatcatctccctcaatctaacctatacgacatccctgatatgtcaaatgaataccgattggcaatgaaggattttgggaagaggcttgagattctagctgaagagctattggacttgttgtgtgagaatctagggttggagaaagggtacttgaagaaggtgtttcatgggacaacgggtccaacttttgcgacaaagcttagcaactatccaccatgtcctaaaccagagatgatcaaagggcttagggctcacacagatgcaggaggcctcattttgctgtttcaagatgataaggtcagtggtctccagcttcttaaagatggtgattgggttgatgttcctcctctcaagcattccattgtcatcaaccttggtgaccaacttgaggtgataacaaacgggaagtacaagagtgtaatgcaccgtgtgatgacccagaaagaaggaaacaggatgtctatcgcgtcgttttacaaccccggaagcgatgctgagatctctccggcaacatctcttgtggataaagactcaaaatacccaagctttgtgtttgatgactacatgaaactctatgccggactcaagtttcaggccaaggagccacggttcgaggcgatgaaaaatgctgaagcagctgcggatttgaatccggtggctgtggttgagacattctaa

SEQ ID NO: 2380 - DNA, 2040 bp, Arabidopsis thaliana
atggatgatcttgccacaacttttgcaaagctgaacagaaatgttaccgggcccaaacaccttggagtaattggtgacagaggatcagggtccttttcaagagaaagttctactgctacagattggactcaggataatgagttcacaagctggttggatcagcacacagttgaagaacaagttcaggaagctagttggtcttcacagccacaatcatctcctaattcaaattctctgtataggacatcctcatatcctcagcagcaaacacagctacaacattacagtagcgaaccgattatcgtaccagaatcgacgtttacatcttttccttcgcctggaaaaagatctcaacagtcttccccgagccatattcatcgtgctccttctcttcctggtggtagtcagtcgaacttttcagctccaaacgcctctccgttgtcgaattctactttccatctctcgggattgtcacatggaccgtcgcattatggtaataatttggctagatatgcctcatgtggtcctactcttggtaacatggtgcaacaacctcctcattgggttaccgaccccggccttctccacggtgatcattccgcgttgttacacagtctaatgcaacagcaacatctccaacaactgcctcctcggaatggttttacttcacaacagttgatatctcttcagcagagacaatctttagctcatcttgctgcattacaacctcagctatatataagggaacacaaacataagtcgtctcatcgaagtcgaaagaacagaggtggtatctctcaacagacatcagatttagctagccagaaaagcgaaagcggattgcagtttagatcaaagtacatgacttcagaagagatagagagtattctcaagatgcagcattctaattcacacagtagtgacccttatgtcaatgattattaccaccaagctcggcttgcgaaaaagtcatccggatcaagaacaaagcctcagttgtatccttctcatttgaaggatcaccaatctcggtcgcggaatagttctgatcagcaaccacaagttcatgttgatgctcttggaaagattacacttccttctatttgcagaccacgagctctactcgaggttgactctcctcctagctctggtcataagcatcttgaagatgagcctcttgttgcagctagagtcacaattgaagatgctttcggagttcttatcgatatagttgacattgataggactcttcaattcaaccggccacaagacggtggtgcacagctcaggagaaaacggcagatccttcttgaaggattagcaacttcacttcaacttgttgatccttttagcaaaactggtcagaaaaccggattgaccacaaaggatgatatcgtgtttctccgcataacgactcttcctaagggtcggaaattgctgacaaagtatctacagcttcttgttccgggtactgagatcgcgcgggttgtctatagccttgcagcagagacgatagctaatcttgctaaagcagttacggtttgtgttcaagcaatggacctccgagcattgagtgcttgtcttgcagctgttgtttgctcgtcagaacagccacctctccgtccaataggaagttcttccggggacggagcatcggttgtcttggtatctcttcttgagagagctgctgaagtaatagtggcggtggttccaccgcgtgtcagcaaccacgggaatccgaatgatggactctggagagcctcgtttgatgagttcttctctcttcttactaaatattgcaggagcaagtacgagacaatccatggtcagaaccacgacaatgcagctgatgtgttggagttagctataaagagggaaatgcctgccgagcttttacgtgcgagtcttcgtcatactaatgaagaccagcggaacttcttacttaacgttggtcgtagtgcatcgccagttagcgagtcgacaacaacccgtgcaagtgcaagtggtggtcagattaactctgaatttgtgaggggttaa

SEQ ID NO: 2381 - DNA, 1428 bp, Arabidopsis thaliana
atggagatggaatcgtcgttacctcatgtgatgctcgtatcattcccagggcaaggtcacataagccctcttcttcgtctcggaaagatcattgcctctaaaggcttaatcgtcacctttgtaaccacagaggaaccattgggcaagaagatgcgtcaagccaacaatattcaagacggtgtgctcaaaccggtcgggctaggttttctccggttcgagttcttcgaggatggatttgtctacaaagaagactttgatttgttacaaaaatcacttgaagtttccggaaaacgagagatcaagaatcttgtcaagaaatatgagaagcaaccagtgagatgtctcataaataatgcctttgttccatgggtttgtgacatagccgaggagcttcaaatcccatcagctgttctttgggtccagtcttgtgcttgcctcgccgcttattactattaccaccaccagttagttaagtttccgaccgaaaccgagccggaaataaccgttgacgtccctttcaagccattaacattgaagcatgacgagatccctagctttcttcacccttcctctccgctgtcctctataggaggtaccattttagagcagatcaagcgacttcacaagcctttctctgttctcatcgaaacttttcaagaacttgaaaaagataccattgaccacatgtcccagctctgccctcaagtcaacttcaaccccatcggtccgctttttactatggctaaaaccataaggtctgacatcaagggagacatctccaagccagatagtgactgcatagagtggcttgactcgagagaaccatcctccgttgtttacatctcttttgggactttggctttcttgaagcaaaaccagatcgacgagattgctcacggcattctcaactccgggttgtcctgcttatgggttttgcggcctcccttagaaggcttagccatagaaccgcatgtcttgcctctagagcttgaagagaaagggaagattgtggaatggtgtcaacaagagaaagttttggctcatcctgcggttgcttgcttcttaagtcactgtggatggaactcaaccatggaggctttaacttcaggagttcccgttatttgtttcccgcagtggggagatcaggtgacaaatgcggtgtacatgattgatgttttcaagacaggattgagactcagccgtggagcttccgatgagaggattgttccaagggaggaggttgctgagcgactgcttgaggccaccgttggagagaaggcggtggagctgagagaaaacgctcggaggtggaaggaggaggcggagtctgccgtggcttacggtggaacatcggaaaggaattttcaagagtttgttgacaagttggttgatgtcaagacaatgacaaacattaataatgtcgtgtaa

SEQ ID NO: 2382 - DNA, 531 bp, Arabidopsis thaliana
atgggatcggaacaaaacgatagcacaagcttcacgcaatcgcaagcttcagagccaaagctatgtgttaaaggatgtggtttctttggatcaccatcaaacatggatctctgttctaaatgttacagaggcatttgtgctgaggaagctcaaacagcagttgctaaagctgctgttgaaaaatctttcaagccttctcctcctcgtagtctcttcatagcagaacctcctgctgttgttgtggaacccaaacccgaaaaggcggcagttgttgttgtctcggccgagccatcttcctcggcggttcctgaggcgaacgagccatcgagacctgcacgaaccaaccggtgtttgtgttgtaacaagaaggttgggatcatggggtttaagtgcaaatgcgggagcactttctgcggcgaacatcggtacccggagactcatgattgcagctttgatttcaaagaagttggacgtggagagattgccaaagctaatcctgtggttaaggctgataaaattcaaaggttctga

SEQ ID NO: 2383 - DNA, 993 bp, Arabidopsis thaliana
atgtctcgcctcctccctcctcatctctccgtcaaccttcctaccatggagaaaactacttcttccgagttaaccccaactcgactcggttttcctaacgagttcccttacgagttcgactctccttccttctcccctggtttcacttctcccggtgactccactgagacggaagacgaaagcagtgatgacgaggaagacttcctcgctgggttaactcgccgactcgctccttcgactcagcgtcttccttcccctctcttcaagtctgaggagaaacgtcaagttgcagctacttcaccacagtcaacactgagtggactcggaagcttttcaaactcaggaagtagaagccctatccttccatctccaccggctcctacgtcatcatttcgtagagacaacgcgtgggatgtgatttctgcggctgctggagaagtcgctagacttaagctcggaagctacgagcctcatcaccttccccttcaaacccctgagtctcttctccgccgtcaaaacgctgccatacatgctgaactccaacaccagcgtctcatcgaacagatgtggctctgctctgctcagtcaagattcaagctctcagagaatcgtatcccaaggagagtagttaatgaagaaggcttatttgagaatccgagatacgtgagacgcaacaatcctacgtggttgcctccgcaacaagccgcagctcctttgaaacgtccttctgctggaaccggtgtttttcttccccggcgatacccatcggccgccccttccgattccctgaaaacaccagtcaacactccagctatgttgcagcctaaagtgaaacctcaaaatctcaactttgatgagttcaccaatattgttgggccaaggcgtagccaattcgattacgagtgcatgttggcgagaagtacagtacttgctcgtcagggaaatttcagagcagttagtggtggtggtcttccacaggattggatgtactga

SEQ ID NO: 2384 - DNA, 798 bp, Arabidopsis thaliana
atggtgaggctgttcaaaatacgtcacacaacatctcacttgttcaagatagacaacttctctttactcaaaaagcatggaatcgaaaaggtcgaatcctctgttttcgatctcgctggtcacaaatggaaactctctgtgtacccaaatgggcataagaatgctaaggggactcatgtctccatgttcttagtgaatcaagttccggtaaatgatatgcctacatatgagctcctagtcgtcagtcaactagagcgaaaatggcacacccatggacgagatgagtttgatataaatccagaaccagctagtgaggggtttttaaggttcatatctcttgctgatcttgagagaaaaggtttccttattggagattgttgtatgtttggtgtcaagtttcatgggattgaacctgctaatcccggaacagcagagtgttttagcttaatagagaagcctcttaaccacaaagtcacttggatgatgagcaagttctcgtccttcaaccctggaaaggctcatcagtctaatgaatttgtcgttggaaccaggaaatggagacttgaagttcatccaagagggtatatggatgaaaaagacaaatcattttctgtgtatctatcagcagaagggtttgtcaacaatgcaccaatgacaaaaacttacgccaagttcaagctgcgggtattggatcaagttagctggaatcatgttgaggaatcaggtatatatataggatccatctttattaggaggaatttgttttggaaatttagtcttgtgatggtaaaatactag

SEQ ID NO: 2385 - DNA, 438 bp, Arabidopsis thaliana
atggcgatgacgtcagcagctaccggatttattctcacggccaacgtcccggcggcaataggcggtggttcttcaaagagcaccaccattgtgtctttcttgccgatgagaagcttcggttcaaggctagtagtcagagcggcggaagatacacctccggcaaccgcctcgtcggatagttcttccaccaccgctgctgctgctccggcgaaagttccggccgctaaggctaaacctcctccaattggcccaaagagaggatccaaggtcaagattctaaggaaagaatcatactggtacaagaacgttggatcagttgtggccgttgatcaggacccgaagacccgatatccggttgtggtccggttcgccaaggtgaattacgcgaatatatcgaccaacaactacgcattggacgaggtggaagaagtaaaatga

SEQ ID NO: 2386 - DNA, 489 bp, Arabidopsis thaliana
atgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccatgaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 2387 - DNA, 1407 bp, Arabidopsis thaliana
atgggtcgtgtccgaaaatcagatttcggttccattgttcttgttctgtgttgtgtcctaaatagcttactctgtaatggaggcatcaccagtagatatgtcagaaaattagaagcaaccgttgatatgcctcttgatagcgatgtttttcgtgttccttgtggctacaatgctcctcaacaggtgcatataacacaaggagatgtagaaggaaaggcagtgatagtatcatgggtgacacaagaagcaaaaggatctaacaaagtcatttactggaaagagaatagcaccaaaaagcacaaagctcatggcaaaaccaatacttacaagttctacaattatacttctggttttatccatcattgccctatcagaaacttagagtatgacaccaagtactattatgtgttaggtgtgggacaaacggagcgtaagttttggttcttcactcctcctgagatcggtcctgatgttccctacacttttggtctcattggggatcttgggcagagttatgactcaaacataaccttaacacattatgagaataacccaacaaaagggcaagcggttttgttcgtcggcgatatctcatacgctgatacttatccggatcatgacaataggagatgggacagttggggaagatttgctgaaagaagcacagcttatcagccttggatttggactaccggaaaccatgaactcgattttgccccggagattggtgaaaacagaccgtttaagccgttcacgcataggtaccgaactccttaccgatcatcaggcagcaccgaaccattctggtactcgataaagagaggaccggcttacataatcgtgctagcttcatattcagcatatggaaaatacacaccacagtaccaatggctcgaagaggagttcccaaaggttaacagaacggaaactccgtggttgattgttctgatgcattcaccatggtacaacagctatgattaccattacatggaaggtgaaacaatgagggtaatgtatgaggcttggtttgtcaagtacaaagtagatgtagtttttgcaggtcatgtccacgcctacgaaagatcggaacgtgtatcaaacatagcttacaatgttgttaacggcatttgcactccagtcaaagatcaatcagctccagtctatatcaccattggtgatggaggcaatattgagggcttggctaccaaaatgactgagcctcagcctaagtactctgcctttagagaagcaagcttcgggcatgctatattctcgataaagaacaggacgcatgctcactatggatggcataggaaccatgatggttatgctgtggagggtgacagaatgtggttttataacagattttggcatcctgttgatgattctccttcttgtaattcttga

SEQ ID NO: 2388 - DNA, 1689 bp, Arabidopsis thaliana
atggaggatctccgtcgtagatttccgactaaaaagaacggagaagaaatctctaatgtcgccgtcgatcctcctcttcgtaaagcctctgacgcgcttcctcttccgttatacctaaccaacacttttttcctctcgctcttcttcgctactgtttattttcttcttagccgatggcgtgagaagatccgtaactcgacgcctcttcacgtcgttgacttatctgagatctgtgctctaatcggtttcgttgcttcgtttatctacctccttggtttctgtggtattgatctcattttccgatcttcttccgatgatgatgtttgggttaacgatgggatgattccatgtaatcaatccctagattgtcgtgaggttcttccgattaaacctaattccgtcgatcctcctcgggaatcggagcttgattcggtggaagatgaagaaatcgttaaattagtgatcgacggaaccatcccttcgtactcattggagacgaaactcggagattgtaaaagagcagcagcgattagaagagaagcggttcagaggataaccggtaaatccttaaccggtcttccattggaaggtttcgattacaattcaattttggggcaatgctgtgagatgccagttgggtatgttcagatcccagtggggattgcaggacctttgttgcttgatggggttgagtattcagtgccaatggctacaacagaaggttgtttggttgctagtaccaatagaggttttaaagctatacacttgtctggtggtgcttttagtgttcttgtgaaagatgccatgactagagctccagttgttagattcccttctgcaagaagagctgctcttgtcatgttttatcttcaagatccttctaatttcgagagattgtctctcattttcaacaaatcgagtagatttgctaggcttcagagtattacatgcacgattgctgggaggaatctgtatccgaggtttgcgtgtagtactggtgatgctatggggatgaacatggtctcaaaaggtgttcagaatgtcttggactttgtaaagagcgagtttcctgacatggatgttattggcatctctgggaactactgttcggacaagaaggcttcggctgtaaactggatcgaaggacgtggtaagcatgttgtatgtgaagcttttattaaggctgagattgtggagaaagtgttgaagactagcgttgaggctcttgtagagcttaacacgctcaagaatcttgttggttcagccatggcgggttctcttggtgggttcaatgctcattcaagcaatattgtcagcgctgtgttcatcgccactggccaagacccagctcaaaacgtggagagctcacactgtatgaccatgattcttcccgatggtgacgaccttcacatctctgtttcaatgccttgcattgaggttggtactgttggaggtgggacacaacttgcatcacaagcagcttgtttgaatctactcggtgtgaaaggatcaaacaacgagaaacctggctcgaacgcacagcaattggcaagaatagtggctggttcggttcttgcaggagagctttcactaatgtctgctattgcagctggacagcttgtgaagagtcacatgaaatacaacagatccagcagagacattggcccttcgtctcaagtcaacaggtga

SEQ ID NO: 2389 - DNA, 2754 bp, Arabidopsis thaliana
atggcgacctccgtcgataaccgccattatcccaccatgaacggcgtcgctcacgccttcaaacctcctctcgttccttctcctcgctcattcgaccgccaccgtcaccaaaaccaaactctcgacgtcatcctcaccgaaactaaaatcgtcaaagaaaccgaagtcatcaccaccgtcgtagacagttacgacgactcctcaagcgacgacgaagacgagagccataaccgtaacgtcccttactacaaagagctggttaaaaaatcaaacagcgatttagaaccgtcgattttagatccgagagatgaatcaacggctgatagttggattcaacgtaactcatccatgctccgtctcaccggaaaacatccattcaacgccgaagcacctcttcctcgtcttatgcaccatggattcatcactccagttccactccattacgtccgcaaccacggtgcagttcccaaagcgaattggtcagactggtcaatcgaaattaccggactcgttaaacgtccggctaaattcaccatggaagagctaatctccgagttccccagccgcgaattcccggtgacactcgtctgcgccggtaatcgccgcaaggaacagaacatggtgaaacaaacgatcggattcaattggggatccgccggagtatctacttctctatggaaaggtattccgttaagcgaaatcctccgtcgatgcgggatctatagccggagaggaggcgcgttaaacgtttgcttcgaaggagcggaggatcttcccggcggcggcggatctaaatacggaacaagtattaagaaggagatggcgatggatccggctagagatattatcttagcttatatgcaaaacggcgagcttttaacgccggatcatgggtttccggttcgggtcattgtaccgggtttcatcggtggtcggatggttaaatggttaaagagaatcatcgtcacgcctcaagaatctgacagttactatcactataaagacaatcgagtccttccttctctcgttgatgctgagctggcaaattccgaagcttggtggtataagcctgaatacataatcaacgagcttaatataaactcggtgattacaacacctggtcacgcagagattttaccgattaatgcattcactactcagaagccgtacacattaaaaggctacgcttattctggaggaggtaagaaggtaacgagggttgaggtgactctagacggaggagacacgtggagtgtttgtgagcttgaccaccaggagaaaccgaacaagtacggtaaattctggtgctggtgtttctggtcacttgacgttgaggttcttgatctgctcagtgctaaagacgtcgcggttcgagcctgggacgagtctttcaatactcagcctgataaactcatctggaacctcatggggatgatgaacaattgctggttcaggattaggaccaacgtgtgcaagcctcatagaggagagatagggatagttttcgaacacccgaccagacccggaaaccagtcgggtgggtggatggcaaaggagcgtcagcttgagatttcctcagaatccaacaataccttgaagaaatctgtctcatctcctttcatgaacactgcctcgaagatgtattcaatctctgaagttagaaaacacaacactgctgactctgcatggatcatcgtccacggtcacatctatgactgtacacgtttcttgaaagatcatccaggaggcacagattctatcctgataaacgcaggtacagattgcaccgaagagtttgaagccattcactctgacaaagccaagaagcttttggaagattaccgtatcggtgaactcatcaccactggctacgactcttcccctaacgtctcagttcatggtgcctcaaactttggtcctttgttagctccaatcaaagagctaactcctcaaaagaacattgctttggtcaacccacgtgagaaaatcccggttaggctcattgagaagacttcgatctcgcacgacgttcgtaagttccgattcgcattaccatcagaagatcaacagcttggtttacccgtggggaagcacgttttcgtttgcgccaacataaacgacaaactctgtctcagagcttatactcccaccagcgccatcgacgcggttggtcatatcgacctcgtcgtcaaagtttacttcaaagacgttcatccaaggtttcccaatggtggactcatgtctcaacacttagactcgttaccaatcgggtcaatgatagatatcaaaggtccactagggcacatcgagtacaaaggcaaaggcaacttcctggtcagcggcaaacctaagtttgccaagaaactagcaatgctcgccggaggaacaggcatcactcctatctaccagatcattcaatctatattgagtgatccagaggacgaaaccgagatgtatgtggtttacgcaaacagaaccgaggatgacattcttgtgagggaagagctagaaggatgggctagtaagcataaggagaggctaaagatttggtacgtcgttgaaatcgcaaaggaaggttggagttacagtaccgggtttataactgaagctgtgcttagggaacatatccctgaaggtttggaaggcgaatcgctagcactcgcatgcggaccaccgcctatgattcagtttgcgttgcagccaaatctagagaagatgggttacaacgtgaaggaggatctcttaatcttctag

SEQ ID NO: 2390 - DNA, 852 bp, Arabidopsis thaliana
atgtacaaggatcggagtggaggaggaataatgggtggtggtggatcatcgagatcggagatccttggtggagctattgatcggaaacgaatcaatgatgctttagacaaacatcttaagaaatcttcaccttctacatctagggttttcacttctaaggacaaagattctgtcccttctacttcaactgctaaatctcagcttcattctcgttcccccgatgttgaatctgacacggatagtgaaggatcagatgtgagtggttcagaaggtgatgatacctcttggatctcatggttttgtaatttgagagggaatgagtttttctgtgaagtagatgaagattatatacaagatgatttcaatctctgtggtttgagtggtcaagttccttactatgattatgcacttgatctcattttagatgttgaatcatcaaatggtgatatgtttactgaagaacagcatgagatggtggaatcagctgctgagatgttatatggtcttattcatgttcgttatattctcactactaaaggaatggctgctatgatggagaagtataagaattatgatttcgggagatgccccagagttttctgttgcggacagtcttgtcttccggttggccaatctgatatcccgaggtcgagcactgtgaagatatactgcccaaaatgcgaggatatttactacccgcgatctaaataccaaggcaacattgatggagcttactttggaactactttccctcatttgtttctcatggcctatgggaacatgaaaccgcagaagccggctcaaaactacgttcctaagatctttggctttaaggtacacaacaaacaatga

SEQ ID NO: 2391 - DNA, 390 bp, Arabidopsis thaliana
atggcttcaaaaatttcagcctctcttgtcattttcctcacattcaacattctttttttcactttaaccaccgcatgtggcggtggctgcagttccacccctaaacccaaacctaagcccaagtccaccggaagctgccctaaagacactctcaagctcggcgtttgcgccaatgttctcaaggatcttctcaaaattcagttgggaacaccaccagtgaagccttgttgttcgctcctcaatggtttagttgatcttgaggctgccgcttgtctctgcaccgccctaaaggctaaagttttaggcattaatcttaatgttcccgtctctctcagccttcttctcaatgtttgtggcaagaaggttccttctggtttcgtatgtgcttga

SEQ ID NO: 2392 - DNA, 837 bp, Arabidopsis thaliana
atgactagtactaacaataattcctataacaccatcgtcacaacacaaccaccaccaacaacaacaacaatggattcaacaacagcaacaactatgataatggatgacgagaagaagttgatgacgacaatgagcactaggccgcaagaaccaagaaactgtccaagatgcaactcaagcaacaccaagttttgttattacaacaactacagcttagcacagcctaggtacttgtgtaagtcttgtcggagatattggactgaaggtggctctctccgtaacgtccccgtaggcggaggttctagaaagaacaagaagcttccatttcctaattcctctacttcttcttccaccaagaacctcccggatctcaaccctcctttcgtcttcacatcatcagcttcatcatcaaaccctagcaagacgcatcaaaacaataatgacctcagcctatccttctcctcccctatgcaagacaagcgagctcaagggcattacggtcatttcagtgagcaagttgtgacaggagggcagaactgtcttttccaagctcctatgggaatgattcagtttcgtcaagagtatgatcatgagcaccccaaaaagaatcttgggttttcattagacaggaacgaggaagagattggtaatcatgataacttcgttgttaatgaggaaggaagtaagatgatgtatccttatggagatcatgaagaccgtcaacaacatcaccatgtgagacacgatgatggtaataagaagagagaaggtggttcaagcaatgagctatggagcggaatcatcctaggtggtgatagtggtggaccaacatggtga

SEQ ID NO: 2393 - DNA, 2361 bp, Arabidopsis thaliana
atgttgttgtttccttctacttctttacgtctcttcttctttctcttcctcttgttctcctcttgtttcttacagattagaggagatgatgatgatgatgatataagcgatgataatatcaaagtcgacccgagtctcaagttcgaaaacccaagtcttcgacaagcctacattgctcttcaatcatggaaacaagctattttctctgatccttttaacttcactgctaattggaatggctctgatgtttgttcctacaacggtatcttttgtgctccttctccttctagtccgaaaactcgagttgttgcgggtattgaccttaaccatgcggacatggctggttatttacctcgtgagcttggtcttctcactgatcttgctctctttcatctcaactcaaaccgcttttgtggagaagtacctctcacgtttaaacacatgaagcttctcttcgagcttgacttaagtaacaaccgttttgttgggaagttccctaatgttgtcttgtctttaccttccctcaagttcttggatcttcggtacaacgagtttgaaggtagtatcccttcgaagctattcgataaagagctcgacgcgatattcttaaaccataaccggtttatgtttgggatacccgaaaacatgggaaactctccggtgtctgctctagttcttgcggataatgatcttggaggttgcataccgggaagtatcggtttaatgggaaagactctcaacgagatcatcctctctaacgataacttaaccggttgcttaccaccacagattgggaatctcaagaatgtgacggttttcgatatcagtttcaaccgtttaagcggtccattgccatcaagcattggaaacatgaagagtttggaacagctcaatgttgctaacaatagattcacaggagttataccaagcagcatttgtcagctctctaaccttgagaacttcacttattcttccaacttcttcaccggtgatgccccgagatgtgtggctcttttgggagacaatgtggtggttaatggctcgatgaattgtattgatggtaaagaagatcaaagatcgtctaaagagtgttcttctccagcctcacgctctgttgattgtagtaagtttgggtgtaacaactttttctctcctccaccaccgtcttttaagatgtcacccaccgttcgagtacttcctccaccgcctccgtcttccaagatgtcgcctacatttagagcaactccgccaccgccgtcttctaagatgtcaccatcttttagagcaactccgccaccgccttcttctaaaatgtcgccttcttttagagcaactccgccaccaccttcttctaagatgtcgccttccgtcaaggcgtatcctcctcctccaccaccgccagagtatgagccatctccgcctcctccttcttccgaaatgtcaccttccgttagggcataccctccaccaccaccactatcaccaccaccaccatctcctcctccaccatacatctactcatctcctccaccaccgtcaccatctcctcctccgccatacatttactcatctcctccgcccgtagttaactgtccacccacaacacaaagtcccccacctccgaaatatgagcaaactccttcaccaagggaatactatccatcaccttcaccaccttactaccaatacacgtcttctccgccaccgcctacttactacgccactcaatctccaccgccaccaccaccgcctacttactacgctgttcaatctcccccgccaccaccaccggtatactacccacctgtaacagcaagtcctcctccaccaccggtctactatacaccggttatacaatctcctcctcctccaccggtttactattcacctgttacccaaagtcctccaccaccaccaccggtttactatcccccggtaacacaaagtccaccaccatcaccggtctactatccgccagttacccaaagtccacctcccccaccagtttattatcttccagtaactcaaagccctccaccgccatcaccagtctactatccaccggtagcaaaaagccctccaccaccatcaccagtctactatccaccggtaacacaaagcccacctccaccgtcaacaccagttgagtaccatccaccggcaagcccaaaccagtctccaccaccggagtatcaatcaccaccaccaaagggatgcaacgacagtccaagtaacgaccatcactaccaaacaccaacaccaccttctctgccgcctccatattacgaagacacacctcttccgcctatccgcggtgtctcttatgcgtctcctcctccaccatcaatcccatactactaa

SEQ ID NO: 2394 - DNA, 1206 bp, Arabidopsis thaliana
atgattagaatgtttgtggggacatggaacgtgggagggaagtcgccacatgaaggattagacttaaaagattggcttaaatctccggctgatgcagacatttacgtgctagggtatgcatataatcatattaattggttttatcgtacttttaatatactttttctggagtttcaagaaatcgtgccgttaaatgccggtaacgtacttggagccgaggataatggccctgcggctaagtggttgtctcttatccgagaagccttgaacaacaccaacaatttatccttctcaggcctctcagatgataccccaatcccatgcaattcaactcctcctcgcggctatagccttgcggcgagtaaacagatggtggggatatttttgtgtgtgtgggttagagatgatctccggaaacgtataaccaacctcaaggtttcatgtgttggccgtggtatcatgggatatcttggaaacaagggctcggtttcgatcagcatgtcgttgcatgagacaagtctatgtttcgtttgtacgcatcttacgtctggagaaaaagaaggcgacgagcttagaagaaacttagatgtgaccgaaatatttaagaggacaagattttcacgttcttctaaagattctcgaccggagacaataatggaccatgataaagtaatatggctcggagatttgaattatcggctaagggcgagcagtgacttgcatgaacagcttagaaaccatgattgggaatcacttctagagaaagatcagcttaagatagaacaaagagctggtagaatttttaagggatgggaagaagggaagatttatttcgcaccaacatataaatatcgaataaactctgataattacgttgtccaaaccgaaaaatcaaaggaaaaacgaagaactccggcttggtgtgatcggatattgtggaaaggtgacggaatgaaacaactttggtacgtgaggggagagtcgaaattctcggaccacagaccggttcaatctctattttcggtacatattgacttgaagaatcaatcgaaccggaaaactaaaccggttaaccaaaatcatcgtccaaacccggtattgacttatacgtgccacgggaaagttcaagctgaagagatcttgttgctcacacgtgcacagagttgtatagatacactacctagacttatttcgtccgcttcctaa

SEQ ID NO: 2395 - DNA, 336 bp, Arabidopsis thaliana
atggctccaagaaccccccttgcactcttcgtttctctcaacctcctcttcttcacttacacctctgcaaccacagggacttgtcctaaaaattccatagagatcggtacttgtgtcactgtgctcaatctagtggacctaacattgggaaacccacctgtaaagccatgttgctcgctcatccaaggcttggctgaccttgaggccgcggtctgcctttgcactgcagtcaaggctagcattcttggaattgtcaatattaaccttcctatcaatctcagcgtactcctcaatgtttgtagtaggaatgctccaaagagtttccagtgcgcgtaa

SEQ ID NO: 2396 - DNA, 549 bp, Arabidopsis thaliana
atgggtgttgagaaaatggtgtgtttagcttctcgtacgggtcgtcagtttcagagatacaacaaaggtcgtcgtcaagtcgttggatgtgttccttacagattcaagctatctaatgatggtaaaataagtgatgaagtagaagttcttgttatctcttcccaaaaaggccacgccttaatgttccccaagggtggttgggagcttgatgaatctgtagaagaagctgcatcaagagaatgtcttgaagaagctggagttcttggcaacgttgagcaccaacttggaaaatgggattttttaagcaaaagcagaggaacatactatgaaggactaatgttccctatgcttgttacagaacaacttgagctttggcctgaacaacatgttaggcaaagaatctggatgaatgtaaccgaagcaagagaagcttgtagagattggtggatgaaagaagcattagatgttttggttgagagactttcatcaccaatgaatcaaccaaaggaagagaagactatgtcaatctctattgaaacaatgtgttga

SEQ ID NO: 2397 - DNA, 1833 bp, Arabidopsis thaliana
atggacgccctgcttcaagtttcagttgatgggtttagatttgagaacggatctggatcttgctgcaaacccagaaacaatctcgaatctgggaacaatctcttccctgatttccacgagtctcagaatcagtcttcaccaaacgattcacctccaacggtgtgtttggataactctcctgttctgaagtacatcaatgatatgttgatggacgaagaagacttcgtaggtatatctcgtgacgatttagctttacaagccgctgagagatccttctacgagataattcaacagcaatctccagaatctgatcagaacactagctcctcctccgatcaaaactccggtgaccaagatttctgttttcccagcacaacaacagattcatcagcgttggtttcgagcggagaatcacagagaaagtaccgtcatcggaatgatgaagaagatgatcttgagaacaatcggagaaacaaacaaccagcgatatttgtctcggagatggaagagttagcagtgaagttagaacatgtgttgttggtatgcaaaacgaaccaagaagaagaagaagaaagaacagtaataacgaaacagagtactccaaacagagcaggaagagcaaaaggttcatcgaacaaatcaaagacgcacaaaactaataccgttgatctacgaagtctcttgacgcaatgtgctcaagctgtagcgagctttgaccagagaagagctacagataaactcaaggagataagagcacactcttctagcaatggagatggaacacaaagactagctttttactttgcagaggcgcttgaggcacgtatcactggaaacatctcaccgcctgtttctaatccgtttccttcaagcacgacatcgatggtggacattttgaaagcgtacaagctgtttgttcatacttgtcccatctatgtaactgattacttcgctgcgaacaaatcgatttacgaacttgctatgaaagcaactaagcttcacatagttgattttggagttctctacggctttcaatggccttgtttgttacgagctctgtctaaacgaccgggcggaccaccaatgcttcgggtgactggaatcgagctgccacaagcgggttttcgtccttcagaccgcgttgaagagactggtcgaagactgaaaaggttctgcgatcagtttaatgttccttttgagttcaacttcatagccaaaaaatgggaaaccatcactcttgatgaacttatgatcaatccaggagagacaacggtcgtcaactgcattcatcggttacaatacactcctgatgaaactgtgtcattagactctccaagagacacggttctgaagctattcagagatatcaatcctgacctctttgtgtttgcagagattaacggaatgtacaactctcctttcttcatgacgaggttccgagaagcgctttttcattactcttcactctttgacatgtttgacaccacaatacacgcagaggatgagtacaaaaacaggtcactgttggagagagagttacttgtgagagacgcgatgagcgtgatttcctgcgagggtgcagagcggtttgcgaggcctgaaacctacaagcaatggcgagttaggattttgagagccgggtttaagccagcaactattagcaaacagatcatgaaggaggctaaggaaattgtgaggaaacgttaccatagagattttgtgatcgatagcgataacaattggatgcttcaaggatggaaaggaagagtcatctatgctttttcttgctggaaacctgctgagaagttcacaaacaataatttaaacatctga

SEQ ID NO: 2398 - DNA, 1062 bp, Arabidopsis thaliana
atggctacatgctggcctgagccgattgtttccgtgcaatccttgtcccaaaccggtgtaccaactgtaccaaaccgctatgtgaagccggctcatcagagaccggtctttaacaccacccaatccgatgctgggatagaaatccctgttctagacatgaacgacgtttgggggaaaccagaggggctaaggctcgtgaggagcgcgtgtgaggagtggggtttcttccaaatggtgaaccatggtgtgacccactcgttgatggagagagtgagaggagcgtggcgagagttcttcgagctaccgctagaggagaaacggaagtatgcaaactcaccggacacgtacgagggatatggaagccgccttggggttgtgaaagatgctaaattagattggagtgattatttcttcctcaattacttgccttcttccataagaaacccttccaagtggccatctcagcctcctaagatcagagaattgatcgaaaagtacggagaagaagtgagaaaactgtgcgaaaggctaacagagacgttgtcagagagtttaggtttaaaaccaaacaagctcatgcaggctttaggaggaggcgacaaagtcggagcttctctgaggacaaacttctacccaaaatgccctcagccgcagctcactttaggtctctcttctcattctgaccctggaggcatcaccattcttctcccggacgagaaggtcgctggccttcaggtccgtcgtggtgatggctgggtcaccattaaatcagtccctaatgctttgatcgttaacattggagatcaacttcagatacttagcaatggaatttacaaaagcgtggaacatcaagtgatcgttaattccggtatggaacgagtctctttggcattcttctataacccgagaagtgatatcccggttggaccaatcgaagaactagtaactgcaaaccgacctgctctttataaaccaatcaggttcgacgagtaccgttctctgataaggcaaaagggtccttgtggaaaaaaccaagtcgactcactgttattaactagataa

SEQ ID NO: 2399 - DNA, 885 bp, Arabidopsis thaliana
atgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaa

SEQ ID NO: 2400 - DNA, 729 bp, Arabidopsis thaliana
atggctaaggatgaagccaagggattgctgaaaagtgaagagctctataaagtttgtccttacatactcatctctacgttatatatactggagactagtgtgtacccacgcgagccagaggttctcagggagcttaggaacattactcataaccaccctcaagctggtatggctactgcaccagacgctggccagttgatggggatgctgctgaatctggtaaatgcaagaaagactatcgaggttggggttttcactggatactctcttctcctcactgctcttacgctaccagaagatggcaaggttatcgccattgacatgaatagagactcgtatgaaataggattgccggttataaagaaagctggtgttgaacacaaaattgatttcaaagagtctgaagctcttccagccctcgacgagcttttaaacaataaagtgaatgagggtggattcgacttcgcatttgtggatgcagacaagctgaattattggaactatcatgagaggcttattagattgatcaaggttggtgggatcatagtgtatgataacactctctggggaggatcagttgctgaaccggactcgtccacgcccgagtggaggatagaagtcaagaaagcaaccctcgagctgaacaagaaactctcggctgatcagcgtgtgcagatctcgcaagctgcgcttggcgatggtatcactatttgcaggaggttatattga

SEQ ID NO: 2401 - DNA, 216 bp, Arabidopsis thaliana
atgggtggaggaatggaaacgaacaagaacaagttcatcgaggactggggatctgctagagagaatctcgagcacaatttccgctggactcgtcgtaacttcgctctcatcggaatcttcggcatcgctctcccgatcattgtctacaagggaatcgtcaaagatttccatatgcaagatgaagatgcaggcagaccacacagaaagttcctctga

SEQ ID NO: 2402 - DNA, 1452 bp, Arabidopsis thaliana
atggaggatatacaggaggaagagaacggtacggacgaggaggttctgggatcgagcttgaccatggagaaagtggccgcagcgaagcagtacatcgagaatcactacaaagctcagaacaagaacattcaagagaggaaagagagacggtggatcttagaaagaaagttggcgtcttctggagtgccaaaagaggagcaaatcaacatgattaaagacctggagagaaaagagacagagtttatgaggcttaaaaggaacaagattagtgtcgatgactttgagcttttgactatcattggaagaggtgcttttggtgaggttcgcttatgtcgggagagaaagtctggaaatatttatgccatgaagaagttaaagaaatctgaaatggtcatgagaggacaggttgagcatgtcagagcagagaggaacctgctggctgaggttgaaagccattatattgtgaagctttactattcatttcaggatcccgagtatctgtatctgattatggaatatctccccggtggtgatatgatgaccttgctcatgagggaggacacattacgggaagatgttgccagattttatattgctcaaagtgtcctggccattgaatccatacacagatacaactatattcatagggatatcaaacctgataacctacttttggacaaagatgggcacatgaaactctcggactttgggctctgtaagcctcttgattgtagaaatttaccttcaattcaggagaatagggccacggatgatgaaactatgtcagaacctatggatgttgatagatgctttcctgacactgataacaagagaagctggcgcagtccccaggaacaacttcagcattggcagatgaatcgcagaaaactagcattttcaactgtgggaacaccggactatattgctcctgaagttttgctgaagaaaggatatggcatggaatgtgattggtggtcattaggtgcaattatgtacgaaatgctcgttgggtatcctcctttttatgctgatgaccctatatcaacttgcagaaagatcgtccattggagaaaccatttgaaatttcctgaggatgcgaagttttcatctgaggcaaaagatcttatctgcaggttgctgtgcaacgttgaccataggcttggtactggaggaggagcccagcaaatcaaggatcatccttggttcaaggatgttgtgtgggaaaagctctatgaaatggaggctgcgtacaaaccagaagtgaacgacgagctagatacacaaaattttatgaagtttgatgaagtgaattctcctgcacctgaaagaactagatcaggactctccaggaagatgcttcttgctcccaaggatttaagttttgttggctacacatacaagaactttgacgctgtaaaaggattgcgtcattcacttggtaaattcacatga

SEQ ID NO: 2403 - DNA, 1527 bp, Arabidopsis thaliana
atggcttctgtaagcttacttgacgttgccatagccatcatttgccttttcttcttctattacatgtacttcaagaaacctcatggtcaggtttttcgaaactggccagttattgggatgcttccaggcttcctgatggttctccaccgcatctacaacttcggcgtggaggctcttgaaatgagccacttaacctttctatttaagggaccgtggttcgctgaaatggatatgttgttcacagttgatccagctaatattcactacatattgagctcaaacttctccaactataccaaaggtgccgactttaaagaagtctttgatgtttttggagaaatgatctttagttcggactcggagctatggaagaatcaaagaaaagctgctcaattcatgcttaatcatcaaggctttcaaaagctatcattgagtgcaacgaggagtaagctttacgatggtcttgttcctcttttcaatcaatgttgtgaggaagagaaggtcgtggatttgcagcaagtgtttcaaagattcacttttgatacaactttctttattgttaccgggtttgatcctaaatctctctctattgaaatgccggaagtggagtatgctaaagctcttgacgatcttggagaagggattttttataggcacattaaaccgaagttcttctggaagctgcaaaaccggtttgggttagggcaagagaagaggatgactgaagctgatgccacttttgatcgcgtttctgcgaaatacatattagctaagagagaagagataaggtcacaggggattgatcatcatgcaaatggtgaaagtgaggatcttttgacatctcacataaagcttgatacaaccaagtacgagctcttgaacccgagtgatgataagttcctcagagacaccatcttagctttcaatcttgctgggagagacacaacgtcttctgctctctcttggtttttttggcttctctctgaaaaccctcaagttgtaacaaagattcgtaaagagatcatcgacaaaaatatttcaaaagacggaagaaatggccaagagaacttagacaagttggtctacttacatgcggcgttgtatgaatcaatgaggctctatccaccggttgccttccaacgcaagtctcctataaagccagatgtgctgccaagtgggcataaggtagaagcaaactcagtcatcataatttttcttttcgcgttgggaaggatgagagcggtttggggagaagatgcaacagagttcaagccagagagatgggtttctgagtccggtgggttgagacatgcaccttccttcaagtttttatcatttaacgccggtccgagaacttgtcctggtaagcaattagctatgactctaatgaagaccgtagttgtggagatattacaaaactatgatattgatgttatcaaaggacagaagattgagccagaacctggtcttatgttgcacatgaagcatgggcttagagtcacaattactaagagatgttcagcttga

SEQ ID NO: 2404 - DNA, 705 bp, Arabidopsis thaliana
atggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcaaaaaggatcaacttatgacaaatgaaatcagagaacttaatcgtaagggacaaatcatccaaaaagagaatcacgagctacaaaatattgtagatataatgcgtaaggaaaatattaaattgcaaaagaaggttcatggaagaacaaatgcgattgaaggcaattcaagtgtagatccaataagcaatggaaccacaacatatgcaccaccgcaacttcaactcatacaactacaaccagctcctagagaaaaatcaatcagactagggctacaactttcctag

SEQ ID NO: 2405 - DNA, 678 bp, Arabidopsis thaliana
atggcgaagaaagaagagagtgtgaagcttctagggttttggataagcccttttagtcgtagagtcgagatggctctcaaacttaaaggcgtaccatacgagtacttggaagaagacttacccaaaaagagcactttacttcttgaactaaatccggttcacaagaaggttccggttcttgttcacaatgataaattattatccgagtcacatgtgatcctcgaatacatcgaccaaacttggaataacaatccaattctacctcacgatccctacgagaaggccatggttcggttctgggccaagttcgttgatgagcagatcctaccagttggcttcatgcccctagtaaaagcagagaagggaatagatgttgctattgaggagattcgagaaatgcttatgtttcttgagaaggaagtcactggaaaagatttctttggtggcaagacgatcggattcttggacatggttgcgggaagtatgatcccgttttgtcttgctcgggcttgggaatgtttggggattgatatgactccagaggatacgtttccagaattaaacagatggatcaagaacttgaatgaagttgagatcgtgagggaatgtatacctccaaaagagaaacatattgagcgtatgaagaaaattatagagagagctaagtctacgttctaa

SEQ ID NO: 2406 - DNA, 402 bp, Arabidopsis thaliana
atggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataa

SEQ ID NO: 2407 - DNA, 327 bp, Arabidopsis thaliana
atgaaaataatagtctccatcttagtgttagcctctcttcttctaatcagttcatctcttgcttcggctactatatcagatgcttttggtagtggcgcggtagctccggcaccgcagagcaaagatggaccggcgttagagaaatggtgtggacagaaatgtgaagggagatgcaaagaagcggggatgaaagatcggtgtttgaagtattgtgggatatgttgcaaagactgtcagtgtgttccttcaggcacttatgggaataagcatgaatgtgcttgctatcgtgacaagctcagtagcaaaggcactcctaaatgtccttga

SEQ ID NO: 2408 - DNA, 1113 bp, Arabidopsis thaliana
atgtctctcgttctctctctttgcttggtcttcctttgttctcttgttcatggttctcatagcttaccagcacaacggactcctcatcttgatgggcttctcccaaatgggaactttgagcaaattcctaacaaatcaaacatgagaaagaggcaaataattggcaaatactctcttccacattgggaaatctccggccacgtagagctagtctctggcggtccacagcccggtggtttttacttcgcagtgccacgtggagtccacgcagctaggctagggaacttagcatcaatatctcagtatgtgaaagtgaaaagcggcttggtctattctctaacgtttggtgtcacgaggacttgtgctcaagacgagaacatcagaatctctgtgcctggtcagaccaatgagctaccaatccaaacattgttcagtaccaacggtggtgatacgtacgcatgggcttttaaggcaacgtctgacttggttaaggtcactttttataatcctggtgttcaagaagaccctacttgtggcccaatcgttgacgctgttgccattaaggagattcttcctctccggtataccaaagggaaccttgtgaaaaacggcggatttgagaccggtccacacgtattcagcaacttctctaccggaattttaattccggcgaagatacaagacctaatctcaccgcttccgggatggatcgtcgaatctctaaaaccggttaagtacatcgataaccgccacttcaaggttccctcaggtctcgcagcaatcgagcttgttgccggaagagaaagcgcaatcgctcagatcatccgtaccgtctccggtaaaaactacattctctcgtttgttgtgggagacgcacacaatggttgtcacggatcgatgatggtggaggcgtttgcgggaatatcggcgtttaaggttacattcgaatctaatgataaaggagcgttcaaagtggggcgtttcgcgtttcgtgccgattcgaatcgcacaaggataactttctatagtgggttttatcataccaagcttcatgattttggacatctttgtgggcctgtgcttgataatgttagtgtttttttggcccattaa

SEQ ID NO: 2409 - DNA, 3279 bp, Arabidopsis thaliana
atgagtctgttccatgtgctagggtttggtgtcaagattgggcatctcttctggatgctatgctgctggtttgtttcttggttcgttgataatgggatcgaggacaagtctggtcttttagttggctctgtcggtgatcttgagaagactaagatgactacgttgaagaagaagaacaagatgtggttctggaataagatctctagcagcggactcaagatcccgagtttctcttatcagtttcttggctctgttaaattcaacaaggcgtggtggaggaagcttgtggtggtttgggttgtcttctgggtcttggtctctatttggacgttttggtactttagctcgcaagctatggagaagaggaaagagacgctagctagtatgtgtgatgagagagctcgtatgctgcaggatcagttcaacgttagcatgaatcatgttcaagccatgtctatcttgatctcaaccttccaccatggcaagattccttctgctatcgatcagagaacattctcagagtacactgatagaacttcctttgagaggcctcttactagcggggtagcttatgctatgagggtgctccattcagagagggaagagttcgagaggcaacaaggttggactattaggaagatgtattctcttgaacaaaacccagttcacaaggatgactatgacctggaagctttggaaccatcccctgtccaagaagagtacgctccagtcatctttgctcaggacactgtttctcacgttgtttctctcgatatgctgtctgggaaagaagatcgtgaaaacgttttgcgggccaggagttcaggtaaaggggttttgacagctcctttcccattgataaagacaaatagacttggggtgatcctgacatttgcagtgtacaagagagatctcccctccaatgcaacgccaaaagagagaattgaggctactaacgggtatctcgggggagtgtttgacattgagtccctggtagaaaacttgcttcaacagctggctagcaagcaaacgattcttgtcaatgtgtacgatatcaccaatcactctcaaccgattagcatgtatggtacaaatgtgtcggctgatgggttggaacgtgttagtccactaatctttggcgatccattgagaaagcatgagatgcgttgcaggtacttgcagttggcacatacatatgtctgtaatttcttcttgtttgcaagaatccaggtgctaacattttgttgtgagcttcttcctctttgtagatttaagcagaaaccaccatggccagtgctatcaatggtgacatcattcggtatccttgtgattgcgttacttgttgcacatataatccacgcaaccgttagtcgaatacacaaagttgaagaagattgtgataaaatgaagcagctcaagaaaaaggctgaagcagcagatgttgcaaagtcacagttccttgccactgtttcacatgaaatcagaactccaatgaatggtgttctaggaatgttgcatatgcttatggacacagagttagatgttacgcaacaggattatgttaggaccgcacaggcaagtggaaaagctttagtctcgctaataaatgaggttttggaccaagcaaagattgaatctggaaagcttgaacttgaggaggtgcggtttgatttgagaggaatattagatgatgtcctgtcactcttctctagcaagtcccaacaaaagggggtggagttggcagtatacatatctgatcgtgttccagatatgttaattggtgatcctgggaggtttcgacaaatactcacaaatcttatgggtaattccattaagttcactgagaaaggacacatctttgtaactgttcatttggtggatgagctatttgaatctatcgatggagagacagcatcatctccggaaagtacactgagtgggcttccagttgcagaccggcagaggagctgggaaaactttaaagctttcagctccaacgggcatcggagctttgaaccatctccccctgatataaacctaatcgtctcagttgaggatactggcgtagggatccctgtagaagcgcagtcccgtatttttacgcctttcatgcaagtcggaccatccatatccaggacgcatggaggcacaggaattggacttagcataagcaaatgtctagttggactgatgaagggagaaattggattctcgagtactcccaaggttgggtccacattcacatttactgctgtattttccaatgggatgcaaccagctgaaagaaagaatgacaacaaccagcccatattctcggaattccggggcatgaaagctgtggttgtggaccataggcctgcaagggcaaaagtctcgtggtaccattttcagcgtcttggaattcgagtcgaagtagttccacgtgttgaacaggctctacattatctgaagattggtactaccactgtgaatatgatactcatagagcaagaaatatggaatagggaagcagatgatttcattaaaaagctacagaaagaccctcttttcctttctcctaagttgattttgttagcaaactcagtagaatcgtcaatatcagaggctttatgcaccggtatagatcctccaatagtgatagtgaaaccattgagggcgagtatgctagcagcaactttgcagaggggattgggtattggaatcagagaaccacctcaacacaagggacctcctgctttgattctcaggaatcttctccttggtagaaaaattttaatcgtggatgataacaacgtaaacctcagagtggcagcgggagctctgaaaaagtacggagctgatgtggtctgcgctgagagtgggataaaggcaatctcattgcttaagccacctcacgagtttgatgcttgcttcatggacattcagatgccagaaatggatggatttgaagctacaaggagaatacgagatatggaagaggagatgaacaagagaataaagaatggggaggctttgatagtagagaacggtaacaaaacaagctggcatcttccggtattagcaatgacggcagatgtgatccaagcaacgcatgaggaatgtctgaagtgtggaatggatggatacagaatcataagaggagatggggctggaagaagaacagcgaaggaaacacaaaaactcgtgtctcctatgcatcttgaagtagtagaaaaacagattgacgattgcaaaaagagtgtatatagaaaggccggtgtgaccaggccaagaacttag

SEQ ID NO: 2410 - DNA, 294 bp, Arabidopsis thaliana
atgcagtcggcgaaggaaaagatcagtgacatggccagtacggccaaggagaaactcaacatcggtggcgcaaaggcacaaggtcatgcggagaagacgatggcaaggaccaaaaaagagaagaagttggcccaagagcgagagaagtctaaggaggcgcaggccaaagctgacctccatcaatccaaggctgagcatgctgcggacgctcaggttcacggccaccatcttcccggtcactccacctaccctacccgagccaccggagctaattacccgccgggacagatctaa

SEQ ID NO: 2411 - DNA, 1023 bp, Arabidopsis thaliana
atgttgggaggcaacaatgataaccctgtgccgcaggttctaatgaacgacagccagtttcggtatcaatcaaacacatcgttgaatcagcttcacttgcttgggacgatgagagctggttgtactattgatcctgtaaactactttgctaatgataaccttgctcctatgatgcggcttaatagcacacgcggaagggaaactgaaaacaacaatattatgcagagacagcagaagctgcagatctctttgaattataactacaacaacaataatactgttgttcaagatgaagtcccaaagcagaacttagtgtcaactggtctgagactatcttatgatgatgatgagcgcaactcttctgtaacttcagcaaatggaagcataacaactccagtctatcagtcactcggtgacaatatcagattggacctcaatagacagaacgacgagcttgatcagtttatcaaattccgggcagatcaaatggcgaaaggtgtgagagatattaaacagagacatgtcacgtcctttgtcacggccttagagaaggatgtgagtaagaagcttcaagagaaagaccatgagattgaaagcatgaacaagaagaaccgggaactcgtggataagataaaacaagtggcagtggaagctcagaactggcattacaaagcaaaatacaatgaatctgtggttaatgccttaaaggtaaatttgcaacaagtgatgtcacatggaaacgacaacaatgcagtaggaggaggagttgctgatcatcatcaaatgaaagaagggtttggggatagtgagattgatgacgaagcagcttcttacaattacttgaacatcccggggatgccaagtactgggatgagatgtaagttgtgtaacgtaaagaatgtttcggtcttgctcgtgccatgtaggcacttgagtttgtgtaaagattgtgatgtgtttactggtgtttgtcctgtttgccagtctttgaaaacttctagcgttcaggtcttcttcttctga

SEQ ID NO: 2412 - DNA, 2001 bp, Arabidopsis thaliana
atgcaaggtccacgaagcactggtgattcatcgactggaataaattatgcagatggagaacccatctgtagcaccaattcagagactacttccaataacatcctgaatccagtggatgttcagtttccaaacaatactacaggttcaggacgaccaacttacgcaagctctagctcgcatgttgttcaaaatcataactggtggagttttggtgaatccagctctagattggggccttctgatcatttaaattccaatggttcaaagactgatcgacagcttctctcagatggctatggatttgaggaagggcaatcaggtatgttgttacctggagagtcctttttgcgtgggtcaagctctagtcatatgttaagtcatgtaaatctgggcaaggacatggacattggtagtggtctgcagacttctggggtcgttatccgccataataactgcgagacttcattgggaagctcaagtcaaaccgcagaggagagaagcagtggtccaggttcttcgttgggtggtctaggttcatcctgcaaaagaaaggctcttgaaggagctcctagccattctttccctggtgaaagtcatggttgcttttttcaaactgagaatggtgcttggaatgagggtcttgctcaatatgatgcttcaagtagcttaagtttgtctatgccctcacaaaattctccaaatgttaataatcagtctggtctaccagaaccaagatttggattgggtggtgggagagcagttacagcaagtgcttttccttctacaagaagcacggaaaccatctctagacctggcaggcggttaaatcctgggcagccaccagagtcagttgcattcagcttcacacagtccggtagttctgtgcgtcagcaacagcagttaccagcaacttctccttttgttgaccctctggatgcaagagcaataccagttacaggtagctcaagcagtggtgatggtcagccaagtatgatccaccttcctgcattgacaagaaatatacaccaatttgcttggagtgcttcgtctagttcgagagcaaacagtatgcctgaagagggattgtcaccatgggacgcgccaagaataaactcagagcagccagtctttactacacctgcaaatgaaacgagaaatccagtgcaggatcagttttgttggagtttcactcgtggaaaccctagtacatctggagattctccctttgttcctcgagcaggatcgagttcagggatccatggtttgcagccgaatcccacttgggttactccccataatcaatcaagaatatcagaagttgctccgtggtctttatttcctagtatcgaatctgaatctgctactcatggtgcttctcttccattactacccacagggccttctgtttcctcgaatgaagctgcagcgccgtctggatctagtagtcgtagtcatcgctctcgacaaagaagatcgggattattactggaaaggcaaaatgatcatctccatttgcgtcacttaggaagaagcttagctgctgataatgatggaaggaaccggctgatttccgagatacggcaggtgttgagtgccatgcgaagaggggagaatttacggtttgaggattatatggtattcgatccactgatctaccaaggtatggccgagatgcatgataggcatcgggatatgcgtcttgatgttgataacatgtcatatgaggagctattggcacttggggaacgcataggagatgtgagcactggtctaagcgaagaggtgatcctgaaagtaatgaaacagcacaaacatacatcatccgctgctggctctcaccaggacatggagccttgctgtgtctgtcaggaagagtatgcagaaggagatgatcttggaacactgggatgtggtcatgaatttcacactgcctgcgtcaagcaatggctgatgctcaagaatctctgcccaatttgtaagactgtggctttatcgacataa

SEQ ID NO: 2413 - DNA, 1509 bp, Arabidopsis thaliana
atggcgaaaggagacgataatgtgcagaggaagaagaataaagtgacgaggaagaagatgagtaggaagaacgataccgccaccgtatctgctcgtatcgccgccattatcgccgccaagaaacgtcgcaagtctggcaaacgcagcatgtgtcagggaatgtgttttactcttcctacacttgaagatccattcaatgaaaggcaaggtaaagctgatattactaaaaagaagaagaaaaagaaaaaggtgaagagtagagaagacaagaaaccatctcctatgtctattgaaggtgttgagaagatggatggtccaccaaagtttctgatgttaaacttgaatgagattgagagctcatttcgtaaagatattacatacagtgaacaacatgataagtctttgtttactagtagttgggggattgagttctggaaatgttactcatctgggaatgatattttggacacgagtggaatgtcttccactgtggaacagattgcttggattgtttctactgctgctgatgctattgctagacgggagaaagacgaggtggaggaggaggaggagttgttgggaaacagtccttttcttttgtaccttgtgccatctcagtctaaagcttctcaggttcgatcggtttgcaaggcactgaaaggtattggaattcatactgtgagcttacaccaaggagcaccactagatcatcagatttccggattaaaaagcgttgagcctgaatttatagttgctacacctgagagacttttggagattgttaccttgaagggtgttgatatatccaacgtttcattgctggtcatcgatgaactaggttcactgtgcagtggtggttatctaaatgctgttaaatccatcaagcaggccatttccagcaaacaccaaactatagtttttaacaacagttttagtgcttccattattccggccgtacagagtttcttggggggatcagttaacagagttactgtcaatgagtctgttgccagccaaggctcttgtattacccagactgttagtgtatgcgcctcggaggaaaaaaaactgcagaagttcgcaaagcatctggattcatcttcgtcgaagttaatatacattgttacgaaggaggaaagtttcaaaaagataatggctatccttaagctcaagggtatctctgtatcaaccagtagtgattcaaaactctcagaggtcaaaaagagccggaaacctgtggcgcacttgattgattttgaacagttggatactacagttatgagggactctgaaaccgttctacttccagactttttcccatcaatcgaaatttacactcagattctgacaagtatggctagagagagtgctcacggcgtacttcacagctatataacagaaaaggatgctgcttcttatcaagctggaccattggtgaatgtcctggagaattgtggtcagaacgtacctgaccgttggaggaatatggatgttgctatgtctgattga

SEQ ID NO: 2414 - DNA, 630 bp, Arabidopsis thaliana
atgggtcttaccccaactgcaaccctactcgtcgctgttttcgcgttttgcctcgtcgctgtaacggcgcagttcgcctacgttttgtggtggaaacgtcggttccgtcgtcggagtatcgccggatcagaacgcgacgctttttcctctcgcggtggtgacctaacggctacaccaccgccatcgaaagagcttctttacttcttcttgttctgtctcgaaaacaaacagttcagaataggatctgccaccgctccgccgctccctgcagccgcaccgccggttaatgacgtggcatcaaagtggtcaataaacggagaaaatttactttgcggaccttcggagactttgtttaccatcgctgaagactatactagcgagtccgatcatcggacgggtgagattgatccacgtggaagcatctttacagaggatcatgtaaaggatgatgaagtggaagaggaggtagtcgcgacggatataagcgacgacgaggttgactttagccactataatcaaactacgccgttttctactccatgtgcttccccaccgttttacacgccgtctccttctccgattcgtgatgatctctctaagacggtacgtgaggagagtgtgtacggctga

SEQ ID NO: 2415 - DNA, 2430 bp, Arabidopsis thaliana
atggcaaaccctaagctcactagggttctaagcacaagggatcgcgtgcaagacacgctttccgctcaccgcaacgaactcgttgctcttctctccaggtatgtggatcaggggaaagggattcttcaaccacataacttaattgacgaactcgaatctgttatcggagacgatgaaacaaagaagagtctctctgatggtccttttggagagatccttaaatcagcaatggaagctatagttgtaccaccttttgttgcgttagccgttagaccaagacctggtgtttgggaatatgttcgtgttaatgtcttcgagctaagtgttgaacaattaacagtctctgagtatcttcgtttcaaagaagaactcgttgatggacctaatagtgaccctttttgtcttgagcttgatttcgagccctttaacgcaaacgtgccacgtccttctcgttcgtcttcgattggtaatggagttcagtttctgaatcgtcacttgtcttctgttatgttccgtaacaaagattgcttggagcctctgcttgatttccttagagttcataagtacaaaggtcatccgttgatgttgaatgatcggattcaaagcatatctaggcttcaaatccagcttagtaaagcagaagatcatatctctaagctttcacaagaaactccgttctcggaattcgaatacgcgttgcaaggaatgggttttgagaaaggatggggagataccgcagggagagttcttgaaatgatgcatcttctctctgatattcttcaagctcctgatccttcgtccttggagaagtttcttgggatggtaccaatggttttcaacgttgtgatcttatctccacatggatatttcgggcaagccaatgttttaggcttacctgacactggtggacaagttgtctatattcttgaccaagtccgtgcccttgagactgaaatgctgttgagaataaagagacaggggttggatatatcacctagtattcttattgtaactaggttgataccggatgctaaaggaactacgtgtaaccagcggttagagagagtcagcggaacagagcatactcatattctccgggttccttttaggtctgagaaaggaatcctccgtaagtggatttcaagattcgacgtatggccttatctagagaactatgctcaggatgcagcaagcgagattgtcggtgaattgcaaggcgtaccggactttatcatcggtaactatagtgacggaaaccttgttgcatcgttaatggcacatagaatgggtgttacacaatgtactattgcacatgctttggagaaaaccaagtatccagattcagacatttactggaaagacttcgacaacaagtatcatttctcttgtcaattcacagctgatcttatcgcaatgaacaacgcagatttcatcatcacaagcacttaccaagaaatcgcaggaacgaagaacaccgtcggtcaatatgaaagccacggggcttttacgctcccgggactatatagagtagtacacggcatcgatgtgtttgatccgaagttcaacatagtctcgcccggtgcagacatgaccatatatttcccgtattccgaagaaactaggagacttacagctttacatggttcaatagaggaaatgctctatagccctgaccagactgatgagcatgtcggtacactgagtgatcgatcaaagccaatactcttctctatggcgaggctcgacaaagtgaagaacatctccggtttagttgagatgtatagtaagaacacaaagttgagggagctggttaatctggttgtaatagctggtaacattgatgtgaacaagtccaaagatagagaagaaatcgtagagattgagaaaatgcataaccttatgaagaattacaagcttgatggacagtttcgttggataactgctcagactaaccgagctcgaaatggtgagctttaccgctacatcgcggatacaagaggtgcttttgctcagcctgcgttctacgaggcttttggacttacggtagtggaagcgatgacttgcgggctcccgacttttgccacttgtcacggtggtccagcagagatcatcgagcacgggctctcgggtttccacatcgatccataccatcctgagcaagcgggtaacataatggctgatttctttgaacgttgtaaggaagatccaaaccattggaagaaagtatcagacgctggtctccaaaggatatacgaaaggtacacatggaagatatactcggagagattgatgacactagctggtgtgtatggtttctggaaatacgtatcgaaattggagcgtcgtgagactcggcgatatcttgaaatgttctacattctcaaattccgcgacttggtgaaaactgttccttcaaccgccgatgactga

SEQ ID NO: 2416 - DNA, 1746 bp, Arabidopsis thaliana
atgaccaaagaagtttgctccaacattggactttggttattgctcacgttacttattggtaactatgtcgtcaatcttgaagcctcgcaccatgtctacaagagacttacccaaagcactaacaccaaatctccttccgtaaaccagccctaccggaccggtttccatttccaaccccccaaaaattggatgaacgggcctatgatatacaaaggaatatatcatcttttctaccaatggaacccgaaaggagccgtgtggggtaacatcgtgtgggctcattccacgtcaacagacttaatcaattgggatccacatcctccagctatcttcccatctgcacccttcgatatcaacggatgctggtccggttcagctactattctccctaatggaaaaccggttatcctctataccggaatcgaccctaagaaccaacaggtccaaaacatagccgagcctaagaatctctccgatccttatctccgagaatggaaaaagtcgccgttaaatcctctcatggctcctgacgccgttaacggaatcaacgccagctcgttccgtgacccaaccaccgcgtggctaggccaagacaagaaatggagagtgatcatcggaagcaagattcaccgtcgtggactagccattacttacacgagtaaagactttctaaaatgggaaaaatctccagagccgttgcattacgacgacggaagtggaatgtgggaatgtcctgattttttcccggtcacgaggtttggttctaacggcgtggaaacgtcttcgtttggtgaacctaatgagattttgaagcacgtgttgaaaataagtttggacgacacgaaacatgattattacacgattggtacgtacgatcgggttaaagataaattcgtaccggacaatggtttcaagatggacggtacggctccgagatacgattacggaaagtattacgcgtctaaaacgttttttgactcggctaagaaccggagaatcttgtggggttggactaacgagtcatcgtcggttgaggatgatgttgagaaaggctggtccggtattcagacgattccaaggaaaatatggcttgatagatcagggaaacaattaattcagtggccggttagggaagttgaaagattacgtacaaaacaagtcaaaaacttacgcaacaaagttctaaagtcaggatctaggcttgaagtctatggtgtgacagctgcacaggcggatgtagaagtattgttcaaagtgagagacttggagaaagcggatgtgatagaaccaagttggactgatccgcagttgatttgtagcaagatgaatgtatcggttaagtctggtttaggtccattcggtttaatggttttggcatctaagaatttggaagagtacacatctgtttattttagaatcttcaaagcccgtcaaaacagcaataagtacgttgtgctcatgtgcagtgaccaaagcagatcttcgctgaaggaagataatgacaaaacgacatacggagcttttgtggatattaatcctcaccaaccactatccctcagagccttgattgatcattcagtagtggagagtttcggtggaaagggaagagcatgcattacctcaagagtgtatccaaaattggcaataggaaaaagttcacatctctttgcttttaattatggatatcaaagtgttgatgtcttaaacttaaatgcttggagcatgaactctgcccaaatcagttga

SEQ ID NO: 2417 - DNA, 1362 bp, Arabidopsis thaliana
atgagagaaggatctcatcttatcgtcttgcctttcccaggacaaggccacataactccaatgtcccagttctgcaaacgcttagcctcaaaaggtcttaagctcactctggtcctcgtctccgacaaaccctctcctccatacaaaacagagcacgactcaatcactgtcttccccatctccaacggcttccaagaaggcgaggaaccattacaagacctcgatgattacatggaaagagtagaaaccagcatcaaaaacaccttaccgaagttggttgaagacatgaaactgtcgggaaatccacctagggctatcgtgtacgactccaccatgccatggcttcttgatgtagctcatagttatggattgagcggtgccgtgtttttcacgcaaccttggcttgtcacagctatttactaccatgttttcaagggttcgttctctgtaccgtctacaaagtacggtcactcgacattagcatctttcccttcgttcccgatgctgactgcaaatgatttgccgtctttcctctgcgaatcgtcctcatacccgaatatactgaggattgtggtggatcagctctcaaacattgatcgagtcgacatagtgttgtgcaacactttcgataaattggaggaaaagttgttgaaatgggtccaaagcttgtggccagtcttgaatattggaccaacggttccatcgatgtatttagacaaacgactgtctgaagacaagaactacggttttagcctcttcaatgcgaaagtcgctgaatgcatggagtggctaaactcaaaggagcctaattctgttgtctatttatcattcggaagtttggtgattctaaaagaagatcaaatgttggaactcgctgcgggtctgaaacagagcggacgtttctttctgtgggttgtgagagagacagagacacacaaacttccaagaaactatgtcgaggaaatcggtgaaaaaggacttattgtaagctggagtcctcagcttgacgtacttgcacataaatcaatcggttgtttcttgacacactgtggatggaactcgacgttagagggattgagtttgggagttccaatgattggtatgccacactggactgatcagcccacgaatgctaagttcatgcaggatgtgtggaaggttggggtaagggttaaggcagaaggtgatgggtttgtgagaagagaagagattatgagaagtgtggaagaagttatggagggagagaaagggaaagagattagaaagaatgctgagaaatggaaagtgttggctcaagaggcagtttctgaaggaggtagctctgataagagcatcaatgagtttgtttctatgttttgttga

SEQ ID NO: 2418 - DNA, 2556 bp, Arabidopsis thaliana
atgctttctcgcttcaacattcatcagccatttaaacgctgtaaatttcgattctttttgcgttccattggaaacccagataccattttggtggaatcatgttcgtcttcctcttgttcatcgccagagccatctctggttcgttccgattacttgactaaaccttctgatcaagaccagatttttccgttgaacaagataatagctaggtgtgtacgttcaggagatatagatggagctcttagagtgtttcacggaatgagagctaagaacaccattacctggaattctctgctcattgggatttctaaagatccaagcagaatgatggaagcacaccaactgttcgacgaaatccctgaaccagatactttctcttataacattatgttgtcttgctacgttcgtaatgttaacttcgagaaggcacagagcttcttcgatcggatgccattcaaggatgcggcgtcatggaacacgatgatcacagggtatgcacgaagaggtgaaatggagaaagcgcgggaattgttctactccatgatggagaagaatgaagtttcttggaatgccatgatctctggatacattgaatgcggagatttggaaaaggcatcacatttcttcaaagtggctccagttagaggcgtcgtggcttggacggcgatgatcacagggtacatgaaagccaagaaggttgaattagctgaggcaatgttcaaagacatgacagtgaataaaaatcttgtaacttggaatgctatgatctctggttatgttgaaaattctaggccagaagatggattgaagcttttcagagctatgcttgaggaaggaattaggcctaactcgtctggactaagcagcgcattgctcggatgcacattgacgtctctgatcagtatgtactgcaaatgtggagaacttggtgatgcttggaagctctttgaggtgatgaagaagaaagatgttgtggcgtggaacgcaatgatttccgggtatgctcagcacggtaatgcggataaggctctgtgtttgttccgtgagatgatagataacaagatcagaccggattggataacgtttgttgcggttttactggcctgtaaccatgctggactagtgaatattgggatggcatatttcgaatcgatggtgagagattataaggtagaaccgcagcctgatcattacacgtgtatggttgatcttttgggtcgggctgggaagctggaggaggcattgaaactgataagatcaatgccgtttagacctcatgctgcggtctttgggacgctcttaggggcttgtagagtgcacaagaatgtggaattggctgaatttgcagctgagaaactgcttcagctaaactcgcaaaatgcagccgggtatgtgcagcttgcgaatatctacgcatcgaagaatcgttgggaagacgttgcaagggttcgcaagagaatgaaagagagcaatgttgtgaaggtagagcgagtcaaagtacctggatacagttggatcgaaatacgaaacaaagttcaccatttcagatcaagtgatcggattcaccctgaactagactcaatacacaagaaactgaaggagttggagaagaagatgaaactagctggatacaaaccggaactagagtttgctttacacaatgtagaggaagagcaaaaagagaagctattgttatggcacagcgagaagttagctgttgcatttggttgcataaaactccctcaaggttcacagatacaagtgttcaagaacttgagaatctgtgcgagtggttctagagttttggatcattttccggcgacttcaaggtctccgcctcgatctcagagtgttacagcaatggaagatgatgtggagctgcttttgcctaggtacgatccgaattctcaagcggggaagagagagaaatcaagattcagattttcagaaaacgtcatccatttgattcctctcattcttcttctctgtgtcgcaatcctctggctctcctcttactcagtgaatatctcccaatcaagcttcttcaattttgcttgctctctctcttacacggccaatcggtgttttcgcagctttcagccatcgtttctgccaagatgcttgaactacaaaattggggcaaagcgcaaaagaaagtatgcgtttcttcttgaatgtagttgccacagtgatatgttatttatcttacttctaatatggaagctgatgaactatttatctttgttgagtagatatggacataatgaatggtcaagatctactgggatggtagttttcaactataaggattgtaataatacattacaaagaactgaaggaaaccgtggtttaggatatcccgaggcaacagagcttgctggacaatttgagatgactagcaacattccaccagccatagcccactcttctctggacgctggtgctaaagttatattaacaaccgaagctgtggtccctgctactaagacaagaaagttatctgctgagcgatcagaggctagaaggtttgttcatcatgacaccccgtcatcataa

SEQ ID NO: 2419 - DNA, 960 bp, Arabidopsis thaliana
atggacggtgccacataccaaagattcccaaagatcaagatccgtgagcttaaagatgattacgccaagttcgagcttcgtgaaaccgacgtttctatggccaacgctctccgtcgcgtaatgatctccgaagtccctaccgtcgcaatagatctagtcgaaatcgaggttaattcatctgtactcaacgacgagttcattgctcatcgattaggtctcattcctctcactagcgaacgtgctatgagcatgcgtttctctcgagattgtgatgcttgtgatggagatggacaatgcgagttttgctctgttgagtttcggcttagttctaagtgtgttactgatcaaaccctagatgttactagtagggatttgtacagtgctgatcctactgttactcctgtggatttcactattgactcgtctgtatctgattcaagcgagcacaagggaattatcattgtgaaactgcgtcggggacaagagttgaagcttagagcgatagcgaggaaagggattgggaaagatcatgcgaaatggtctcctgcagctactgttacgtttatgtatgagcctgacataattattaatgaagatatgatggatactttgtcagacgaggaaaagatcgacttgattgagagcagtcctaccaaagtgtttggcatggatccagtcaccagacaggttgtagtggttgatcctgaagcatacacttacgatgaagaagtgatcaagaaagctgaagcaatggggaaaccgggactcattgagatcagtccgaaagatgacagttttatattcactgttgagtccacaggtgcagtgaaggcttcccaactggtactaaatgccattgatcttctgaagcagaagcttgatgcagtccgtctctcagatgacaccgtagaagcggatgatcagtttggtgaactcggtgcccatatgcgtggaggatga

SEQ ID NO: 2420 - DNA, 588 bp, Arabidopsis thaliana
atgaacaaaacccgccttcgtgctctctccccaccttccggtatgcaacaccgtaagagatgtcgattgagaggtcgaaactacgtaaggccagaagttaaacaacgcaacttctcaaaagatgaagacgatctcatcctcaagcttcatgcacttcttggcaatagatggtcattgatagcgggaagattgccaggacgaaccgacaacgaagttaggatccattgggaaacttacctaaaaaggaagctcgtaaaaatgggaatcgacccaaccaatcatcgtctccaccatcacaccaactacatttctagacgtcacctccattcttcacataaggaacatgaaaccaagattattagtgatcaatcttcttcggtatccgaatcatgtggtgtaacaattttgcccattccaagtaccaattgctcggaggatagtactagtaccggacgaagtcatttgcctgacctaaacattggtctcatcccggccgtgacttctttgccagctctttgccttcaggactctagcgaatcctctaccaatggttcaacaggtcaagaaacgcttcttctattccgatga

SEQ ID NO: 2421 - DNA, 939 bp, Arabidopsis thaliana
atgaagagatcacgtggaagctccgattctttatccggtttcttaccaattcgccattctacaacagacaaacaaataagcccaagaccaacaactaccggctttctctattccggcgccggagactactcccagatgtttgacgcattagaagacgacggaagtctagaggacctcggcggcgttggacacgcgtcttctacggcggcggagaaaaaacggcggttgggtgtagagcaagtgaaagcgttagagaagaatttcgagattgataacaagttagagccagagaggaaagtgaagctggctcaagagcttgggttgcagccacgccaagtcgcgatctggtttcaaaaccgccgtgctcggtggaagacaaagcagcttgaacgtgattacggcgttcttaagtcaaactttgatgcactcaaacgcaaccgcgactcgcttcaacgcgataacgattcactccttggacagattaaagagctgaaagcaaaacttaacgtggaaggggttaaaggtatagaagagaacggcgctttaaaagcagtggaagcaaatcaatcggtgatggctaataatgaagtcttagagctaagccaccgttctccatcgccaccaccgcatattcctacggacgctccgacatcggagctcgcattcgaaatgtttagcatttttccacgcacggaaaacttcagagacgatcctgccgatagcagcgactcaagcgcggttttgaacgaagagtatagtcccaatacggttgaagcagctggcgcagtggcggccacgactgtagaaatgtcgacgatgggttgttttagccaattcgtgaaaatggaagagcatgaagatctgtttagtggagaggaagcttgcaagttgtttgcggacaatgagcaatggtattgctccgatcagtggaattcgtaa

SEQ ID NO: 2422 - DNA, 2088 bp, Arabidopsis thaliana
atggcagcttcatcagcttgtcttgtgggaaatggtttgtcagtgaacacaacaaccaaacagaggttaagtaaacatttttccggcagacagacaagcttttcttcagtgattaggacatctaaggttaatgtagtgaaggcttctttggatgggaagaagaagcaagaaggaagaagagattttctcaaaatcttgttaggaaatgctggggtcggtttggttgcaagtgggaaagcaaatgctgatgaacaaggtgtttcttcgtcgaggatgtcgtattctaggtttctagagtacttggataaggatagggtgaataaagttgatttgtatgagaatgggactatagctattgtggaagctgtttctcctgaattgggtaaccgggttgagagagtacgtgttcagctaccgggtttaagtcaagagcttctacagaagcttagggctaagaatattgattttgcagcacataatgctcaggaagatcaaggttctgtgttattcaacttgattggtaatcttgctttcccggcgcttttgattggtggtttgttccttctttcgagacggtctggtggtggaatgggtggacctggtggtcctggtaacccacttcagtttggtcagtccaaagcaaagttccaaatggaacctaacactggtgtaacatttgatgatgttgctggagttgatgaagcaaagcaagatttcatggaagtggtggagtttttgaagaaacctgagagattcactgcggttggtgccaagatcccgaaaggtgttcttcttattggtcctcctggtaccgggaaaacccttttggcaaaagccattgctggtgaagctggtgtgcctttcttctccatctctggttctgagtttgttgagatgtttgtcggtgttggtgcctcgagagtccgtgatcttttcaagaaagccaaggagaacgctccttgcattgtctttgtagatgaaatagatgctgttggtaggcaaagaggaaccggaattggtggaggtaatgatgaaagagaacagaccctcaatcagctcctaactgagatggatggttttgaaggtaacactggtgttatcgtagttgctgcaaccaatagagcagacattcttgactctgctttgttgaggccaggacggtttgaccggcaggtaagtgttgacgttcctgacgttaaggggagaacagatattctcaaggttcatgccggcaataagaagttcgacaatgatgtttcacttgaaataatagcaatgagaacacctggatttagcggagcagatctcgctaacctcttgaatgaggctgctatattggccggaaggcgagcacggacatcgatatcatctaaagagattgatgactccattgatagaatcgttgctggcatggaaggaacagtgatgaccgatggcaagagcaaaagcttggtagcttaccatgaagttggtcatgcagtgtgtggaacattgactccaggacatgatgctgtgcaaaaggtaacgttgataccaagaggccaagcaagaggtctgacttggttcattccatcagatgacccgacactcatctccaagcagcaactctttgcaagaattgttggtggactcggtggtagggccgctgaagaaatcatctttggtgattccgaggtgactactggcgcagttggtgacttacaacagatcaccggtttggctagacagatggtaacaacatttggaatgtctgatattggaccatggtctttgatggattcttcggcacaaagcgatgtcatcatgagaatgatggcaagaaactccatgtctgagaagcttgcagaagacattgattctgcggtgaagaaactatcagacagtgcatatgagatagctctaagccacataaagaacaatcgtgaagccatggataagctcgttgaagtgcttctcgagaaagaaactattggcggtgacgaattcagggcaattctttccgagtttactgagatccccccggaaaaccgagttccttcttcaacaacgacaactccagcatcagcaccaacaccagctgctgtctaa

SEQ ID NO: 2423 - DNA, 1365 bp, Arabidopsis thaliana
atggaggaagagaacgaagtagtgaagacgtttgcagagcttggtgtgcgtgaggagcttgttaaagcttgcgagagattgggatggaagaacccttccaaaattcaagccgaagcccttccttttgctcttgaagggaaagatgtaattggacttgcgcaaaccggttctggtaaaaccggagcttttgcaattcctatattgcaagcactacttgagtatgtttatgattctgagcctaagaaaggacgtagaccggatcctgctttcttcgcttgtgttttatctccaactcgagaacttgcaatccagattgctgaacagtttgaagctcttggtgctgatataagtcttaggtgtgctgtgcttgttggaggtatagacaggatgcaacaaactattgctcttgggaaacggcctcatgttgcaacacctggtcgtctttgggatcatatgtctgatacaaaaggcttttctctgaaatcattgaaatatctggttcttgatgaagcagatagactgttgaatgaagattttgagaaatctcttaaccagattttggaagagatccctcttgagcggaaaacatttcttttttcagcgactatgactaaaaaggttcgaaaacttcaaagggcatgtttgaggaatcctgtgaagattgaagctgcctccaaatattccactgtcgatactcttaagcagcagtatcggtttgttgccgctaaatacaaggattgctatctggtatacattctgagtgaaatgcctgaatcaacatctatgattttcacccgaacatgtgatggtactcgctttctggctttggtgcttcggagccttggttttagagctattcctatcagtggtcaaatgactcagtcaaagagactgggagctttaaataagttcaaagcaggggaatgtaatatcttggtttgtaccgatgtggctagtagagggctcgatatcccatcagttgatgtggttatcaattatgatattcccacaaattcaaaggattacatccatagagtaggaagaaccgctcgtgctggacgttctggtgttgggatatcacttgtaaaccagtatgagctcgaatggtatatacaaatagaaaaactcattggcaagaaactacctgaatatcccgctgaggaagatgaagtcttgtcattgttggagagagttgcagaagcgaaaaagctatctgcaatgaatatgaaagaatcaggaggtaggaagagaaggggagaagatgatgaagaaagtgagaggttcttgggaggtaacaaggacagaggcaacaaggaaagaggtggtaacaaagacaagaagtcttctaagaagttcaaacgataa

SEQ ID NO: 2424 - DNA, 1716 bp, Arabidopsis thaliana
atgaatgagggtggaatgatgatagatagggctaatggtaagcaaagcaaagcaatagtgtggttttgtgctgccagcttggaagaggaaaggatccaaagaacttcatcaaagggtaaatccatcgttgataaatacatgaaagaagcaaagagtttaatagcgagtcaagatccaaacgacgtgaaatcagctctaaatcttctggaatctgcactctctgtatctcctcgttacgaactcgctctcgaactcaaagccagatcccttctttacctccgtcgatacaaagacgtcgccgatatgcttcaggattacattcctagtcttaaattagccggcggcggcgaagattccggtatcggttcatctgagctttcttttactcattcttctcgtgaatctgtcaaacttctcaacgatttgcctagtcatcatcatcatcatgactcgtcttttaaatgcttctctgtctctgatttgaagaagaaagtcatggctggtctcactaaaaactgcgacgaacaagggcaatggagatatttggttttgggtcaagcttgttgccatttaggtttaatggaggatgcaatggttcttcttcaaaccggtaaacgcttagccaccgctgcgttccgccgtcagagtatttgttggtctgacgatagcttcattctcttctcctccgaagacggcggctcctctcctccctcctccgtcgtcgtaacttccgcatctcagccacgatccgagagcatcgctcacgtgttatctcacatcaagctactcttaagacggcgcgccgccgcactcgccgctctcgacgcaggactctacacagaatcgattcgccatttctcaaaaatcttagacagtcgccgtggcgcgccgcagggatttctcgcccagtgctttatgcaccgcgcctccgcttacagatccgccggaagaatcgcggaatcaatcgccgactgtaacaaaaccctagcgttagatccgtcgtgtctccaagctttagaaacgagagccgcattgttagaatccgttcggtgcttccccgattcgcttcacgatttggaacatctgaaactcctctacaactccatcttacgtgaccggaaactacccggtccggtttggaaacggcacaatgtccggtacagagaaataccggggaaattatgcgtcttaaccacgaaaatccagcaattgaagcagaaaatcgcaaacggagaaatcggaaacgtggattactatgctctgatgggaatcagacgtgattgctcgagatcagagctggatcgagcttacttgttactcaatttaaagcataaaccggagagatcaatgtcatttattgaccggtttgagttaaccgatgatgaggaagaattagactcggttaaggaccgagcaagaatgtcaactctattactatacagattgatccagaaaggctactcagtcgtcacaagtaacatcgcagccgtggagaagcaacgaaaagccatcgccgccgcagtagcgactgaatctcatcggagtaatatcatcgaaacgccgattagagcggtcgcggttgctgtgaacagtaataacaatacgaatgtggtgaaaggagtgttttgtagagatttgacggtggttgggagtttgattgcgcggaccgggtttaaccaaccgattccggttaaatacgaagcgcttagttgctga

SEQ ID NO: 2425 - DNA, 393 bp, Arabidopsis thaliana
atggctcctacattttcgcctaatccccaaaatttcaccaaaaaagataaaacaaaagctgaaaggaggaaaccagaggaaggagacgacgaccaccaccacaacgcatctcagctcttccttaatccatggcagacaagggccgcccgttgccgaagtttggcgaatgggatgttaatgacccttcatcagctgaggggtttactgttatcttcaacaaagctagaaacgagaagaaaggaggtggaaaatctgactcaccagggaaagatgaacctggatataataaaaatggggaagttcttgagaaacccgccaaaaaatggttttgctgtatacgcgcagaataagtggagaggtgtttgccttggaaggtcttttatctatatctaa

SEQ ID NO: 2426 - DNA, 843 bp, Arabidopsis thaliana
atggcaacatctttgcttctcagacattcctcagctgtcttcttctctcagtcttccttcttcaccaagaacaaatcttttcgctcctttacttccatcaaaatggaaaaaggtgaagcagagaatgcagtgaagacaaagaaggtgtttgtcgcaggagcaactggacaaaccgggaagaggattgtggagcagttgttgtcccgtggctttgccgtcaaagctggtgttcgtgatgtagagaaagcaaaaacatctttcaaagacgacccgtctcttcagatagttagagcagacgtgacagaaggtcctgataagctagctgaagttataggtgatgattctcaagctgtgatttgtgctactgggtttcgtcccggatttgatatattcactccttggaaagtcgataatttcgggacagtgaatcttgtggatgcttgccgtaaacaaggagtggaaaagtttgttcttgtaagctccatcttggtgaatggagctgccatgggacagatactgaaccctgcttacctcttcctcaacctctttggactaactcttgtcgctaagcttcaagccgagaagtatatcaaaaaatctggcatcaactatactatagtaaggcctggtggtcttaaaaacgatcctccaactggaaatgttgtcatggagccagaggatactctatatgaagggagtatatcgagagacctggtcgcagaagttgcagtggaagctttacttcaagaggaatcatctttcaaggttgtggagatagttgctcgtgccgaagctccaaaacgttcctacaaagatctatttgcctctgttaaaggacaataa

SEQ ID NO: 2427 - DNA, 1197 bp, Arabidopsis thaliana
atggccagtgaatcagatgcatcgagcattgctactctttcctgtgctcgctgcgagaagcctgcacatcttcagtgtccgaaatgcatagacttaaagcttcctcgtgaacaagcctctttctgcactcaagaatgtttcaaggcagcttggagctcgcacaaatcagtacatgtgaaagctcagctgtcttcaatcggtgatcagaactctgatcttatttctcaaggctggctctattgcgtcaagaaaggccaggctagaacacctaagcttccacactttgattggactgggcctctaaagcaatatcccatatctaccaagcgtgttgtgcctgctgagattgagaaacctgactgggcaattgatgggactcccaaagttgaaccgaatagtgatctacaacatgttgttgagataaaaacgcctgaacaaatccagagaatgcgtgaaacctgtaaaattgccagagaggtcctggatgcagccgctagggtgattcaccccggtgtgactactgatgagattgatcgagtagttcatgaagcaactattgcagcaggaggatatccatcgcccctcaactactatttctttccgaaatcttgctgcacatctgttaatgaagtaatttgtcatggaattccggatgctaggaaactagaagatggtgatatagtaaatgtggatgtaacagtctgttataaaggttgccatggtgaccttaatgagacatactttgttggaaacgttgacgaagcatcacgtcaactggttaagtgcacatacgagtgcctggagaaagctatagcaattgttaaacctggagtaagatttcgtgaaattggagagatagtcaaccgccatgctacaatgtctgggttatcagtggtgagatcttattgtggtcatggtattggagatctcttccattgtgctccaaacattcctcactatgcaagaaacaaagcagttggagtgatgaaagcaggtcagactttcacaatcgagccaatgatcaacgcaggggggtggagggatcgaacatggcctgatggatggactgcagttaccgcagatggaaaacgcagcgctcagtttgagcataccctattggtaacggagactggtgttgaggttttaacagcgaggcttccttcatcgcctgacgtatatccttggcttaccaagtga

SEQ ID NO: 2428 - DNA, 693 bp, Arabidopsis thaliana
atggcagtctcctcactctcaatccgctgtggtggtttctcaccaacaatctcccacaagacagaaattctctgtccaaatccatcactcaaagcttgttgtttactttcatccggtgcttaccaaaaaggcagcggaaacaattggaagagaaggcaagctcttgtgggagtaggaactttagtggcaacttcaattccagcaactttgcttcttgctgaagagataccaaaaagctactcgccttttgtggatcgagaagacgggtattcttactattacccatcagactggagggaatttgacttcagggcacatgattcagccttcaaagatagatacttgcaactgcagaatgtgcgggtcaggttcataccaacggagaaaaacgacatccatgaagtaggtcctatggaagaggtggtttatgatctagtgaagcataagtttgcagcaccaaaccaagtagctaccatctacgatatgaaagagagggtggaagatggaaagaactattacacgtttgagtatggactaagaactcctatctatgcaaccacttcctttgcaacagtggcagttggaaacaacagatactacactctcatagttggagcaaatgagagaaggtggaggaaagtgaaaaagcagcttcaagttgtggccgactctttgaagatccttcagatttga

SEQ ID NO: 2429 - DNA, 1287 bp, Arabidopsis thaliana
atgggtcgatctcaagaacagggacagggacagggtccggttcacagcattcggctatctaccgtaggtgcgacccggccgacagagacgggtacgacccacgaaccaaccggtttagacctagccatgaagctccactacctcaaggcggcatacatttactcagccgagacagcacgtgacttaaccgtgagacacctgaaggaggccatgttcatgttgttcgaccagatcgcttggaccacaggcaggttctcaaggagagactcgggccgtccgtacatcaagtgcaacgactgcggcacacgtttcgtggaaggtcaatgcaatctcactgtggaggagtggctcagtaaaccggaccggtcagttgatgagtttctggtttatcatcatcctattggaccggaattgacgttctctcctttgatctacgttcagatgacccggtttaaatgcggaggattagggttgggcctaagctgggccaatataataggagacgcattctctctgttctatgccttcaacttatgggctaaggccattaccggagaaaagatttatgccccaacaacaccctctataggagagagaaggttccaaagcccaaacccgacggttaaagatccggtttcaattaaacgggtcgaacccgttggagatctctgggtcactccaaacgacaagaaattggcgaattactgtttcaatctctcagtcgccgatcagatatcaccacattttccggcgaagggagatgactcgattccggtgttcgagattctcgccggaatcatatggaaatgcatagctaaagttagggtagagccaaagcctgtaacggttacgatcattaaaaaagatccgaacgatctgaaacttaatgcgattcgaaacagtcaggtgatcagctcagtgagcgtggattttccggtggcggaagcgacggtggaggaattagtgaaagctatgggggaagcgaaggatgagagatgtggaattgaggagatcggagagagttgcgatgggaatttggattttgttgtttatggagcgaaattgacgtttctggatctgactggtgaggatttgtatgaggcgaaagtgatggggaagtcgccggagtcggtttattgtaatgtggaggggataggggaggagggattggtggttgtttacgcggcggcgaaatcggaggagagggttgtgacggttacgttgccggaggaagagatggagagggtaaaattggaatttaagaagtttggtttgatcgcgccatga

SEQ ID NO: 2430 - DNA, 1533 bp, Arabidopsis thaliana
atgaacggagcttcgctctgcaactccgttttgcttcattctcattctctctctcgttttcagtcatcctcttcttcttgttctgtgtatctgatttcttctgcgcgtactacgtctaagtatatctcaatttctcatagaattcgacagagctttcgagaagttattgaaaaaaggagtaatgggttttgttcattcgctgtaaacaagcgtagaagtggcgattccgttattgtggagtcagacgatgatgatgaagaagatgatgaagattggggtgaatttgatggagaagatgaaggagaagaagaagaagaagatgaaggagagttcttaccaatggataagatgaagaaatggttagagaaaaagcctcgtggatttggtttaggtaaaaagtacgaaactttaattgaagataagttgctcgacgaaattgagcaaagttggaaagctcaagctgctaatctcaataagcttaagaatgatcctctcaagtctcaacagcttaagcgtgacgataatctcctcaaaggaactggagaaactcaaattgggtttcgtgttcgtgtgactaatcttcctaagaagaagaatgttcatagagatcttaaggttgcgtttaaagaagtaagtggcgttttgagtataacaccagctgtgtctgggaataagaagactaaggatcctgtgtgtaaaggatttgctcatgttgatttcaaaactgagattgatgcaaacaggtttgtgaaacagttcacgggacagagcttagcatttgggaaggttataaagcaaatcaaatgtcaggttgtggagtttacttctgatgattctgtatcgaaggaagtgtacttagataacggtttcaaggtgcagaagcttccgtattctggtcttgaaggagattctagtgctgatgttgttgaagaagaggttttgttgggttcaggggaagaatcggatgattcagaagaagaggtagatgaaagagaagtggaagacgatgagcggaatcatatctctagtagcatagaatcttctcccattgaaatgacacgtgattcgaataccaagttaaagtttgagaaacaagttgtgaagcgagagataagagaacatgaggaactagagacacctttagtttcattccaggtgaataaatctgaggaagctgcagcggaaacacacttggatgatgaacaatctgaggaagctgtagcagaaacactcttgaatgatgaacttgatggggatgatgaagaagaagttgctgaagacaatcttgaacctctgaacagttcattgtcatcctcagaagaaaatagagtagatagaatccgtaggctagagcaaaagcttctcggtaaagaaaaactcttgggtggaggagttggctttgataaaccagaagcaaaacccgctagagttgaaggaaagaagaaggagaaaaagaagaagacaaagattcttgtgaaaggccaagccaaaaaggggacaaagatagaaatccctggatcatcaaagaggtaa

SEQ ID NO: 2431 - DNA, 969 bp, Arabidopsis thaliana
atggccaaagctcttcacataaccatctttctcttcctcatatcctccaatctcctcgcatttatcaactccgccagacttcttgacgagatccaacctcagcctcagttagtccctaccggccaaatccccactgtggctccaaccgaagctgaggaggaggatggaaccgatgacaacccaggactagcaaccacaaccacaactgcatcagcagttacagtcccagccggtccagcagaggctacagagccattactagagttctttatgcatgacgtgctaggcggatctcacccatcagctcgtgtggttacaggtatagtagctcaaactgaagtgaacggaataccattctcaaaggccagtaacagcattttcccggttgacaatggagtcccactggtcaactcaaacaacatcaacagtgtcattaacccaaacacagctccacttctcaccggacttggcggtgctcaaacctccaccgtcatccaaaacactaacggaaattccaacgatgcccttagcgccaacagtctcccttttgtaactgccgggaaccttcctcccggtgctgccctccagcatctcatgttcggaaccataaccgttgtagatgatgagctaaccgaaagccacgagcttggctcagccgttatagggagagctcaaggcttttacttggccagttccctggacggaacaagtcagactctttctctgactgtattgctacatggtgagcatgaccagcatgacactttagacgatgccattagtttctttggggttcacagaaccgcctctcatgcctcccagatcgcggttataggcgggaccgggaagtttgaacacgccaaagggtatgccatagtggaaactctgcataaccaggacaaccagcatatcactgatggtcaagacaccatcctccatttcagtgtataccttacctacaaagcttga

SEQ ID NO: 2432 - DNA, 411 bp, Arabidopsis thaliana
atggcggctccgggatcggttcagaaaggagatgaagagtggcgtgcgattctttcacctgaacagtttcggattcttcgtcaaaagggcactgaatatccaggaacaggggaatatgtcaacttcgacaaggaaggagtttacggttgtgtaggatgcaatgctcctctttataaatccaccacaaagttcaacgctggttgtggctggccagctttctttgaaggaatccccggtgccattacccgaacgacagacccagatgggagaagaatagagatcaactgtgcaacatgtggtggacatcttggtcatgttttcaaaggagaaggtttcgctactccaaccgatgaacgccattgcgtgaacagcgtttcgcttaagttcacacccgcagcgtcttccttgtaa

SEQ ID NO: 2433 - DNA, 423 bp, Arabidopsis thaliana
atggcttcttcacttatcacctccgcagtcattgtcgtggttttaagcctagtgcttggatctgtagagcaagtgagtggactacgtcacgttcccaagtcccctaagaccactgatgtcaaacaccctgactttcttgtaaccattgagcccaaaccaactattctcattcccggtgttggaaggttcttgcttcctcccaaatgcaagaagccgttctacccttacaatcctgtcaccggagctccacttactggtgggggaatcccatcatataatggtggacaaggggccggacctcacacccaactccctggtggcgatgatacgcttgtcccaaaccccggatttgaagcgccaaccccgaccattggagctggcaccggaagcaacggccaagttccaccagtgccactaccctga

SEQ ID NO: 2434 - DNA, 954 bp, Arabidopsis thaliana
atggaagaagattgcgagtttcgacattgggatgagttgattccagatgctcttggtttaatctttagccacttacctcttcaagaagtactaacagtggtgcctagagtttgcaaagcatggaacagagctgttactggaccttattgttggcaagagattgacattgagctgtggagtaaccgttttcaccagtctgatcatcttgaccggatgcttgagatgttgatccctagaagcgctggctctttgcgaaaactctccgttactggccttcgaaatgactctatcttctccttcattgcacaacatgctggttcacttaagaccttgaaggtgccaagaagtggtctgactaattcgggtgtggtaaacgtagctgaaaagctctcgtctctcactttcttggatttgagctactgctgcaaaataggcccagaggcgatacaagccataggaaaacactgtaaatcactgagagagttttgcagaaacatgcatccattggatgtagcaagtgttgtctctcacgacgatgaagcttatgctatcgccaatacaatgccgaagctgaagcggttagagatagcttaccaccgagtcagcacagaaggagtactcaagatcttatcgtgctgtgtttttcttgagttcttggaacttagaggctgttgggacgtgcaacttgataacaagtttttcaaagagaagtttccggatatgaaagtgttaggtccacgcgtgatcggattctatgatatgataaatgattgggaggattgctgctcagattacttctcagatgggtctgattacttggcttgggagttttttgaagatggtgtaatgggagagttctatgaggatgagtttgagcatggttgggacgataatttttatgcggaaaacgcagttttagacatggaaccgcatatttggccaccatctccatga

SEQ ID NO: 2435 - DNA, 1902 bp, Arabidopsis thaliana
atgtcgtcatcgccttttccagtcttggacaaccgaccaattgataagtggaaggttacggaattgaaagaagagcttaaaagacggagactaacaacaagaggcttgaaggaggaattggttaggcgtcttgatgaagcacttcgtgctgagcaagaagagtctgaaaggatcaatagtgctactgttgctgctgctgaaaaagccaatcaagagcctcagatgtttcctgttactgtaggtgatcgtaatcaaaccactcctgttactcctgttgaagcggcatttagcactgagacaactcctgttacagctgagaaaaccccagaaccaactcagaccaagataacaactgaagcttcagctggtgttgagactacaccagccccggtgttttcagaaccagaggttaacgctgtgccattcgctagtgatgaagatgagaaagagaaagttgatgatgttagagacatagctggtcttgatagttcagtggttgcacgtgatgcagcagttgtgcaagtggcgtctagtgagcacaaatctgagaataatgaaccatttagtgggttggatggtggggattctaaggctcaaccatcagaggcagtgcttgaaaaatctgctatgtacaaccaggtatctgaggtcatccccgttacagggtttgaggtaaaatctgattgtatttctactgattctgtgtcaaataatgaaaaaatagaactaaaggataacaaaattgctgataatgtcaaattagaacaaaatgttaataagttccaagagccatcaacagtcgttggcgaatcgcatccaatggatgtcgaggagccacttgagcagaagacatctgttggaggtggggatgacagcaatgctgcaaacgcagatatgatcaaagaaaataatattatcgatgcaggcgactcagaaaagttgaatttagatagaagttctggtgatgagtctatggaggatgagccggagacaaagcaatccgagtcaattacatctgatgataagagtgcaaaaattgaaatgctttctaaggaggaaagccgtgctgatatggatgcggggaaagggaaatcccctgaaaataaaagtcacccactggtggcttctgacaaaagaaagcttcctgctaatgatcaagaagctgttggaaacaatgaacctgcaaagaggcgccgatggaactctaatagtattaaagttcctgaagcacagatcactaatagtgctacacccactacaacaccaaggtcgactggtctgaagcgcgacttctcaaggtctgactcttcggttagtgaagatggacccaaggaacgtgtggttcctccatctccaaaggagcctacaaattccctcaggattgaccgtttccttaggccgttcacactgaaagctgttcaggagctcctgggtaaaaccggaaatgtcactagtttctggatggaccacattaagacccactgctatgtatcgtatccctcggttgaagaagcagcagcaacaagagaagcagtgtataacctccagtggccacctaatggaggccgccatctgatagctgaatttgttagagcagaagaagtaaaagaaaaactggaagctcctctgcctcctcagcctcagcatcagccacaagctcagactctttcgcggccacctccaactgctcttccaccaccaccacctctggccaaaccacctcacgttgtagaacgtcttcctctgcctccccctcctcctatagcccctgaggaacaagaacctcccattgtcactcttgatgatctattcaagaagacaaaagcgatccccaggatatattacttacccttgtcagaggagcaagttgcagctaaacttgcagcgaataataacaagtga

SEQ ID NO: 2436 - DNA, 657 bp, Arabidopsis thaliana
atgaatgattccacgaggactgaagtatccattgataaatcagaagtagacaagcttgttgacaagattgattttggggaattatgcaacgattttgagtgcacaagtagtccgcaggtggaatccacagctagacaacttgttcgcgacattcttgaaatcagagaaggaaatcgtgcctttgcatgctatgcagtttccgttaaatataaggatccggttagaagttttacaggtcgtgagaagtacaaaagaccaatgtggataactagtggattagagaatcctaccgtgacggtacaagagatggtaatgttatcgaccagcgtcttgcgaattaaatggacagtgaaaggaaaaccaaaatctattcttgctgctgtaagtggagatttgatagtaaaagtcaaatctgaatttactcttaaccagattagtgggcaagtgtttgagcatgaagagtcttgggacttatcttcatcatcccctattgctcaagcctatttctggacatcccgccgcctctttgctgcttctgaatccgcaaaagatgtcgccgatgtcacaaaagacttgaccgccaatttgacaactcgaaaagaggacacagatatatatcgcgatccaaccgatccaaataaggtcagcttcatctaa

SEQ ID NO: 2437 - DNA, 735 bp, Arabidopsis thaliana
atgatgaaacaatcaccattctcacttttaacatcaatctttctcatagctgctctttttactgcaactaccgcactcgatcctgcacccgaagacccgatttttgaattgtacatgcacgatatacttgggggaagcagtcccacagcaagacccattacgggtttgcttggaaacatctacaacggtcaagtaccgtttgctaagcagatcggttttgttccaccgcaaaacggtgtagccatacccaacgcaaatggggcaatgccaacggttaacggtatcaacggtattccattaggtactggtttgtctggaacagcgttttctggtcagaatctaaatgggattcagactcagttgggtcctgatggtctgagtcttgggtttggaacaatcacggtgattgacgacataatcacatctggtcctgacttggggtcacaaccacttggtaaggctcaaggtgtttatgttgccagctcagcagatggaagcacgcagatgatggctttcacagctatgcttgaaggtggagagtacaatgataatctaaatttctatggaatctataggataggaagcgccatgtcacatctgtcagtgactggaggaaccggaaggtttaagaacgcttgcggatttgcagaggttaggccgttgattcctgcgggccaacactttgttgatggagctgagatgctgttgaggatcattgtccatctgaaatactga

SEQ ID NO: 2438 - DNA, 132 bp, Arabidopsis thaliana
atgccttcggtgccctctaagcttcttcctctcctgtctttgattccttcgttgactccttatcattctggtttgagttctaatcgtttgaaacctcttgaaaagtgtgattggcgtggtaatcttagttaa

SEQ ID NO: 2439 - DNA, 186 bp, Arabidopsis thaliana
atgcccatggacgttgatggagctctagggcttctccgttttgggtatcttgctattggctctcatattccattgccttgcggagcggcgtcgctgcttttaccgtttgggaccggccatgagatctatattcccctgtattttggttttcagttttatctagttaggattgtatttagccaatga

SEQ ID NO: 2440 - DNA, 600 bp, Arabidopsis thaliana
atggaagttgaagaagaagttaaacaaatcatagatgaggtcaaagagcttcatgactccgccgcttctttcatctcatcttcttctcaacaagagctctctctccgtcaaaaagcctccgccgttgattcctctatccgtcgtctccactctactatcgtctccaacaaaaatctcgatcctaagctccttgaggaagatctgcatcgtgctagatgcatgcttgttgacggagaaacatcttcatttctcccatccaaaccacaaggacgctttgtgagaatgttttgtggacctgtgaatgttcgagctttgcgtaaagatgttcagcttaaagttaaagaagaatacaatcgttacagagacaagactgctcttctttttctttttttccctgccacacttttaatccttaggtcttattattggggtggatgtttgcctgcgtttcctgtccagctctatgaggcttggctgttgtttctctatgctgggttggctatgcgtgagaatatattaagagctaacggaagcgatattcgtccatggtacttttatgcgttccctcctcgttcggttatgactgttatgatcacttaa

SEQ ID NO: 2441 - DNA, 6147 bp, Arabidopsis thaliana
atggaagatccagatgggacattagcaagtgttgcccaatgcattgagcagctgcgccaaggttcatcatctgcacaagaaagagaatattgtctgaagcagttactggaccttatagaaatgcgtgagaatgcattcagtgctgtcggatcacactcccaagctgtgccagtacttgtctctcttctccgatcgggatcagttggagtgaagatacaagctgcaaccgtcttgggttcactctgcaaggagaacgaacttagagttaaggtgttacttgggggatgcattcctccattgcttggtcttctcaagtccagttcagtcgaagggcagatcgctgcagcaaagacaatctatgctgtttctgaaggtggggttaaagaccatgttggatcaaaaatattttccactgagggagttgtaccggttctgtgggaccaattgcgcagtggaaataaaaaaggagaggttgatggtttgttaactggtgcacttaagaacctttctagtaccacagagggattttggtctgagacaattcgagctgggggagtggatgtacttgtgaagctgctcacaagcgggcagtcaagtacactatctaatgtctgcttccttcttgcgtgtatgatgatggaagacgcctctgtttgttccagtgtattgactgcagacattacaaaacagcttctcaaattattaggatcgggtaatgaagccccagtgagggcagaggctgctgctgctctcaagtcgctttctgctcaatctaaggaagcaaagcgggaaatcgctaattctaatggtattcctgttttaataaatgcaacaatagctccatctaaagaattcatgcaaggtgaatatgcgcaagcattacaagaaaatgcaatgtgtgcccttgctaatatttccggtggtttgtcatatgtcatatcaagccttggtcagagccttgaatcttgctcttcgcctgctcagactgccgacacccttggggctttagcttcagcattgatgatatatgatggcaaggcagaaactacaagagcatcagatccattggtcgttgaacagactctgctgaagcagtttaagcctcgtctaccattcttggtgcaagaacgtacaattgaagcacttgcaagtttgtatgggaattccatactctctgtcaaactttccaactcggatgcaaaacgtttgcttgttggtctaataacgatggcggtgaatgaggttcaagatgagcttgtaaaggctcttctgatgctgtgtaaccatgaaggtagcctgtggcaagcactacagggccgtgaagggatccaattgctaatatctcttttgggtctttcatccgaacagcagcaagaatgtgctgttgcacttctttgccttttgtctaacgaaaatgatgaaagcaagtgggccatcactgctgctggaggtatacctccacttgttcaaattctagagactgggtcggccaaagccagggaagactctgcaactatccttaggaacttgtgcaatcatagcgaagatatacgtgcttgtgttgaaagtgcggatgctgtccctgctctcttatggctactaaagaatggtagtccaaatggtaaagaaattgccgccaagacattgaatcatttgattcataaatcagatactgcaactatcagtcagcttactgctttgctgaccagtgatctacctgagtctaaaatttacgttttggatgcattgaagagtatgctttctgtggtcccattcaatgacatgctacgtgaaggcagtgcttccaatgatgctattgagacaatgatcaagttgatgagctctggtaaagaagaaactcaagcaaattcagcatcagctcttgcagctatcttccagagcagaaaggatttgcgtgagagtgctctagccctcaaaactctcttgtcggccataaaactgttaaatgtggattcggagaggatccttgttgagtcttgccgctgcctggctgcaattttactttcaattaaggagaatcgcgatgtggccatttctgccagagaagcattgcctaccatagtatctctagccaactcttctgttctagaagttgctgagcaaggaatgtgcgctttggctaatcttatattggacagtgaagtgtcagagaaggtcattgtcgaagatatcatcttgtccgccactagaatcttacgtgaaggtacagtgtctgggaagacacttgctgctgcggcaattgcccgcctccttagtcgtcgccgaattgattctgcattgacagattctgtgaaccgagctggaacagtgcttaccttagtgtctcttctagaatctgccgatggaagatctgatgcaatatcagaggccctagatgcgcttgctatattctcaaggtcaggagctaatggaaatgtaaaaccagcttgggctgttttggctgaatctcccaacagtatggccccaatagtctcatctatagtgagtgttgctaatccttcactacaggacaaagctattgaagttttgtcaagactttgccgagatcagcctattgttttgggaaacatggtcaacaatgccagagattgcgtgtcatctatagctaaaagggtgataaataccagggacccgaaaataaaaattggtggagctgctattattatctgtgctgccaaagttgacgaccagaagatgatagaaaatctgaatgagacacaattgtgtgccaaattcgttcaagcacttgtggggatcctagattctgtgcaagatcaggaaaaggatgagaaagataaaatctgcatatgcattcatcccaaagaaaaggaagaagatgaagaagaagaggcaacagaaaatagggagggttccacgggggcaacagttatttctggagacaatttagccatctggttgctctcggttctttcttgtcatgatgaaaagagcagagcagtaatattggagtcagaaggcattgagttgattactgacagaataggcaaccgttttctccaggctgataatggagaagatgccaacatttgggtttgtgctttattgctggccatacttttccaagacagagaaatcactcgcgcacatgcaacaatgaaggctgttccagtgctctcaaatcttgtgaagtcagaggaatacgcagacagatattttgcagcacaagctctagctagtcttgtctgtaacggtagtcgcggaactcttctatctgttgcaaactccggtgctgcggctgggtttatatcattgcttggttgttctgatgatgacataaaagaacttctgcagctgtcgcaggagttcactttagtgcggtacccagaccaggttgcccttgaaaggcttttccgagttgaagatattagagttggggctacttctcgaaaggcgattcccttactagttgaacttcttaaaccaattccagaccgccccggtgctcctctactttcacttaatcttctaactcagcttgctggggactgtccacaaaatatgattgtcatggtagagtcaggtgctcttgagggtctctcgaaatatctttcccttggacctcaggacgagcaagaggaagctgcaacaggtcttttaggcatcttatttagcagtgctgaaattcgaaggcatgagtcagcatttggcgcggtcagccaacttgtagctgttttgcgtctaggtggaaggggggcaaggtacagtgccgccaaggcattggatagtctctttactgctgaccatataagaaatgcagagtcttctagacaagctgttcagccattggtagagattctcaacactggttcagagagggagcagcatgctgctattgctgcacttgttaggttgttgagtgataatccatcacgggctctggcagttgcagatgtggagatgaatgcggtggatgttctctgcaggatcctttcttcaaactatacgatggaactgaagggagatgctgcagagctgtgttatgttctgtttgcaaatacaaggattagatctacagttgctgcagcgcgttgtgttgagccacttgtctctcttcttgtgactgagttcagccctgctcagcattcagttgtgcgtgcactggacaagcttgtcgacgatgaacaactggctgaactagttgcagctcatggcgctgtggtacctcttgttggccttctctatggtaaaaactatgtgcttcatgaggctatatccagggctctagtaaagttgggtaaggacaggcctgcttgtaaactggaaatggtgaaagctggagttatcgactgcgtacttgatattctccacgaagctccagattttctatgtgctgcgttttcagaactgcttcgaatcctcacaaataatgctactattgccaagggacaatctgctgcgaaagtggtggagccacttttccatttgctgacgaggttggagtttggagctgatggacagcacagtgctctgcaagttctggtaaatatcttagaacatccacaatgccgcgctgattatacacttacaccgcaccaagtaattgagcctttaattccgctactggaatctccatccccagcagtccagcagttggcagctgagcttctatctcatcttctctacgaggagcatctgcagaaagatccattaacgcaacttgcgattggtcctctaatccatgtgctgggatccggcatacacctattacagcagagagctgtgaaagctctcgtcagcattgctctaacatggccaaatgaaatagctaaagaaggtggtgtgagtgagctgtcaaaggtgatactgcaagctgatccatcgctctccaatgtgttatgggagtctgcagcatcaattttggttatcatcttgcaatttagctccgaattttacctggaagttcctgttgctgttcttgtaagactgcttcgttctgcatctgaaaacaccgtggttggtgcacttaacgctcttctagtgttggaaagcgatgatggaaccagtgcagagtccatggctgaaagtggtgccatagaagctctgcttgatcttttaaggtctcatcagtgtgaggacacagcagcgagactgctcgaggtactgctcaacaacgtgaagattagagattcaaaagccaccaagactgcaatcttgccattgtctcagtacctcttggatccacaaactcaagctcagcaggcgcggttactagcaactttggcccttggtgatcttttccagaatgaagctcttgctagaagcaccgatgcagcttctgcttgccgtgctttagtcaatgtccttgaagaacaacccacagaagaaatgaaagtagttgctatatgtgctctgcaaaatctcgtcatgtatagccgatctaacaaaagagcagttgccgaggcaggtggtgtgcaggtcgtcttggatctgatcagttccagtgatcctgaaacgtctgttcaggctgcaatgttcgtaaaactactcttctctaatcacaccgttcaagagtacgcatctagcgaaaccgtcagagcaataactgctgccattgagaaagacttatgggccactggaaccgtgaatgatgaatacctaaaagccttaaactctttgtttaacaacttcccgcgtctaagagctacagagcctgcaacactaagtataccacatctagttacatccctcaagacaggatcagaagcaacacaagaagctgccttggatgcattgtttcttctcagacaagcttggtcagcctgtcctgccgaagtttccagggcccaatcagttgctgctgcagacgccatccccctacttcagtacctaatccaatcaggtccaccacggttccaggagaaagctgaattcctcttgcagtgtttgccaggtactctggtagtcactatcaaacgtggtaacaacatgaagcaatccgttggtaacccgagtgtgttctgcaagataacactcggcaacaatcctcctagacagaccaaggtaggaaaagacttatcaccctttcgtcaattcactgtgactagtaattcctttagatatcaaccgtatctttcgattttctcaggtgatatcgacaggtcctaa

SEQ ID NO: 2442 - DNA, 666 bp, Arabidopsis thaliana
atggtgaggggaaagacagagatgaagaggatagagaacgcaacgagcaggcaagtgactttctcaaaaagaagaaatggacttttgaagaaagcttttgaattatcagtcctttgtgatgctgaagttgccctaatcatcttctctcctagaggcaaactctatgagttctctagctcctccagtatacctaaaacagtagaaagatatcaaaagcgaatacaagatctcgggtctaaccataagagaaatgataattcacagcaatcgaaggacgaaacctatggcttggcgagaaagatcgaacatttggagatttcgacacgaaaaatgatgggagaaggacttgacgcatcttctatagaagagttacaacaattggagaaccagttggacagaagcttaatgaaaataagagccaaaaagtaccagttattacgagaagaaactgagaaattaaaagaaaaggagaggaacctcattgcagaaaataaaatgctgatggagaagtgtgagatgcaaggaagaggaataataggaagaatatcatcatcatcatcaacatcagaactggatatagatgacaatgaaatggaagtggtgactgatttgttcattggacctcctgagactcgacacttcaaaaagtttcctccttcaaactaa

SEQ ID NO: 2443 - DNA, 175 bp, Arabidopsis thaliana
cccaaatcattggtccggtactggatgtagccttccccccgggcaaaatgcctaatatttacaatgctctggtggttaagggtcgagatactcttggtcaagaaattaatgtgacttgtgaagtacagcaattattaggaaataatcgagttagagctgtagctatgagtgctac

SEQ ID NO: 2444 - DNA, 531 bp, Arabidopsis thaliana
atggcgaatcctaaagtcttcttcgacatcttgattggtaagatgaaggcagggcgtgttgtaatggagttatttgcagatgtgactccgagaacagctaataatttccgtgctttgtgcactggggagaatggtattgggaaagcagggaaggctttacactacaaaggctcagcctttcaccgtataatcccagggttcatgtgtcaaggtggagatttcactcgtgggaatggaactggaggagaatctatttacgggtctaaatttgaagatgagaacttcaagttgaagcacactggtccagggattttgtctatggctaactctggtcccaacactaatggttctcagttcttcatctgcacagagaagacttcgtggcttgatgggaaacatgttgttttcgggaaagttgttgatggatacaatgtggtcaaggcaatggaggatgttggctctgacatgggaaatccttctgaacgagttgtgattgaagattgtggtgagctcaagaacccaagttcataa

SEQ ID NO: 2445 - DNA, 1173 bp, Arabidopsis thaliana
atggaaacgttcctatttacctctgaatccgtcaatgaaggacacccagacaagctttgtgaccagatttctgatgcgatccttgatgcttgcttagagcaagatcctgaaagcaaagtggcgtgtgagacatgcaccaagaccaacatggtgatggtgtttggtgagatcactaccgctgcgaaagttgactatgagaagattgttagatccacttgcagggagattggttttatctctgctgatgttggtcttgacgctgacaaatgcaatgttttggttaacattgagcaacagagccctgacattgctcagggtgttcatggtcatttgaccaagaagcctgaagatattggtgctggtgatcagggacatatgtttgggtatgctactgatgagactcctgagctcatgccgttgactcatgtcctagccaccaagcttggtgctaagcttactgaagtgaggaagaacaagacttgcccatggttgaggcctgatggtaagacacaagtcacagtggagtacaagaacgatggtggagctatgattccgattagagtccacactgttcttatctcaactcaacatgacgaaactgtcaccaatgatgagattgctgctgacttgaaggagcatgtgatcaagcctgttatccctgctaagtaccttgacgataacaccatctttcacttgaacccatctggtcgttttgtcatcggagggcctcatggtgatgctggacttacagggaggaagatcatcattgacacttatggtggttggggtgctcatggtggaggtgccttctcaggaaaggacccaaccaaggttgacagaagcggtgcctatatcgtgaggcaggctgcaaagagcgtggtagcagcaggactcgcacgccgttgtatcgtgcaggtatcatacgccattggtgtccctgagccgctctcagtgtttgttgacacctacaagaccgggaccatcccagacaaggatatccttgtgttgatcaaggaagcatttgacttcaggccgggaatgatggccattaaccttgaccttaagaggggaggtaacttcaggttccagaaaaccgctgcgtatggccatttcgggcgtgatgaccctgacttcacttgggaggttgtcaagccgctcaagccaaaggcctag

SEQ ID NO: 2446 - DNA, 969 bp, Arabidopsis thaliana
atggcattctcgaagggactcatttttgcgatgatatttgcggttttagcgatagttaagccctcagaagctgctcttgatgctcattactatgatcaatcgtgccctgctgctgaaaaaatcatacttgaaactgttaggaatgctactttgtatgatcccaaagtgcctgctcgtctcctaagaatgttcttccacgattgcttcatcaggggatgtgatgcgtccattctactagattcgacacggtcaaaccaagctgagaaggatggtcctccaaacatctcagtacggtcattttacgtgatcgaagatgctaagagaaagctcgaaaaggcttgtcctcgtaccgtgtcttgtgccgatgtaatcgccattgccgccagagatgtggtcaccctgtccggtggtccttattggagcgtactgaaagggcgaaaagacgggacaatttcacgagccaacgagactagaaatctcccaccaccaacgttcaatgtttctcaactgatacaaagctttgcagcaagaggcttgtcggtgaaagacatggttacgctctcaggtggccacaccatagggttctctcactgttcttctttcgagtcccgtcttcaaaacttcagcaaattccatgacatagatccttcgatgaactatgcgttcgcgcaaaccttgaaaaagaaatgcccgagaacatctaaccgaggcaagaacgcagggacagtcttggactctacttcctcggttttcgacaatgtttactacaagcaaattttgtccgggaaaggagtgtttgggtctgatcaggcacttctaggcgattcccggactaagtggatcgttgagacgtttgctcaagaccaaaaagctttcttcagagagtttgcagcttccatggtaaaacttggaaactttggagtcaaagagactggacaagttagagttaacactcgcttcgtcaactaa

SEQ ID NO: 2447 - DNA, 1401 bp, Arabidopsis thaliana
atgcaggcaacggctttatcatctgggttcaatcctctaacgaaacgtaaagatcacagatttcccaggtcatgctctcagagaaattctctgtctttgattcaatgcgatataaaagagagatctttcggagagtctatgacgatcacgaatcgtggattgagttttaagacgaatgtgtttgagcaagctcgttctgtgactggagactgttcttatgatgaaacttcagctaaagcacgttctcatgttgttgcagaagataagattggtgtcttgcttttgaatttaggtggtcctgaaactcttaacgatgttcaacctttcttgtataatctctttgctgatccggatattataaggcttcctagaccatttcagtttcttcaagggactatagctaagtttatatctgttgttcgtgctccgaaatctaaagaagggtatgctgctattggtggtggctctcctttgcgtaaaataactgatgagcaagcggatgctattaagatgtctttgcaagcgaagaacattgctgctaatgtctatgttggtatgcggtattggtatccgttcactgaggaggctgttcagcagataaagaaggacaaaattactagacttgttgtactgccattgtatcctcagtattctatctctacaacgggttcaagcatacgcgttctccaagatttattcaggaaagatccgtacctagctggagtgccggtagctattataaagtcctggtaccaaaggcgaggctatgtcaattctatggctgacctcattgagaaggagcttcaaactttctctgatcctaaggaggttatgatattcttcagtgcccatggtgttccggtcagctacgtagagaatgctggagatccgtaccagaagcagatggaagagtgtattgacttgataatggaagagctaaaagccagaggggttcttaacgaccataaattggcataccagagtcgtgttggccctgttcaatggctgaagccatacaccgatgaggttcttgtcgaccttggtaagagtggtgttaagagtctactagccgttccagtcagtttcgtgagtgagcacattgagacacttgaggagatagacatggagtatagggaattagctcttgagtcaggggtagagaactggggacgggtacccgcgctaggtctcacaccatccttcatcaccgacttagctgatgcagtgatagaatcacttccttcagcagaagcaatgtcaaacccaaatgcagtggttgactcagaagatagcgagtcgtcagatgctttcagttacattgtcaagatgttcttcggttcgattctggctttcgtcctacttctctccccaaagatgttccatgcgttccggaacctatag

SEQ ID NO: 2448 - DNA, 2244 bp, Arabidopsis thaliana
atgcaacaacaaggtgaaccatcggttttgagtttgagacccggcggtggcggcggcaaaagcaggcttttcgtccctcgctttagctcctcttcctcttttgatcttaccaatggcggctccgaagaaaccccttttcccgtcaagagagaaaattctggtgaacgtgtgaggttttcccgagaagagatacttcagcacagagagtctgttcaagtctctgatgaaattcttagacgctgtaaggaaatcgcagttgagctttttggcgaagagcagagttgggggaatcatgcagccgagagtaaaataacaaatcatactcagcatcgtcataccgagactgataaccgtgactggcatagtcgttctcagattccaacctctggtaaagaatggttaagggacgaccctcgtgaagccaaaagtacatggcaagggtctggtcctacccctgtgctgattaaagcggaggttccgtggtcagctaaaagaggagctctttcagataaagatcgagtcgttaagagcgtgaaaggtattctaaacaagcttactccggagaagtacgagcttcttaaaggtcaattgattgacgctggcatcacttccgcagatatcctaaaggaagtgatacagctaatttttgagaatgctatactgcagcccacattctgcgagatgtatgctcttctgtgttttgatattaacggacagctaccttcgtttccctctgaggaacccggtgggaaagaaataacctttaaaagagtgcttttgaataattgccaagaggcatttgaaggtgctggcaaattgaaggaagagatcagacagatgactaatccagaccaagaaatggaaagaatggataaggagaaaatggcaaagctccggacacttggaaatatccgtctgattggtgaacttctcaagcaaaagatggtgcctgagaagatagttcatcatattgttcaggagcttttaggagacgatactaaagcttgcccagcagagggagatgttgaagctctctgccaattttttataaccattgggaagcaacttgatgacagcccacgatctcgaggtattaatgacacgtactttggtcggttgaaggagctagcaaggcaccctcagctagagctgcgtctcagatttatggtccaaaacgttgttgatcttcgagctaataaatgggtaccaaggcgtgaggaggtgaaagcgaagaaaatcaatgaaatccattctgaggcagagagaaatcttgggatgcgtccgggtgcaatggcaagtatgagaaacaacaacaacaaccgcgctgcggtttctggtgcagcagacggtatgggcttgggaaatatccttggccgtcctggtactggaggaatgatgcccggcatgccgggaactagggtgatgcctatggatgaagacggctgggaaatggcacggacccggtccatgcccagaggcaatagacaaacagtgcagcagccgcgttttcagccacctcctgctatcaacaagtcactctcagtcaactcaaggcttcttcctcagggtagcggaggtctcctcaatggtggtggtaggccaagccctcttttgcaaggtaacggttctagctcagctcctcaagcctctaaacccattccaactgttgagaagccgcaaccacggtctcaacctcagccacagccacaggcagctcctctggctaatagcctgaacgcaggagagctcgagagaaaaaccaagtcgcttcttgaagagtatttcagtattcgtttagtggatgaggcattgcaatgcgttgaggaactaaaatctccatcttaccacccggagctcgtcaaggaaacaatctcgctcggtctagagaaaaacccaccattggttgaaccaattgccaaactcttgaaacatctgatctctaagaatgtgctgacatctaaagacttaggggcaggttgtttgctctacggttccatgttggatgacattggaatcgatctgccaaaagcaccaaacagcttcggagagttcttaggggagttggtctcagctaaagtcttggatttcgagctggtgagagatgttctgaagaagatggaagatgagtggttcagaaaaaccgtactcaatgcagtgataaagagtgttcgcgagtgtccatcgggacagtctgtattggattcgcaggcggttgaagttgaggcatgccagagtttgctctaa

SEQ ID NO: 2449 - DNA, 1116 bp, Arabidopsis thaliana
atgggttatgctaaatcagccatgctgatcttcttactagcattggtcatcgcatcttgtgccacggccatggacatgtccgttgtttcctccaacgataaccaccacgtgaccgccggtcccggccgccgtcagggtattttcgacgctgaagccaccttgatgttcgagtcatggatggtcaaacatgggaaagtgtacgactccgttgccgagaaggaacggcgtttaactatttttgaggacaacctccgttttatcactaaccggaacgctgagaatctcagttaccggcttggtttgaatcggtttgcggatttatctctccatgaatacggagaaatttgccatggggctgatccaagacctcctaggaaccacgtcttcatgactagcagcaaccgatacaagactagtgatggtgatgttcttcctaagtccgttgactggagaaacgaaggcgcagtgactgaagtcaaagatcaaggcctttgcaggagttgttgggctttctccactgtgggagcagtggaaggcttaaacaagattgtgactggagagctagtaactttgtctgagcaagatttgatcaattgtaacaaagaaaacaatggttgcggaggaggcaaagtcgagacagcctatgagttcatcatgaacaatggtggtcttggtaccgacaacgattatccttacaaagctctcaatggagtctgcgaaggccgcctcaaggaagacaacaagaatgttatgattgatgggtatgagaatttgcctgcaaacgatgaagccgctctcatgaaagcggttgctcaccagcctgtgactgccgttgtcgattccagcagccgagagtttcagctttatgaatcgggagtgtttgacggaacttgcggaacaaacctaaaccatggtgttgttgtggtcgggtatggaaccgagaatggtcgtgactactggattgtgaaaaactcgaggggcgacacatggggggaggctggctacatgaagatggctcgcaacattgccaatccaagaggcctatgtggcatcgcaatgcgagcttcataccctctcaagaactcgttttctacggataaagtttcggttgcctaa

SEQ ID NO: 2450 - DNA, 540 bp, Arabidopsis thaliana
atgggtttggttacagaggaggtgagagctaaggcagagatgtacaccggagatgagatatgtagagagaagacaaagtgtttcctcaaggaaatatctatgcccaatggtttattaccattgaaggatatagaagaggttgggtatgacagagagtcaggtgttgtatggctgaagcagaagaagagcatcactcacaagttcacagagatagataagcttgtctcctatggaaccgaagtcacagccattgttgagaccgggaaaatcaagaagctcactggagtcaaagccaaggaacttcttatttgggtcactatcaatgagatctataccgaggaaccccctaccaagatcacgttcaagacaccgaccacactgtccaggactttcccggtcacagcttttatagtcccagaagaacctgccaaggaggaacctgccaaagaggaacctgccaaggagaagagcagcgaagccaccgaggccaaggaggctgttgcaatcaaggaggctgtcgcagtcaaagaggcggcctaa

SEQ ID NO: 2451 - DNA, 1263 bp, Arabidopsis thaliana
atggcggcgtcacagacattctcactcctcgccttcactttctccctcctcgcctttgcttccaccgtgagtagccacaacatcactcaaatcctcgctgattctccagattactcttccttcaacagctacctttctcagacgaagctcgccgacgagatcaacagccgcacgacgattacagttctcgtccttaacaatggcgcaatgtctgctctcgccggaaaacatccactctccgttattaaaagcgctttaagcctcctcgtcctcctcgattactacgatccacaaaaactccacaagatctccaaaggcacaactctctccaccacactttaccaaaccaccggaaacgctcccggaaacctaggattcgtcaacatcaccgatcttaaaggaggcaaagtcggatttggctccgccgcttcaggttccaaactcgattcatcttacaccaaatccgttaaacaaatcccttacaacatctcaatcctcgagattgatgctccgatcatcgctcccggagttttaaccgctcctgctccttccgcctccttgtcaaacatcaccggattactcgaaaaagccggttgcaaaacctttgctaatttgcttgtctcaagtggagtactcaagacttacgaatccgccgttgaaaaaggcttgacggtttttgcaccgtccgatgaagcttttaaagctgaaggtgtaccagatctgacgaagctcacacaagctgaggtagtctcgctcttagagtatcacgccctcgctgagtataaacctaaaggctcattgaagactaacaagaacaatatctccacgttagccactaacggcgccggaaaattcgatctaacgacctctacctccggcgacgaagttattctccacaccggcgttgctccgtcgagactcgcggacactgtgctcgacgcgactccggttgtgatattcactgtggataatgtccttctccctgctgagctattcggaaaatctaaatctccatctccggcaccggcgcctgagccagttaccgcaccgacaccatctccagcggatgcaccttcacccaccgcagcttcaccaccggcacctccgacggacgagtcaccggaaagtgctccttcagactcgccaacaggttcagcgaacagtaagtcagctaacgcagcggttggcgtgagcacaccgtcgttgttcaccgcattggtcacgatcgccgccatagccgtctccgtgtctctctgctcttaa

SEQ ID NO: 2452 - DNA, 2522 bp, Arabidopsis thaliana
gtgcatgcaaaaaattagggatttacgattattcagaattgaatggaaacttaggtactagtcattatattttaatatattctgctatctttcatgagaactcggatttattagtaaaaagacgaagaaatagatttcttattccattccaatcggttcaagagcaagagaaagaattcataccgcaggcaggtatctcggttgaaaaaggccgttgaaatacccataaatggtattttccatagacatagtatttttgctttttttgatgatcctagataccgaagaaagagttccggaattcttatatatgggactctaaaggcggattcaatcatccaaaagaggatatgattgagtatcaaggagtccaaaaaattaagacaaaataagaaatgaaagtagatcgcttttttttcattcctgaggaagtgcatattttacctgaatcctctgccataatggtacagaactatagtatcattggagtggatacgcgactcactttaaatataagaagccaagtcggtgggttgatccgagtagagaaaaaaaaaggattggactcaaatattttcaggggatatccattttcccgacaagacagataaaatatcccgacacagtggcgtcttgataccgccaggaagaggaaaaacaaactcaaaggaatccaaaaaatttaaaaatcctatttatgtccaacggattacaccaaccaagaaaaagtttttttttgttttggtgcggccttgtagccacctatgagataaatttggcaacactcttccaacaagatctctttcggggaaatgatactattcaacttcgagtttttaactatatcctttatggaaatggcaaaccaactcgaggaatttttgacacaagtattcaattagttcgaacttgtttagtcttgaattgggacaaaaattcttctctgaagaggtccgtgctttctttgttgaagtaagtacaaagggtttgattcaagatttcataagaactggcgtagtgaaatcccatatttcatatataaggaaaaggaataattcgtcagattcgggattaatctctatagatcacatgaatcagttttattcgatttcgccaaagtctggcattcttcaacaataacttagacaaaatcacggaactattcacatgttcttaaatcaaaataaggagtcccaatctttgttacttttatcatcatctaattgttttagaatgggtccatttaatcatgtaaaacatcacaatgtgataaataatttaataagaaaaaaaaactctaattaccattgaaaatttgttgggacccttaggaacagctaccccaatttcaaatttttattcgtttttgcctttactaatttataatcaaatctctttaattaaatatttttgacttgataacttaaaatatatttttcaaaaaattaactcttacttaatcgatgaaaacgtaagaattttaaatctcgacccatacagtaacgttgttttgaatcaagtcaaattgaattggtattttcttcatcaaaattatcatcataatgtttgtgaagaaacgtccacaataattagtcttggaaaaatttgttgtgaaaatgtatgtatagctaaaaaagaaccgcacctaaaatcgggtcaagttttaattgttcagagggattctgcagtaataagatccgctaagccctatttggctactccgggagcaaaagttcatgggcattatagcgaaattctttacgaaggggatacattagttacatttatatataaaaaatcgagatccggtgatataacctaaggtcttccaaaagtagaaaaagtattaaaagtccgctcgattgactcagtatcgttgaacttagaaaaacggattaagagttcgaacaagtgtataacaagaattcttggaattccttggggattcttgagtggtgctgagttaactatagtgcaaagtcgtatttctttggttataagattcaaaaggtttatcgatcccaaggggtgtagattcataataggcaaacggaaattaatgtacgtccactaacatcaaaagttttcgtttccgaagagggattgctaatgcttttttacctggagaacttattggattattatgagcggggcgtgctttagaagaagcaatctgttatcgagccgttttattagtattaactcgagcatctttgaatactcaaagtttatatccgaagcaagttttcaataaactgctcgagttttagaaaaagtttttgctcttcggggtcatatcgatttgttgaaaggcctgaaagaaaatgttgttctaggggggatgatccccaccgggatcagattcaacaaaggaatggtgtattgttcacggcaacataccaacattattttggaaaaaaacaaagaatttagctttattcgagggagatatgagagatattttattctaccacagggaattttgtgactcttctatttccaaatctgatttttctaggatt

SEQ ID NO: 2453 - DNA, 550 bp, Arabidopsis thaliana
gtgatggtttttcaatcttttatactaggtaatctagtatccttatacatgaagataataaattcggtcattgtggtcggactttattatgaatttctgaccatattttctataggaccctcttatctctttcttctccgagtttggacgaaggaaaacaaagaccgggaagaaagtatcgcaacaacatgttttattgcgggacagcttatgatgttcatatcaatctattatgcgcttctgcttttagtattgggtaaacctcatacaataactcttctagctctaccgtatcttttatttcatttcttttgaaacaatcacaaacacttttttgattatagatctactaccagaaatgaaatgcgtaatctttgcattcaatgtgtattcctgaataatctcatttttcaattattcaaccatttcattttaccaatttcaatgttagccagattagtcaatatttatatgtttcgatgtaacaataaaatgttatttgtaacaagtagttttgttggttggttaatttggtcacattttattaaga

SEQ ID NO: 2454 - DNA, 1239 bp, Arabidopsis thaliana
atggcttcttctcgtatttctctccgccttgttcgccgatttgcctcagccgccgctgacggtacgaccaccgctccctcttcaggcaaaatctctgtctccaaagctaagtccactctccggaaagaacacgatcccgacaaagctcttaagatctacgccaatgtctccgatcactcagcctctcctgtttcatctcgctacgcccaagagctcactgttcgtcgcctcgccaagtgtcgccgtttctcagacatcgaaaccctaattgaatcccacaaaaatgatcccaaaatcaaagaagaacctttctactctacgcttatcagatcttacggccaagcctctatgtttaatcacgccatgagaaccttcgagcagatggatcaatacggcacacccagatcagctgtttccttcaacgccttgctcaacgcttgtctccattccaagaatttcgataaagtcccccaactgttcgacgaaattcctcagaggtacaataagatcatccctgacaaaatctcttacggtatattgattaagtcatactgtgactctggtacccctgaaaaagccattgagattatgagacagatgcaaggtaaaggcatggaagttactaccattgctttcaccaccattttgagttcattgtataagaaaggtgagctcgaggtagctgataacttgtggaatgagatggtgaagaaaggctgtgaattggataatgcagcgtataatgttcgtataatgagtgctcaaaaggaaagccctgaaagagttaaggagttgattgaagaaatgagtagtatgggattgaaacctgatacgattagctataactatcttatgactgcgtattgtgagagaggaatgttggacgaagctaagaaagtgtatgaaggacttgaaggtaacaactgtgctcccaacgcagctacttttaggacattgatatttcatctttgttatagccgattgtacgagcaaggctatgcgatcttcaagaagagtgtgtatatgcacaagattccagatttcaacactttgaagcatttggttgtgggattggtggagaacaagaaaagagatgacgctaaagggttgattagaacggtgaagaagaaattccctccgagtttcttgaatgcgtggaagaaactcgaggaggaactcgggctgtattcaaaaaccgatgcttttccatcttctgcaaaagaggctgctgctgcttaa

SEQ ID NO: 2455 - DNA, 1782 bp, Arabidopsis thaliana
atggcggctttgtcttcctccgtcaccacccgatcatatcattccggttatttggcttctttctcaccggttaacggtgaccgacatcgatcactctcgttcctgtctgcttctcctcaaggattgaatcctcttgacctctgtgttagattccagaggaagtctggtcgtgcttctgtctttatgcaagatgtcactaattcaaattcatcagagagtaaaacttctcttaagggattgaaagatgaggtgctatcagctttatctcaagaagcagccaaggttggagtagaatctgatggtcaaagccagtcaacagttagtattacggtggttggagcctctggtgatcttgctaagaagaagattttcccggctcttttcgccctttactatgaaggttgtctccctgagcattttacaatatttggatattctaggagtaagatgacagatgttgaacttagaaacatggtcagcaaaaccctcacttgcagaattgataagagggcaaactgtggtgaaaagatggaagaatttctcaagagatgtttttaccattctggtcagtatgattctcaggaacattttactgaattggataagaagctcaaggaacatgaggctggaagaatctcaaaccgcctcttttatttgtctatccctccaaatatatttgtagatgctgtgaaatgtgcaagcacttctgcttcatctgtcaatggatggactagggttatcgtcgagaaaccttttggtcgagattctgaaacctcggctgctttaacgaaatccctcaagcagtatttggaggaagatcaaatttttaggatagaccattacctaggaaaggagctagtcgagaacttatctgttcttcgattctcaaaccttatatttgagccgctatggtcaaggcagtacataaggaacgtgcaatttatattttctgaggatttcggcactgaaggacgtggagggtactttgacaattacggaataataagagatataatgcagaatcatctgcttcaaatcttagccctctttgccatggaaacgcctgttagtttggatgcagaggatatcagaaatgaaaaggttaaggtgttacgttcaatgaggccaattcgagttgaagatgtggtaataggacaatacaagagccacacaaagggaggagtcacatatcctgcctacaccgatgataaaactgtaccaaaaggtagtctgactccaacatttgcagctgctgctcttttcatcgacaatgcaagatgggacggtgtgccctttttaatgaaagcgggcaaagcactacacaccaggagtgcagagataagggtgcagttcaggcatgttccggggaatttgtataaccggaatactggttctgatcttgatcaagctacaaatgagcttgtgatccgtgtccaaccagatgaagcaatctatttgaaaatcaacaacaaggtccctggtttaggaatgagattagatcgcagtaacttgaatcttctatactcagcaaggtattcaaaggagataccagatgcatatgagaggcttctgttagatgcaatagaaggagaaagaagattgttcataagaagtgacgagcttgatgcagcttggtcgctattcactccattgcttaaagagattgaagagaagaagagaatccctgagtactatccttatggtagccgtggtcctgttggtgctcattatctagctgctaaacacaaggtgcaatggggtgacgtcagtattgaccagtaa

SEQ ID NO: 2456 - DNA, 1779 bp, Arabidopsis thaliana
atggatctccgtcggaggcctcctaaaccaccggttaccaacaacaacaactccaacggatctttccgttcttatcagcctcgcacttccgatgacgatcatcgtcgccgggctacaacaattgctcctccaccgaaagcatccgacgcgcttcctcttccgttatatctcacaaacgccgttttcttcacgctcttcttctccgtcgcgtattacctcctccaccggtggcgtgacaagatccgttacaatacgcctcttcacgtcgtcactatcacagaactcggcgccattattgctctcatcgcttcgtttatctatctcctagggttttttggtattgactttgttcagtcatttatctcacgtgcctctggtgatgcttgggatctcgccgatacgatcgatgatgatgaccaccgccttgtcacgtgctctccaccgactccgatcgtttccgttgctaaattacctaatccggaacctattgttaccgaatcgcttcctgaggaagacgaggagattgtgaaatcggttatcgacggagttattccatcgtactcgcttgaatctcgtctcggtgattgcaaaagagcggcgtcgattcgtcgtgaggcgttgcagagagtcaccgggagatcgattgaagggttaccgttggatggatttgattatgaatcgattttggggcaatgctgtgagatgcctgttggatacattcagattcctgttgggattgctggtccattgttgcttgatggttatgagtactctgttcctatggctacaaccgaaggttgtttggttgctagcactaacagaggctgcaaggctatgtttatctctggtggcgccaccagtaccgttcttaaggacggtatgacccgagcacctgttgttcggttcgcttcggcgagacgagcttcggagcttaagtttttcttggagaatccagagaactttgatactttggcagtagtcttcaacaggtcgagtagatttgcaagactgcaaagtgttaaatgcacaatcgcggggaagaatgcttatgtaaggttctgttgtagtactggtgatgctatggggatgaatatggtttctaaaggtgtgcagaatgttcttgagtatcttaccgatgatttccctgacatggatgtgattggaatctctggtaacttctgttcggacaagaaacctgctgctgtgaactggattgagggacgtggtaaatcagttgtttgcgaggctgtaatcagaggagagatcgtgaacaaggtcttgaaaacgagcgtggctgctttagtcgagctcaacatgctcaagaacctagctggctctgctgttgcaggctctctaggtggattcaacgctcatgccagtaacatagtgtctgctgtattcatagctactggccaagatccagctcaaaacgtggagagttctcaatgcatcaccatgatggaagctattaatgacggcaaagatatccatatctcagtcactatgccatctatcgaggtggggacagtgggaggaggaacacagcttgcatctcaatcagcgtgtttaaacctgctcggagttaaaggagcaagcacagagtcgccgggaatgaacgcaaggaggctagcgacgatcgtagccggagcagttttagctggagagttatctttaatgtcagcaattgcagctggacagcttgtgagaagtcacatgaaatacaatagatccagccgagacatctctggagcaacgacaacgacaacaacaacaacatga

SEQ ID NO: 2457 - DNA, 1986 bp, Arabidopsis thaliana
atggattcagctcccaacttcatccctcggttacttctactatcacttctcatcgtatcaattcctctaacatcatcacaatccgacgccaacactactaatccgtcaccgtcaccaccgtcagattcggatctatgcaacggtgtattcgtttcatacactcacactaaaggatctaagatcccacccaacgacaccgcaaatcaaccctaccggttcgaatctgtgataacagtgctcaaccacggccgcgacgagctcaaatcatggcgtgtcttcgtcaaattcgcacaccgagagatcctcgtctctgcttcaaacgctgtactctcagacggctcgagcttaccggtgagcgtcgaaaacggtaccgttttcgctggttatccttcgtcggatttgaaatcagctattcagactgctggtgatgtcactcagatgcaagctcgtgttgagctcgtcgggactcagttcggagttgcgccgccgaatgtgccgcttcctaagaacatcactctcgctactgatggatggaaatgtcccaaagctactcaaaaaggtacaaatgttctgcaagtatgttgcattcctgacccagactatgataacagagagatcattgataatgagtttcttccacgaaaagatggagacctcactatcatgtacgatgtggtcagatcatattcatccaattatatggcacaggtcactatggagaaccataacccgcttggccggctggataactggaaactgagttttgactggatgcgggacgagtttatctacaccatgaaaggggcttacccgagtattgttgattcatcagattgtgttgatggcccacaggcgaagcactatcaagatcttgacttctctaacgtgttaagctgtgcaagacggccaaccgtcatagatctccctcctacgaaatacaatgattcgacattcggtcttatcccattttgctgcagaaatgggacgattctaccacggtcaatggatcctagcaagtcgagctcagttttccagatgcaggtgtacaaaatgcctcctgatctcaatatctctgctctatcaccgcctcagaactggagaataaacggtacactgaacccggattacaagtgtggccctcctgttcgggtgagcccgagccagttcgtcgatcccagtggattaccttcaaaccggactgcttttgcaagctggcaggtggtctgcaacatcacccaaccaaaagatgcgagtcctagatgttgtgtatcgttctctgcctacttcaacgactcaatcgtcccatgcaagacatgtgcttgcgggtgttccagcaacaaagcagcccgcgcttgcagtgccacagctccgtctcttcttctaccgcagcaagctcttctggttccatttgagaaccgaactgaactcaccgtcgcttgggcttatctaaaacaacggcccgtgccaaacccgatgccttgtggggataactgcggagttagcatcaactggcatttggctacagattatcgaggtggatggacagcccgggtcacagtcttcaactggggagaaacagactttgtagattggtttaccgcggttcagatgaaaaatgctgcaccgggtttcgagaaagcctactcattcaatgcatctacaattggtatcaacgggaagaacaatactattttcatggagggccttcctggattgaattatctcgtcgcagaaagagacggggaaaatccattgaagaatcctcggattccaggaaaacaacaatctgttatgtcctttactaagaaactgactcctggaatcaatgtccctggtggagatggcttcccgagcaaagtgttcttcaacggtgaggagtgctctctcccaaccatactcccaatgagaagtagccaacaccggaaacacatctctgttttcctcctggcattacctgttttggctctcttgattctgcgggcgtaa

SEQ ID NO: 2458 - DNA, 2043 bp, Arabidopsis thaliana
atgctcgacctggatgctcttccggggatacagactctttgtttactccacaatgctttggataaaactaagcagcttcttcaatattgcagtgaatccagtaaactctacatggcagtaacaggagatgctatactcgcaagaggttctagagctaaaaaatcattagagcaatgcttaaacgacattagaagtatagtaccaactattttggagatcaagatatctcagatagtccaagaccttagatcaacacagttgactctagaattctcggaagaagaagctgggaaagctattagagaattgatgcaaaagagcacgtcttcctctgcttctccggatgagataaaagattttcattatgctgcgttaaaactccaactttcaacacctgaagctattgtgacagagagaagatccttaaaaatcatttgtgaagatcacaaacagaactccttcacgcatcatcagtccatcgatgattctctgcatgctaatgctgcagaagctgaggcttctgaggaacacaatggtacacttcctgagaaatttaagtgcacgctttctcgtaccgtgatgtatgatccagtcatcatctcctcaggcaacacctttgagaggatgcagattcagaaatggttcgatgaaggtaatgattcttgtcctatatctaaaaggaaactggatgacttcacattgaagcctaatgtagagcttaagagtcagatatcagaatggtgcgcgaagaacggtcttgatgttcaagatccagcgaggaagcacgtaaaggcttccaacagtatcgacttctctgtttccatcgctagtttcggaagttctctgtacaacatccctgatcacagcggcatttcgattacggatttcaactcgagctattccattgattcgtcatcctactctaagatgtcaaagggtggttacttcactccaatgcagaggatagattctgcttcaggcgctggtgacacagattctagtcacagcgagattgagatagatcccttgtgtggactcacaaaccttccatgggatgcgcagatcaaagtcgtcgaagatgtaagaagtcgttttgagcacagtactcgtgcttttcggtctatgtcaccgagtaaatttcttgagccacttatcacatatttgaagaatgctctcgaaagaaatggcaccgctggagagataataaagggtggattggatttgttgctggctttccttagtggaaataggagagctatagaatctttggaagaagaggttttcaaaatgttctcagtctttcttgagtctgaggtagtagctgaagaagctctaaacatacttgaggttctgtcaaaccatccgcacggtccgtccaagataacttcatcaggatctctttcttcccttttgaagatcgtagagtcccaagcagaacatctccaagaacaggctatgatcacactcaagaatctttcatcaagcatggagatttgtctggaaatggtatctctcgatttcatccagaagctcacatctttcttgcaacaaaaagttttctgcaaacactcgattatcattctgaaaaacctctgcagcaccgagaaaggtcggggttgtatcaccgaaaccccggattgtttagcttccatagctgaattactcgagtcaaatgttcccgaggagcaagagaacgcaatctccatcctccttcagctctgtgtgcagaagatagagtattgctgtcttgtcgtgagagaagcaactgatatttactcatctctaatcttgatatccaacaatggaacagaggaagtaaaggtgagtgcatcagaattacttagagctcttgtagaagtagattccgacaaagaagaagaagaagaagtttcctccagaccagaaggaagaacaactgcttcgcctacttcacaggttgttactccagttactcatccggaacctgttaaaataacaccatctcccaagaaatctggtctttttggattcaatttctccagtctcaagaagaagaaaaaatag

SEQ ID NO: 2459 - DNA, 528 bp, Arabidopsis thaliana
atgcgtcactatatattaaaccgaaatcgtttcttcttccttcaagccgtcaacaatgtcgaagcgagcttttcgaacctcgttttaatcgttgttgatttggatttttttcgattagggcgtggaggtacctctggtaacaaattcaggatgtcactgggtcttccggtggcggcgacggtgaactgtgccgataacaccggtgctaagaatctctacatcatttccgtgaaaggtatcaaaggtcgtcttaatcgattaccttctgcttgcgtcggagacatggtgatggccaccgtcaaaaagggtaagcctgatctcaggaaaaaggttcttcctgccgtcatcgttaggcaacgcaaaccatggcgccgaaaggatggtgttttcatgtacttcgaagataatgctggagtcattgtcaaccccaagggagaaatgaaaggttctgcaattactggtcctattgggaaagagtgtgctgatctttggccaaggattgctagtgctgccaatgccattgtctaa

SEQ ID NO: 2460 - DNA, 657 bp, Arabidopsis thaliana
atggctgaaatcaaggatgaaggaagcgccaagggctatgctttccctctcaggaaccctaatgttacgctgaatgagagaaactttgcagccttcactcacagatcagctgctgctcatccttggcatgacttggagattggtccagaagctcctactgttttcaactgtgttgttgaaattagcaaaggtggaaaggttaagtacgagctagacaagaacagtggccttattaaggttgatcgcgttctctactcatccattgtgtacccccacaactacggtttcatccctcgaactatctgtgaagacagtgatccaatggatgtcctggtactgatgcaggagcctgtgctaaccggatcattcctccgtgcccgtgctattggtctaatgcccatgattgatcagggtgagaaagacgacaagatcattgcagtatgtgctgatgatcccgagttccgtcactacagagacatcaaagagcttccccctcaccgtctagctgaaatccgtcgcttctttgaggactacaagaagaacgagaacaagaaagtcgacgttgaagctttccttcccgctcaagctgccatagacgctatcaaggactccatggatctttacgcagcttacatcaaagctggcctgcaacgctaa

SEQ ID NO: 2461 - DNA, 1734 bp, Arabidopsis thaliana
atgtcgctggttcgaacagtgacgatcgttctttttataatcgcgtttctgcaaaacgctgcggctcagaaaagacagcaaagtattgttaagtctcgcggtgcggttgcgacagatgatggacggtgttctgttatcgggatgcgtgttcttcgtgaaggaggaaacgcgattgatgcgtctgtggctgctgctctgtgtttgggcgttgtaagtcccgcgtctagcggtataggcggtggagcgtttacagtggttaagatagctggtgggaaagaaattgcttatgattctagagaaaccgctcctctaagagccactgaggtaaaacgcgttttaaatatgtatggaggtaatgttgacctaaagaagaaaggagccttatcagtaggcgttcccggggaagttgcaggtctattcacggcttggaaacaacatgggaagctaccgtggaagcggttagtgactcctgcagagaaacttgcagagggattcaagatttccaagtatctttatatgcagatgaacgcgactagaagcgatatcttagcagacaaaggtctctctgacctatttgtttcaaatggagagctcaagaaaccagggacgatttgccataacccaaaattggctttaaccttgaagctaattggagagtacggtccaaaagcattttacaatggcacagttggggttaacctagcgagagatatcaaaaaatctggaggaataataactttgaaagatctgcaaagttatagagttaagattaaagaaccgttgtctgcagacattcttggatatagagtccttggtatgcctcctccttcatctggtggcgctgcaatgatgcttgttttgaacattctttctcaatatgggattccatcaggtgtttcaggccctctcggtgttcatcgactaatcgaggctctgaaacatgcattcgcagttagaatgaacctcggggatccagatttcactgatgttaccaaggttgtttcggatatgttgtcgccaaagtttgcaaaagacttgaagagcaagataaacgaccaaaaaacttttgatccaaaatattacgggggcatgtggaatcagatcgacgaccacgggacaagtcatttatcgatcatagaccgcgagaggaacgctgtgtctatgactagtacaataaatggttactttggggcattgatgctatctccgagcacaggaatagttctgaacaacgaaatggacgatttctcaatccctatgaaatctaacggtaacttagatgttccaccaccagcaccagctaacttcatccgtcctggaaaacgacctttgtcctctatgtcacccaccattgtactcaaggacggtaaagtgaaagccgctgtgggtgcgagcggaggagccaacattattgccgggacaacggaagtttacttgaatcattttttcctcaagatggatcctctttcttccgtcttagctccaagaatctaccatcagctgataccaaacagagcttcgtacgagaactggacaacagtattcaatgatcatttcgagattcctaaagcaacaagagttgtgttggagaagaaaggtcatgtcctatctcctattgccggagggacgattgctcagttcatagttcaagaatccggtgagaactccggtggaagaagtgagcttgtggcagttagtgatcctcgaaaaggagggttcccttcaggatattga

SEQ ID NO: 2462 - DNA, 1206 bp, Arabidopsis thaliana
atggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatggttttagaaaagctgatcctgagcaatgggaatttgcgaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttga

SEQ ID NO: 2463 - DNA, 1734 bp, Arabidopsis thaliana
atgtatcgtttcgcttctaacctcgcctccaaggcaaggattgctcaaaacgctcgccaggtttccagcagaatgagctggagcaggaactatgcagcgaaagagattaagtttggtgttgaagctcgagctttgatgcttaagggtgttgaagatcttgctgatgctgttaaagtcaccatgggtcccaagggacgtaatgttgtgattgagcaaagttggggtgctcctaaagtgacaaaagatggtgttactgttgccaaaagtattgagttcaaagacaaaattaagaacgttggtgctagtcttgtgaagcaggttgcaaatgctactaatgatgttgctggtgatggtactacttgtgctactgtcctcacccgggctatatttgccgaaggatgcaaatcagttgccgcaggaatgaatgcaatggacttgcgaagaggtatttccatggcagttgatgctgtggtgacaaaccttaaaagcaaggctaggatgatcagcacatctgaagagattgctcaggttggaaccatttctgctaatggagagagggaaattggtgaacttattgccaaggctatggagaaggttggcaaagaaggtgttatcacaatccaagatggaaagacattgtttaacgagttggaagttgtagaggggatgaaattggacagaggttatacttcaccatactttatcactaatcaaaaaacccaaaaatgtgaactagacgatcctctcattcttatccacgagaagaagatctcaagcatcaactctatagtgaaagtgttggagttggctctgaagaggcaaagaccactattgattgtttctgaagatgtggaaagtgatgctcttgcaactcttatccttaacaagctccgtgccggaattaaggtctgtgccatcaaggcccctgggtttggagagaataggaaggccaatttgcaagaccttgctgcccttactggtggagaggttatcacagacgagcttggcatgaatctggagaaggtggacctaagcatgctaggaacctgcaaaaaggttacagtctccaaggacgacactgttattcttgatggggctggcgacaagaaaggaattgaggaaagatgtgaacagattaggtcagcaattgaactgagcacctcagattatgacaaggaaaaactgcaagaaaggttggctaagctctctggaggtgttgcagtgttgaagattggaggagcaagtgaagctgaagttggtgagaagaaagacagagtgacagatgctttgaatgccactaaagcagcagttgaagagggtattttaccaggaggaggtgtggctcttctatacgcagcaagagagttggaaaaacttccaacagccaactttgaccagaagattggtgtccagattattcagaacgcattgaagactcctgtttacacaatcgcttcaaatgctggagttgaaggtgctgttattgttggcaagctcttggagcaagataacccagacctcggttatgatgctgctaaaggtgaatatgtggatatggtgaaagctggaatcatagaccctctgaaagtgatcaggacagctttggttgatgctgcgagtgtgtcatctttgttgacgacaacggaagctgtagtggttgatcttccgaaagacgaaagcgagtcaggagcagcaggagcaggcatgggtggaatgggaggcatggactactag

SEQ ID NO: 2464 - DNA, 1134 bp, Arabidopsis thaliana
atggcgcagatactttcccctgtttgtacggatcttttgaagttccagaactcagctcttagctccagatcaggtgcgtcgccgcggttctcggcgaagaccaccggtgcttcttcatcttggtacttacctcggtacgcaggaaagaggcgaaccgattcaatcggaagattgagagttgcaactgaggatgcttcttctctttccaccggtgatgtcgccgatgattactatgccgttctcggactccttccagatgctacgcaggaggagattaagaaagcttactataactgtatgaaatcgtgccatccagacttgagtggcaatgaccccgaaaccacaaatttctgcatgttcattaacgatatctatgagattctcagtgaccctgtacagcgtatggtttacgatgaaattcatgggtatacagtgactgccatcaatccttttcttgatgactccaccccaagggatcatgtttttgttgatgagtttgcttgtatagaggctgcgtgctttgatgatctggaaagtgactacatttgcgtttggtgtttaacaggctgcaaaaattgtgccaatgtggctccagatatatttcaaattgaggaagactttggtagagcaagggcttgtaatcagcgtggcaacccagatttggttcagcaagcagttgaaacatgcccggttgattgtatccatcagacttctgctgcacagttgtcattgcttgaagatgaaatgcgaagggttgaaagagtgaatctcttggaattgtcattgattgatcaggttgctctgatgctttctggaatggggtcaggagcagttgatgttttcagaatggcgagatctcgatgggaaaagaggcaagcaaaagttttgaatcaagctagaagtagaatgatgaagaggaaaaacacagatgaaacaccttcctattgggataacctctggggcaaacagaatgaataccagaaaagcggtaaaattgatgataaggaagaagtacaagaacgagcacagcgagccgccgcagcagccaggagatggagggaatactcacgaagaggcgtggataagcgccccaccttcaaactcccagactccgcctccagaggagacaactga

SEQ ID NO: 2465 - DNA, 1341 bp, Arabidopsis thaliana
atgaaacagagtaaaaccctagaattcaattcctttgctctgttatgcagtcttcatttcatcaaattcaacacagaagattcgatgagtagcttcaacggagactccatggatgatttcaaaggcctccgaataactcagcttgatgatgatgacgatgatgaaactgcggtggaacctataaatatggatgaatttgatgatgatgatgaggaagatgatgaagattatgaacctgtgatgttaggtttcgttgagagtcctaaattcgcatggtcaaatcttcgtcaactgttccctaatttagctggtggtgttccggcatggttggatccagttaatttaccatcagggaagtcaattctatgtgatctatgtgaagaacctatgcaatttgtacttcaactttatgctcctttaacagacaaggaatcagcttttcatcggacattgtttctcttcatgtgtccatctatgtcttgtctccttcgtgatcaacatgaacaatggaaacgtgccccagagaaggctatgcggagtacgaaggttttccgttgccaattgcctcgagctaatcctttttactcgagtgaggctccaaagcacgatggaacagacaagccattgggtcatggagctccgctttgcacttggtgtggaacatggaaaggagataaactatgtagcggctgcaaaaatgctcgatactgttcaccgaaacaccaggccctgcattggcgcttgggtcataaaaccgaatgccaacagcttcgaacggttagcgaaacatctgactcaggccctgtcaataatggggttgctccaactgaaaagcagaaagttgcgagtaagagtttatggaaagaatttgtattgatcaatgaggatgaaagtgagtatgatactgagatgtcaggagatgatgaagtagctaaacctttggtctcaaagagagaagttgacgaccaaatgaaatcgctaatgaacgattttgagggagatgctgataaaaagaattgggttaatttccagcaacgcgtagacaaagcccctgaacaagttctgagatattcccggagctctggtgctaaacccctttggccaatagcaagcggacgagtctctaaatctgagcttcccagttgcaaatcttgtggtggtcctcgttgttttgaatttcaggtgatgccgcagctactgttcttcttcggtgggaagaacgagagggaatctctcgattgggcaacaatcgtggtgtacacttgtgagaactcgtgtgactcgagcttaagttacaaggaagagtttgtctgggttcaactatacagtcagacaacttag

SEQ ID NO: 2466 - DNA, 1341 bp, Arabidopsis thaliana
atggatgatgagattgctaagttcatcagaagagtgaatccaccaagggttgtgatcgataacgaagtctgcaaagatgttactgtcattaaggtggatagtgcgaataaacatgggatacttctggaggttgttcaagttttgactgagcttaatctgactattaagaaagcttatatctcctctgatggtggctggtttatggatgttttcaatgttactgatcaagatgggaacaaagttaccgatgaaattgttcttgaatatatccgtaaatctcttggtcctgatgagtcttcttgcttcagtccatcaatgagatcaaccattggggttaaacaatctgtcgactacactgtggttgagctaacaggaactgatagacccggtttgttgtctgagttatgtgctgttcttatggacctccaatgcaatgtggtaaacgctgaaatttggacacatagagcaaaagcagcagcggttttgcaagtgaccgatgaagaaacgtgctctgcaatcactgatccagagaggttgtccaaaatcaggaaacttcttggttatgtgcttacaggtggaagcagtggcagaagattccgtgaaccgaaaaccactgtttcttctgctcttaatgagactcacacggaccgtaagcttcatcaattgatgtttgcagatagagattatgatgaatgggagaacaatgtcgatgacgaggataaatgtgggagagtaattccagatgtggatgtctccaatttgcatgatttggattactccattgtgatgatcaagtgtaaagacagaccgaagcttcttttcgataccgtcttcactctgacagatatgaattatgtcgtttcacatgctagcattgacgctgaaggcccccaagcttatcaggaatactacataagacatacggatggatctcctgtcaaatccgaggcagaaagacagcgagtgatcaaatgtctaaaagcagctattcaaagaagagtctctgaggggttgaagcttgagctttgcacttcagatagagtcgggttactctcggatgtgactcgaatcttccgcgaaaacagtctcacagtaacaagagctgaagtgaaaacaaaaggagacaaagctcttaacacattctacgtgagggacgcttctggctaccaagttgataccaagaccatagaatccattagacaagtcatcggtcagacgatacttcaagtgaaaggcggaaacacagacgcgaaaccgagtcctcaagattcaccaacagggtttcttttcggggttttcaagtcgagatctttcgtcaatttcgggttgataagatcttaa

SEQ ID NO: 2467 - DNA, 1074 bp, Arabidopsis thaliana
atggcatgtatgaagaaggcactaccattcattttaatggtattgttgcaaatagggtatgcaggaatggatattcttacaaaggatgtcctaaacaaaggcatgagcatttacgttctttccgtctaccgtcacggagttgccaccgttgttatggctccgttcgccttctacttcgacaagatagtgagaccgaagatgacagcgttgattttcttcaaaatagcgattcttggtttattagatccagtgattgctcaaaacttattcaatctcgggatgaaatacacgacagctacatttgcaattgccttgtacaacactttacctgcagtcacgttcatcctcgccttaatattcaggctcgaaagcgtgaagtttcaaagtatcaggagtgccgctaaggtggttggaacagtaactacagttggaggaatcatggtcatgacacttgtaaaaggtccagctcttgacctcttctggactaaaggaccctctgcacagaacacagttgggaccgatattcatagctccatcaaaggtgcagttttagtcacaattggttgcttcagctatgcatgtttcatgatactacaagcaatcacattgaagacttaccctgcagagctctctctcgcaacatggatatgcctaataggtacaatagagggagtagttgtagcattagtgatggagaaaggaaatcctagcgtgtgggccattggttgggacactaaacttcttacaatcacctatagtgggatagtgtgctcagcgcttggttactacattggaggagtggtgatgaaaaccagaggtcctgtgtttgtaacagctttcaaacctctttgtatgatcgttgtggcgattatgtcgagcatcatctttgatgagcagatgtacctcggaagggctcttggtgctacggtcatatgtgtaggtctataccttgtgatatggggcaaagccaaagattatgaatatcctagcacgccgcaaatagatgatgacttagcacaagcaaccacaagcaagcaaaaagaacaaagaagaacagtgatagaatcagtctaa

SEQ ID NO: 2468 - DNA, 1218 bp, Arabidopsis thaliana
atgaaaagtttggctagtgcggttggagggaagacggcgagggcatgtgatagctgcgtgaagaggcgggcacgttggtattgcgcagctgatgatgcctttctttgccatgcttgtgacggttcggtccactcggcaaaccctcttgctcgtaggcacgagagagttcgcttgaaatcggctagcgccggaaagtatcgccatgcctcgccgcctcaccaagccacgtggcatcagggatttacacgtaaagctcggaccccacgtggaggcaagaagagccacacgatggtttttcatgatcttgtgccggagatgagcacggaggatcaagcggagagttacgaggtggaagagcagctcatatttgaggtgccggtgatgaactcgatggttgaggagcaatgctttaaccaatccctggagaaacagaatgagtttccaatgatgcccttaagtttcaagagtagtgacgaagaagatgacgacaacgctgagagttgtctgaatggtttgttcccaaccgacatggaactagctcagttcacagctgacgtggagactctactcggtggaggggatcgagagtttcattccatagaagaactagggttaggtgagatgttaaagatcgaaaaagaggaggtggaggaagagggagttgtgacaagagaagtgcatgatcaagatgaaggtgatgagacatccccatttgaaataagctttgactacgagtacacacacaagaccacattcgatgaaggagaagaagatgagaaagaagacgtgatgaagaatgtgatggagatgggagtgaatgagatgagtggtgggattaaagaagagaagaaggagaaggctcttatgcttagattggactatgaatcagtcatttccacttggggaggccaagggatcccatggaccgcccgggtgccatctgaaatagacctcgacatggtttgtttcccaacccataccatgggtgaaagtggagcagaggctcatcatcacaaccacttccgcggcctagggttacacctaggagatgctggggatggaggaagagaggctagggtttcaagataccgagagaaaaggaggacaaggttgttctccaagaagataaggtacgaggtacgtaaattgaatgcagagaaaaggcctcgcatgaaaggaaggttcgtcaagagatcttcaattggtgttgctcactaa

SEQ ID NO: 2469 - DNA, 238 bp, Arabidopsis thaliana
tcgagcggccgcccgggcaggtaccaaaccggaaaatacagtctcatacttttaagtttttctgtttcagagtaagagatgactgctcttcctcctcttgttgaggaaaccatcttctccacttaatttccataatttccttgctttgtaggagttacgactccacttttttgcttcttgtaatgtttctctatttaaaaaaaaccaaaaaaaaaaaaaaaaaaaaaaaaaaaaaaaa

SEQ ID NO: 2470 - DNA, 1134 bp, Arabidopsis thaliana
atggttttcttgttgttcttcgctccttctccagtctccgctggtttctatacaaactcctcagccattccgccgcagcttctccgaaacgccaccgggaacccctggaactcattcttgaatttcactggatgtcacgccggcaagaagtacgatggtctctatatgctcaaacaatattttcaacattttggctacatcaccgaaactaatctctccggaaacttcactgacgacttcgacgatattctcaagaacgccgtcgaaatgtaccagagaaacttccagctaaacgtcaccggagtactcgacgagctcactctcaaacacgttgtgatcccacgttgcggcaaccccgacgtagtcaacggcacctcaactatgcatagcggtaggaaaaccttcgaggtttccttcgccgggcggggacaacgcttccacgccgttaaacactactctttcttccccggagagccacggtggccgagaaatcgtcgtgatctaacctacgctttcgacccgcgaaacgcgttgaccgaagaggtcaagagcgtgttctcacgcgctttcactcgttgggaggaggtgactccactaacgttcacacgcgtggagaggttctcgacctctgacatcagcatcggattctactccggagagcacggagacggagaaccgttcgacggcccaatgagaacgctagcacatgcgttctcgcccccgacgggacacttccatctagacggagaagagaactggatcgtctccggcgaaggaggcgacggttttatctccgtgtctgaggctgttgatctagaatcggtggctgttcacgagattggacatcttctagggttaggccattcctcggtagaaggttcgatcatgtatccaaccatcaggacgggtaggcgtaaagttgatttaacgaccgatgacgtggaaggagtccaatatttgtacggtgcgaatcctaacttcaatggttctagatctccaccaccgtccactcaacaacgagacactggcgattctggtgctcctggtagaagcgacggttctagatcggttttgactaatctacttcagtattatttttggattatatttggattatttttgtatttagtgtag

SEQ ID NO: 2471 - DNA, 2919 bp, Arabidopsis thaliana
atggagtggaatcgggagactctagtgttcctttcgcaatgttttcttaacacgctctctccgataccggagcctcgtcgaacggctgagagagcactctcggatgctgctgatcaggctaactacggcctagccgttctccgtttggtggctgagccagcaatcgatgaacagacgcgtcacgccgctgctgtcaactttaagaaccatctccgttcgcgatggcatcctgctggtgattctggtatctcaccgatcgtagattctgagaaggagcagatcaagacactcatcgtctctcttatgctctctgcttctcctcgtatccagagccagttgagtgaagccctaaccgtcattggtaagcacgatttccccaaagcttggcctgctttgcttcctgagcttatcgccaaccttcaaaacgctgctctcgctggcgattatgtgtccgtcaatggtattcttgggaccgctagttcgattttcaaaaagtttagttatgagtatagaaccgatgctctgtttgttgatttgaagtattgcctggataattttgctgctcctttgactgaaatattcctgaaaacgtcttcgttgattgattctgctgcgagctctggtggttcacctccgatcctgaagcctctcttcgagtcccaaaggctgtgctgtacaatattttactctttgaactttcaggacttaccggagtttttcgaggatcatatgaaggagtggatgggagagtttaagaagtatctatcttcaaattatcccgccttggaaagcacagaggaggggttaacacttgttgatgatcttcgcgctgctatttgcgagaatatcaatcattatattgagaaaaacgaagaagagtttcaaggctttttgaatgagtttgcatcagttgtctggacattgctccgggatgtgtcaaagtctcctagcagagatcaactagctactacagcaatcaagttcttgacctctgtgagcacaagtgttcaccatgctttgtttgcgggggacaatgttatcaaggaaatttgccaaagtattgtgattcctaatgtttctttgagggtggaagatgaagaaattttcgagatgaactatattgagtttatccgtagagatatggaaggaagtgatgtggacactagaaggagaatagcttgtgagctactcaaaggccttgccacaaactacaaaacacaagtgacagaagtagtttctcttgagatacagaggctcttgagttcattttcagcaaacccgtcggcaaactggaaagataaggattgtgcaatttacttggttgtctctctatctactaagaaggcagggggtgcatctgtgtctacagatctcattgatgttcaaaacttctttgcaaacattattctcccggagctgcaaagccgcgatgtcaacagctttccaatgctaaaggcagggtccttgaagttcttaactatgtttcgtagtcatataccaaagccctttgcaatgcagttgttcccagagttggtccgtttccttaaagcagagtcgaacgtggtccactcttatgctgctagctgcatagagaagctcttgctagtgaaggaggaaggcgcaaggggtaataggtatgctgctggtgatttaagtccctttttgctgcagttgatgacaaacctgtttgatgcgctgaaattcccagaatcagaggagaatcaatatctgatgaagtgtataatgcgggtccttggtgttgctgatatcagtgctgaggttgctggaccttgcatcgggggattgacctctattctcagtgaagtttgcaaaaatcctaaaaatcctatatttaaccactatctctttgagtctgtggctgtacttgttcgacgggcatgtgaacgtgatatttctcttatatctgcatttgaaacgagtcttttcccaagcctccagatgattttggcgaatgatatcacagagttcttgccttatgggtttcagttgctggctcagcttgttgagttaaatagaccaactctctcaccaaactacatgcagatcttcttgctgctcctctcgcctgagtcatggaagagaagtggcaatgttccagctcttgtgcgcctgcttcaagcttttctgcagaaagcacctcatgaggttactcaagagaatcggttgagtcaagttctggggatatttgaaaagctggttgcatctcctagcacggatgagcaaggcttttatatccttaacacgattattgagaatctggactacagtgtgattgcaccttacatgaaaggtgtatggagtgctctattcacacgcgttcaaaacaaaaagacagtcaagttccagaagtcgctagtaatattcatgtcgcttttcttggtgaagcatggacaggcttatctagtggagactatgaatactgttcagccaaacatcatcactgctatcgtggagcatttctggattccgaacctgaaactgatcatggggagtatggaggtcaagttaacggcagttgctgcaactagactcatatgtgagactccggctctcctggatccatcagctgctaaactctgggggaagatgcttgatagcatagtgacgcttgtttccaggcctgagcaagaaagggtacttgatgaacctgaaatgccagaaatctcagagaatgttggatacacagctgcatttgtgaaactccacaatgctgggaaaaaagaagaggatcctctgaaagacatcaaggacccaaaacagttcttggtcgcttctgtttcgaggctttcttctgcttctcctggtaggtacccacagataattggtgagaatcttgaacaagcaaaccaaacagctttgatccagctctgcaatgcttacaactgtggaattgcttga

SEQ ID NO: 2472 - DNA, 2703 bp, Arabidopsis thaliana
atggagttccgtttcgagaatcttcttggcgctccttacagaggcgggaacgcagtcatcactaagaatactcagctaatttcaccggttggtaatcgtgtctccgtcaccgacctaagtaagaaccattcggtcactcttccgctcgaaacctctaccaacatatgtcgcctcgcttcctcacccgacggtactttcctactcgccgtcgatgaacaaaaccgatgccttttcatcaacttgcctcggcgggtagttcttcacagaattaccttcaaggataaagtcggtgccttgaagttcagccctaatggtaagtttatcgctgttggaattggtaagttggtggaaatatggcgatcacctggtttcaggcgagctgttttgccctttgagcgggttaggacttttgctaattctgatgataaagttgtctccttggagtggagcttggactctgattatttgcttgttggctcaagggatttagctgctaggttgttttgtgttagaaagttgaagggtgttttaaataagccatttttgtttctgggtcatagagattctgttgtgggttgcttctttggtgttgataaaatgactaacaaggtcaacagggctttcacgattgcaagggatggttacatttttagttggggctatactgaaaaggatgtcaaaatggatgaatcagaagatggccactctgagccaccgtcacctgttactccagatagggctgatgaggtgatggtggaaaatggtggtggtgttggtactgagcttaagaaacgaaaagagtatgacggtaaaggtcttgaatcagatgaagaaggagatgatgatgatgaagagtatatgcacagaggaaaatgggttttgttgaggaaggatgggtgtaatcaggcatcagcaaaggtgaccgcttgcgactatcatcagggacttgacatggttgtggtggggttctcaaatggtgtttttgggctttatcagatgccagatttcatctgtatccatctgctctctatttctaggcagaagctaacaacagctgtcttcaatgagcgtggtaattggctgacctttggttgcgcgaaacttgggcaactgttagtctgggattggcgaaccgaaacctatatactgaagcaacaaggacactattttgacgtcaactgtgtcacttactcaccggattcgcagctcttggcaactggtgctgatgataacaaagtcaaggtgtggaacgttatgtcaggaacatgtttcattacattcaccgagcataccaatgccgtgactgctcttcattttatggctgacaaccactccctcttaagtgcatctctggacggcactgttcgtgcttgggattttaaaagatacaagaactataagacatacacaacccctacaccccgacaatttgtttccttaacagcagacccgagtggtgacgtcgtctgtgctgggaccctagattcattcgagatttttgtatggtccaagaagactgggcaaataaaggatattctgagtgggcatgaggctcctgttcatgggttgatgttttctcccttaacgcaacttttagcttcatcctcatgggactatacagttcggttgtgggatgtgtttgctagcaaaggcaccgtggaaacgtttcgacacaaccacgatgttctaacagttgctttccgtcctgatgggaagcaattagcctcgagtacgctagatgggcagatcaatttctgggacaccattgaaggtgtgttaatgtacaccatagaggggcggagagatatcgctggaggtcgggtcatgactgaccgtcggtctgcagctaattcaagttctggaaagtgttttacaacattgtgctattccgctgatggagggtatattctagccgcaggaactagcagatatatttgcatgtatgatatcgcagatcaggttcttctgcgccggtttcagatatcccataatctttcgttagatggggttctggacttcttgcactctaagaagatgacagaagcaggaccaattgatctgatcgatgatgacaacagcgatgaagaaggtggcattgataaacagtcgagagggaatctgggttacgatctgcctggatccaggcctaaccgtggcaggcccattatccggacaaaaagcctcagcattgccccaactggaaggagctttgctgctgcaacaacagaaggagtcctcatcttttcaattgacgataccttcatctttgatccgaccgatctagatatagatgttactccagaggctgttgaggctgccatagaagaggatgaagttagcagagcacttgctctaagtatgcgtttgaacgaagatagccttatcaaaaaatgcatcttcgctgtagcccctgcagacataaaagctgttgccatctctgtccgccagaaatacttagaaaggcttatggaagctttggtggatctgcttgagaactgtcctcatctggagttcatacttcactggtgtcaggaaatctgcaaggctcacggaagctccattcagcggaactacagaactctattgcctgcactgagatcgttgcagaaggcgatcaccagagcccatcaggatctggcagatatgtgttcttccaatgagtacacgcttcgctacttgtgttctgttccaaacaatcattga

SEQ ID NO: 2473 - DNA, 3099 bp, Arabidopsis thaliana
atggctagagatttggactcgcgaaagaaaagaaggatctctttagatggaattgctgccttgtgtgagcattccaaagagatcattgattcattgcctatgttgaattctcctgactacttcttgaagccatgtataaacgagctggttgagcgagaaattgaaagccctgattattgcagccgggttcctgattttactattggcaggattggttacggttatattaggtttcttggaaacacggatgttagaaggttggacctggatcacatagttaagtttcataggcacgaggttattgtttatgatgatgagagctccaagccggttgttggtgagggacttaacaaggctgctgaggtgactctggtcgtaaacataccagatctaacttggggaaaacagcaagttaaccatattgcttataaattgaaacagagcacggaaagacaaggagcaactttcatctcatttgatcccgataatggtttatggaagttcttcgttcctcatttcagcagatttgggttgagtgatgatgaggcagaagatattgcaatggatgatgcgccaggtttgggagatcccgtaggactggatggtaaaaaggtagctgacattgatgaagaagatcagatggaaacttcggagctagagctttctcattctctcccagctcatttaggacttgatcctgaaaagatgaaagaaatgagaatgctgatgtttcctaatgaagatgaagacgaaagtgaggactttagagagcaaacttcccatcttatgacatccttgactaaacgaaatgtaagaccttcgcagaaaattgctcaaagaaatagtcatcaagaccctccaccggtcgtgcgcaaaactccgcttgctttgctggagtataaccctggtaatgataaaagctccccaggtagtatcctgatggtacaacaaaataagaatttggcagtgagaaagtcgaaaacgggaggtttcgagctggacatcagccatgtcacaccgttaactgataactattcccgcaatgttgttgatgcagcattattcatgggaagatcgttccgagcaggttggggcccaaatggcgttctttttcacactggtaagccaatatgtagctccagttcccagatggtattgtcttctgtgatcaataaagaaaagatagcaattgacaaagtggtttgggatagaaagggaaaagttcagaaagaacttattgattctgcgtttgaggctcccttaagtctccacaaggaattgaatcatgtagaagaagaagttaggtttggctctttcagtcttaaacttcagaatgttgtcaccgatcgtgtagttctttcagatatctgccgaagttatattggtataatcgagaaacagctggaagttgctgggttgtccacatctgcgaagctgtttttaatgcaccaagtcatggtctgggaactcataaaagttctcttttctgagagacagagtactgaacgtttgatgtatgcagcttctgataacgaggaagacgtgatgcaggatgtgaaggaagattctgcaaaaattgatacagaagctcttccgcttatccgaagagcagaattcagttgttggctccaagaaagtgtcagtcaccgtgtacaagaagatgtgagtgatctaaatggttctagctaccttgagcacttattctttcttctaactggacgagagcttgattcagctgtggaacttgccatatctaagggagatgttagacttgcttgtttgttgagccaggctggtggatcaactgtaaaccgcaatgatatcttgcagcagcttcacctttggagaaggaatgggctggattttaatttcattgagaaggagagaattaagctttacgaattgcttgctggtaatatccatgatgcgttacaagattttacaattgactggaagagattcctagggttgttaatgtggcatcatctacctcccgacagttcattacctatcatcttcagaagctatcagctcctactaaatcaggcaaaagctccgtggcccgtcccaatatatattgatgaaggacctgcagatgggtttgtaagcgacaacaagcattctgacatcttgtattatcttatgcttctacacagcaaagaagaggaagaatttggtttcctgcagactatgttcagtgccttctcttcaactgatgatccacttgactatcatatgatctggcaccaccgaggaattctagaagcagttggagctttcacttcagatgatcttcacactctagatatgggatttgttgcacagcttctctctcagggcctttgtcattgggctatctacgttgttcttcacatacccttccgtgaagatcatccatatctacacgtcactgtcattcgggaaatcctgtttcaatactgtgaaacttggagttctatggaatcacaacggcaatttatcaaggacttgggtatcccttctgaatggatgcacgaagctctggcagtttattacaattaccatggagatttcgtaaaggctcttgaccagtttattgaatgcgcaaactggcaaagagctcattccatttttatgacgtcagttgctcattcattgtttttgtcagctaaccattcagaaatctggagaattgctacttcaatggatgatcgcaagtctgagattgaaaactgggatttgggtgctgggatttacatgtcattctatttactaaagagttcactgcaagaagatgctgatacgatggtagaactggaaccccttgatagcacaaacgagtcttgcagaaattttgtcggtcgtttaaacgaatcattggctgtttggggtgacagattaccagttgaagcaagagtcgcatactcaaagatggctgaggaaatatgcgatttacttctgtcagatctgagtaagaatccaagccgagagactcagctaacatgctttgagacagcctttgatgcccctttgccagaagatgtaagatcaacacatctgcaagacgctgtgtcactcttctctctatatctctcagagacgggccaaatctcagcttag

SEQ ID NO: 2474 - DNA, 864 bp, Arabidopsis thaliana
atggtgtcagtctcaggcagtccgatccaacggctaggcacttacatggcagaagggcttagagcgaggcttgaggggtctgggagcaatatatacaaatccttgaaatgcaatgaaccaacgggaagggaactgatgtcttacatgagtgttctctatgaaatctgcccctactggaaattcgcgtacacaactgcgaatgttgagatcttggaagcaatagctggggaaaccagagtccacattatcgattttcagattgcacagggatcacaatacatgtttttgattcaggagcttgcgaaacaccctggtgggccgccgttgctgcgtgtgacgggtgtggatgattcacagtccacctatgctcgtgggggaggactcagcttggtaggtgagaggcttgcaactttggcgcagtcatgtggtgtcccgtttgagtttcacgatgccatcatgtctgggtgcaaggtgcagcgggaacatctcgggttggaacctggctttgctgttgttgtgaacttcccatatgtattacaccacatgccagacgagagcgtaagtgttgaaaatcacagagacaggctgctgcatctgatcaagagcctctccccaaaactggttactctagtagagcaagaatccaacacaaacacctcgccattcctgtcacggtttgtggaaacactggattactacacagcgatgtttgagtcgatagatgcagcacggccacgggatgataagcagagaatcagcgcagaacaacactgtgtagcaagagacatagtgaacatgatagcatgtgaggagtcagagagagtagagagacacgaggtactgggaaatggagggtcagaatga

SEQ ID NO: 2475 - DNA, 1452 bp, Arabidopsis thaliana
atgacaccggagacggatgctctcaaagttcagatcctacctaagcaccagtcattgccctacacagtcacgaaggccaagtcgaaatcattgatcctgctagttgtcgtttccgtgactatcacgttagggttattattatatgttttcaactcaaattctgttatatcttccggaagtttgcttagtcggagatgtaagctccggtacagcgtccttatcgacgcagggagttcagggacccgggttcatgtgttcgggtactggtttgagtccgggaaacccgttttcgatttcggagagaaacattacgctaatctgaagttgactcctggtttgtcttcgtatgctgataatccggagggagcaagcgtgtcagtgacgaagcttgtggaattcgccaagcagaggattcccaagagaatgttcaggaggagtgacattaggttaatggcgactgctgggatgagattacttgaagtgcctgttcaagaacagattcttgaagttacaagaagagttcttagatcttcaggttttatgtttcgagacgaatgggctaatgttatctctggatctgatgaaggtatatattcttggattactgccaattacgcacttggttcgcttggaactgatccgttggaaacaacggggattgttgaactaggcggtgcttctgcgcaggtgacatttgtgtcaagtgagcatgtgcctcctgagtactcgcgtacgattgcctacggaaatatttcatacacaatctacagtcacagcttcctcgattatgggaaggatgcagcactaaaaaagttattggaaaaactccaaaactcagctaactctacagtggatggagtagttgaagacccttgtactcctaaagggtacatctacgacacaaattcaaagaattattcatccggattcttagctgatgaaagcaaacttaaaggctcccttcaagctgctggtaatttctcaaaatgccgatccgctacgtttgcgcttttgaaagaaggaaaagagaactgtctatatgagcattgttctattggatcaacattcacacctgatcttcaaggaagttttttggctacagcatctttctactacaccgccaagttctttgagttggaagaaaagggttggttgtctgaattgattccagctgggaagagatattgtggagaagaatggtcgaaactgatattggaatacccaacaactgatgaagaatatttgcgtggctattgtttctcagcagcatatactatatcaatgcttcatgatagtcttggtattgctcttgatgatgaaagtatcacgtatgcaagtaaagcaggagaaaaacacataccactagattgggcattgggggcttttatactagatgttgtaacacccaattctgattacaatggtaaatctagaaaatatcttggcttttaa

SEQ ID NO: 2476 - DNA, 708 bp, Arabidopsis thaliana
atggctgaagatgaaatagtagtcgaagaagagcaatcacagccacaggagattactccagttccaccatcttcttcgtcttcgccttcgttagtggtggaagacgacgatgagatgaagctcaagcacttggaattcattcaagtcgcggcggtttacttcgccgcctgtttctcgaccctctacgagttggctaaagacaacgctggtccactcaaactcggcgtcgagaacattgaagattgcgttcgaaccgtgcttgctccattatacgaaaaattccacgacgttcctttcaagcttctccttttcgtcgatcgtaaggtggacgatgtgttcttcgatgttgagacatatgttccgtcattggtgaagcaagcttctagccaagcgctcacggtggccacggaggtgcagcgcaccggcgttgtggacactaccaagagcattgcaagaagcgtccgggacaagtacgagccagcggcagagtattacgcagcgacgctgtggcgtttactgaatcaactgccgttgttccctgaagttgcgcatttagtgatccccacggcgttttactggtcagagaagtacaacgatgcggttcgttacgttggcgacagagactactttggggcagagtatctacccatgattcctattgagaagatctctgatattttggaacaagatcagtgtcgagctgattga

SEQ ID NO: 2477 - DNA, 1473 bp, Arabidopsis thaliana
atgatgatgatgataattctcttgtggtcaataattttcatgaccattctcttcttaaaaaaacagttgagtgggaagaaaggtaagacacctccgtcaccaccgggacttccgttgatcggaaaccttcatcagctcggccgccacactcaccgatcactatgcgatctcagtcgccgttacggtcctctcatgctccttcacttaggtcgtgtccccgttcttatagtctcttccgcggacatggctcaagaaatcttgaagacgcacgaccaagctttcgcaaaccgcccacggtcaaaactctcccagaagcttctttacaacaatcgtgatgtggcctcagctccttatggagagtattggaggcaaatgaagtccgtgtgcgtcattcatctcttaagcaacaaaatggtacgatcttttcgagatgtaagagaagaagaaatcactttgatgatggcaaaaatccggaaatcgagttctttgccgtttaatgtaagcaaggtcttggagtgtttgaccaacgatgtgatatgtagagtcgctttgggacggaaatatggtggtgaaactgactttaagaagttaacggatagactaagcgagctattgggaacgtttagtatagggagttttgtaccgtggctcgcgtgggttgattggatccgcggttgggatgctcagctagataagatgggaaaggatcttgatgacttctttgagaaagttgtgcaagatcatgaagatggtgaccgccgagatgggactgatttgattgatgcattgctcagggttaaaagagaaaagagtcccgggtttgagatagagcgagtcagcataaaggcaatcacgttggatgtttttgtgggtggttcggacacatcgttcacgcttttggaatgggcaatgacagagcttctacgtcatccgaagtctctgaacagactccaagaagaagtccgtacgatttgtaaggggaagtcaagagtatctgaagatgacattcaaggaatgaaatacttaaaagctgtgatcaaagaggcactcaggctacatcctccatttccaatgatggctcctcatgaatcaacagaagatgttaaattaagagactaccacataccagccggtacacaagtgatgatgaatgcttgggcgatcgggagagaggttgccacatggggaccagacgcggaggagttcaaaccggagaggcatttagatacgtctgttgatttccgaggtcaaaactttgagctgcttccatttggagcagggagaaggatttgtccagcagtatcattcgctgtggtattgaatgaggtggttttggctaacttagtgcatgggtttgattggaaactaccggaggaatctaaagaagacaaaactgatgtcgctgaatccagcggtttttcggttcaccgcgagttccctctttatgccgttgcatcaccttacttgacttag

SEQ ID NO: 2478 - DNA, 480 bp, Arabidopsis thaliana
atggatttgaagaaagcatctttgtttttattccttcttctctgtctccacctgcaactgcaacaccactttgctcacgcggtctcgcgatcttcaacaagtttagccttcgttgatccaaaccatgatgatctcccgtttcaagaagtagaattgaagccagacggtgacgtaatcgaagccaatttaccgaaattaacagtcgttgttaagaaaggcggcggaggaggaggcagaggtggaggcggtttcggcggagggggacgcagtttcggcggaggagggagttctagcagaggcggtggaggaagttctagcagaggcggaggagggagttctagcagaggaggaggattacgtccgattccgatttatggcggtggaacgcaccgcagtggtcatcattcaagcggcggccgggaaactgctagtggttggttaggtctatcgattttagccggtttaggtttggttttttaa

SEQ ID NO: 2479 - DNA, 954 bp, Arabidopsis thaliana
atgcaagtgtgtgtgttttttcttttggcaggattttgtgttgaactcacgaggcatgaagttgttcacttgtgtatggaaaccagtgaagcaagaaccaaaggcattgctcttcctctgccatggctacgctatggagtccagcatcaccatgaacagttcagcgcagccacgaggttagccaatgccggttttgccgtatatggaatggactatgaaggacatggaaaatctgagggtctaaatggttacatcagtaactttgatgatctcgttgatgatgtctctaatcattattctacaatttgtgagagggaagagaacaaggggaagatgaggttcctacttggagaatccatgggaggagcagttgtgttgctcttagccagaaagaagcctgatttttgggacggtgccgttttggtagcacccatgtgtaagttagcagacgagataaagccacatccagtagtgatctcaatccttatcaagttagccaagtttattccaacgtggaaaatagttccaggaaatgatattattgacattgcaattaaagaacctcacatcagaaatcaggtgagggagaacaagtattgctataaaggccggcctcgcctcaacaccgcctaccaactcttgttggttagcttagatcttgagaagaatcttcaccaggtatcaattcctttcattgttcttcacggagaagatgataaagtgacggataaaagcataagcaaaatgttatacgaagtggcttcaagctcggacaagacattcaagctgtaccccaaaatgtggcatgctttgttgtatggggaaactaatgaaaattcagaaattgtgtttggtgatatcataaactggttggaagatagagccacagattcgaacggagggttagagagtcagctaaaacataagcatgatggattcttgaagcataaataa

SEQ ID NO: 2480 - DNA, 774 bp, Arabidopsis thaliana
atgtcgatgtcgaagagttcaaagatgcttcagttcatcaactacaggatgcgagtgacgatccaagacggaagacagctcgttgggaagttcatggcgtttgaccgtcacatgaacctcgttctcggcgattgcgaggagtttcgtaagcttccaccagctaaagggaagaagatcaacgaagagcgtgaagatcgccgtacgctaggtttagtgttgcttagaggtgaagaagttatctcaatgactgtcgaaggaccacctcctcctgaagaatctcgtgctaaagctggctctgcagctgctgttgctggtccaggaattggccgtgccgctgggcgtggagttcctactggtccgttagttcaagctcagcctggtttatctggtcctgttcgtggtgttggtggacctgctccgggaatgatgcagcctcagatctctcgtccaccacagctttcagctcctccgattattcgacctccgggacagatgttgccaccgcctccttttggtggtcaaggtcctcctatgggaagaggtcctccaccgccttatggtatgaggccaccgccacagcagttttctggaccaccaccgcctcagtatgggcaaaggccaatgattcctcctcctggtggtatgatgagaggacctcctcctccacctcatggaatgcaaggacctcctccgcctcgccctggaatgcctcctgctcctggtggttttgctccaccgcgtcctggcatgccaccacataatcagcagcagtga

SEQ ID NO: 2481 - DNA, 747 bp, Arabidopsis thaliana
atgacgcctatctccaggaccaactccgtcgaatcattatccagctacggcgagagattcgccggcgggaagatttcgatcgaggttaaggctaatgtagggatgcggagggtgttatcggaaagtgatgtgattagatctgagagaatgttgaaaagagttggatctaagccttcgccggcgagaatcccggaggatgatgaagcgggggaggaagaaattaggtttgcagatggttgggggtctatgatctccggtggtttacctgtggaggagaaatgtttcacgggtggcggtgttggtggtggatctggttatagcggcggttatggaaacggaggaggaggcggttatgaagataagagcaagatcggtgattattatcgagagatgttgagatctaatcctaataattcgcttcttctgatgaattacggcaagtttttgtatgaggtggagaaagatgcagagggagctgaagagtactatggaagagcaatactggagaatccaggagatggagaagctttatccatgtatggaagattgatatgggaaacgaagagagatgagaagagagctcaaggttactttgatcaagctgttaatgcttctcctaatgattgtatggttttgggatcatatgcacgtttcatgtgggaggcagaggatgatgatgatgatgatgaagaagaagaagaagaagaatggatggctgcatcaccactcatggtttctgcagtttag

SEQ ID NO: 2482 - DNA, 1239 bp, Arabidopsis thaliana
atggctacaacaaccacatcatgggaagaactcttaggctcaaagaattgggacactatcttagacccattagaccaatcacttagggaactcatcttacgttgtggcgacttttgtcaagccacctacgatgccttcgtcaacgaccaaaactccaagtactgtggagccagccgctacggcaaatcttctttcttcgacaaggtcatgctcgaaaacgcttccgactacgaggttgtaaacttcctctacgccacagctcgtgtttctctccccgaaggtttgcttctccaatcacaatcaagagattcttgggaccgtgagtctaactggtttggctacattgctgtcacgtctgatgaacggtctaaggctttaggacgccgtgagatctatatagctttgagaggaacgagcaggaactatgagtgggtcaatgttttgggtgctaggccaacttcagctgaccccttgctgcacggacccgagcaggatggttctggtggtgtagttgaaggtacgacttttgatagtgacagtgaagatgaagaagggtgtaaggtgatgctcgggtggctcacaatctatacttctaatcaccccgaatcgaaattcactaagctgagtctacggtcacagttgttagccaagatcaaggagcttctgttgaagtataaggacgagaaaccgagcattgtgttgactggacatagcttgggagctacagaggctgttctggccgcctatgatatagctgagaacggttccagtgatgatgttccggtcactgctatagtctttggttgtccacaggtaggaaacaaggagttcagagacgaagtaatgagtcacaagaacttaaagatcctccatgtaaggaacacgattgatctcttaactcgatacccagggggacttttagggtatgtggacataggaataaactttgtgatcgatacaaagaagtcaccgttcctaagcgattcaaggaatccaggggattggcataatcttcaggcgatgttacatgttgtagctggatggaatgggaagaaaggagagtttaaactgatggttaagagaagtattgcattagtgaacaagtcatgcgagttcttgaaagctgagtgtttggtgccaggatcttggtgggtagagaagaacaaaggactgatcaagaacgaagatggtgaatgggttcttgctcccgttgaagaagaacctgtacctgaattctaa

SEQ ID NO: 2483 - DNA, 1551 bp, Arabidopsis thaliana
atgtcagtaatggatgaatcaggcatgtttaacgttcaacaaaccattggaagtgtattgtgttgcaagtgtggtgttcccatggcaccaaacgcagccaacatgtgtgtgaattgtcttcgttccgaagtcgatatcaccgaaggtttacagaagagtattcagatcttctattgccctgaatgcacttgttacttacagccaccaaagacttggatcaaatgtcaatgggaatctaaagagcttttgacattttgtatcaagaggttgaagaatctcaataaggttaagctgaagaacgctgaattcgtttggactgagcctcattccaagaggattaaggttaagttgactgttcaagctgaggttcttaatggtgctgttcttgaacagtcttatcctgttgagtatacggttagggataatctgtgcgagtcgtgttcgaggtttcaggctaatcctgatcagtgggttgcttctattcagcttaggcagcatgtttcgcataggaggactttcttttatctcgaacagttgattcttaggcacgatgctgcttcacgtgccattagaatccagcaggtggatcaggggattgatttcttctttgggaataaaagtcatgctaatagctttgtggagtttctgaggaaagttgtccccattgaataccgtcaggaccaacagctggtgtctcatgatgtgaaaagcagtttgtacaactataagtacacttactctgttaagatctgtcctgtttgccgtgaggatcttgtttgcttgccttctaaagttgctagcggcttggggaaccttggtccacttgtggtttgcacaaaagtctctgataatatcactctacttgatccgagaactctaaggtgtgccttcttggatgcgagacagtactggaggtctgggttccgatctgcgctcaccagtagacaacttgtcaagtactttgtgtttgatgttgagccacctgttggtgaagcgactgttggtgggcaaaagtacgctctttcctatgtccagattgcccgtgaatcagacattggtaagatgttttatgtccaaactcatcttggacacattctgaaacctggggatcaagctttgggttatgacatctacggagctaatgtgaacgacaatgaaatggagaaataccgtctgagtgtgaagaatgggcttcctgaagcaattctgatcaagaaatgttacgaggagcagagagagaggaagcagaagaaatcccgtaactggaaactcaagtcgcttccaatggaaatggatgattcaagaggcagggttgatccagagaagacagacaaagaatacgaagagtttttgagggatcttgaagaaaaccctgagctaaggttcaacatatctttgtacagggacaaggattatcaagcttctgagactgcttcaatgacagatggagaaggtgcaccatctgttccaattgaagagttgcttgctgaccttgacctaagctttgaggaagaagacgatgatgacgaggacgacatggctgctgaataa

SEQ ID NO: 2484 - DNA, 1086 bp, Arabidopsis thaliana
atgaagaaacttcttttgatatttctcttttctcttgtcattctccaaactgcttgtggattcgattacgacgacaaggaaatagaaagcgaagagggcttatcaacgctttatgatagatggaggagccaccactccgttcctaggagtctaaatgaaagggagaagagattcaacgttttcagacacaatgtcatgcatgtccacaataccaacaagaagaaccgatcctacaaacttaagctcaacaagtttgcagatttaacaattaatgagttcaagaatgcatacaccggttccaacatcaagcatcacagaatgttgcaaggaccaaaacgcggctcaaaacagttcatgtatgatcatgagaatttatccaaattaccgtcctccgttgattggagaaagaaaggtgctgtcactgaaatcaagaatcaaggaaaatgtggaagttgttgggcattctctaccgtagcagctgttgagggaatcaacaagatcaagactaacaaactggtctcactgtctgaacaagaactagtggattgtgatactaagcagaatgaaggttgtaacggaggtcttatggagattgcatttgaattcatcaagaagaacggtggtatcaccactgaagatagctatccttatgaaggtatcgatggaaaatgcgacgcttcaaaggataacggcgtgcttgtgacgatagatgggcatgaagatgtacccgaaaacgacgaaaatgctcttcttaaggctgttgcaaaccaacctgtatctgttgcaattgatgctggaagttcagatttccagttttattcagagggagtgtttacgggatcttgtggaacagagctgaaccatggtgtggcagcggtcgggtatggatctgagagggggaaaaagtattggatagtgagaaactcatggggagctgaatggggagagggaggctatataaagattgaaagagagattgatgaaccggaagggcgttgcggtattgcgatggaggcatcgtatccgatcaagctatcgtcgtctaatcctaccccgaaagacggtgatgtcaaagatgagctctag

SEQ ID NO: 2485 - DNA, 1206 bp, Arabidopsis thaliana
atggcccttcaagctgcttctttggtctcctctgctttctctgttcgcaaagatgcgaagttgaatgcttcttcatcatctttcaaggactcgagtctttttggtgcctccattaccgaccaaatcaaatccgaacatggatcttcctcgttaagattcaagagagaacagagcttaaggaatctagcaattcgagcccaaaccgctgcgacttcaagccctacagttacaaaatccgtggacggcaagaaaacgttgaggaaaggaaatgtggtggtcactggagcctcgtctgggttaggtctagccacggctaaagctctagctgagacagggaaatggaacgtgataatggcgtgcagagacttccttaaagccgagagagctgctaaatccgtagggatgcctaaagacagctacacagtgatgcatttagacttagcctcgttggacagcgtgagacagtttgttgataatttcaggagaacagagacgcctctcgatgttttggtctgcaatgctgcggtttatttcccgacagctaaagagcctacttacagtgctgaagggtttgagcttagtgttgcgacgaaccatttgggacattttcttctcgcaaggttgttgcttgatgacttgaagaaatctgattacccttcaaagcgtctcatcatcgtcggatccattaccgggaacacgaatacattggcgggtaatgtaccaccgaaggcgaatctcggtgatttgaggggtttagccggcggattaaacggtttaaacagctcagctatgattgatggaggagatttcgacggtgcaaaggcttacaaagacagtaaagtctgcaatatgttgacaatgcaagagtttcacaggcgtttccatgaagaaactggagtcactttcgcttcgctttaccccggttgcatcgcctccacaggtttattccgagagcacattcctctcttccgtgccctcttccctccctttcagaagtacatcactaaaggatatgtctccgaaacagagtcaggcaaaagacttgctcaggtggtgagtgatccaagcttgacgaaatcaggggtttattggagctggaacaatgcttcggcttcttttgagaaccagttatcagaagaagcaagtgacgttgagaaggctcgtaaagtgtgggagatcagtgagaagctcgtgggcttggcctaa

SEQ ID NO: 2486 - DNA, 1152 bp, Arabidopsis thaliana
atgtgttggatctcaatgagccagtcaagattcattataaagtctttatttagcacagcaggaggtttcttacttggatctgctctctcaaatccgccgtctctagccaccgcgttttcttcttcttcctcgtcctcctccgccgccgccgccgtcgacatggaaactcacaaaaccaaggtttgcatcgtcggaagtggaccagcagcacacacggcggcgatctatgcatcgagagcggagcttaagcctcttctcttcgaaggatggatggctaacgacatcgctcccggcggtcaattaactacaacaaccgacgtcgaaaacttccctgggttccctgaaggtattctcggtattgatatcgttgagaaattcagaaaacaatcggagagatttggaactacgatcttcacggaaactgttaacaaagttgatttctcatcgaaaccgtttaagctattcactgattcgagaactgttctcgctgattctgtaatcatttctactggagctgttgctaaacgtcttagcttcactggatctggtgaaggtaatggtggtttttggaatcgtggtatctccgcttgtgctgtttgcgacggagctgctccgatttttaggaataagcctcttgtggttattggtggtggtgattcagctatggaggaagcgaattttctgactaagtatggatctaaggtttatattattcataggagggatacgtttagggcgtctaagattatgcagcagagagctttgtctaaccctaagattgaagtgatttggaactctgccgtggttgaggcgtatggtgatgaaaatggacgtgttcttggaggattgaaggtgaagaatgttgttactggggatgtttcagatctgaaggtgtctggattgttctttgctattggtcatgagccagctacgaagtttttggatgggcagcttgagcttgatgaagatggttatgttgtgaccaagccaggtactactaagacgagcgtggttggtgtatttgctgctggagatgttcaagacaagaagtatagacaggccatcactgctgcaggaactgggtgcatggcggcattggatgcagagcattacttacaagagattggatctcaggagggtaagagtgattga

SEQ ID NO: 2487 - DNA, 2829 bp, Arabidopsis thaliana
atgcctggaaataagtacaactgcagttcttctcatatcccactctctcgaacagaacgcctcttgagagatagagagcttagagagaagaggaagagcaaccgagctcgtaatcctaatgacgttgctggcagttccgagaactctgagaatgacttgcgtttagaaggtgacagttcaaggcagtatgttgaacagtacttggaaggggctgctgctgcaatggcgcacgatgatgcgtgtgagaggcaagaagttaggccttataataggcaacgactacttgtagtggctaacaggctcccagtttctgccgtgagaagaggtgaagattcatggtctcttgagatcagtgctggtggtctagtcagtgctctcttaggtgtaaaggaatttgaggccagatggataggatgggctggagttaatgtgcctgatgaggttggacagaaggcacttagcaaagctttggctgagaagaggtgtattcccgtgttccttgatgaagagattgttcatcagtactataatggttactgcaacaatattctgtggcctctgtttcactaccttggacttccgcaagaagatcggcttgccacaaccagaagctttcagtcccaatttgctgcatacaagaaggcaaaccaaatgttcgctgatgttgtaaatgagcactatgaagagggagatgtcgtctggtgccatgactatcatcttatgttccttcctaaatgccttaaggagtacaacagtaagatgaaagttggatggtttctccatacaccattcccttcgtctgagatacacaggacacttccatcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcactcgtgtagctgcttttccaattggcatagattctgatcggtttatacgagcacttgaggtccccgaagtcatacaacacatgaaggaattgaaagaaagatttgctggcagaaaggtgatgttaggtgttgatcgtcttgacatgatcaaagggattccacaaaagattctggcattcgaaaaatttctcgaggaaaatgcaaactggcgtgataaagtggtcttattgcaaattgcggtgccaacaagaactgacgttcctgagtatcaaaaactcacaagccaagttcatgaaattgttggacgcattaatggtcgttttgggacactgactgcagttccaatacatcatctggatcggtctctggactttcatgctttatgtgcactttatgccgtcacagatgttgcgcttgtaacatctttgagagatgggatgaatcttgtcagttatgagtttgttgcttgccaagaggccaaaaagggcgtcctcattctcagtgaatttgcaggtgctgcacagtctctgggtgctggagctattcttgtgaatccttggaacatcacagaagttgctgcctccattggacaagccctaaacatgacagctgaagaaagagagaaaagacatcgccataattttcatcatgtcaaaactcacactgctcaagaatgggctgaaacttttgtcagtgaactaaatgacactgtaattgaggcgcaactacgaattagtaaagtcccaccagagcttccacagcatgatgcaattcaacggtattcaaagtccaacaacaggcttctaatcctgggtttcaatgcaacattgactgaaccagtggataatcaagggagaagaggtgatcaaataaaggagatggatcttaatctacaccctgagcttaaagggcccttaaaggcattatgcagtgatccaagtacaaccatagttgttctgagcggaagcagcagaagtgttttggacaaaaactttggagagtatgacatgtggctggcagcagaaaatgggatgttcctaaggcttacgaatggagagtggatgactacaatgccagaacacttgaacatggaatgggttgatagcgtaaagcatgttttcaagtacttcactgagagaactcccaggtcacactttgaaactcgcgatacttcgcttatttggaactacaaatatgcagatatcgaattcgggagacttcaagcaagagatttgttacaacacttatggacaggtccaatctctaatgcatcagttgatgttgtccaaggaagccgctctgtggaagtccgtgcagttggtgtcacaaagggagctgcaattgatcgtattctaggagagatagtgcatagcaagtcgatgactacaccaatcgattacgtcttgtgcattggtcatttcttggggaaggacgaagatgtttacactttcttcgaaccagaacttccatccgacatgccagccattgcacgatccagaccatcatctgacagtggagccaagtcatcatcaggagaccgaagaccaccttcaaagtcgacacataacaacaacaaaagtggatcaaaatcctcatcatcctctaactctaacaacaacaacaagtcctcacagagatctcttcagtcagagagaaaaagtggatccaaccatagcttaggaaactcaagacgtccttcaccagagaagatctcatggaatgtgcttgacctcaaaggagagaactacttctcttgcgctgtgggtcgtactcgcaccaatgctagatatctccttggctcacctgacgacgtcgtttgcttccttgagaagctcgctgacaccacttcctcaccttaa

SEQ ID NO: 2488 - DNA, 2766 bp, Arabidopsis thaliana
atggctccgtcgttaaggaatttcaacttctttcaccgcttctccaccttcctcgtcttctctctattctccgtcgtttcttccgacgatctccaagtcttactcaagctcaaatcatcattcgccgattccaatctcgccgtgttcgattcctggaaactgaactccgaggcaacgttacagagattgatctctctcgtcgagagtctcgagaaactctctctcggattcaattcactatctggaataatccccagcgatttgaaaaactgcacgagtttgaagtatttggatctcggcaacaatttattctccggtgctttccctgagttctcatctttaaatcagttacagtttctgtatctcaacaacagcgctttttccggcgtctttccgtggaaatcgctccgaaacgcaacgagtctcgtcgttttgagcctaggcgataatccgtttgatgcgacggctgatttcccggtggaggttgtttctctgaagaaactctcgtggctttacttgtcgaattgcagtatcgccggaaaaattccaccggcgattggagatttgacggagcttcggaatttggagatttccgatagcggattaaccggagagattccgtcggagatttcgaaacttactaatctctggcagttagagctttacaacaactccttgaccggaaaacttcctaccggattcggaaacttgaagaatctgacttacttggacgcttcaacaaatcttctacaaggcgatttatcggagcttaggtctctgactaatctcgtttcactacaaatgttcgaaaacgaattctccggtgagattccgctggagtttggtgaattcaaggatctcgtgaatctctctctgtatacaaacaagttaaccggttctctgcctcaaggactcggttcacttgctgattttgatttcatcgacgcatcagagaatctcttaaccggaccgatccctccagatatgtgcaagaacgggaagatgaaagctctgcttctcctgcaaaacaacctcactggctctatccctgagtcctacgctaactgtttgactctgcaacggttcagagttagcgagaacaacctcaacggaactgttcccgcgggactttggggattaccgaagctcgagatcatcgatatagagatgaataacttcgaaggtccaatcaccgcggatataaagaacggtaaaatgctcggagcgttgtatctagggttcaacaagttgtctgatgagctgcctgaagagataggtgacactgaatctttgactaaggttgagcttaacaataaccggtttaccgggaagattcctagctccattgggaaactcaaaggacttagcagtctaaagatgcagagcaatggcttctccggtgagatacctgactcgattggttcgtgctcgatgctcagcgatgtcaacatggctcaaaactcgatatccggagaaatcccccacacgcttggatcactcccgacgctcaacgctttgaatctttcggacaataagttgtctgggagaatcccagagagtttgtcgtctttaaggcttagccttcttgatctgtctaacaacagattatcaggtcgtatccctctgagtttgtcatcatataatggtagcttcaatggcaatcctggcctctgtagcacgacgatcaaatcgtttaaccggtgcataaatccttcgagatcgcatggagacactcgcgtgttcgtgttgtgtatagttttcgggttactgatcttgctagcgtctcttgtgtttttcttgtacctgaagaaaacagagaagaaggagggacgttcgcttaaacacgaatcttggagtataaagtcattccgaaagatgagtttcactgaagatgatatcattgattcaatcaaagaagagaatttgattggtagaggaggttgtggggatgtgtacagagtagtacttggtgatggtaaagaagttgcggtcaaacacatccggtgtagtagtactcagaaaaacttcagcagtgcaatgccgattctcactgaacgggagggaagatcgaaagagtttgaaacagaggtgcaaacgcttagttcgatacgacacttaaacgtggtgaaactctattgtagcatcacgagcgatgactcgagcttgctggtgtacgagtacttgcctaatggaagcttatgggacatgcttcactcttgcaagaagtcgaatcttggttgggaaacacggtatgatatagctcttggtgcagcaaaagggcttgagtacttgcatcatgggtatgagagaccggtgattcaccgtgatgttaagtccagtaacatattgctagatgagttcttgaaacctagaattgcggattttggtcttgccaagattcttcaggccagcaatggcggtccagagtccacgcatgtcgttgcgggaacctatggctacatagctccagggaaaaaaccgatagaggcagagtttggagagagcaaagacatagtgaattgggtgagcaacaatctgaagagcaaagagagtgtgatggagattgtggacaagaagataggagaaatgtatagagaagacgcggtcaagatgctgaggattgcgatcatctgcaccgcaagacttcctggactaagaccgacgatgaggagcgtggtgcagatgatcgaggacgcggaaccttgcagattgatggggattgtgatcagcaaagagagtgatgtcaaggtcaaagaaataagttga

SEQ ID NO: 2489 - DNA, 627 bp, Arabidopsis thaliana
atgttgcgtactatcttcctcttatctcttctctttgctctatccaatgcctctgttcaagatttctgtgtcgcaaacctgaaacgcgctgaaacccctgcgggttacccttgcattcgtcccattcatgtcaaagctacagactttgtcttctctggcttaggcactcctggaaacactacaaacatcatcaacgccgctgtcacacccgctttcgcagctcagttcccgggtctgaacggtctaggcctctctacagctagacttgacttagctcctaaaggtgtgatcccaatgcacactcaccctggtgcctctgaggttctctttgtccttactggctccattaccgctgggtttgtctcctcggcaaacgctgtctacgtgcagacactcaaaccaggacaggtcatggttttcccacagggcttgcttcatttccagatcaacgcgggaaaatcctctgcttcagccgttgtcactttcaacagcgctaatccgggtctgcagattctcgacttcgcactctttgctaacagtcttcccactgaactcgtcgtgggtactactttccttgacgccactacagtcaagaagctaaagggtgttcttggaggaactggctaa

SEQ ID NO: 2490 - DNA, 660 bp, Arabidopsis thaliana
atggctttgcctttgtctggcacgcgccacctcacgcgcgctctcctctctaatgtcactcttatggctcctcctcggattccttcctctgttcactacggtggatctcggttaggttgttcgacccggttcttctcaattcgatgtggagctaaccggtcaggttctacttactcgccgcttaactctggctctaactttagtgatcggcctccgacggagatggctcctttgtttccgggatgcgattatgagcactggcttattgttatggataaacctggcggggaaggcgcgactaagcagcagatgattgattgttacattcaaaccctagcgaaagtcgttggaagtgaggaagaggcgaagaagcgaatctacaatgtttcatgtgagaggtatttagggtttggttgtgagattgatgaagagacatccactaagcttgaaggtttaccaggtgttctgtttgtgcttccagattcctatgtggatcctgaaaacaaagattatggagctgagctgtttgttaatggagagatagtccaacgatcaccagagaggcagaggcgggttgagccacagccgcagagagcccaagatagaccgagatacaatgacagaactcgttactctcgccgcagagaaaacacaagatga

SEQ ID NO: 2491 - DNA, 789 bp, Arabidopsis thaliana
atgtttgtgatagtaattcgtcatcctgaagtgaagtgggctgagactaccgagaagattttcctcactgtagtattagctgatactaaggataccaaggttaacctagacccagaaggagtctttgatttctctgcgaaagttggtccagaaaaccacgtttatgagctcaaactggaacttgccgataaagtcaatgttgaggaaagcaaaatcaacattggagagagaagcatattctgcataattgagaaagcagagccggaaaggtggaataagctactccgtgtgaagaagcccccacactatgtcaaggttgattgggacaagtgggttgatgaggacgatgaaggcagtgctggtgccgcagatatggatatggcaggaatggaaggaatgggaggaatgggaggcatgggcggcatgggaggaatgggtggaatgggaggaatgggtggaatgggaggaatggaaggaatggatttctcgatatacctagctctgagaaatgacctcatacttgatccttgcttcgtgcagaaattaatgggtggaatgggtggaatgggtggaatgggcggactcgaagggctcggtggaatgggaggcatgggtggaatgggaggcatgggtggtatgggaggcatggaagagtttgaagacagtgatgatgaagaagagacagcaaaatcaggagacaagaaggatgatgccgttaaggaggaaggtcttgcgacagagaaggcaccagcggcagaagaaacaacatctgttaaggaagacaagtga

SEQ ID NO: 2492 - DNA, 471 bp, Arabidopsis thaliana
aatgacgaagaagaggaacaagaagaatagagacgaggaagcttccatggacgtttctgaatctcagagcgtctctgaagctactcctcaagtgatggacactacggagaccggtgacgggaaactagcttctcgtgctcgtagctggatgagcacgaggaaaggaaaaccgatgaagagaacgaagattgcaatgaatatgaaagctgtggctgtagccatggacactacggaaaccggtgacgtgaaactagctacggaaaccggagacttgaaagtagctacggaaaccggatacctgaaactagctactctttctcgtaaccggacaaacatgaagagaacaaagaatgcaaggaagatgaaagccgtggctaaagctatagcgttgagcgagaagtatgaagcgaaagctacaaaggacaaaaccaaaaccctcagaactctttcggccaagaaattgtacgagtg

SEQ ID NO: 2493 - DNA, 888 bp, Arabidopsis thaliana
atgtccactcttcctttcgcgccttctgtcacccatgcgcactttagccactccctctcccccatgtttatcctgcgccatctccctcttacacgccatctccgtttatcccgaaataaccgcgtcgcttccgttgtatccgccgccgccgttcgccaggacgcttccctctggactccagctcctctctctctaatcgaatcagctgcagaatcgcttttccacatctcaatcgacatttcaaacgctccggatctcgtagcttcgtacacgagacccggtcagtatctccagatccgtgttcctgatgttgagaagccttcttttatggcaatcgcttctcctccttccttggcgtcttctcgtggtgctttcgaattcttggtcaagagcatcgctggttctaccgcggagattctctgcgggttgaagaaaggagagaccgttgagcttagctctgtgatgggtaatggtttcaatatcgatctgattgatcctcctgaggaatatcccaccgttttgattttcgccactggatctggaattagccccatccgctcactaatcgaatcaggatttggcgctgatagaagatctgacgtaagactctattacggggctaggaacctgaataggatggcttaccaggaaaagtttaaagagtgggaatcagcgggtgtcaaagttgtgccggtattatcacagccagatgatgggtggaaaggggaaactggatatgtgcaggctgcttttgcaagggctaaacagctatcagctcccaaggccacgggagcggtgctgtgcggacagaaacaaatggctgaggagataacttcaatgcttgtagctgatggagtctcaaatgacaagctgctcaaaaacttttga

SEQ ID NO: 2494 - DNA, 285 bp, Arabidopsis thaliana
atggctatttcaaaagctcttatcgcttctcttctcatatctcttcttgttctccaactcgtccaggctgatgtcgaaaactcacagaagaaaaatggttacgcaaagaagatcggctttcgaggaggccgaggctgtgtcacagagcgtgcgggacttgctgctacaggtgcaactgtgtgcctccgggtacgtacggaaactacgacaagtgccagtgctacgctagcctcaccacccacggtggacgccgcaagtgcccataagaagaaacaaagctcttaa

SEQ ID NO: 2495 - DNA, 921 bp, Arabidopsis thaliana
atggagttctggggagttgcggtgacaccaaaaaacgctactaaggtgactcctgaagaagacagccttgtccacatttctcaggcttcacttgactgcacagtgaaatctggagaatctgtggttttgagtgtgactgttggtggggctaaacttgttattggaacactttcacaagacaagttccctcagattagctttgatttggtttttgataaagagtttgagctttcacacagcggtaccaaagcaaatgttcatttcattggctacaaatcccccaacatcgagcaggatgacttcactagttcggatgatgaggatgttcctgaagctgttcctgctcctgcccctactgctgttactgccaacggaaatgctggagcagctgttgtcaaggctgacacaaagccaaaggccaaacctgccgaagtgaagcctgcagaagagaagcctgaatcagacgaggaagatgagtctgatgatgaagatgagtctgaagaggatgatgactctgagaaaggaatggatgttgatgaagatgactcagatgatgacgaggaggaggattctgaggatgaagaagaggaggagactcctaagaagcctgagccaatcaacaagaagaggccaaatgaatctgtatccaaaacacccgtctctggaaagaaggcaaaaccagcagcagcaccagcttctactcctcagaagacagaagagaagaagaaaggaggacacaccgccacaccacacccagctaagaagggtggaaagtctcctgtgaatgctaaccagagccccaagtctggaggtcaatcatccggtggtaacaacaacaagaagccattcaactcaggcaaacaatttggtggttccaacaacaagggttctaacaagggcaagggaaagggtagagcttaa

SEQ ID NO: 2496 - DNA, 1206 bp, Arabidopsis thaliana
atgatgctttacagcaacaatagttggagatcgaattccattttaatacttctacttggtctctccattgtggccgccgcagactccgccggcaaaacttcaccggtcgaagacggcttggtggttaacggcgactttgagacaccgccgtcaaacggcttccctgatgacgcaatcatcgaggacacctccgagatcccgagctggcgatccgatggtacggtggagctaatcaagtccggtcaaaaacaaggcgggatgatcttgatcgtgcctgagggccgtcacgctgttagattaggaaacgatgcagagatcagccaagaacttacggtggagaaaggctctatctactccgtcacgttcagtgcagcccgcacatgtgcacaactcgagtcgctgaatgtttcggtagcttcttctgatgaacctatcgcatcgcaaaccattgacttgcaaacggtgtacagcgttcaaggatgggatccatatgcatgggcgtttgaagcggttgtggatcgcgtccggttggtttttaagaaccctggcatggaggatgatcctacttgtggacctatcattgacgacattgccgttaagaagctctttactcctgataaacccaaaggcaatgcagtgattaatggagattttgaagaaggtccatggatgtttaggaacactaccttaggtgttctgcttccaacaaacctcgatgaagaaatatcgtctcttcctggatggaccgtcgaatcgaaccgagcagtacggtttattgactcagaccatttctcggtccccgaggggaagcgagctttggaacttttatcgggcaaagaaggcataatttctcaaatggttgagacaaaggcgaacattccgtacaagatgtctttctctttgggacacgcaggggacaagtgtaaggaacctttggctgtaatggcttttgctggagatcaagcacagaactttcattatatggcgcaagcaaactcgagtttcgaaagatcggagttgaacttcactgcgaaagctgaacgtacgaggatcgccttctacagcatttattacaatacgaggacggacgatatgacttcattgtgtggacctgtgattgatgacgttaaggtttggttctccgggtctagtagaattggatttagttttccgctttttattcttctttctttggttttcatctag

SEQ ID NO: 2497 - DNA, 1017 bp, Arabidopsis thaliana
atggagacaaagagcgaggagaagctaagtgtcatcgaactactaaaacgagctcttaagctactctttggtaacatcaatctcgctctcttcctctttctttgctctctcccactgttttgtttcttgatcttcttcgagctctccctccaaaccactgtctcactcgcttccacatacatctccaaactagtcaattctgaggaggacttgtcggagaatgatcttcttccttggctgattcagacaactctgctctacttctttccctatactattcttgacctccttaccaccaccacgatcgttgcagcatcatcgattgcttacacatctgaggaagagccgttagggttgctttatttggtagggagatctttcaagctatgtcagaacaaagtaggaggttgtctgatcacatctctctatgtccttctcttgtcgacctctgttttcctcggtttgttctctggttcgaccatctacttatattttgcttctctcacactcgaacaacaaatattctttaatcaagcagtggtgcaagaccaaagattccttgaacaagcagtggttctgttggatgtggtggtagttctgattcatggtactgtcttcatagttctggctgcaaagttcagcaagtggagcgcgggatggaacattagtatggttgtttcggtcttagaagaggaagaagatagtaaaggcatctatggaagtagtgctctgtctctttcagcttggtacttaagaggacaagagaagcgtgacttctggatgatgctagtgttcttggtcggcgctcttgtgacaaggatgccatgtttatactacaaatgcagtgaaagtctgagtgggaatggagtgttgtacactggtctctatgtaagtttgatttgtgttgggaatgtcgttaaatgggtttcttgtgttgtttggtaccatgattgtaacacaagggtcttgaggaaaaagggtgacgtggagattgggtcaaaagcttttgctacatag

SEQ ID NO: 2498 - DNA, 819 bp, Arabidopsis thaliana
atgagtatgtcgcagtctcgagctgtccaaagatcgtcttcacctaatgaggatagaggtgagaatcagttagtggtttatgacttgaaaggaaatgatgatactgaagaagaagttctaccggttcaatctcagcctttgtcatctagaacacagtgtccctctatcggggcatttacggttcagtgtgcaagttgtttcaaatggagactcatgccttcaatgcagaagtatgaagagattagggaacagcttcttgaaaacccgtttttctgcgatacagcgcgtgagtggaagccggatatttcttgtgatgttcctgctgatatctatcaagatggaactcgtctttgggctattgataaaccgaatatctctcgtccacccgctggctggcaacgtttactgcggattagaggtgaaggaggtaccagatttgctgatgtttattatgttgctccgtctggaaagaagcttcgatcaactgtggaggtccaaaagtacttgaatgacaactccgaatacattggagaaggggtgaaactttcacagttctcgtttcaaatcccgaaaccgctgcaggatgactacgtgaggaagcgcccagctcgactactggattccatcgataatacaaacacccctgtagctaaagaagctaatccactggcatggatatctccagatgatcatatatcgttgcagctaggtacgccaaccgagtctggacttaacaattcacattaccaaccatcgaaaaagaaaaaaacatcgacgctatcaatctttggctccaacgacgaacttgctgatagataa

SEQ ID NO: 2499 - DNA, 1452 bp, Arabidopsis thaliana
atgtcgattccttgtctaaccgaagagacagccaaaactgttcttcgccaggtggagttctatttcagtgatagtaatctacccattgatgatttcctcaagaagactgttacagagagcgaagatggcttggtgagtttggcgttgatttgctcctttagtaagatgagaggatatttgaagttgggtgattctaaaggagatgatattcctgaagataccatcaaagctgttgctgatactcttcgaacctcttctgctctcaagatttctgacgatgggaaaaaggttggtaggagtactgaattgttgaagctggaagatttgattgagcaacttaatgctagaacagtagctgcgtcacctttctcctatgatgttaaaagggaagacgtggaatcctttttcagtcagtatggaaagattggttatacaagtttttggtatatgtatgtgtcgtccttgcaggttaatagtgtgaggatgcctcgtcatgttgcagagtcgaggatattttctggtgttgccttggttgagttccctacagaagaggatgcccagaatgttatgaagcagaatttggtctttgctggtcaggagttggagctgaaaccaaagaaagagtttgataatgaaagggagaaggatgaagtaaaatttgctaattaccaacctcagaagggatctgcaaatcagaagaatggttctgatcacaaaaacaattctgcttatgagccagattatcccaagggtttgatcatttcattcaccctcaagcgttcagctgaagagggtaccacggaacaaaaaagttctgaggagccaactgataagacaatggaagaaagtgaaacaaagccagcagatactcctgatgctgataaagaaaacactggtgaggttcaggccgagggagcagaggatgaagatgatgagaaagaagaaaagggtgctctagccacccataaagataataaggatgttgtcttacgtgaagatcttaaggctgttttcggaaaatttggtgatgtcaagtttgttgatttcaagatgggatctgagacgggttatcttaggtttgatgaacctgaagcatcccagaaagcccgtgcagcagcagtattagccaatgaaggtggactagccgtgaagaattttattgctgtcctagaacctgttattgttaaatggtcacttgtttatattgctctctgtcaggcgaagctgaaaaggagtattggactctcctacgaagcaaagatcggtttgacaagggtggccgtggaggaaggtgagttcattttttgtttggttcttcagataataatatacttggtctatgcaggggaggaagaagaggagggagattcgggagaaagaggggatcagattcaccgggtggtcgctggaacaaatctcagaaggtggaagcatgagagatttcgctcgtga

SEQ ID NO: 2500 - DNA, 180 bp, Arabidopsis thaliana
ggagatgcgtatgtttcaggtcatggaagctgcattttcccgggaagcaagaaggtcggaaataggacacagacagtggtgaattcgactgaagttgccgcgggtgaagctacttcaaggagtctctcaagaggcttctgtgtcactattatgattcttgtaacattttccatattgtaa

SEQ ID NO: 2501 - DNA, 1062 bp, Arabidopsis thaliana
atggctttgtcttccaaaaccctaaagtcaactctcttcttcctctctattattttcctctgtttctccttgatcctagctcacggcggcatagacgacggcgacgaagaagaggagaccaaccagccacctccggccaccggaacaaccaccgtcgtgaatctccgatcgaaaagcttggtgcttgtgaagatctactgtattataatactcttctttagcacattcttagccggagtttcaccttacttttaccgatggaacgagtcgtttctcctcctcggaactcaattctccggtggtatattcctcgcgaccgctctaatccatttcctcagcgacgctaacgagactttccgagggttaaaacacaaagagtatccttacgccttcatgttagcagccgctggatattgccttacaatgctggcagatgtggcggttgcgtttgtagcggctgggagtaataacaaccacgtcggagctagcgtcggagagtcgagggaggatgatgacgtggcagtgaaagaggaaggacgtcgtgagataaagagtggtgttgatgtgagtcaagcgcttatacgaactagtggatttggagacacagctttgctgatttttgctctttgttttcactccatctttgagggaatcgccattggtctctcagacactaaaagcgacgcttggagaaacctatggacaatatcgttgcacaaggtctttgcggccgtagcaatgggaatagctcttctcaagctaatccctaaacgtccattcttcctcactgtcgtctactccttcgcctttgggatatcgagtcccataggtgtcgggattggcataggaatcaatgccactagccaaggagctggtggtgactggacctacgcgatctctatgggccttgcgtgtggagtttttgtgtacgttgcggttaaccatctcatctcaaaagggtataagcctcgtgaggaatgttacttcgacaagccaatctacaagtttattgccgtcttcctcggtgttgctttgctctctgttgtaatgatttgggattga

SEQ ID NO: 2502 - DNA, 396 bp, Arabidopsis thaliana
atgaattctaaggcaatgcaagctttgatctttcttggtttcttggccacttcatgtctcgctcaagctcctgcaccagcaccaaccaccgttactcctccaccaacggcgcttcctccagtgacagcagaaacaccttcaccaattgcttcaccgcctgttccagttaacgagccaactccagctcctaccacttctccaacaacatccccggttgcttctcctcctcagaccgatgctcctgctcccggtccttccgctggattaactccaacttcgtctccagctccaggaccagacggtgctgctgatgcaccaagtgccgcatgggctaacaaagctttccttgtgggaacagctgttgccggagctttatacgctgtcgttttggcttag

SEQ ID NO: 2503 - DNA, 1416 bp, Arabidopsis thaliana
atggtttcttctcagtgttctgttgcaaacaaaaaccagactgggaagccgtttcagaaacatctatctttatccatcagccctccaaaatctgtcttgggtgataaccttgagcttcaattctctgatgtctttggaccaatgcctgaagctaactctgaagaggcctgtgatgttgcttacgacgagcctgctgttgtctacagtcgatcccactcattggttggcccgtctttggttgttagccattctttgaagatgaacaagctcactttacgagaaactgaggactcagttgacttggtggagtgtgttgaaggtgaatcgataaaagagaacgatgaattctctggtaatgatgacactgacagtgagaaatctccagaggaggtctcaggtgtagtaggcattgaggactttgaggtattgaaggttgtgggacaaggtgcatttggaaaagtgtaccaggtgaggaaaaaagacacgtctgagatatacgcgatgaaggtcatgagaaaagataaaattgttgagaagaatcatgctgaatacatgaaagccgagcgcgatattctaaccaaaatcgatcatcctttcattgtgcaacttaaatactcttttcagaccaaatacagattgtatcttgttcttgactttataaacggaggtcatcttttcttccagctctatcaccaagggcttttcagggaggacttggctcgtgtgtacactgcagaaatcgtctctgcagtttcccatctccatgagaaaggcataatgcatagagatcttaaacctgaaaacatactcatggacgtagatggccatgtgatgttaactgattttggtttagcaaaagaatttgaagaaaacacaagatcaaactccatgtgtgggactacggagtatatggcccctgagattgttcgtggaaaaggacatgataaggctgccgactggtggagtgtaggaatccttctgtatgagatgctcactggaaagccgccgtttctcgggagcaaaggaaagatacagcagaaaatcgttaaggacaagatcaagcttccacagtttctgtctaatgaagctcatgccttgctgaaagggctgctgcaaaaagagccagaaaggagactgggaagtggaccgagcggagcagaggagataaaaaaacacaaatggttcaaggcgataaactggaagaagctggaggctagagaagtacaaccaagtttcaagccggcggtttcgggaagacaatgcatagctaattttgacaagtgttggactgacatgtctgttttggattctccagcaagtagtcccaactctgatgctaaggcgaacccttttacaaacttcacatacgtcaggcctcctcattcattccttcatcggaccacatccaacttgtag

SEQ ID NO: 2504 - DNA, 600 bp, Arabidopsis thaliana
atggcttgcaccgtagatttccggtgccttgacgaaggattcggcggcaaaacctacaaacgcaaacgcgaatctcaagaacaagccgccgccgaagcaatcgccgatgaagcttccatggacatcgatggtgctcctcctgccgcgaaacgtagcgccgtcgcttcctctgaaaatccagacaaacctattgctctagctgtcgagagaccaacctacgacggtgtaatcgccgggaaagtctccggacggaactggaaacagccgcgaactcatagatcttcagggaggtttgtgaagaacaggaaaccagatctggaggagatgaagaggcaaagggagattaagaaagcgtataaggagagggtgaatgagctgaaggaagagattaggagtaataaggttgagaagaggaagaagaaggaagagagagagaagcggaagaaggagaatgttttgagaactggtactaagttgcagaagattacaaatcccaagactttgaagaaaatttctatgtctaagaagcagaggaagcagcttaagaaaattcctgacgagatgttgagtggtggtagcaagaagagtatcacgaattag

SEQ ID NO: 2505 - DNA, 2235 bp, Arabidopsis thaliana
atgggaggtgtttgttcttgtgtattcaaagatgatgataagaagaagaagttgagatcaaacgatgatgataagtcaagagggttttctgggaaacttaagtctatgagaagaaataattacggaggctcaagacggaaaagttctaagcctgatgaggttgttttcaacttttctggcgagcttggtccgatgcctccattaaggaacgattccaccaagtttatgcagaggaactcgtttatgggacgggctggggtaatggggctagagaaagctgttgaagttctagacacgctcgggagcagcatgactcgtatgaatccgagcaacgcgtatctctctggtgttacatcgtcccgtggtggcaaagtcactatattggcttttgaagtggccaatactattgccaaaggtgctgctttgctgcaatctttgtctgaagagaatctcaagttcatgaagaaagatatgttgcattccgaggaagtcaagaagttggtttctacggataccacagagttgcaaattcttgctgcttctgacaaaagggaggaactcgatcttttctctggagaggttatcaggtttggtaatatgtgcaaagatctgcagtggcacaatctcgatcgatattttatgaagcttgacacagagaactcacagcataaactgctcaaagatgatgcagaggcaaggatgcaagagctcgtcactcttgccagaatcacttctataattgagaagcttgtggatgttgtaagttatatacggcagacgattgtggaagtttttggcaacaatggtctaagagacaatgaaggggagcagggaagagaacgattaggtgaagccggtctttcgttacactatgctaatctaatacaacaaatcgataatattgcgtctcgaccatcgtcacttccttctaatgtaagggacacgctgtacaatgcattacccgctactgtcaagacagctcttcgtcctcggctacaaactcttgatcaggaggaagagctttcagtacctgagatcaaagctgaaatggagaagtcgcttcaatggcttgtcccgttcgctgaaaacaccaccaaagcacatcaaggcttcggatgggtaggtgaatgggcaaattcaaggatagagtttgggaaaggaaaaggaaaaggcgagaacaacgggaatccaacacgacttcagacgcttcatcatgcggataaaccaatagttgattcatatgtactcgaactcgttgtatggcttcatcgactaatgaagtcatcaaagaaacgtgctcacggcgttaagcttcaagaaaccaaccatgtctctccacccaacaacagaaccatctccaacacgcaactatcactctcccctgacttcacctacaaaaaccagctctctctagaagacaggttgttgttagacagagtccaaagtataagatttggtccaaatctaagtaagagtcaagagttagtcggcttgaagaagaacaagaaaggattcaagatttgggcactgagtagaagtacaggaaactctccaaaagttgatctttcagataagaactcttctagtgatttggatgtccttgatggtcaactactttcttttttctctccatcaactcctcagacaatcttaaagaagctaacaactccagaggctgcacaagtaaccaaaatcaccacaccattagaaccaacaggaggagtaagcgtgaaccagaaccaaccaattcttggtcaaccttcttcttcttcacctgtaaaccagcctttaaccgggttaagccaaccattaatcggattcaatcaaccttcatcaactggtttgaagcaaccaattcttggtcagccatctacttcttcttcggtaaaccagcctttaaccgggataaatcaaccattaaccggatttaatcagccatcatcaactggactcaacaatccaattcttggtcagccatctacttcttcttcccttaaccaacctttaaccgggtttaatcaaccatcatcaactggattcaaccaaccgatttcttcgtcttcttcttcatcatcatctgctcaaaatcaaccctttacgaatcgactcaaccagaacaatctctctggcgttccatttcttaatggaaattcaaagttgaaggtctccggcacaaagattatctttatctggattggtcttttccttgctttgcacggtactgacaggaactga

SEQ ID NO: 2506 - DNA, 669 bp, Arabidopsis thaliana
atgggtttgtttttgttatatagtaagcttcagagtgaggctgttagagaagccataacgactatcaagggaaaatctgaggagaagaagcgtaactttgttgagacagtggagcttcagattggtctgaagaactatgacccacaaaaggataagcgtttcagtggatctgtgaagctcccacatattcctcgcccaaaaatgaagatctgtatgcttggagatgctcagcatgttgaggaggcagagaaaatgggacttagtaacatggatgttgaggctttgaaaaagcttaacaagaacaagaagcttgttaagaagcttgctaagtcttaccatgctttcttggcttctgagtctgtcattaagcagattcctcgtcttcttggtcctggtcttaacaaggcaggaaagttcccaacacttgtgagtcaccaagagtcattggaagcaaaggtgaatgagaccaaagcaacagtgaagttccagttgaagaaagttctgtgtatgggtgttgctgttggtaacctttccatggaagagaagcagctcttccagaatgtgcagatgagtgttaacttcctcgtctcgctcttgaagaagaattggcaaaacgtaaggtgtttgtacttgaagagcaccatgggaccaccacaaagaatcttttga

SEQ ID NO: 2507 - DNA, 273 bp, Arabidopsis thaliana
atgacgcagaagagcaatcagttcaagggccaacagaagaggaagactattgctcctaatcgccatggcaaatccattcaaactcgcaaagggaagagaaatgtgaaaccaacaaagatgacgaaagagatggacactgatcgggagcttacgaaattcataaaccattgcaatgaagtgaaagcaactaatgcagcttgtaaagaaggtggtcaactcaatatcatcaaagctgaatctcaacctgagccatccaagaaatccgccaaatag

SEQ ID NO: 2508 - DNA, 2445 bp, Arabidopsis thaliana
atgggaaagattggtattgttttctttgcttcgttgctcttcttgctaattatattcccaagttgtgcctttgcagctataaccagagcaagtcctttgtcaataggacaaactctgagctcccctaatggaacttatgagttagggttcttcagtccaaacaactctcggaatcagtatgttgggatctggttcaagaacatcacccctcgggttgttgtctgggtggctaacagagataagccagttacaaacaacgcagcgaatctcactatcaacagcaatgggagccttatcttggttgagagagaacaaaatgttgtttggtcaataggagaaactttctcttctaacgagcttcgtgctgagctattagaaaacggaaatcttgtactcattgatggagtttcagaaagaaacttatgggaaagtttcgagcatcttggtgatactatgttacttgaatcatctgtgatgtatgatgttccgaataacaagaaacgtgttttatcttcttggaaaaatcccaccgatccttcacctggagaattcgtagctgagcttacgacacaagtacctccgcaaggctttataatgagaggatccaggccttactggagaggtggtccatgggcaagggtaaggttcaccggcataccagaaatggatggatcacatgtaagcaaattcgacatttcccaagatgttgcagccggcacaggatctttgacttattcattagaacgaagaaattcgaacctgtcgtacactacgctcacatcagcgggatcgttaaagatcatttggaataatggctctggttgggttactgacttggaggcccctgtaagctcatgtgatgtttataatacatgtggaccttttggcttgtgtataagatctaatcccccaaagtgtgaatgcttgaaaggctttgtaccaaaatcagatgaggagtggaataaaaggaattggactggtggttgtatgagaagaacaaatttatcttgtgatgtgaactcttctgcaacagcacaagccaataatggagacatcttcgacatagttgcaaatgtgaagcctccagacttttatgaatatctaagtttgatcaatgaagaggattgccaacaacgttgtcttggaaactgttcttgcacggcattttcctatattgaacaaattggatgtttggtatggaatcgagagcttgtggatgtaatgcagtttgttgctggaggagaaactctttccattcgtcttgcaagttctgagttagctggaagcaatcgagtgaagattattgttgctagcattgtcagcatttctgttttcatgatcttggtttttgcctcttattggtactggagatacaaagccaaacaaaatgattcaaatcctataccattggagacatcacaagatgcatggagggaacaactgaaaccacaagatgtaaatttctttgatatgcaaaccatattaactatcaccaataactttagcatggaaaataagcttggtcaaggtggattcggtccagtgtataagggaaatctacaagatgggaaagaaatagccataaaacgcctttcgagcacctctggacagggtctagaggagttcatgaatgaaataatactcatctcgaaactccaacacagaaacttggtccgccttttgggatgttgcattgaaggagaagaaaagctattgatttatgagtttatggcgaacaaaagcctcaatacctttatctttgattcgacgaaaaagcttgagcttgattggcccaagcggtttgaaatcattcaaggtattgcttgcggacttctttatcttcaccgcgactcatgtcttagggttgtacaccgagatatgaaggtcagcaacatccttttagacgaggaaatgaacccaaaaatatcagattttggattggctcggatgtttcaaggaacccaacatcaagccaacactcgcagggttgttggaacgctcggatacatgtctccagagtatgcttggacaggcatgttctctgagaaatccgacatctacgcatttggagttctgctattggaaatcataaccggcaagaggatttcaagtttcaccattggagaggaaggcaaaactcttcttgaatttgcatgggattcttggtgcgaaagcggtggatcggatctactggaccaagatatctctagctcgggttctgaatccgaagtagcgagatgtgttcagattggtttgctctgtattcaacaacaagccggggatagacccaacattgcacaagtaatgtcaatgcttacaaccacaatggatcttccgaaaccaaaacaacccgtattcgcaatgcaagtccaagagagtgattcagagtctaagactatgtactctgtcaataatataacacaaactgctatagttggtcgataa

SEQ ID NO: 2509 - DNA, 1308 bp, Arabidopsis thaliana
atggttgatatggattggaagaggaagatggtatcatcagatttaccaaactcacctaagctttcttcaaagcttcacgtaactattccatcaccgttcaaaatcgtccctgtttcatctccgatctcatgttcagcacctgctctttgctctgcttacgagctttaccttcgtctccctgagctaagaaagctctggtcatctcgtgattttcctcaatggacatcagagccgattctcaaaccagctcttcaagctttggagatcagtttcagattagttttcgccgtttgttctgatactagaccgtacatcaaccaccgtgaatggaaccggaggctagattctctcatcacgaagcagatccagcttgtagcagcgatctgcgaagatgaagaagaagaaggtatatcagcggaggctccggtcggcggtggacggagttcgttgagtttgttaccgcagctagctacgtggaggagatcagaggctttggggaagaagatcttatatacgatcgataacgagatgagtcggtgtaagtacacgctcggactcggtgaacaaaacatcgccggaaaaccaaatctccggtacgatgcgatttgccgaccaaacgagatctatagcctcaaggataatccatacgcagatcatatcgataatcacgagaatcaaactctctatatcattcaccagatcctcgaatcgtggatctacgcatctggaaatcttctgaatcgaatcgtctcaagtatcgaagaagagaaattcggaaaagcttcaaacgatgtttacttgctggagaagatctggaaaattttagcggagattgaagatcttcatatgttgatggatccggaagattttttgaaattgaagaaacagttacagatcaaatcgacgggtaaaaacgatgcgttttgtttcagatctaaaggattagtggagatgatgaagatgtcgaaagatctgagacagaaagtaccggcggtcttggcggttgaggtagatccaaccggaggaccaagattacaagaggcggcgatgaagctttacgcgaggaagacagagtgcgataagattcatttgcttcaggggatgcaagcggtggaagcggcggcgaagagtttcttctttgggtataggcagttagtggcggctatgatgggaagtgcggagatgaacgcgacggcgagtcaagagtcgtgtgactcactgagtcagatatttatggagccgacgtatttcccgagccttgacgcggcaaagacgtttctgggagagttttggagtcatttgggatga

SEQ ID NO: 2510 - DNA, 1353 bp, Arabidopsis thaliana
atgcgagaaatcataagcattcacatcggacaagctgggatccaggtcggaaattcgtgttgggagctttactgtctcgaacatggaatccagccggacggaatgatgccgagtgatactacagttggtgttgcacacgatgcgttcaatactttctttagcgagactggtgctgggaagcatgtccctagggctgtcttcgttgatctcgagcctaccgttatcgacgaagttcgtactggtacttaccgtcaacttttccatccagagcagctcatttctgggaaagaagatgctgctaacaacttcgctagaggacattacactgttgggaaggaaattgtggatctatgtcttgaccgtgtgaggaaacttgccgacaactgtactggcttacaagggtttttggtgttcaatgctgttggtggtggaactggttctggattgggttctctgttgctagagcgtttgtctgtagattatggaaagaagtctaagcttggttttaccatatacccttctcctcaggtttctactgctgttgtagaaccttacaacagtgttctctcaacgcattcccttcttgaacatacggatgtagctgtcctcttggataacgaagccatctatgacatttgccgcagatccctagatatcgagaggccaacctacacaaacttgaacaggttgatatcacagatcatttcatccttgacaacatctttgaggtttgatggtgccatcaacgtggatatcactgagttccagaccaatcttgtcccatatccccgtatccatttcatgctgtcatcttatgcaccagtcatctcagccgccaaggcttaccacgagcagctatcagtccctgagatcaccaatgccgtttttgagccagctagcatgatggcaaagtgtgacccgagacacggaaagtacatggcctgttgtttgatgtaccgaggagatgttgttcccaaagatgttaatgctgctgttggcaccatcaagacaaagaggactgttcagtttgttgactggtgcccaactgggttcaaatgtggaatcaactaccaacctccaacagttgttccaggtggtgacctcgctaaggttcagagagctgtatgtatgatcagtaacaacacagcagttgcagaggtgttctcacggatcgaccacaagtttgatctcatgtatgcgaagagggcatttgtccactggtacgttggtgaaggaatggaggaaggtgaattctctgaggcacgtgaagacttggccgcactggagaaagattacgaagaagttggtgctgaaggtggagacgatgaagaagatgaaggtgaagactattga

SEQ ID NO: 2511 - DNA, 441 bp, Arabidopsis thaliana
atgactcttggctcaggaggatctagcgttgttgttccgaggaattttcggttgttggaggagcttgaacgtggggagaaaggtattggggatggaactgtgagctatggaatggatgatggagatgacatctatatgcgttcttggactggcaccatcatcggtcctcacaacactgttcatgaaggtagaatctatcagttgaagctcttttgtgacaaagattacccggagaaacctccaactgtccgattccattcacgtgtcaacatggcttgtgtcaaccacgaaacaggagtggtggatcctaagaaatttgggctacttgcaaactggcaaagagagtacacaatggaggatatactggtacagttgaagaaggaaatgtctacgtcgcataaccgtaagcttgttcaacctccggaaggtacttgcttctag

SEQ ID NO: 2512 - DNA, 765 bp, Arabidopsis thaliana
atggcaaagatgcaattatcaatctttatcgctgtcgttgcgcttatcgtctgctctgcatctgctaaaaccgcaagccctccagctccagtgctgccaccgacaccagctccagcaccagccccggaaaatgtgaatctcaccgagcttttaagtgtagctggtccgttccacacattcctcgactaccttctctcgactggagtcattgagactttccaaaaccaagctaacaacactgaggaaggcatcacaatctttgtccctaaagatgatgctttcaaagctcagaagaatcctcctttgtcaaatctcacaaaggatcagcttaagcagcttgttctcttccatgctctgcctcattactattcgctttcggaattcaagaacttgagccaatctggtccagtgagcacctttgctggtggtcaatactccttgaaattcactgatgtttctggcacggttaggattgattctttatggaccaggactaaagtcagcagcagtgttttctccactgaccctgttgcggtttaccaagtgaaccgcgtgcttctacccgaagcaatctttggtactgatgtccctccaatgcctgctccagctcctgctcctatcgttagtgctccttcggattctccttcagttgctgattctgaaggagcttcttcaccaaagtcctcacacaagaactccggacaaaagctgctacttgcaccaatctccatggttatttccggtttggtggcattgttcttgtga

SEQ ID NO: 2513 - DNA, 1764 bp, Arabidopsis thaliana
atgaagagagatcatcaccaattccaaggtcgattgtccaaccacgggacttcttcttcatcatcatcaatctctaaagataagatgatgatggtgaaaaaagaagaagacggtggaggtaacatggacgacgagcttctcgctgttttaggttacaaagttaggtcatcggagatggcggaggttgctttgaaactcgaacaattagagacgatgatgagtaatgttcaagaagatggtttatctcatctcgcgacggatactgttcattataatccgtcggagctttattcttggcttgataatatgctctctgagcttaatcctcctcctcttccggcgagttctaacggtttagatccggttcttccttcgccggagatttgtggttttccggcttcggattatgaccttaaagtcattcccggaaacgcgatttatcagtttccggcgattgattcttcgtcttcgtcgaataatcagaacaagcgtttgaaatcatgctcgagtcctgattctatggttacatcgacttcgacgggtacgcagattggtggagtcataggaacgacggtgacgacaaccaccacgacaacgacggcggcgggtgagtcaactcgttctgttatcctggttgactcgcaagagaacggtgttcgtttagtccacgcgcttatggcttgtgcagaagcaatccagcagaacaatttgactctagcggaagctcttgtgaagcaaatcggatgcttagctgtgtctcaagccggagctatgagaaaagtggctacttacttcgccgaagctttagcgcggcggatctaccgtctctctccgccgcagaatcagatcgatcattgtctctccgatactcttcagatgcacttttacgagacttgtccttatcttaaattcgctcacttcacggcgaaccaagcgattctcgaagcttttgaaggtaagaagagagtacacgtcattgatttctcgatgaaccaaggtcttcaatggcctgcacttatgcaagctcttgcgcttcgagaaggaggtcctccaactttccggttaaccggaattggtccaccggcgccggataattctgatcatcttcatgaagttggttgtaaattagctcagcttgcggaggcgattcacgtagaattcgaataccgtggattcgttgctaacagcttagccgatctcgatgcttcgatgcttgagcttagaccgagcgatacggaagctgttgcggtgaactctgtttttgagctacataagctcttaggtcgtcccggtgggatagagaaagttctcggcgttgtgaaacagattaaaccggtgattttcacggtggttgagcaagaatcgaaccataacggaccggttttcttagaccggtttactgaatcgttacattattattcgactctgtttgattcgttggaaggagttccgaatagtcaagacaaagtcatgtctgaagtttacttagggaaacagatttgtaatctggtggcttgtgaaggtcctgacagagtcgagagacacgaaacgttgagtcaatggggaaaccggtttggttcgtccggtttagcgccggcacatcttgggtctaacgcgtttaagcaagcgagtatgcttttgtctgtgtttaatagtggccaaggttatcgtgtggaggagagtaatggatgtttgatgttgggttggcacactcgtccactcattaccacctccgcttggaaactctcgacggcggcgtactga

SEQ ID NO: 2514 - DNA, 2763 bp, Arabidopsis thaliana
atggagaggccaagagcccctccatctcctttgaatgatgcggagtcattaagtgaacgtagatctcttgagattttcaacccttcgagtggaaaagagacacatggatcaacttcttcttcttcaaagcctcctcttgatggcaacaacaaaggtagtagtagtaagtggatggagtttcaagattccgctaagattacagaaagaaccgctgaatggggattgtcagctgttaagccggattcgggagacgatggcattagtttcaagctgtccagtgaagtggaacgaagcaagaacatgtctaggaggtcatccgaagaatctacatcttctgaatcaggggccttccctagagtatcccaggagctcaaaactgctctatccacgttgcagcagacttttgttgtctctgacgctacacagcctcactgtcccatagtctatgccagcagtggattctttaccatgactggttattcttccaaggaaattgttggaagaaactgccggtttctgcaagggccagacaccgacaagaatgaggttgccaaaatcagagattgtgtcaagaatggaaaaagttactgtggaaggctgttaaactacaaaaaggacggaactcccttctggaatcttctcacagtcactcctatcaaggacgaccagggcaataccatcaagttcattgggatgcaggttgaagttagcaaatacacagaaggggtaaatgataaagcattgaggcctaatggactctccaaatccttgattcgatatgatgctcgccagaaggagaaagctttggattccatcacagaggttgtgcaaactataagacatcgtaagtctcaagttcaggaatccgtgagcaatgacactatggtaaagcctgatagttctactacacctacacctggtagacaaacaagacagtcagatgaggcttcaaagtctttcaggacacctggacgtgtttctactccaacggggtcaaagctcaaaagctcgaataacaggcatgaagatcttttacgtatggaacccgaagaattgatgttgagcacagaagtaatagggcagagggacagttgggacctatcggatagagaaagggatatacgccaagggattgatctagctaccactcttgagcgcatagagaagaatttcgtcatcagtgatcctcgtctccctgataatcccattatctttgcatcagacagctttcttgaattgacagagtattcacgcgaggaaatattggggagaaattgtcggtttcttcaggggccagagacagatcaagcgactgtccagaagataagagacgcaattagagatcagagggagattactgtgcagttgataaactacactaaaagcggaaagaaattctggaacttattccacttgcaacctatgcgtgatcagaagggagagcttcaatacttcatcggtgtgcagcttgatggaagtgatcatgtagagcccctccaaaatcgtttgtctgagagaacagagatgcagagttcgaaattggtgaaagctacggcaacaaatgtagatgaagctgtcagagagcttccagatgctaatacgcggcccgaagacctgtgggctgcacactcgaagcctgtctatcctctgcctcacaataaggagagtacgtcctggaaagcaataaaaaaggcatgcatcgaaccatgttactttttacttgaaacagtgggactacatcatttcaaaccaataaaaccgttgggctctggtgatactggcagtgtccatttggttgagctgaagggcacgggtgaactatatgccatgaaagcaatggagaaaacaatgatgttgaatcgtaacaaggctcaccgagcgtgcatcgaaagggaaatcatttcccttctggatcatccattccttcctactctctacgcttcttttcagacctctacgcacgtctgtttgattacagacttctgcccaggtggagagttgtttgcactacttgacagacaacctatgaaaatattgacagaagactctgcaaggttctatgcagcagaggttgttatcggcttagaatatcttcactgcttaggaattgtatatcgagacctgaagcctgagaatatactgctcaagaaggatggacacatagtattggctgactttgatttatcattcatgacgacctgcacaccccagcttattattccagctgcacctagcaaacgaaggagatccaaaagtcaaccactacccacatttgttgcagaaccaagtacccagtcaaactcgttcgtaggaactgaagaatacattgcgcctgagataatcacgggtgctggtcatacaagtgctattgattggtgggcactgggtatcttgttgtatgagatgctttatggtcgcacacctttcaggggtaagaataggcaaaagacatttgccaacatcttgcacaaagatctcactttccccagcagtatccctgtgagtcttgtaggtagacagttgatcaacacgttgttaaatagagatccgagcagtcggttaggatccaaaggtggggcaaatgagataaagcagcatgctttctttcgcgggatcaattggcctctcatacgaggcatgagtcctccaccactggatgcaccgttgagcataatcgaaaaagatccgaatgccaaagatataaagtgggaagatgatggagtgcttgtgaattctacggacttggacattgacctcttctaa

SEQ ID NO: 2515 - DNA, 474 bp, Arabidopsis thaliana
atgggtcttccaacagatttcaaagagcttcagattccaggttacgtactaaaaacactttacgtcatcggtttctttagagacatggtcgatgctctttgtccttacatcggtctaccaagttttcttgaccacaacgagacctctcgatccgacccgacccgactcgctctctccacgtcagcaactcttgccaacgagttaatcccggtggttcgtttctccgatcttttaaccgatccggaagattgctgcacggtttgcttatccgattttgtatccgacgataagattagacagctgccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaa

SEQ ID NO: 2516 - DNA, 2331 bp, Arabidopsis thaliana
atgaagcgtgagatgaaagcacctactactccactagagagtctccaaggtgacctcaaaggaaaacaagggaggacatctggccctgctagacgatctaccaaaggacaatggacacctgaagaggacgaagtcttgtgtaaagctgttgagcgttttcaaggaaagaactggaagaagatagctgaatgttttaaggatcggactgatgttcagtgtcttcatagatggcaaaaggtcttgaacccagagcttgtgaaaggaccgtggtcaaaagaggaggataacacaataattgacctggttgaaaaatatgggccaaagaaatggtctactatatctcagcatttacctgggcgcataggaaagcaatgtagggaaaggtggcataaccatcttaaccctgggattaataaaaatgcatggactcaggaagaggaactgactcttattcgtgcgcatcaaatttatgggaataaatgggcagagcttatgaaatttttgccaggaaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataa

SEQ ID NO: 2517 - DNA, 1437 bp, Arabidopsis thaliana
aacatctcagcagccaccatcacccccctcacagcttcccctccgtacaatgccgggatcgtacggctggccgttggttggaccattatcggaccgtttagattccaaggacccgataagtttttccggacaagagctgagaagtataagagcactgtgttccgtacaaatattcctccgacgtttcctttcttcggcaacgttaaccctaacatcgtcgccgttcttgacgtcaagtcttttagccatctttttgacatggatctagttgataaaagagatgttctcatcggagacttccggcctagccttgggttctacggcggcgttcgtgttggagtttatctcgacactactgagccaaagcacgccaaggttcgtacatacgttgctttgctactattacgtttcgctatggaaacactaaaacgaagctcaaaagtatggctacaagagcttcgttcaaacctaaacattttctggggaacaatcgaatccgaaatctccaaaaacggtgccgcttcatatatcttccctctccaacgttgcatcttcagtttcctctgcgcctctctcgccggcgttgacgcttccgtatcgccggacatcgctgagaacggttggaaaacaatcaatacttggcttgcgttgcaagttattcccactgctaaacttggcgtagttcctcagcctcttgaagagattttacttcatacttggccttatccttctctcttaatcgccggaaattacaaaaagctttacaatttcatcgacgagaacgccggagattgtctccggttaggtcaagaagaattcgggttgacccgagatgaggctattcaaaatcttctctttgttttaggttttaatgcctacgggggcttttccgtcttcttaccttctttgatcgggagaataaccggcgacaattccggtttacaggagaggattagaaccgaagtcaggagagtttgcggatccgggtcggatcttaatttcaagacggttaacgaaatggagctggttaaatccgtggtttacgaaacgctgcgttttagtcctccggttccgctgcaattcgcacgtgcgaggaaagattttcagataagttcacacgatgctgtttttgaggtcaagaaaggtgagcttctttgtggttatcagccgcttgtgatgagagacgctaatgtttttgacgaaccggaggaatttaaaccggaccggtatgtaggtgagaccgggtctgaattgctgaattatctctactggtctaacggtccacaaaccggtaccccgagcgcgtcgaacaaacagtgtgcagctaaggacattgtcactctcacggcttccttgctcgttgccgatttatttctccggtatgatacgattactggtgactccggttcaattaaagctgttgttaaagctaaataa

SEQ ID NO: 2518 - DNA, 1737 bp, Arabidopsis thaliana
atggattcttcttcatcagtcgtttacgttggttcatcatccaaatccagaaactttcaatctaaatccaaaggttcgattacatctttctcaatcgattcaagaggcaccaagaaatcaatgaagacgttattaatcccagaaccagaaccaacttcccctgaagttatagaaagttctgtgtcctctgtttcagctgaatccgagacaccaatttcgattatacgtaagaagaaacaatcagagccaaggttttactctagcccaaccaacacgttttacacagaagcaaaacaaagctttaccaacacagaattcagtgaatgtgcaagcataagcactattggtataggtggtattgatttggagaagaatggtgtaatgatatacagaggaagtatagggagtgatgttagtgatgagagtagctcaagtggtctgagtaatgcagcttacaagccacatagagataataacgataagcgttgggttgcgattcaggaggttcgttctcgggttggttcgtcgcttgaggctaaagatttcaagctgattaagaagttaggaggaggtgatattggtaatgtttacttagctgagttgattggaactggagtgagttttgctgtgaaagttatggagaaagctgctattgcagcgaggaagaagcttgttagagctcagactgagaaagagatacttcaatcgttagatcatcctttcttgcctacgctttactcacatttcgaaacagagatgaattcttgtttggttatggagttttgtcctggtggtgatttacattctcttagacaaaaacagcgtggaaagtacttccctgagcaagctgctagattttatgttgctgaagttcttcttgctatggagtatctacatatgcttgggatcatatacagagaccttaagcctgagaatgttttagttcgtgaagatggacatataatgctatctgatttcgacctctctttgagatgtgcagtctctccaacgttggttcggttcgcagcaatcacgcttgagtccaaaagctcaagctactgtatccaaccaacatgtgtagaccaatcgagctgcattgttcagcctgactgcatccagccagtgtgtttcactcctcggttcttgtctaaaggaaagcacaggaagaagtcgaacgatatgagccgccaaatcagaccgcttcctgagctgatagctgaaccgactagcgcaaggtcaatgtcgtttgttggtacacacgagtacctagcaccagagattatcaaaggagaaggtcatggaagcgcggttgactggtggacattcgggatattcctctatgagcttctatttgggataacaccgtttagaggaggcgataacagagcgacactctttaacgtagttggacagccattgcggtttcccgagcatccaaatgtgagctttgcagctagagatttgatcagaggattgctagtgaaagagcctcagcatcggttggcttatagaagaggagctactgagattaagcagcatccgtttttccaaagtgtgaattgggctttgatcagatgcaccagtccaccacagattcctcaaccggttaaaccaatggatcaagctcacagtgttcgtcatggttttagtcaaggacatggacatgttggttatgataagcctcctactgtggatgtgaagccttctggtaattatttggaaattgatttcttctga

SEQ ID NO: 2519 - DNA, 2343 bp, Arabidopsis thaliana
atggaggaattcttagataagttgccgcagatggatctgatgcgttcggagaagatgacgcttgttcagcttatcatccctgttgaatccgctcatcgttccatcacttatctcggcgagctcggactcttgcagtttcgcgacttaaatgctgataagagtccctttcaacggacatttgcaaatcaggtaaaacgatgtggtgagatgtcaagaaagctgcggttttttaaagatcaaattgacaaagctggtctaagatgttcaccacgccttgaaatagaaccagatattgcacttggagatttagagagacaacttgctgatcacgagcatgaagtacttgaaatgaattcaaacagtgaaaagcttcggcagacatataacgaacttctagaattcaagatagttcttgaaaaggtaggtgtattcgcctttcgtctcagatctatatctatctcatttttatctttactaataaaacagttattttattcacaggaaatgaatcctggacactctaatcaatcaggattgagatttattagtggaatcatcaacaaagacaaacttcttaagtttgaaagaatgttgtttcgtgcaacacgaggcaatatgcttttcaaccaaacaacctctgatgaggaaatcatggatccttcaacatcagaaatggtggagaaagttgtatttgtggtattcttctctggggagcaagcaagaacaaaaatattgaaaatatgtgaagcatttggtgcaaattgctatcctgtccccgaggatacaactaagcagaggcagcttactagagaagttttatcccgactctctgatctggaagccacattagatgctggaactcgccatcggaataatgcccttaattctgttggctatagcttaactaactggatcaccacggttcggagagaaaaagctgtttatgatactctgaatatgctaaattttgatgtaaccaagaaatgccttgttggcgaaggttggtgccccacatttgctaagacccagattcatgaggtcctgcagcgagcaactttcgacagcagttcacaggtgggcgttatatttcatgtaatgcaagcagtagaatcacctcccacctatttcagaacgaacaaacttacaaatgccttccaggagattattgatgcttacggtgttgcgagatatcaagaggcaaaccctgctgtttattcagttgtcacatatccctttttgtttgctgttatgtttggtgattggggtcatggtctatgcttgctgctaggagcgttgtatcttcttgctcgtgaaagaaagttgagtacgcagaaacttggaagctttatggagatgctttttggaggccgctatgtaatcttactaatggcacttttttcaatatattgtgggcttatctacaatgagttcttctctgttcctttccacatctttggtggttcagcttacaaatgcagagatacaacttgtagcgatgcttacacggttggtttaatcaagtaccgtgatccatacccttttggcgtagatcctagttggcgtggcagtcgtacagaactgccttacctaaactctcttaagatgaagatgtctattctgctgggaattgctcagatgaatctgggactaatattaagtttctttaatgcccgctttttcggctcatcattggacataaggtatcagtttatacctcagatgatatttctgaacagcttatttggttacctttcactgctcatcatcatcaagtggtgcactggatctcaagcagacttgtatcatattgtgttattgcttctggcattcatcgctgtcccatggatgctttttccgaaaccttttgccctcaggaaaattcacatggagaggtttcaaggtcgcacgtacggggttcttgtttcttctgaggtggatcttgatgtagaaccagactccgcaagaggaggaggccatcacgaagaagagtttaacttcagcgagatttttgtacatcaattgattcactccatagaatttgttctaggttcagtttctaacacagcatcttaccttcgtctttgggctcttagtttggctcattcggaattgtcaacagtcttctatgagaaagttcttcttcttgcctgggggtatgaaaacattttgatccggttaatcggagtagcggtgtttgcgtttgcaacggcgtttatacttctgatgatggaaacactaagtgcatttctccatgctctgcgtcttcactgggtagaattcatggggaagttcttcaatggagatggttacaagttcaagcctttctctttcgctttaatctga

SEQ ID NO: 2520 - DNA, 1185 bp, Arabidopsis thaliana
atgacaaaatcagttataagattttcccttctcttcacacttctcaccttcattgatgtctcgattagcgcctccaacgttttcaacgtcgttagcttcggtgccaaaccggacggagtcaccgattctaccggagcattcctcaaggcatggcaaggggcttgtgtctcagcatcttcagccacggtggtggtccccaaggggacatttctgttgaaggtaataacgtttggaggaccatgcaagagcaaaatcacatttcaagtggctggaaccgtcattgctccggaagattacaggacctttggcaattctggcttctggattctcttcaataaggttaacagattctcactggtcggtgggactttcgacgctcgagctaatgggttctggtcttgccggaaatctggtcagaattgtcctcccggtgttagatcaatatcgttcaactcggcaaaagacgtgatcataagtggagtgaaatccatgaacagccaggtcacccatatgaccctcaatggttgcaccaatgtggtcgtccgtaacgtcaagctagtggctcctggaaacagcccaaacaccgacggtttccacgttcagcactccaccggggtcacattcaccggaagcaccgttcagaccggagatgattgtgttgctatcggccctggtacccgcaacctcctcatcaccaaacttgcttgtggcccgggtcacggggttagcatagggagcttggcgaaggaactgaaagaagacggagtagagaacgtgacagtatcgagttcggtattcaccggatcacaaaacggcgtgagaataaagtcatgggcgaggccgagtaacggattcgttagaaccgtcttcttccaagacctagtcatgaagaacgtcgaaaacccaatcataatcgaccaaaactattgtcctactcacgaaggttgccctaatgagtattctggggtgaagataagccaagtgacatataagaacatacaaggaacgtcggcgacacaggaagcaatgaagctggtgtgtagcaagagcagtccatgcacaggaatcacattacaggacattaagcttacttacaacaaaggaactcctgctacttccttctgtttcaatgctgttgggaaaagtcttggtgttattcaacctactagttgtctaaaccgatga

SEQ ID NO: 2521 - DNA, 777 bp, Arabidopsis thaliana
atgggtcgtgttatcagagcacaacgtaagggagctggttccgtcttcaaatcccacactcaccaccgtaaaggtccggccaaattcaggagtctcgatttcggggagagaaatggttatctgaaaggtgttgtgacggagatcattcacgatccaggacgtggtgctccattggctcgtgtagctttccgtcatcctttccgattcaagaagcagaaggagcttttcgttgctgctgaaggtatgtataccggtcagtttctttactgtgggaagaaagctactctcgtcgtcggaaatgttcttcctctcagatctattcctgaaggagctgttatttgtaacgttgaacatcatgttggtgatcgtggtgttttcgctagagcttctggtgattacgccattgttatcgctcacaatcctgataacgacactagcaggattaagttgccatcgggttcgaagaagattgtgccaagtggatgcagggccatgattggtcaagttgcaggtggtggaagaacagagaagccgatgctcaaggctggtaacgcataccacaagtaccgtgtgaagagaaactgctggcctaaggttcgtggtgtggctatgaatccagttgagcatcctcacggaggaggtaaccatcaacatattggtcacgctagtactgttcgtcgtgatgcaccaccaggaaaaaaggttggtcttattgctgcaaggaggactggtcgtctcagaggtcaagctgctgctcttgcttccaaggcagactaa

SEQ ID NO: 2522 - DNA, 855 bp, Arabidopsis thaliana
atggcgagattagtgcgtgtggctagatcctcctccctctttggctttggtaaccgtttctactctacttcagccgaagctagccacgcgtcgtcgccttcgccgtttcttcacggcggcggagctagcagggttgctccgaaagatagaaatgttcagtgggtgtttttgggatgtcctggtgttggaaaaggaacttacgctagtagactatcaacccttctcggcgttcctcacatcgccaccggcgatctcgtccgtgaagagcttgcatcttctggacctctctctcaaaagctatcggagattgtaaatcagggaaaattggtttctgatgagatcattgtagacttattgtccaaaagacttgaggctggtgaagctagaggtgaatcagggtttatccttgatggctttcctcgtaccatgagacaagctgaaatactgggagatgtaactgacatcgatttggtggtgaatttgaagcttcctgaggaagttttggttgacaaatgccttggaaggagaacatgtagtcaatgtggcaagggttttaatgtagctcacatcaacttaaagggtgagaatggaagacctggaattagtatggatccacttctccctccacatcaatgtatgtcaaagcttgtcactcgagctgatgatactgaagaggtggtgaaagcaaggcttcgtatatacaatgaaacgagccagcctcttgaagaatactaccgtaccaagggaaagcttatggagtttgacttacctggaggcatcccagagtcatggccaaggctattggaagctttaaggcttgacgattacgaggagaaacagtctgtcgcagcataa

SEQ ID NO: 2523 - DNA, 663 bp, Arabidopsis thaliana
atggactcgagatgttttggcttcttctttactttgttatctctaaatgtgattgttcttgcttacgatcctgacacacttcaagatctctgcgttgcggatcgcacttcagggataaaagtgaatggtttcacatgtaaacccgaatcaaacatcaccgcttcagattttttcttcgccggaatcggaaaacccgccgtcgttaacaacacagtcgggtcagccgtcacgggagcaaacgtagagaagatcgcagggcttaacacgctcggagtctcactcgcgcgtatcgactacgctcccggaggtttaaacccgccgcacacgcatccacgcgccaccgaagtgatcttcgttttggaaggcgagcttgacgttggattcataacgacggcgaacaagctcttcgctaagacggtgaagaaaggagaagtgttcgtcttccctagaggattgattcattaccagaaaaacaacgacaaagcgaaaccggcgtcggtgatctctgcgttcaacagtcaattaccgggaacacaatcgatcgccgccacgctattcacagccactccggcgattccggatcacgttttaacgacgacgtttcaaatcggaacgaaagaaatcgaaaaaatcaaatctaagtttgctcccaagaaagtctaa

SEQ ID NO: 2524 - DNA, 831 bp, Arabidopsis thaliana
atggctaccaccactgcagcagcagcctcaggtatttttgggatccggattcaagatcctagacctggaaccggtagggtccaagcccggttcgggttcagtttcggaaaaaagaaaccggctccaccgccaaagaaatcaaggcaggtccaagacgatggagacagactagtttggttccccggcgcaaacccgccggaatggttggacggatcgatgatcggagaccgtggatttgatccgtttggtttaggtaaaccggctgagtatcttcagtacgatttcgatggacttgaccaaaaccttgccaagaacgtggcgggtgacatcatcgggatcatccaagaatcttcggagatcaaaccgacgccgtttcagccgtacactgaagtctttgggatccaacggttcagagaatgtgagctgatccatggaaggtgggccatgcttggcactctaggcgccatcgccgtagaggctcttacaggaattgcatggcaagacgccggaaaggtggaattggtggaaggatcatcgtatttgggacaaccattgccgttctcgttgacgacgttgatatggatagaagtgttagtggtcggatacattgagttccaacgtaactctgaactggatccagagaaacggatttacccgggtgggtattttgacccgttgggactcgcggctgatccagagaagttggatactttgaagctggctgagataaagcactctcgtctcgctatggtcgcatttctcatctttgctcttcaggcggcctttaccggcaaaggccctgtcagcttccttgccacctttaacaattag

SEQ ID NO: 2525 - DNA, 2982 bp, Arabidopsis thaliana
atggcttccgctgcggcggcttctccttctctctccttaaacccaacctctcatttccaacaccaaacttctctcgtcacctggcttaaacctcctccctcctccgccctcttccgccgcaaaacccttcctttcttcgaacgccactcacttccgatttcagcttcttcttcttcttcttcttcctcttctacttccctctccgttcacgagaaacccatttcgaattcggttcacttccacggcaatctcatcgagagcttcgagaatcaggactcttcatacgctggaaccattaaaggagcaagcttgattgaggagcttgagaatcctgtcgaaaggaatggactttctggtcggagaagactgtttatgcaagacccaccatggatctctgctttgtttctcaagggtttgagtaaaatggttgatcagactttgaaaatcgagcggaaagatatcgataagaggaaatttgattccttgaggagacgacaagtgaaggaagagactgaagcgtgggagaggatggttgatgagtacagagatttggagaaggagatgtgtgagaagaatctagctccgaatttgccttatgtgaaacatatgttcttgggatggtttcaacctttgaaagatgtgattgagagagagcagaagttgcagaagaataagagcaagaaggttagagcagcttatgctcctcatattgagcttttgcctgctgataaaatggcggttattgtgatgcataagatgatgggtttggttatgtctggacatgaagatgggtgtatccaagttgttcaagctgctgttagtattggcatagctattgagcaggaggtgaggattcataacttcttgaagagaactaggaagaacaatgcaggggactcacaagaggaattgaaagaaaagcaattgcttaggaaacgtgttaatagtttgattcgaaggaaaaggattattgacgcattaaaagtggtgaaaagtgaaggtaccaaaccatggggacgagctacacaagctaagcttggaagccgtctgctagaactattgatcgaagcagcttatgtgcaacctcccttgacccagtctggggactctatacccgagtttcgacctgcattcagacacaggtttaaaactgtgactaaatatccagggtctaagctggtgaggaggtatggagttattgaatgtgactcgctccttcttgcaggactagataaatctgctaagcatatgttaattccttatgttccgatgttagtgccaccaaagagatggaaaggatatgacaagggtggttacttgtttttaccttcctatatcatgcgtactcatggatccaaaaagcagcaagatgcactgaaagatattagtcacaagactgctcatagagtatttgaggcattggatacacttgggaataccaagtggagggtgaataggaatatacttgatgtggtagaaaggctctgggctgatggaggcaacattgcaggcttagttaatcgtgaagatgttcccatacccgaaaaaccatcctctgaggatcctgaagaactccagtcctggaaatggagtgctcgaaaggccaacaagattaacagagagaggcattctctaagatgtgatgttgagctcaaactttctgtggctagaaaaatgaaggacgaagaaggattctactaccctcacaatcttgactttagaggccgtgcatacccaatgcatcctcatctgaatcatctgagttctgatctttgccgtggaaccctggagtttgctgaaggacgaccacttggaaagtcaggcttgcattggctgaaaatacatttagcaaacctctatgcaggtggtgttgaaaagctctcacatgatgcccgtctggctttcgtggaaaaccatttggatgatataatggattcagctgaaaatcctatacatggaaaacgatggtggttaaaggctgaagatccgtttcagtgtttagctgcatgtgttattctgacacaagccttgaaaagcccttcaccttattcagtaatttcccacttgcctattcatcaggatgggtcgtgcaatggtctacagcattatgcagctttaggaagagatagttttgaagctgcggcagttaatctagttgcaggagaaaaaccagctgatgtctactctgaaatttcacggagagttcatgaaataatgaagaaggacagcagtaaggatcctgagtcaaacccaaccgccgcactggcaaagatccttatcactcaagtcgacaggaagctggtaaagcagacggtaatgacgtcagtatatggtgtcacctatgtaggggctcgtgaacaaataaaaagaagattagaagagaaaggtgttatcactgacgagagaatgttatttgctgctgcttgctattctgcaaaagtgacgctagctgcccttggagagatatttgaagcggcacgtgccattatgagttggcttggtgattgtgcaaagataattgcttccgataatcatccagtgcgatggatcacccctcttgggcttcctgttgtgcaaccctattgcagaagtgaaagacatctgataagaacatctcttcaggttttggctctgcagcgagagggtaacacggtcgatgttaggaaacaaagaactgcatttcctcccaactttgtgcactcgctggacggcactcacatgatgatgactgctgttgcatgtcgagaggccggcctaaactttgcaggtgtgcatgactcatactggacccatgcatgtgacgttgacacaatgaacagaatacttagagagaaattcgttgagctttacaacacaccgatccttgaagatttgctccaaagtttccaagaatcatacccgaatctcgtgtttcctccagtaccaaagagaggtgatttcgatttaaaggaagttctcaaatcacagtacttcttcaactga

SEQ ID NO: 2526 - DNA, 3204 bp, Arabidopsis thaliana
atggctaatctgttgcaaaggcttcgtagacgaaccgggccaaagccagattatattgaagacaagttggatgaatacattcgtgaagaacaagttgaagaaacaggcggaagtaaccaggattgtcctcttggcgagattgaaaagattttggaccgtgaatggcgtcctactgcatctaacaatccgaattcttctgacaacgggacaccaaccctagttgtcgtgaaacaatatcttgtgaagtggaaggggttatcgtacttgcactgctcttgggtgcccgagcaggagttcgagaaggcttacaagtcccatcctcatttaaaactaaaattaagggtgaccaggtttaacgctgctatggacgtattcatcgctgagaacggagctcatgagtttatcgccattcgtcctgaatggaaaactgttgaccggattattgcttgccgggaaggagatgatggggaggagtatctggtgaagtacaaagaactttcttacagaaatagttactgggaatctgaatctgacatctcagatttccagaatgaaatccaaaggtttaaggatataaactctagctctcgtagagataaatatgtcgaaaatgagagaaatcgagaggaattcaaacagtttgatcttactcctgaatttcttacaggcacattgcatacataccagctcgaagggctgaatttcctaaggtattcatggtccaagaaaaccaatgtaatccttgcggatgaaatgggactaggcaaaactattcagagcattgccttcttggcctctttgttcgaggaaaacttatctcctcatctagttgttgctcctctctcaaccatccgtaactgggagagggaatttgccacctgggcaccacatatgaatgtggttatgtacactggggattcggaagcacgtgatgttatatgggaacatgagttctacttctctgaagggcgtaaaaggttaaagaaagacgtgctcaaggataaggtgcccccaaagaaggagctcattttgcgtgttgatatgagcagccagcaaaaagaagtgtacaaagctgttattaccaataattatcaagtcttgacaaagaaacgagatgctaaaatatctaacgtgctaatgaaattacgccaagtttgctctcatccgtatctgttaccagactttgagccaagatttgaagacgcaaatgaagcttttacaaaactattggaagcttccggaaagttgcaactgttagacaaaatgatggtcaaactcaaagagcaggggcacagagtgctaatctatacccaattccaacacaccctttaccttttggaagactacttcactttcaagaattggaattatgaacggattgatggaaagatcagtggacctgagaggcaagtaagaatagatcggtttaatgcagaaaactcgaaccggttctgttttttgctcagtacaagagctggtggaatagggataaaccttgcaacagctgatacagtcatcatttatgacagtgattggaatcctcatgctgatctccaggctatggctagagttcatcggcttggccaaacaaataaggtaatgatctacagactgattcacaaaggtactgtagaagaacggatgatggagataaccaagaacaagatgcttctagagcatctcgtcgtgggaaaacaacatctttgtcaggacgagttagatgacatcatcaaatatggttccaaggaacttttctctgaagagaatgatgaagcagggaggtctggaaaaatccattacgatgatgctgctatcgaacagttgctagatcgtaatcatgtagatgctgtggaggtctcactggatgatgaggaggaaactgattttttaaagaatttcaaggtggctagttttgagtatgtagatgatgaaaatgaggctgcagcattagaggaggcacaagctatagaaaacaattcttcagtaagaaatgctgatagaacaagtcactggaaagatttgctgaaagacaaatatgaagtgcaacaagctgaggagctcagtgctcttggaaagaggaagagaaacggcaagcaggtgatgtatgctgaagatgatcttgatggtttagaagaaatctctgatgaggaggacgaatattgtcttgatgatttaaaagtgacctctgatgaggaggaggaagcagatgaacccgaagcagctcgacagagaaagccgaggacggttacaaggccttacagaaaaagggctcgcgataattcggaggaaatacctttgatggaaggcgaagggagatatctcatggtgctgggatttaacgagactgagagggatatatttttacgtacgtttaagaggtatggaatcttatttttgaaacacattgccgaaaaccctaccgataattctacaaattttaaagttattacggcaatggtctatgcagatggagttcccaaagaagggataagcagtgacgagctactagtgagcatgacttttatgatgctagtaaaggagaagtgtcaatttttggacaaccatccgacagcacctgttttctctaactacgtcatcagtaagtacaatttgagaaatggagcattttctaaggaagaacatgataggatactgattcctgctgtttccaagcatggctatggtagatgggtggccatcgttgaagacgaagagatagggttccaagaggttgcctgcaaagacctgaatatccctttccctcctgatactaaatctgctcgtaaaagaatttgtgaccatgtgggaaaacgggttaagaagatggaggatgccataaagtatgagtacgcagaaaagatacttgctgaacaagcaaaagctgaaacaaagggaacaagctttgttgatgcagaaaaagaaatgcttaagaatgatcccatcacttcaaaaaaaaattctgcaactgccgttgacaacaagcaaggcagagttgaaatggctcaatcatacgatcagagtgttaatgagaagtcaggtgagtcattccagacatatttagatattcaaccgctgaatcgaatgccgagggagagctttaagcctctggaacctatcaatgaggaaataagcactaggctaagcgttgggacagatcatgatgtagagatggatgcagcggataacatcattgtgctggattga

SEQ ID NO: 2527 - DNA, 4323 bp, Arabidopsis thaliana
atggcgaattcaaggatttatccgcaattcttccacacacttgttcctagcttccacactcacttgatgattcctgaagacttcttctcagagtatatcgaaggaagaagcgtcgcagagctgaaattggacttttcagacaaatcttgggaagtgaagttgtctgatcggagaatcactgacggctgggaagagtttgtggtggctaatgattttcgtatcggcgatgttgtcgcttttagatatgttggaaatttggtgttccatgtttctaatttaggacctaattactatgagattgaacacaatgatgagcttcccaaagagaagaaagcgaagacgaacagtgaagaagcagatgcagtttcttcttcttcatcagcagacaagtcatgttttatggccattatcacagctttagatctaacgacagatacactgtatcttccactacattttacaagcgcaaatggtcttacacgaaaaaaccgggagattattttaacagatggaggggaaagatcaagggtattggatctgaggttcgacgaatcatctggtactttttatatcagccggggttggagaaatttctgtgatgaaaatggacaaaaagcaggaggtttctttctgtttaaactagtgggaaaaggtgaaacgctggtgctcagtttctgtcctacagaatctatcaatggggaagagaacataacaagggaggacagtaaagacgagtgcagctcgttggactcattgatgaatatagtagaaaaaaagaagtatattccgaaaccaagaggttcaccatattcatcatattcaccaagtcataaacaattcgtaacatttacgcttccaccggattatgctagaattggaaaattgagtctttcggcgcctttcgttagggaaaatggcatcaacaagcctggggagatatgtcttttggataaacatggtagaaagtggttgacaagtcttctgctggacagtaaaggaacaatgtctttgggaaagggttggaaagagtttgttaaagcaaacagcttagagacgggcttcacactcaagttgatatgggaagaaacaactcctgtgcttagtttgtgtagtccagaatctaacagtgacagagagcaggaagagatttcaaaagctatcgagaaacattctcttttcatagatcctagcaacagggacaaaatcagcaacaatgacaaagaggagaacatgtcatgggagagaaagaaggatcatctgaaaagtagagattcaactctatcaagccaaaaacaatttgtaacaataacaattacaccttccagtgatagattggtaagtttatcaaatgactcttgtttagtggttgttagtttattgtactttgatatgcgtctcccaaaggtattcacgagggagaatggcatcaacaagccggggaggattactctgttgggaaaagacggtataaagcagcagacgaatttgttattcgacaaagcaaatggtgccatgtctttgggacacggctggaaagattttgttaaagataatggcttaaagacaggtgactccttcacgctaaagttgatttgggaagaccaaactcctgttcttagcttgtgtcctgcagactgtagcattgacagagaagcaggaggagggcgatctgaaacaaaccagaaaaagtctcttccaatagaacctagcacatgtaaaaaaatcaggaaagacgtgaacatcaaagatgacaacagcaaagagaaaaatgacaaagaagagagcaaatcagtggatggagagaggaaatatctgagagggacatatttaactccatcaagccaaaaacactttgtgacattaacaattacaccttcctctataaaaaaagatagacttattctttccccacaatttgcaaggaagaacaatattgacaagcctggaatgatatatctgctggatacagatggtacaaagtggctgataagccttcaacgagataagaaaggaacaatgagtttgggaaaaggttggaaagaatttgctgaagcaaatgactttaagttaggcgaatcctttacgatggagttagtatgggaagacacaactcctatgctcagtttgttacgtaccgagtttaggagttcaaaagctaacgagaaagagtcaatttcctcagaacataaaaccagagaatcatccccaacaatcaaaaaccgaatcgtgactccagcactcacacctgaagatgttaaagcctgtaaattggtaacttcatcaaactactcttgtttttcagagattctttcagcgcaatttgcaagggagaacaatattaaccagcctggaacgatatatctattggatacagatggtaggaagtggctgacaacggttaaacgggacaagaaaggaacaatgagtttgggaaagggttggaaagagtttgctgatacaaaagacttaaagtcaggcgactcctttacgatggagttaatatgggaagacacaaatcctgtgctcagtttgttacgtacaaagtttagcagttctaaatctaacaaggaagagtccatttttttagaaccaaaaagtagagattcatcctccccaacaatcgtaaacagattcgtgacattagcacttacaccagaagatgttacagcctgtaaactgattcttccaagtcagttcatgaaggctaatggcatcaacaacaaacttgggaagataactcttttgggtgaaaacggagtcgaatggccgggatatatgttgtcgctagatggaactctcgctttaggaaatggttgggaaggcttttgtgaggctaatggcgtgaagttaggacagacttttactttggagtttgttaatgaacaagatacaacaacaactccgagaatacctgtagccttcttcttgaagaatatagaaggaagatatgagcagaagacggcggagctgagatcagatgcgtcaaagataacttgggaagtgaagatagatggacagagactcactgacggttggaaagagtttgctctctcacatgatcttcgaatcggtgacattgttgttttcagacaagagagagatatgtctttccacgttacaatgttgggacctagttgttgtgagatccaatatggttcgtgttcagacgaggagagaaacctcgagaagaagaagaatccaaatggagaagcaaagtcttcttcactagatccttcttgtttttcggctaatgtggcgccttcgagtctacgttatgacttaatgctttttccaatgggttttgtgagggaaaatggtgtagtcggatctggaaagattgttctgatgaatgaaaagggcagatcatggaattttaacttgagacaaaagccatcatgcggaacagtttatgttagaggagggtgggtgagtttttgtgatgccaatggacttcaagctggagatatctacactttcaaactgatcaaaagaggaggaactcttgttctacgtttgttacccaaaggggcagagtcttgttcactagatccctcttgttttgtggctaatgttgcgccttcgactctacgctatgacacactgtatcttccaaagcgttttatgagggaaaatggtgtagacaaaagacgtggagagatgattctgatgaatgaaaagggcaaatcatggactttagatttgaaactaaagaaatcatgcggaacttccctcatcagacgaggatggagaagtttctgtagtgccaatggactaagagctggaagtatcattactttcaaactgattaagaaaagtggaactcttgttctatgtttgctctccaacgagccagaagaagaagtgtgctcagaagctaatgaagtagagtctctttcgacagatcaagaaagccatgaagagagtagccacaacgagaaaatctcaagaagaaaggaaaagaagggtagaatgatatggaaagcttcgtcttcaccatccgaaaaccgatttgtgacattaaatcttacaccttataacatcctacgttctgcactgcgtcttccgatacccttcacgaggatgaatggtatcaatgaagaaactaaaatgactctgttggataaacatggtatgaagtggttaacgactctgcggttggtggactacaaaagaaaaagactgggaatggtaggaggctggaaaggattcatccaagctaacggtgtgaaggcaaacgaatccatcatgttggaactgatttgggaagaagaaacaagttgcgtccttaagttctgctccaaggtgaagctagcaatcaaatga

SEQ ID NO: 2528 - DNA, 546 bp, Arabidopsis thaliana
atggaagggggagaagagtttcaagaagaagaagtgtggtcagttttgagagaaagtgaaactcaaggtcctgaaatgaaaatgtccaaaagtaacaatctcttctcagcctcttcctcatcttctgcgaggtacattcctaaaggcaacgaggtctctggaggggcaaaacagtcatctgctccaatgaatattcctgactggtccaaggtttatgggtattcaaagaagaacacaagcagccacttgcattcatgggccattgacgatgatgatgaaggctcaatggttcctccacatgagttagtagcaaaaagacttgcaagaacgcagatctcatcattctctatgtgcgaaggaatcggaagaacgctcaaaggaagagatctcagcaaaacaagaaacgctgtcttaacaagaactggtttttggatttttttagataagtatgatgacgatgaggatgacttgtcaatcccatgcatgggcccataccatttttctcatgttatgtttgtagttctcaatggtcttttaactctttag

SEQ ID NO: 2529 - DNA, 957 bp, Arabidopsis thaliana
atggagatctgcacttacttcaaatcacaacccacttggctcctcattctcttcgttctggggtcaatctcaatcttcaaattcatcttcaccctcctcagatctttctacatctacttcctccgaccatccaaaaacctccgccgatacggttcatgggcaatcatcaccggaccaacagacggaatcggtaaagctttcgcctttcagttagcccagaaaggtcttaaccttatactcgttgctcgtaacccagacaagctcaaagatgtctctgattccatcagatctaagtatagtcaaactcagatcttgaccgttgtgatggatttctctggagatattgatgaaggtgtgaaacggattaaggagagtattgaaggattagatgttgggattttgattaataatgctggcatgtcttatccttatgctaagtattttcatgaggttgatgaagagttgatcaataacttgattaagatcaatgttgaaggaactactaaagttactcaagctgtgttgcctaatatgcttaagaggaagaaaggtgctattattaatatgggttctggtgctgctgctcttattccttcttatcctttttactctgtttatgctggtgctaaaacgtacgtggatcagttcacaaagtgtctacatgttgagtataagaagagtgggattgatgttcaatgccaggttcccttgtatgttgcaacaaagatgacaaaaataagaagagcatccttcttagttgcatcaccagagggttacgcaaaggcagcactgcgttttgtaggctatgaagcacaatgcacaccgtactggcctcacgctctcatgggtgcagttgtctctgcattgcccgaaagcgtttttgaatcatttaacatcaagagatgcctccagatccggaagaagggtctccaaaaagactccatgaagaaagaatga

SEQ ID NO: 2530 - DNA, 3255 bp, Arabidopsis thaliana
atgaacaccggtggtcggttaatcgccggttctcacaacaggaatgagtttgtcctcattaatgccgatgagaatgcccgaataagatcagtccaagagctgagtggacagacatgtcaaatctgcagagatgagatcgaattgactgttgatggagaaccgtttgtggcatgtaacgaatgtgcattccctgtgtgtagaccttgctatgagtacgaaagacgagaaggcaatcaagcttgtccacagtgcaaaacccgtttcaaacgtcttaaaggaagtccaagagttgaaggtgatgaagaggaagatgacattgatgatttagacaatgagtttgagtatggaaataatgggattggatttgatcaggtttctgaaggtatgtcaatctctcgtcgcaactccggtttcccacaatctgatttggattcagctccacctggctctcagattccattgctgacttacggcgacgaggacgttgagatttcttctgatagacatgctcttattgttcctccttcacttggtggtcatggcaatagagttcatcctgtttctctttctgacccgaccgtggctgcacatccaaggcctatggtacctcagaaagatcttgcggtttatggttatggaagtgtcgcttggaaagatcggatggaggaatggaagagaaagcagaatgagaaacttcaggttgttaggcatgaaggagatcctgattttgaagatggtgatgatgctgattttccaatgatggatgagggaaggcagccattgtctaggaagataccaatcaaatcgagcaagataaatccttaccggatgttaattgtgctacgtcttgtgattcttggtctcttctttcactaccgtattcttcaccccgtcaaagatgcatatgctttgtggcttatttctgttatatgtgagatatggtttgctgtttcatgggttcttgatcagttccctaaatggtaccctatcgagcgagaaacgtacttggaccgactctcattaagatatgagaaagaagggaaaccgtcgggactatcccctgtggatgtatttgttagtacagtggatccattgaaagagcctccgcttattactgcaaatactgtcttgtctattcttgctgttgattatcctgtcgataaggttgcttgttacgtatctgatgatggtgctgctatgcttactttcgaagctctttctgagaccgctgaattcgcaaggaaatgggttcctttctgcaagaaatattgtattgagcctcgtgctcccgaatggtatttctgccataaaatggactacttgaagaataaagttcatcccgcatttgttagggagcggcgagccatgaagagagattatgaagaattcaaagtaaagatcaatgctttagtagcaacagcacagaaagtgcctgaggatggttggactatgcaagacggtacaccttggcccggtaatagtgtgcgagatcatcctggcatgattcaggtcttccttggaagtgacggtgttcgtgatgtcgaaaacaacgagttgcctcgattagtttacgtttctcgtgagaagagacccggatttgatcaccataagaaggctggagctatgaattccctgatacgagtctctggggttctatcaaatgctccttaccttctgaatgtcgattgtgatcactacatcaacaatagcaaagctcttagagaagcaatgtgtttcatgatggatcctcagtcaggaaagaaaatctgttatgttcagttccctcaaaggttcgatgggattgataggcacgatcgatactcaaatcgcaatgttgtgttctttgatatcaatatgaaaggtttggatgggctacaagggcctatatacgtcggtacaggttgtgttttcaggaggcaagcgctttacggatttgatgcaccgaagaagaagaagggcccacgtaagacatgcaattgctggccaaaatggtgtctcctatgttttggttcaagaaagaatcgtaaagcaaagacagtggctgcggataagaagaagaagaatagggaagcgtcaaagcagatccacgcattagaaaatatcgaagagggccgcgtcactaaaggttctaacgtagaacagtcaaccgaggcaatgcaaatgaagttggagaagaaatttgggcagtctcctgtatttgttgcatctgcgcgtatggagaatggtgggatggctagaaacgcaagcccggcttgtctgcttaaagaagccatccaagtcattagttgcggatatgaagataaaactgaatggggaaaagagattgggtggatctatggttctgttaccgaagatattcttacgggttttaagatgcattctcatggttggagatctgtttattgtacaccaaagttagcggctttcaaaggatcagctccaatcaatctttcggatcgtctccatcaagttcttcgatgggcgcttgggtcggttgagattttcttgagtaggcattgtcctatttggtatggttatggaggtgggttgaaatggcttgagcggttgtcctacattaactctgtggtttacccgtggacctctctaccgctcatcgtttactgttctctccctgccatctgtcttctcactggaaaattcatcgttcccgagattagcaactatgcgagtatcctcttcatggcgctcttctcgtcgattgcaataacgggtattctcgagatgcaatggggcaaagttgggatcgatgattggtggagaaacgaacagttttgggtcattggaggtgtttctgcgcatctgtttgctctcttccaaggtctcctcaaggttcttgctggtgtcgacactaacttcacagtcacatcaaaagcagctgatgatggagagttctctgacctttacctcttcaaatggacttcacttctcatccctccaatgactctactcatcataaacgtcattggagtcatagtcggagtctctgatgccatcagcaatggatacgactcgtggggaccgcttttcggaagactgttctttgcactttgggtcatcattcatctttacccgttccttaaaggtttgcttgggaaacaagatagaatgccaaccattattgtcgtctggtccatcctcctggcctcgattcttacacttctttgggtccgggttaatccgtttgtggcgaaaggcggtcctattctcgagatctgtggtttagactgcttgtga

SEQ ID NO: 2531 - DNA, 1056 bp, Arabidopsis thaliana
atggagtcaactgatcgttcaagtcaagcaaaagctttcgacgaggccaaaatcggtgtgaaagggcttgtggattcaggaatcacagagattccggccctgttccgtgcaacgccggctactcttgcaagcctgaagtcgccaccacctccaaagcatctcaccatccctaccgttgatctcaaaggagcaagcgtggtggagaagatcggagaagctgctgagaaatggggattattccatttggtgaatcacggcatcccggtggaggttctggagaggatgattcaagggattcgcgggtttcacgagcaagaacctgaagccaagaaacgcttctactctagggatcacactagagacgtgctttactttagcaatcatgatctccaaaactccgaggccgccagttggagagacactctcggttgttataccgcacccgagcctcccagattagaggatttgcccgcggtttgcggggagattatgctggagtactcaaaggaaataatgagtttaggtgaaaggctatttgagcttctatcagaggctttggggttgaactctcatcatctcaaggacatggactgtgccaagtctcaatatatggttggccaacactacccaccttgccctcagcctgaccttactataggcataaacaagcacaccgatatttcctttctcaccgttcttcttcaagacaatgttggagggcttcaagttttccatgaacagtattggattgatgttactcctgtccctggggctctagtcattaacattggagattttcttcagcttataaccaatgataagttcataagcgcggagcatagggtgatagccaatggatcttctgaaccgcggacttccgtggcaattgttttcagcacgttcatgagggcgtattctcgagtatatgggccaatcaaagatctcctgtctgcagaaaaccctgctaagtatagagactgcaccctcaccgaattttcaaccatcttcagctcaaaaacgctcgatgctcctaagttacaccatttcaaaatctaa

SEQ ID NO: 2532 - DNA, 2655 bp, Arabidopsis thaliana
atgaagtcttcttacggttcttcctctaatgatctccacgcttttgtcaatgagatcaagggagaaattcagttgtccaacattaatcttgatccttactcatttgtctctccttccgcttacgacacggcttggttatccatgatcgaagaagacatcaacgtagatgataatgagcttaaaccgatgttccaaggttgtctagattggattatgtgcaatcaaaatgccagagaaggtttctggatgaactccaccagttatacaacggtggctgatggcagagacgaagacggcgaaaaggacatgtgtattctaacttccactcttgcttgtgttgtagcacttcagaaatggaatattgggtgttttcatctccacaaagggacgagatatatcgaaagaaatacggagatgataattgggaaatacatcaacgaagaaggatcttatcctcgttggttcgctatcaaattcacaggaatcctagagcttgctcaaaaacttggcttacactttgttttctctagtcgctgtatcgaaatgatcaaagggatgttttatcaacgccaagagattatccaaagagaaaaattggtacatgactgtaattataaacctttactggcctatctagaggtgttgccatcgaaattatatgtcacaaatcaagaagacatcattgtgaagagtctcgacagtatggatggctctttgtttcagtcaccttcagcaactgcatcagcgtttatgctcactcgcaacacaaaatgtctagcttatcttcaaaatctcgttcaaaaatgccctaatggagtgccacaaaagtaccctctcaatgaagatctcataaaactctccatggttaatctaatcgagagtactggtttaggagagttctttggtatagagattgaacacgttctggaacaagtttacagccgctacgaagaaaaagattttgagagaatgcccatgagttatctggcggatcaattgcacaaagactctcttgcatttcgaatgttaagaatgcatggtcgggatgtttcacctagaagcttttgctggttcttgaatgatcaagaaactcgaaatcatttagaaagaaatatagactctttcttgcttgtgatcctaagtgtttacagagccacggatctcatgtttccgggagagcatgatcttcaagaagcaagagaatatactcggaatttactcgagaaacgtcggtccatcaaagaaaaaatggtaccaatatatctcaataagattatgcatgaattaagtactccatggatagctcgactcaaacaccttgaccataggatgtggattgaggacaagaactcaaatgttttatccatggaaaaagcctcttttctaagactacatagttcgtatagcgacaaactgactcatcttgctgcaagaaacttcgagtttcaacaagccaaatactgtcgcgagctggaggaactgacaatgtgggtaaagaaatggggacttagtgatattggtttcggtagagagaagacaacatattgttactttgcaactgtgacttcgttgccctatgaatatgccattaaatttggtaagcttgcagcaaaaactgctatcctcatcacaattgccgatgacttcttcgatgaaaaaggttccttcaatgacttggaaggtcttactaaagcagttttaagatgggaaggagaagagcttaaaagttacggcaatatcatttttagagcacttgatgatattgtaagagagactgcaaatacttgtcgtacgcaccacaaaaccgacataattgtccatcttcgcaacatctggggtgaaacatttgagtcgtggctacgtgaagctgaatggagtaaaaagggacacacatcgtcaatggacgaatatattcgaaacggaatgatctcaatcgcagcacacaccattgctctttccatctcatgtctcatggaaccttgttttccccacaacaaactcaaaccgggaaattacgatagcataactacattgctcatgatcatacctcgacttttaaatgacctacaaagttatcagaaggaacaagaacaagggaagatgaactccgtgctgctccacatgaagaatcatccaggtctggagattgaggactcgatcgctcatatcgaaaagattatcgattcaaaaaggaaagagtttctggagcatgtactagttgatggactaagcgatttgccaaaaccgtgcaaggagattcacatgtcttgttgtaaagtcttcgagatgttttttaacaagaagaaccgttatgattcaaacacggagatgcttcatgacattaagaaggctctctatgatcccatcaatgtttatgaactatcagagatggagcctatgccactgatggcacatggtgatgaatatatgattcttcctttgcttttgaacagtttgccaaatattcttgaatttaagaggaaggacggatacggagcaatgaaaacatctatgtgctttggaagaagttatcgtgttaataaacgcgttatggcctcacagcttgatgatcaacataagcctctcaagattgttgcgtcgcagcggaaaccggtaccaatgatgcaatcgatattcgcaccatgcttctactaa

SEQ ID NO: 2533 - DNA, 846 bp, Arabidopsis thaliana
atggcggtatcgtacaatgcattagctcagtctttagcgagaagtagctgcttcatccccaaaccttattcctttagagatactaagctgagaagcagatccaatgtcgtattcgcgtgcaatgataataagaacattgctcttcaagctaaggtagataacttgttggaccgcattaaatgggatgacaaaggattagctgtggcaatagcacaaaacgttgatacgggagcagtattgatgcaaggctttgttaatagggaggccctctccacaaccatcagttctcggaaagctacattctttagtcgatcaagatctaccttatggactaagggagagacatccaataacttcatcaatattcttgatgtgtatgttgattgtgatcgtgattcgattatttaccttggaacacctgatggacctacctgtcacacaggggaagagacttgttactacacatcggtttttgatcaattaaacaatgatgaggcttcaggaaacaagctagcattaacaacattgtactcgctagaatcaatcatttccaagcggaaagaagaatcaacagttcctcaagaaggtaaaccatcatggactcgacggttgttgacggatgacgctctgctttgctcaaagatcagggaagaagctgacgagttatgcagaacactggaggataatgaggaagtttcaagaacaccatcagagatggctgatgttttataccacgcaatggtgcttctatctaaaaggggtgtgaagatggaagatgttcttgaagttcttaggaaacgcttctctcaatctggaatcgaggagaagcaaaaccgtacaaagtaa

SEQ ID NO: 2534 - DNA, 1320 bp, Arabidopsis thaliana
atgaagtcttcttcttctcagagctacgatgttttccccaacttcagaggggaagatgtccgccactcattagtcagccaccttcgtaaggaacttgatcgcaaattcatcaatacattcaacgacaacaggatcgaaagaagccgcaaaataaccccagagctgttattggctatagaaaactcaaggatctcacttgtcgtcttctctaaaaactatgcttcttccacgtggtgcttagatgaattggtgaagatccaagagtgctatgagaaattggatcaaatggtgattcctattttctacaaagtagatccttctcatgttagaaaacagaccggagagtttggcatggtctttggggagacctgcaagggcagaacagagaatgagaagcgaaaatggatgcgagctctagcagaggtagcacatctagccggagaagatcttcggaactggcgtagcgaagcagaaatgcttgaaaatatcgccaaggatgtttcaaacaaactcttccccccatcaaataatttcagtgacttcgtcgggattgaagctcatatagaggcattgatatcaatgttgcgcttcgactccaagaaagcgcgaatgatagggatttgtgggccttctgaaactggtaagactactataggaagagctttatacagcagactcaaaagcgacttccaccatcgggctttcgtagcatataagagaaaaatacggagcgactatgaccagaagctgtattgggaagaacaatttctatcagaaattctttgtcagaaggatataaagatagaggaatgtggtgcggtggaacaacgactaaagcacacgaaagttcttattgttcttgatgatgttgatgatatagagctactaaaaacgttggtaggacgtatcagatggtttggatctgagagcaaaattgttgtgattactcaaaaaagggaacttctcaaggctcacaacattgcacatgtttatgaagtgggattcccatcagaagaactggctcatcaaatgttttgtcgatatgcttttgggaaaaactctccacctcatggtttcaacgagcttgcagatgaagctgcaaagattgccggtaatcgtcctaaagctctcaagtacgttggttcgtcttttagaagactagacaaggaacaatgggtgaagatgctatcggagttccgtagtaatgggaataaactaaaaatcagctatgatgagttagatggtaaaggtcaagattacgttgcgtgtttaaccaatggtgagaaaaaatcaatattaaaaattattgcatggagatag

SEQ ID NO: 2535 - DNA, 2313 bp, Arabidopsis thaliana
atgaatgccaatgcatgcaaagacaatccaacaatgcgagggttattacgagcttcatcgcttcttctctgtggtgttattctgattcagctgcttgctgctcaaatccatgctcaaagtaaaaaacctaaaagtccatggccaacgctcactggtgatcctcctcttgtgatagctcgtggtggattctctggattgttcccagattcgagttacgatgcttacaatttcgcaattctgacaagtgtaccagatgctgttctatggtgtgatgttcagctaaccaaagatgctcttggtatttgcttccctgatttaacaatgagaaattcttcatctattgaagctgtttaccctactcgacaaaaatcttacccggttaacggagttcctacttccggttggttcaccattgatttctccttgaaagatctcaaagatgttaacttgatccgaggtattttatctcggtcagaaaagttcgatggtaattctaacccgattatgacggttcaaagcgtatccacgcagatgaaaccatcattcttctggttaaatgttcagcacgatgcgttctacgcgcagcacaatttgagcatgagcagttttctggttgcagcttcaaaaactgttctcattgacttcatctcttcccctgaagtgaacttctttaagaaaattgctggtcggttcgggcgtaatggaccaagtcttgtgttccggtttcttggtcaagacgagttcgagccaacgacaaacagaacttacggctctatcttgagtaacttgacttttgtcaagacgtttgcttcagggattcttgtccccaagtcttacatattgccacttgatgaccagcagtacttgcttcctcatacatccttggttcaagatgctcacaaagcaggattagaagtttttgtgtcaggttttgcaaatgatattgatattgcacacgactacagtttcgatccagtctctgagtatctatcttttgtggacaatggcaacttctctgttgatggtgtgctctctgattttcccataactgcatctgcatcccttgattgcttctcccacgttggcagaaacgctacaaaacaagtggattttcttgttataaccaaagatggtgcgagtggagactatcctggatgtacagacttggcatataagaaggcaatcaaagatggtgctgatgtaatcgattgctcggtccaattgtccagcgatggtacacccttttgcttaagttcgatcgatctcgggaacagcacgacggtctccctaactgctttcagaaaccgttcaacaactgttcctgagttgggctcacttggtgcaatatacactttcagtctcacatgggctgagatccagaccttgactcctgctatttcaaacccctacagagtaaccagcctgtttaggaatccaaaacagaaaaatgctgggaagcttttctcactttctgatttcctaagcttggcaaaaaactccacctctctctccggtgttttgatcagtgtagagaatgcggcatacctgagagaggagcaagggctcgacgttgtcaaagcggttcttgatacactcacacagactggctacagcaatagtacagccacaaaggtcatgattcagtcaacaaacagctcggttctagttgacttcaagaagcagagccagtacgagactgtctacaaagttgaagaaaacatccgtgatattctcgactctgctattgaagacataaagaaattcgctgatgctgttgtgatccaaaaattatcagtctttcctgtcgctcagtcgttcatcacaacgcaaaccaatgttgtggagaagctgcagaagtctcagctcccagtttatgtggaactgtttcagaatgagtttttatctcaaccatatgacttctttgctgatgcaaccgttgagataaactcttatatcactggagccggtataaatggaaccatcaccgagttcccttttacagctgcaagatacaaaaggaatctatgtttgggcagaaaagaaactataccttacatggcccctgcccaacccggtgccctcttaacccttgtgagtcctactgcctttcctccagccgaagctccaaacccggttttcacagatgctgatgtcactgagccaccactacctccggttaccgcaaaagccccaacctcatcccctggaaccccatcaaccaatgcacaagcacctagtggacaaacccgaatcactctatctcttctactttctgttttcgcaatggttcttgcctctcttctacttctgtga

SEQ ID NO: 2536 - DNA, 2562 bp, Arabidopsis thaliana
atggggactggagattctgcttcgagactgattctctggttctgcttagggtttttgattctaggtgttggatttgtgcaatgtggagttacttatgaccggaaagcacttctcattaatggacagagacgaatcctcttctctggctccatacattaccctcgaagcactcctgatatgtgggaagatttgattcagaaggcgaaagatggaggcattgatgtgattgagacgtatgtgttctggaatcttcatgagccttctcctggaaaatacgattttgaagggagaaatgatttggtgagattcgtgaagacgattcacaaagctggtttatatgctcatcttcgaattggaccttatgtttgcgccgagtggaattttggaggattccctgtttggctcaagtatgttcctggaatcagcttcagaacagataatgagccttttaagagagctatgaaaggattcacagagagaatagttgagctgatgaagagtgagaacttgttcgagtcccagggtggtcccattatcctttctcagattgagaatgagtatggaagacaagggcagttattgggcgctgaaggtcacaactacatgacatgggcagctaaaatggctatagcaactgagactggtgtcccgtgggtcatgtgcaaagaagacgatgcccctgaccctgtgataaacacatgtaacggtttctactgtgattcatttgctccgaacaagccatacaagcctttgatatggacagaggcatggagcggctggttcactgagttcggtgggccaatgcaccatagaccagttcaggatctggcgtttggtgttgcacgtttcatacaaaaaggaggatcttttgttaactactacatgtatcatggaggaactaactttggaagaacagccggaggtccatttgtcaccaccagctatgattatgatgctccgatcgacgaatatggtttaatcagacaacctaaatatggtcacctaaaggaactccacagagctatcaagatgtgtgagaaggctctggtgtcagctgatcccgttgttacatcaataggaaacaagcaacaagctcatgtatactctgcagaatcaggagattgttcggctttcctagctaactatgatacagaatcggcagcaagagttttgtttaacaacgttcattataacttacctccttggtcaatcagtattcttccagactgtagaaatgcagtcttcaatactgcaaaggttggagttcaaacatcccagatggaaatgttgcctacagacacaaagaatttccagtgggagagttatttggaagatctttcttctctagatgacagctccacattcaccactcacggactcttggagcagataaatgtcacgcgtgacacaagcgattatctttggtacatgacgagtgttgatatcggtgacagtgaatcattcttgcatggaggagagctaccaactctcattattcaatctacaggccatgccgtgcatatatttgtcaatggacagctttcaggttctgcctttggaacaaggcaaaacaggagatttacttatcagggaaagatcaatctgcattctggaactaacagaattgcgttgctgagtgttgctgttggattaccaaatgtgggtggacactttgagtcatggaatactggaatcttgggtccggtggcattgcatgggttgagtcaagggaaaatggatttgtcatggcagaaatggacataccaggtgggactgaaaggtgaagctatgaatcttgcatttccaaccaacactccctctattggatggatggatgcgtccttaactgtacaaaagcctcagcctttgacatggcacaagacttattttgatgcgcccgaaggaaatgagccgcttgctttggacatggaaggaatgggaaaaggtcagatttgggtgaacggtgagagcatcggaagatactggacagcatttgcgactggtgactgcagtcattgtagctacactggaacatataaaccgaacaaatgccaaaccggctgtggtcaacctacacaaaggtggtaccatgtgccgagagcttggttaaagccgagccaaaatctgttggtcatattcgaggagcttggtggaaacccatcaactgtctctttggtcaaaagatcagtatcaggagtttgtgctgaagtttctgaataccacccgaatatcaagaactggcaaatcgaaagctacggaaagggacagacatttcatagacccaaggttcatttgaaatgtagtccaggtcaagcaattgcatccatcaaatttgcaagctttggaactcctttaggaacctgcgggagttaccaacaaggagagtgtcacgcagctacctcatacgctatcttagagaggaagtgtgtagggaaagcgagatgcgcagtgacgatatccaacagcaatttcgggaaagacccgtgtccaaatgtgctgaaacggttgactgttgaagcagtttgtgccccagagacatctgtaagcacttggagaccttaa

SEQ ID NO: 2537 - DNA, 1398 bp, Arabidopsis thaliana
atgtcgaggaacaagggtttggctgagcaagatcttaaaaaattggatgtaactgtgctacatcctctgtctcctgaggtcatttctcgccaggccactattaatataggaaccattggtcatgtcgctcatggaaagtccactgttgttaaagctatttctggtgtccagactgtccgttttaaaaatgaattggagcgtaacattaccattaagcttggatatgcaaacgccaagatttacaaatgtgaggatgagaaatgccctagaccaatgtgctacaaggcctacggaagtggaaaggaagacactcccaattgtgatgtccccggatttgaaaactccaagatgaaactattgaggcatgtctcattcgttgattgcccgggtcacgatattctcatggcaacaatgcttaatggagcagccatcatggatggtgcactacttttaatcgctgcaaatgaaacttgtccacaaccacaaacgtctgaacatcttgctgccgttgagattatgcaacttaagcatatcatcatccttcagaacaagattgatcttattcaagagaatgttgccattaatcagcacgaggcaattcagaaatttataatgaacactgttgctgatgctgctccgatcgtccctgtctcagcacaactgaaatacaacattgatgtggtgtgcgagtacattgtcaagaagatcccaatccctgagaggaattttgtgtcacccccaaatatgatagtgattcggtcttttgatgtcaacaaacctggttatgaggttgatgagatcaaaggtggagttgcaggtggaagtatcctacggggtgttttgagagtcaaccaattaatcgaaatccgacctggtatcgttaccaaagacgagcgtggcaactcaaaatgcactccaatttactctcgcatcatttcactctacgcggaacagaacgagcttcagtttgctgttcctggaggtctaataggagttggaacaacaatggacccaactctcactcgtgcagatcgattagttggtcaagtccttggtgaaatcggttcacttcctgatgtatttgttgaactcgaggtgaacttctttcttctacgacgtttgttgggagtgagaacaaagggatcagagaaacaagggaaagtgtcaaagctaacgaaaggagagattctgatgctcaacattggttcgatgtccactggagccaaagttgtaggagttaaagtcgatctggctaaactgcaactgactgcgcctgtttgtaccagcaaaggagagaaagtggctctaagcagacgtgtggaaaagcattggcgtttgattggttggggtcagattcaagctggaaccaccatcgaagttcctccttcacctttctaa

SEQ ID NO: 2538 - DNA, 2811 bp, Arabidopsis thaliana
atggggcaacaacaatcacagtccaaggatgagatgctgtttcaagaagtgagtaacaacaacgtcgaaggtatcaaatcacttcaccatgaaggagcaggactcgagggggtggataaattagggagaacaccattaatcttagcttgtacgaacgacgatctatatgatgtagcaaaaactctgcttgagttgggctccaatgtcaatgcttatcgttctggttgcaatggtgggactcctctgcaccatgctgcaaaaagaggtctcgtacacacggttaagttacttctgtctcacggtgcaaatccattggttcttgatgatgatgttaagacagctctcgaggttgctagagatgaaggttacagtaatgtcgtacgcgcaatcgagagtcatatctgcttgttctctggttgtatgcgtgagtattctggctccagcttgcttaatttatttgctcctcagcttctttcaagaaaagtatgggtagttgtcgtaccaactggttcaagaaaccctacaaagcctttaaagttggagttggttctgtatgatagtattcaggcgaggcgttgggctcaagtcgatagacaaatacgtcttaagctagcagctgagatcaaaggcgacatgaaacagatgaattggttttctgaggcatgtaaaggagttccacaggtatatgccataagatatatacaattaactttcgtgatatatccaatgaatcctccaaggtttatgaaaacatctcaagcaacaacaacaacaaccaatgttcctgcactaagtgatgatgctttgactcgtgtcgccatgtcacttccttctccaaaaactgcgaataaagaagatggactgtgtgtgatttgtgtggatgcaccatctgaagcagtgtgtgtgccgtgtggacatgtcgccggatgcatttcttgcttgaaagagattgaaaacaagaaaatgggatgtcctgtttgtcgcgccaacattgatcagattggtatatcggtagttcttgttttcgtatatctgttctacggctcttctgatcatagagcatcggctatcgaatacgggagaaaactcgggttaggtggggatgatgatgatactaaacaggatgacacttctagctcatttggtgttgatgatggtttcactccgagaagttttcctgtgtgtgatgatcgacattcggagcttattccttgcttagataggaatcttatataccaaatgagattgaagctggatttgtctttgatggagcattatgaacgtcattgtcctcctcctgagagacgattcaattgcttgattccgcctcctaatggatataaggttccgattaaatggccaaaaagcagagatgaagtgtggaaagtgaacatacctcatactcatcttgcacatgagaagtctgaccaaaactggatggttgtcaaaggagataagattaatttccctggtggaggcacacattttcattatggtgctgataagtatattgcatcgatggcaaatgtaaggaagttacacttggtgtttgtacaagagaacatgcttaactatcctaacaacgtgctgaacaacggtggaaggctaaggacggttttcgatgttggttgtggtgttgcgagttttggaggttatcttttatcatcggatattctcacaatgtccttggctccaaatgatgtgcatcagaaccaaatccaatttgctcttgagagagggattcctgcctccctcggtgttttagggacaaagaggctcccatacccaagcagatcttttgaactttctcactgttcacgttgcagaatcgattggctacaaagagacgggattcttcttctcgagctagacagagtacttagacctggtggttattttgcatattcatctccagaggcatatgcacaagatgaagaggatcttagaatctggagagaaatgagtgctcttgtggagcgcatgtgttggaagatcgcggcaaaaaggaatcaaactgttatttggcagaaacctttgacaaatgattgttatctagaaagagaacctggaactcagcctcctctttgccgttctgataatgaccctgatgctgtgtggggcgtaaacatggaagcttgcattacttcttacagtgaccatgaccacaaaaccaagggaagtggattagctccatggccagctcggttaacctctcctcctcccagacttgctgattttggatattcaacgggcatgtttgagaaggacacggaactttggaggcagagagtagatacttattgggatctcttgagtccaagaatcgaatcagatacagtgaggaacataatggacatgaaagcaagcatgggctcttttgctgctgctctgaaagaaaaagatgtctgggtaatgaatgttgttcctgaggacggacctaacacgcttaaactgatatatgacagaggtttaatgggcgcggttcatagctggtgtgaagcattctcgacatatccaaggacatatgatctcctccatgcttgggatattatatcggatatcaagaaaaaaggatgtagtgaagtggatttgttactggagatggatcgaatactgcgcccgagcgggtttataatcataagggataaacaaagagtggtggattttgtgaagaagtatctaaaggcattgcattgggaagaagtaggtaccaagacagactcagattcagatcaagattcagacaatgttgtattcattgtccagaagaagctgtggttgactagtgaaagccttagagatatggagtga

SEQ ID NO: 2539 - DNA, 396 bp, Arabidopsis thaliana
atggcgggtcggggaaaacaacttggatctggtgcagcgaagaagtctacttctcgtagtagcaaggctgggcttcaattccctgttggtcgtatcgctcgatttttgaaagccggtaagtacgccgagcgtgttggtgccggagctccggtctatctcgccgccgttcttgaatacctcgccgctgaggtacttgagcttgctgggaacgcagcgagagacaacaagaagacccgtatagttccacgacacattcagcttgctgtgaggaatgatgaggagctaagcaagttgcttggagatgtgacaattgctaatggaggagtgatgcctaacatccacaatctccttctccccaagaaggctggttcatctaagcctactgaagaagattag

SEQ ID NO: 2540 - DNA, 2895 bp, Arabidopsis thaliana
atgcgtgctgatgaacttccttctaaggaggaaatcgaaatgcacaaagacagttgtaaatatttcagtaatgatacagaagaagaagagaccgaggatgaagaagagaatggtgaagttgctcatgcgaaagccgtagcagaagagtttggaaaatcatccaaaagcaagaatgtttcttcttcaatggagcttgatgatgaggtagctgagggtttgaaagaactcgacatggataattacgatgaagaggatgatgagaatctcaaaactcaatttatgctttcattgtgtacaactaaattagactttccattgttgtgtttggattcaggaattgaaatttttagctccgggcgtggggatctttactataagagtaacgagatggatccatatctcaagagaaatgatgatcatgatgatgactcggatgatgatccaccaatcttaccaaccgatttagtgattgtctgcgctatgactgacgacaaagaagctaaccgtcttgacgtttggaatttcctagctgttggttcggatgggacgccaacaatagagatatgggatcttgatgcttggttcgacatgctaccttgtgtacaactaggaggacaaaacaaggaagggaactataaacaaggtagccacactagatcagttcttggtcttgcttggaataaggagtttcggaatatacttgctagtgctagtgccgacaaaaaagttaaggtatgggatgtggctactggaacgtgtaagattactatggagcatcacacaaaggaggttcaagcggttgcttggaaccattatgctccagaagtgcttctcagtgggtcctttgatcaaactgttgtattggtaaatgttttgttccatggtttatttcataaagacggaagacaaccttcacactcgggtttcaaatggtctgtcatgtccgatgttgaaagcttagcctgggatcctcatagtgaacactcctttgtgatggaactgtcaagggctttgatgtacgtcaagcctccatttcagcctctgaatcaaatccaagcttcactattaatggacatgacgaagcagctacttccgtctcatacaacatttcggcacctaatcgccgctatactcactctcggcaaaaaaaaagttcctcagaagcaaacaaatcttcaattgttaaaccctaaacctacaaaagtcttgactttgtttgttgctcatcttcgttcttctctctcgattaaattcgttccgagaaagttaggtcccgtttctaaacgtaaaatgataactgcagtgtcatggataccaaaagggaatctaaaagctgttcctgatgttgctgagcctccgtcaaaggaagaacttaaagagctcattgagagtggtgcttttgcaagaaacgtggaaggtagtaacgaggatgaagaagaagagattgaagaagatggagaagagataagtgaagttgatcatgccaaggctgtagctgaagctttgggtaaatcttctaaaagcaaggctgtttcttcttcaatggaggttgatgaggtttctcaaggattgaaagaacttgacatggataattatgatgaagaggatgatggtacgtttagttggccttttggtgtttgttctgcaattctacaagtgatcattttgattagcagagataaaattgaacttttcagttctggaatgggggatctttattatccaagtaatgagatggatccatatctgaaagatgttgatgatgaagatgatgaagaggatattgatgacacgacagtcaagccgaccgattcggtgattatttgtgctaggaatgaagatgatgttagccatctagaggtttatttatacgaggaatcgtctggctctccaaacatgtatgttcatcatcacataattataccagaattcccattgtgtactgcatggcttgattgtcctcttaaaggaggggaaaaagggaattttgtagctattggttcaaaggatacaccgacaatcgagatatgggatcttgacgttagggacgaggtgctaccttgtatacaactaggaggaatagaggagatgatagtgagtaagaaaaagaagagcaagaaacagaaaccggtgtgtgcatcaaactcgtctatctctagttcgtctatggcaagttcaaattcaaagaaggtagccatactgagtcagtacttggtcttgcttggaacaaggagtttcggtatgtctaagcttactagcgtgtctgattttcttttgatttgtttggataaaaggaacatacttgctagtgctagtgccgacaaaaaagttaaggtctgggatgtggctactgggacgtgtaagattactatggagcatcacacaaaggaggttcaagcggttgcttggaaccattatgctccagaagtgcttctcagtgggtcgtttgatcaaactgttgtcatgaaagacggaagacaaccttcacactcgggtttcaaatggtctgtcatgtctgatgtcgaaagcttagcctgggatcctcattgcgaacactcctttgtggtacatgacacttatctttttcttcagatagacaaatcagtggtaagtcttgaagatggaaccgtgaagggttttgatatacgtgctgcacagtcaggttcagattctgatttaaacccaacttacactatccaagcacatgcccaagacagaggagtctcctccatctcatacaacatttctacacccaatggagctgtgttttccatttcctttgcggtggacaaccctttcttgcttgctattggtggctcaaagggagagctacatgtttgggatacactgttggatgctaatgtcgctcgcaaatatgggagcaatagatcttga

SEQ ID NO: 2541 - DNA, 684 bp, Arabidopsis thaliana
atggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaa

SEQ ID NO: 2542 - DNA, 1962 bp, Arabidopsis thaliana
atggctccgagtattcgaaaagcgattggtgcggttaaagaccaaacaagcataggaatcgctaaagtagcaagcaacatggctccagatctagaagtagccatcgtgaaagctacaagtcacgacgacgatcccgcaagcgagaaatacattcgtgagattctaaacctgacctctctctctcgcggctacatcctcgcttgtgttacttccgtttcacggcgattgagtaagacgcgtgattgggttgttgctctcaaggctcttatgcttgtgcatagacttcttaatgaaggagatcctatttttcaagaagagattctttattcaactagacgaggtacgaggatgttaaacatgtctgattttcgcgatgaagcgcattcgagttcgtgggatcattcggctttcgttagaacttatgctggttacttggatcagaggcttgagttagctttgtttgagaggaaaagtggtgtgtcggtgaatagtggtggtaatagtagtcatcatagtaataatgatgatcgatatgggagaggaagagatgatttcaggtctccaccgccgcgttcttatgattatgagaacggtggtggtggtggtagtgactttagaggtgataataatggttatggtggtgtaccgaagagatctcggtcttacggagatatgactgagatgggaggaggaggaggaggaggagggagagatgagaagaaagttgttacgcctttaagggaaatgacgcccgaaaggattttcggaaagatgggtcatcttcaacggttacttgataggtttttgtcattgagacctactggtttagctaagaacagtaggatgatattgatcgcgttgtatcccgttgtgagggagagttttaagctgtatgctgatatttgtgaggttttggctgttttgttggataagtttttcgatatggagtattcggattgtgtcaaggcctttgatgcttatgctagtgcggctaaacagattgatgagcttattgcgttttataattggtgtaaggaaacgggtgtggcgagatcgtctgagtatccggaagttcagaggattacaagcaagttgttggagactttggaagagtttgttagagatagggcaaaaagagggaagagtcccgagaggaaagagatcgaagctcctcctccggtagttgaagaagaggagcctgagcctgatatgaatgagatcaaagctcttcctcctcccgagaattacactcctccacctccgcctgaaccagaacctcagcccgaaaaaccgcaatttaccgaggatttagttaacttgagggaggatgaagtcacagctgatgaccaagggaacaagtttgcgcttgcactctttgctggtccaccgggtaataacggaaaatgggaagctttctcctcgaacggagtgacctctgcttggcagaatcccgctgcagagcccggtaaagcggattgggaattggcattggttgaaacaacgagcaatttagaaaaacagacagccgctttgggtggtgggttcgataacttgttgctcaacgggatgtatgatcaaggaatggtcagacaacacgttagcacctcgcaattgacaggtggtagcgcgagcagcgtagctttacccttacctggtaaaaccaacaatcaagtattagccttacctgcaccagatggaaccgttgagaaagtgaaccaagacccattcgcagcttcactaaccattccaccaccttcgtacgtgcaaatggccgagatggagaagaagcagtatctactgagccaagagcagcagctatggcagcaatatcaacgtgatgggatgagaggtcaagccagtttggcgaagatgaacaccggtccagttccggcttacggaatgccacctgtcaacgggatgggaccgccaccgacggggtattactacaacaatccttactga

SEQ ID NO: 2543 - DNA, 840 bp, Arabidopsis thaliana
atgtcgatgatggcgggtatacaaggccagattctcgaggtcactggttcgtacctttctcacatccccaattctattatgttcttcaaccttatctatgatccgttgaaatttgttgggtgccagaaattgaaagacacggaatggttttcaagacaagatccatacgtcgtccttgagtatggtggcagaagtcaccgtaccagaacctgcacagatggtggaaagaacgctgttttccaagagaagtttatcttcactttgattgaagggcttagggatcttaaggttgctgtctggaatagcaacactctctccactgatgacttcattggcaatgcaacgattcaattgcagaaagttctttctcaggaatacgacgactgtacctggactttgcagagtaaaactgggagtgctgacatggttttgctcactgatcagagtcgttataaacataattacgggtctgcgccatcagcaccgtatgcacctcacgtacctcaatactcagcaccgccttctgcatctccgtattcaacagcaccaccatactctggaccatctctatacccacaagtacaacaataccctcagccatcaggataccctccagcttcagggtatcctcctcagccatctgcctatccacctccctcaacctcgggctaccctccgatcccttcagcttacccacctcctccgccatcctcagcttaccctcctcaaccataccctccgcaaccatcatattacccacaaggtaccttcctttctttcctgttctatgctgcaattgatcgcatttgcttgtctctaactatagtcagtggtggttga

SEQ ID NO: 2544 - DNA, 1077 bp, Arabidopsis thaliana
accatgtctgcttttgtcagcaaatacgcagatgagctgatcaagacggccaagtacattgcaacgccgggaaggggcattttggcggcagatgagagcacagaaaccattgggaaacgattcgccggaatcaatgttgagaacactgagtccaaccgccaagcttaccgtgagctcctcttcacttcccctggcagttacccttgcctctctggtgttatactcttcgaggaaaccctctaccagaaaacctctgatggcaaacccttcgtcgatctcctccaggagaacggtgttatccccggaatcaaagtggacaagggtttggttgatctagcagggaccaacggcgagaccactactcaaggtctagactcgcttggtgcacggtgtcagcagtattacgaggcaggagcccggtttgctaaatggcgtgcattcttcaagattggggccaccgagccaagcgttctctccatccaagaggacgccagggtgctagcccgctatgccatcatctgccaggagaatggacttgtcccgatcgtcgagccagaggtgctgacaggtgggagccacgacatcaagaaatgtgcggcggtgactgagacggttcttgctgccgtgttcaaggccttgaactaccaccatgtcctcctcgaaggcactctgcttaaacctaacatggtcactcccggctccgacagcccacaggttgcaccggaactaattgcggaatacacggtgactgctctgcgccgcacagtcccaccagctattccgggaatcgtgttcctctcaggcatacagcgcgaagagcaagcgacactaaatctaaacgcaatgaacaagcttgatgtgttgaagccatggacgctcactttctcttttggcggagccctccagcaaagtgctatcaaggcttgggccggtaagcccgagaacgtagccaaagctcaggccaagttcctgaccaggtgcaaggctaacaaggacgctaccctcgggaaatacaccggctgggcttctggtgactcggccgctttcgagaacttggttgtgataggatacaggtac

SEQ ID NO: 2545 - DNA, 1011 bp, Arabidopsis thaliana
atggccaagtcattgaacatccttattgcagctctctcgctcattgcattttctcctttttgtttgtgttccaaagcctatggaagtggcggctatctctttcctcagttttatgaccaatcgtgtcctaaagctcaagagattgttcagtccattgtcgctaaagcattcgaacatgatcctcgcatgcctgcctccttgctcagactccatttccacgactgtttcgtcaagggatgtgatgcttccatactattggacagcagtggaaccataatcagcgagaaacgatcaaaccctaacagaaactcagcccgtggtttcgaactcatcgaggaaatcaaacatgccttagaacaagagtgtcctgaaacagtttcttgcgctgatatcttggctctagccgctagagactcaactgttattacgggtggaccgagctgggaagtacctctaggaagaagagacgcgagaggagcaagcttgagtggttccaacaacgacattcctgctccaaacaacactttccaaaccatcctcactaagttcaagcgtcaaggccttgatctcgtcgatcttgtctccctctcaggaagtcacaccattggaaactcgaggtgcacaagtttccgacagaggttatacaatcaatccggcaacggaaagcctgatatgactcttagccaatactatgcaacactattgcgtcaacgatgtccgagatccggaggtgaccagaccctattcttcctcgacttcgcgacaccgttcaagtttgacaaccactacttcaagaacctgataatgtacaaaggtctattgagctctgatgagattctgttcacgaagaacaaacagtccaaggagctggtggagctatacgctgagaatcaagaggccttctttgagcagtttgctaaatcgatggtgaagatgggaaatatctctccgttgacaggcgccaagggagagatcaggcgtatctgtcggagggttaaccatgcttattaa

SEQ ID NO: 2546 - DNA, 1245 bp, Arabidopsis thaliana
atggagaacgaatcgccctccaagaaaaacatgccgccatcgtgcggaacactcgtaaccatcctcagcctcgatggtggtggagtcagaggaatcatcgccggagtaatccttgcctatctcgaaaaacaacttcaggaactagatggagaacacgtgagggtagctgattatttcgacgtgatagccggaactagcaccggtggtcttgtgacggcgatgttgactgcaccggacgagaacggtagacctcgtttcgcggctaaagaaattgtgccgttttaccttgaacattgtcccaagatatttccccagcccacaggcgtgcttgctctgttaccgaagcttcctaagcttctgtctggtccaaagtacagcggaaactatctgcgaactacacttggtaagcttcttggagagacaaaacttcgccagacactcacaaacgttgttatacctaccttcgacatcaagacacttcaacccactattttctcatcttaccaggcgttgactgatcctagcttggacgtcaaggtatcggacatatgcatcggcacatcagctgctcccacttactttcctccttattacttttccaacgaagacagtcaaggcaagactaggcattttaacctcgttgatggcggggttactgctaataacccgactttggtggccatgactgctgtgacgaagcagattgtgaataataaccctgatatgggtactctcaatccgttaggttacgaccagtttctcgttatatcgataggaacaggatctgcaaaaaaagaagagaggtacagcgcaaagaaggctgcaaaatggggaatcatatcttggttatatgaagatggaactactccgatattagacattacctttgaatcaagccgcgacatagtccattatcacagctctgttgtgtttaaagccctacaatctgaagacaagtacctcagaatcgatgatgatacattggaaggagatgcaagcactctggatctatcgacaaagtctaatttagaaaatcttataaaacttggagagaagatgctgacaaacagagtcatgcaaatgaacatcgacactggtacatatgaacctgctgctgaaaatattaacaatgatgaacaactcaagaggtttgcgaaaatcctctccgaggaaaggaaattaaggagaaagaggagcgacaaaatgactaaagattcatcaatcggatcacaagagatcaagtaa

SEQ ID NO: 2547 - DNA, 2334 bp, Arabidopsis thaliana
atggatacggagggccagcattcaatggatatggaatgccgccgcagccttacgagtgctatggacgaccagtctacgagagctggggtgggggctgcccaccaccaccacctgcttatagacaatgccacgtcactagatgtgattacttcagcgaagagaatccacagagctgttccatcatgtctcgaggctgcaactgcgaacaaagtacccacaaaaaaatgtcatttcatcatctatgttcctctccctcgtctcttctacatgaccctcttcctctctgcaatcttctctcagtgtatcccaaatccacaccaagaagtttcctctcctcttacaatcccaattcttcctcatttccactccagaaaccttctccaagcaacccatgtttcagtacaagaagcgattccacagagtgaaaaatccaaacttgttgatgtagatcttcctataccagaacctactgcttccaaaagctacgtctgggttaatcccaaaagccccagagcttctcagctccgtagaaaatcttacgattcgaggtactcttctcttatcaaactagctgagtctcttgacgcgtgtaagccaaacgaagctgatgtttgcgatgtcattactgggtttggtggtaaattgtttgagcaagatgctgttgttactctcaataacatgactaacccagaaactgcgccacttgtgttgaataatctcttggagacgatgaaacctagcagggaagtgattctctacaatgttaccatgaaggtgtttaggaaaagcaaggatcttgaaaagtcagagaagctgttcgatgaaatgcttgagagagggattaaaccggataatgcaactttcactacgataattagttgtgctaggcagaatggtgtacctaagagagctgttgagtggtttgagaaaatgtcttcttttggatgtgagcctgataatgtcactatggctgctatgattgatgcttacgggcgtgctggtaacgttgacatggctttgagtttgtatgatcgagcaaggactgagaaatggcgtattgacgctgttactttttcgactttgattaggatttatggtgtttctggaaactatgatgggtgtctcaatatctatgaagaaatgaaggctcttggggtgaagcctaatctggttatttacaataggttgatagattctatgggtagagccaagaggccttggcaggctaaaattatctacaaggatcttattaccaatggctttactcccaattggagtacttatgctgctcttgttagagcctatggtagagcccgttatggcgatgatgcacttgctatctaccgagagatgaaggagaagggattgtctttaactgtgattctttacaatactctcttgtccatgtgtgctgataatcgacatgttgatgaggcttttgagatttttcaagatatgaagaattgtgagacttgtgatcccgacagctggaccttctcttcgttgatcactgtgtacgcttgtagtgggagggtttcaaaggccgaggcggctcttcttcaaattagagaagctggttttgagcctactctttttgttctgacgtcagttatccagtgttatgggaaagccaagcaggtagatgatgttgtgaggacattcgatcaagtgttggaactgggtataactccggacgacagattttgtgggtgtcttctgaatgtaatgacccagacaccgagtgaggaaatcggtaaactcattggctgtgtcgagaaggctaagccaaagcttggtcaagtggttaagatgttggtcgaggagcaaaactgcgaggaaggggtgttcaagaaggaagcatctgagttgattgattccattggatctgatgtaaagaaagcatatttgaattgcttgattgatctctgtgtcaatctcaataagttggaaagagcttgtgagatcctacaactaggacttgagtatgacatttatacgggtcttcaatcaaaatctgctacccaatggtccttacatctaaaaagtctctctttgggggcagctttgaccgctcttcatgtttggatgaatgacttatcagaagcggctcttgaatccggtgaagagttccctccgttgcttggaatcaacactggacatggaaaacacaaatactcagacaaaggtctagcagctgttttcgagtctcacttgaaggagctaaatgctcctttccatgaagccccagataaggttggctggtttttgactaccagtgttgcggcaaaggcatggttggagtctagacgctcagctggaggagtttctgcgtag

SEQ ID NO: 2548 - DNA, 651 bp, Arabidopsis thaliana
atgggaaaggcaaagaaacctcaaaagtttgctgtcgtgaagaagatgattagccacaaagctttgaagcattacaaggaagaggttctgaatccaaacaagaaggacctcacggaacttccgagaaacgtaccgagtgttcctgcagggcttttcttttcttacaactctacattggttcctccttaccgtgttttggtggatactaacttcatcaacttctctatccagaataagatcgatcttgagaagggaatgagagactgtctgtacgcaaattgcactccttgtatcacggattgtgtcatggctgagttagagaagttaggtcagaagtatcgtgtagctctaaggattgcgaaagatcctcacttcgaaagactaccttgtatacacaaagggacatatgctgatgactgtctcgttgacagagttactcagcataaatgcttcatagtggctacatgtgatagagacttaaagcgaaggattcgaaagattcctggtgtgcccatcatgtatgtgactaatcgcaagtactcaatagagaagttgcctgaagctacacttggtggaggtatgtatcttccggctgagacatctgaatctactgctactatggtattagactatgtgaattcgcttttgtaa

SEQ ID NO: 2549 - DNA, 810 bp, Arabidopsis thaliana
atgttcattcgggtttccgctcgacccgcgacattcgtcgaggatttcaaagccgcctggtcggaatctcacatccgtcaaatggaagacggaaaagctatccagctcgtccttgatcagagcactggatgtggatttgcttccaaaagaaaatatctattcggacgagtgagcatgaagatcaaactcattcccggagactctgccggtacggtcaccgctttctacatgaactccgatacggccacggtgagagacgagctagattttgagttcttgggaaacagaagtggtcaaccttactcagtgcaaacaaacatatttgctcatggcaaaggagatagagaacaaagagttaatctttggttcgacccatctatggattaccacacttacactatcttatggtcacacaaacacattgttttttacgtagacgatgtgccaataagagaatacaaaaacaacgaagccaagaacatagcttacccaacatcacaacctatgggagtatactcaacattatgggaagcagatgactgggcaacacgtggtggattagagaaaattgattggagcaaagctccattttatgcttattacaaagatttcgacatcgaaggttgtcctgttcctggaccaaccttttgtccatcgaaccctcataattggtgggaaggttatgcctatcagtctcttaacgccgttgaagctcgacgttaccggtgggttagagtaaaccatatggtttatgattattgtactgaccggtctaggtttcctgtcccaccacccgagtgtcgtgcttga

SEQ ID NO: 2550 - DNA, 1728 bp, Arabidopsis thaliana
atgtctggaaactcagaaggactgttagagagctcaggcggcggcgtgggaggttccgtcgaggaggaaaaagatatgaagatggaggaaaccggtgaaggagccggcagcggaggaaaccggtggccaagaccagagactttagctctattgagaatacgttcagagatggataaagcttttcgtgactctactctcaaagctcccttatgggaagaaatttccaggaaaatgatggagcttggttacaagagaagttcaaagaaatgcaaggagaagttcgagaacgtgtacaagtaccacaaacgtaccaaagaaggtcgtaccgggaaatccgaaggcaaaacttaccggtttttcgaagagttagaagctttcgagactctcagttcctatcaacctgaacctgagtcgcaacccgcgaaatcttctgcagtgatcacgaacgcgcccgcaacctcttccttgataccatggattagctctagcaatccatcaaccgaaaaaagttcttcaccgttgaaacatcatcatcaggttagtgtacaacccatcaccacaaaccctaccttcctcgccaagcaaccatcttccacgacgccttttcctttttatagcagcaacaatactactactgttagccagccgccaatttcaaatgacttgatgaacaatgtttcatcgctgaatcttttctcgagctcaacttcttcatctactgcatctgacgaggaagaagatcatcatcaggttaagagctcgagaaagaagaggaagtattggaaagggttgtttacgaagttgacaaaagagttaatggagaaacaagagaagatgcaaaaaaggttcttggaaacactggagtatcgtgagaaagagagaatctcaagagaagaagcttggagggtccaagagatagggagaatcaacagagaacacgaaacattaatccatgagaggtccaatgctgcagctaaagacgctgcaatcatatccttcttacacaaaatctcaggaggacaaccacaacaaccgcaacaacataatcataaaccatcacaaaggaaacaatatcaaagcgatcattcaataacgtttgagagtaaagagccgagggcggttctattggatacaacaataaagatggggaattacgataacaatcattcggtgtctcctagttcttcaagatggcctaaaaccgaggtcgaggccttgataaggataagaaagaatcttgaagctaactatcaagaaaacggtactaagggaccattatgggaagagatctctgcagggatgagaagattgggatacaatagaagcgcgaaacgctgcaaagagaagtgggaaaacatcaacaagtactttaagaaagtcaaagaaagcaacaagaaacgtccccttgattccaagacttgcccttattttcaccagctcgaagctttgtacaacgagaggaacaaaagtggggcaatgccattgccattgcctctaatggtgactccacagagacagttgcttctctcgcaagaaacccagaccgagtttgagactgatcagagggaaaaagttggtgataaagaagatgaagaagaaggagagagtgaagaagatgaatacgatgaagaagaagagggagaaggagacaatgagacaagtgagttcgagattgtgttgaacaaaacatcttcacctatggacattaacaataatcttttcacctaa

SEQ ID NO: 2551 - DNA, 486 bp, Arabidopsis thaliana
atgtcaagttctggtgctccttcacgcaagactctgagtaagatcgcgactaatcgtcttcagaaagagcttgtggaatggcagatgaatccacctactggtttcaaacacaaagtcactgataatctccaaagatggataattgaagttattggagctccaggaactctatatgccaacgatacttatcagcttcaagttgattttccagaacattatcctatggaatcgccacaagtgatttttcttcatccagctcctctgcatcctcacatttacagcaatgggcatatttgtctagatattttgtatgattcgtggtctccagccatgacggtgagttctatctgcattagcatcctctccatgctctcaagctcgactgaaaagcaacgaccaaccgataatgaccgatatgtgaagaattgtaagaacggaagatctccaaaggagacccgatggtggttccacgacgataaagtataa

SEQ ID NO: 2552 - DNA, 2427 bp, Arabidopsis thaliana
atgaatttcaacggttttctcgacgacggtgctggagcctcaaagctactctctgatgctccgtacaacaaccacttctctttctccgccgtagacaccatgctcggaagcgccgccattgctccttctcagtctcttcctttctcttcttcaggcctctctctcggactccaaacaaatggagaaatgagtagaaacggagagattatggagtcaaacgtaagtcgtaagagtagtagaggagaagatgtagaaagcagatctgaaagtgataacgctgaagctgtctccggtgacgatttagatacctccgatagacctttaaagaagaagaaacgttaccatcgtcacactcctaaacaaattcaagacctcgaatcggtttttaaagagtgtgcacatccagacgagaagcaacgtcttgatcttagccgtcgacttaacttagatcctcgtcaagtcaagttctggttccagaatcgtcgtactcagatgaagactcaaatcgaacgacatgagaatgctttgttgaggcaagagaacgataagcttcgagctgagaatatgtctgtacgcgaagctatgagaaaccctatgtgtggtaattgcggcggacctgccgttatcggtgagatctcaatggaagagcaacatctgagaattgaaaactctcgtctcaaagatgagttagaccgagtctgtgccttaaccggtaagtttcttggccggtctaatggttcacatcatataccggactcagcacttgttctcggcgttggtgttggttctggtggatgtaatgttggtggtggtttcactctctcttctccgctgttgcctcaagcttctcctagatttgagatttctaatggaaccggttctggtttggtggctacggttaaccgtcaacaaccggttagtgttagtgattttgatcagagatcgaggtatttggatttagctcttgcggctatggatgagcttgtgaagatggctcagacacgtgagccgctctgggttcgaagctcggattctggttttgaagtgctgaaccaggaagagtacgacacaagtttctctcggtgtgttggaccaaaacaagatgggtttgtctcagaagcttctaaagaagctggaactgttatcatcaatagcttagcgctcgttgaaaccttaatggactcggaacggtgggcggaaatgtttcctagtatggtctcaagaacttcaaccacagagattatctctagtggcatgggagggcgaaatggtgcacttcacctgatgcacgcagagcttcaactgctgtctccactcgtgccggttagacaagtgtcgttcttgcggttctgtaaacagcacgcggaaggtgtttgggcagtcgtggatgtctcaattgattccattagagaaggttcttcttcgagctgtagaagattaccatccggttgcctcgtacaagacatggccaatggctactcaaaggtaacatggatcgagcacacggagtatgacgaaaaccacatccaccgtttataccgcccattactcaggtgcggtctagcgtttggtgcgcatcgatggatggctgcattacaacgtcaatgcgaatgcctcacgattctcatgtcctccactgtttccacttccactaatccatcccctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctga

SEQ ID NO: 2553 - DNA, 3063 bp, Arabidopsis thaliana
atggagagctacttgaacgaaaacttcggcgatgtgaagccgaagaactcgtccgatgaggcgttgcagcgttggaggaagctctgctggatcgtcaagaatcctaaaaggagatttagattcactgctaatctgtctaagcgttccgaggccgaggcgattcggcgttccaatcaggaaaaatttcgagtggcggtcttagtttcacaagctgcacttcagttcattaatagtttaaagttgtccagtgagtatacactacctgaagaagtaagaaaagcagggtttgagatttgtcctgatgagttgggatcaattgtagaaggtcatgatttgaaaaagttgaaaattcatggtggaactgagggcctcactgaaaaactttccacgtctattgctagtggaattagtacatctgaagacctgctgagtgtaagaaaagaaatttatggaatcaaccaattcacagaaagccccagccgtggcttttggttatttgtttgggaagcccttcaggatacaacacttatgattctagctgcatgtgcgtttgtttcacttatagttggaatactgatggaagggtggcctattggtgcccatgacggacttggtatagtggcgagtattctgcttgttgtgtttgtcactgccactagtgattataggcaatccctgcaattcaaggacctggatgcagagaagaaaaagattgtggttcaggttacgagagacaaactgaggcaaaaaatctcaatatatgatctactccctggagatgttgttcatcttggcattggagaccagattccagcagatgggctttttatctcagggttttctgttctgataaatgaatcgagcttgactggagaaagtgaaccggttagtgtcagtgtggaacacccgtttcttctctctggtaccaaggttcaggatggatcttgcaaaatgttggtgactacagttggaatgaggactcaatggggtaaactgatggctacactaagtgaaggcggtgatgatgagacaccgttgcaagtaaaacttaatggtgtggcaaccatcattggtaaaataggtctattttttgctgtcattacgtttgctgttttggttcaaggattggctaatcagaagcgcctagataattctcactggatctggactgctgatgaattgatggcgatgctagaatattttgctgttgctgtaacaattgttgtggttgcagttccggagggtctgccgttggctgtgacattaagtcttgcttttgccatgaaaaagatgatgaatgacaaagcgctagtgcgcaatcttgctgcttgtgagacaatgggatctgcaacaactatttgtagtgacaaaactggaactcttacaacaaatcacatgacagttgtaaaagcctgcatctgtgaacaagccaaagaggttaatggtcctgatgctgctatgaaatttgcctctggtatccctgagtctgctgttaaacttctactgcaatctatatttactaacactggtggtgagattgttgtgggcaaaggaaacaaaaccgagatactgggaactcctacagaaactgctctgttagaatttgggttgtcactcggaggggacttccaagaagtaaggcaagcctcaaatgttgtgaaagttgagccctttaactctacaaagaaaagaatgggagttgtcattgagctgcctgaaagacatttccgggcacattgtaagggtgcttcagagatagttttagattcttgtgataagtacatcaacaaagatggtgaagttgttcctctcgatgaaaaatcgaccagtcacctgaagaacataattgaggaatttgctagcgaagcacttcgaactctttgcctagcgtatttcgaaattggtgatgaattctcattagaggctcctattccaagtggtggatacacttgtataggtattgtgggcatcaaagaccctgtacgccctggtgtcaaggagtctgttgcgatttgtaaatctgctggcatcactgtcagaatggtgactggagataaccttactactgcgaaggccatagccagggagtgtggcatattgactgatgatggcatagctatcgaaggtcctgaattccgggagaaaagtgatgaggaactgctcaagctaatcccaaaattgcaggtgatggcacgatcctcgcccatggataagcatactttggtgagactcctccgcacaatgtttcaggaagtcgttgcagtgacaggtgatggaacaaatgatgctccagcacttcatgaagctgatattggactcgcaatgggcatttccggaactgaggtggcaaaagaaagtgcggatgtgattatcctagatgataacttctctacgattgtcacagtagccaaatggggccgttctgtgtacataaatattcagaaatttgtccagttccagctgacagtaaatgttgtggctcttattgtcaacttcttatcagcctgcctcactggaaacgcgcctctgactgctgtccaactactgtgggttaacatgataatggacacacttggagcactcgcgctagcgactgaaccaccacaggacgacctgatgaagagatctccagtgggaaggaaaggaaacttcataagtaatgtaatgtggaggaacatccttggtcagtcactctaccagcttgtcatcatatggtgtcttcaaacaaagggaaagacaatgtttggtctcgatggccccgactctgatctaacactcaatacccttattttcaacatttttgtcttctgccaggtattcaatgagataagctcgagggaaatggaaaaaattgatgtgttcaaggggatactaaagaactacgtattcgtagcggttctaacatgtacagtggtgttccaagtaatcataatcgagctgctgggtacatttgcggatacaacaccattaaatttgggacaatggttggttagcatcatactcgggttccttggcatgcctgttgctgctgccttgaagatgatccctgttggttcacactaa

SEQ ID NO: 2554 - DNA, 903 bp, Arabidopsis thaliana
atgtttggtttaaggaaatcaccggcaaatcttcccaagcataactcagtcgacctcaagtcttccaagccaaatcctttcgattcagatgatgaatctgacaacaaacatacccttaacccttctaagaggactacctctgaaccctctttggctgatatgacaaacccttttggtggtgagagagttcagaaaggagatagtagttcatccaaacagtcattgttttcgaactccaaataccagtacaagaacaatttccgtgattctggtggtattgaaaaccagtcggttcaggagcttgaaggttatgctgtgtacaaggctgaagagactacgaaatctgtacaaggttgtttgaaggtagcagaagatataaggtctgatgctaccagaactttggtcatgttacacgatcagggcgagcaaatcactaggacgcaccataaagccgttgaaatcgaccatgatctcagtcgtggtgagaaacttcttggaagccttggaggcatgttttcaaagacttggaaaccaaagaagactcgtcctataaatggtcccgtcgtaaccagagatgactcaccaacgagaagagttaaccacttagagaaaagggaaaaactgggactgaactcagcacccagaggacaatcaagaacccgagaaccactccccgaatcagctgatgcttatcagagagtggagatggaaaaagctaagcaagacgatgggctttcagacttgagtgatatactcggcgagctaaagaacatggctgttgacatgggaagcgaaatcgagaagcagaacaaaggacttgaccatcttcatgatgatgttgacgaactcaacttcagagtgcaacaatcaaaccaacgtggtcgccgtttgcttggaaagtag

SEQ ID NO: 2555 - DNA, 966 bp, Arabidopsis thaliana
atggccaccattagagtaccaaacgaagttccttctccagctcaggattctgaaactctcaaacaagctattcgcggatggggaacagatgagaaggcgattatacgagttttagggcaaagagaccagagccagagaaggaagattagagaaagttttagagagatttatggcaaagatcttatcgatgttctatcctccgaactgtctggtgatttcatgaaagctgtggtttcgtggacgtatgatccagcagagagagacgcaaggcttgtgaacaagattttgaacaaggagaagaagaagaaaagcttagagaatttgaaggttatagtagagatctcttgcacgacttccccaaaccatttgattgctgtgaggaaagcttattgttcactctttgactcttctcttgaagaacacattgcttcttctctgccttttcctcttgcaaagttactggtgacattggcaagtacattcagatatgacaaagataggactgatgcagaagtagctactattgaggcggctatgctacgtgaagccatagagaagaaacaattagatcatgaccatgtcctgtacatattaggaacgcgtagtatctatcagctcagagaaacttttgttgcttacaagaagaattatggggtcacaattgataaggatgttgatggatgtccaggagatgctgatctgagaagtctattgaaggtggcaatcttttgtattgatactcctgagaaacactttgcaaaggtggtaagagattcgattgagggttttggaacagatgaggattcgttgacgagggcgattgtgacgcgtgcagagatcgatttgatgaaagtaagaggagagtatttcaacatgtataatacaagcatggacaatgctattactggtgatatttctggagactacaaggacttcattatcaccttacttggatccaaaatctga

SEQ ID NO: 2556 - DNA, 1011 bp, Arabidopsis thaliana
atggcggaatctgtcttctcttgtataccagaagacgtagtcttcaacatcttcttcaagctccaagatgatccaagaaactgggctcgtctcgcttgcgtctgcaccaaattctcctcaattgttcgaaacgtttgttgtaaaactcagtgctactccgctatccccaccgtcatctccgatctcctccctcttcctccctccgccgccgcatccgcttcttcatccaccgcggcggattcgtctcttactcctcccggtggttgggcttctttatacaaactcgctgtttgttgtcctggtctcttccacgctggaattctcctcgaaaactccgatttcggtttagaacgtgagctaggtcccgatcaaaacctcgatccgaaacctactacgacggatctagctcttaacgacgaagaagtttcgaaaccagttggatctggtttagaaacgacttcgttttggtctctatatgatgatctctacacagatactattcccgctcctcctcccgaagattcaatcgacgatcaagaagaagaaatcgaaacgagtgagatcagacctggacgagatcttccggtaaggaaacgaaggaagatttgtcgatctctaggatctcatttagcttccggtggctggaaccttagccgtgaacaaggcaacaagcttctcgcgagtagattccgaggtgattgtctctacatttgcaattggcctgggtgtattcacgtagaagagaaacgaaattacatgttgtttagaggagtcttcaaggatttcaaaaggtctagagtttggagaacgataaacgacggtaatcggagtaagacctcgggtttgaaatgcgcgttttgtttgtgcgatgagacttgggatttgcattcatcgttttgtttgagaagagtgtttgggtttcatgatgatggtgaaccagttgtgagagcttatgtttgtgagaatggtcatgtctctggtgcttggactgctttacctctctacacttga

SEQ ID NO: 2557 - DNA, 2559 bp, Arabidopsis thaliana
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 2558 - DNA, 468 bp, Arabidopsis thaliana
atgtcgctgattccaagcttcttcggcaacaacaggcgaatcaacaacaacatattcgatccattctcactcgacgtatgggatccattcaaggaacttcaattcccgtcatcgtcttcgtcggcgatagcaaacgcacgtgtggattggaaagagacggcggaggcgcacgtgttcaaggcggatttaccggggatgaagaaagaagaggttaaagtagagattgaggatgatagtgtgcttaagatcagcggagagagacacgttgagaaagaggagaagcaggacacgtggcatcgtgtagagagatcgagtgggggattctcgaggaagtttaggttaccggagaatgtgaagatggatcaagttaaagcttcaatggagaatggtgttttgactgtgactgtgcctaaagtggagactaataagaagaaggctcaagttaagtctattgatatctctggctaa

SEQ ID NO: 2559 - DNA, 1011 bp, Arabidopsis thaliana
atgatgagactcctctttgtattcttcatggttcacaccatctttatcccatgcttttcctttgatacaccggggaaggatcttcctttaaccctagattattacaagtctacttgtccaaccgtatttgacgtcatcaagaaagaaatggaatgcatagtgaaggaagatcctagaaatgcagccataattattcgtcttcacttccacgactgctttgtccaaggatgtgatggatcggtgttgctagacgagacagaaactctacagggagagaagaaagcttctcccaacataaattcattgaaaggatacaaaattgtcgacagaatcaagaacataatcgaatccgaatgtcctggagttgtttcatgcgctgatcttctcacaattggtgctagagatgctacaatcctggtgggtgggccttactgggatgttcctgtgggaagaaaagattcaaaaaccgcaagctacgagcttgccacaacaaaccttccaactccagaagagggtttaatcagcatcattgctaagttctattctcaaggtctctcggttgaagacatggtcgctcttataggagcgcacacgatcggaaaagcacaatgtcgcaacttccgatcccgaatttatggagattttcaagtgacgtcagccctaaatccagtttcggagacgtacttggcaagtcttcgagagatttgtccggcgagtagcggagaaggtgatagtaacgtgacggcgatagacaatgtgacgccgaatctcttcgataactcgatctaccacacactgctaagaggagaagggttactgaattcggaccaggagatgtacacgagcttgttcgggatacaaacgcggcgaatcgtgagcaagtatgcggaggatccagtggctttcttcgagcaattctcgaagtcgatggtaaagatggggaacattttgaactctgaaagcttggctgatggagaagttagaagaaattgcagatttgtgaatacatga

SEQ ID NO: 2560 - DNA, 1614 bp, Arabidopsis thaliana
atggctggacaaaagcaagagcttcccgtctccggcgaacctttagccgtcgagagtccgatgaccaacaagaagaagaagaaaagcaagaagaacaaacatacagaggaaaatcatgaagtcgaagaagtgcctcaagaggtcactaatggtgtagaggaagagttgagtaataaagagaagaagaagaaacgtaagagagaggagaaagagtctgagaagaataagaagaaggatgtcccggagaagaagcttgaagctgaggatttaggagaaggagagagtgaacaacagaaggttgttgtgactgggaaaggtgtggaagaagcaaagtacgcagctttgaagacttttgctgaatcgaatttgccggagaatgttttagattgttgtaagactttcgagaagccgtctccgattcagtcacatacgtggccgtttttgttagatgggcgtgatcttatcgggattgcgaaaactgggtcaggtaagacattggcttttgggattcctgcgattatgcatgtgttgaagaaaaataagaagattggtggaggatcaaagaaggttaatcctacttgtttagttctttctcctacacgagaattggctgttcagatttctgatgttttgcgtgaagctggagaaccgtgtggtttgaaatcgatttgtgtgtatggtggaagctctaaagggcctcaaataagtgcaattcgatctggagttgatattgtcattggtacgcctggtcgtttgagagacttgattgagtctaatgtgcttcgtctctcggatgtttcctttgtcgtattggatgaagcagatcgaatgcttgatatgggtttcgaggaacctgtccggtttatattgagtaacacaaataaagttcgtcaaatggttatgttcagtgcaacttggcctttggatgttcacaaattggcccaggaattcatggatccaaatccaatcaaggtgatcataggttctgtagacttagctgccaaccacgacgttatgcaaatcattgaggtcttggatgaacgtgcgcgtgatcagcgtctcattgcattactagaaaaataccataaatctcaaaagaacagggttttggtatttgctttatacaaggtggaagctgaacgtctcgagcgttttcttcagcaaagaggttggaaagctgtatctatacacggaaacaaagcacagagcgaacgtaccaggtctttatcattgttcaaagaaggatcctgcccgttactggtggctactgatgttgcagcaagagggcttgatatcccggacgtggaagttgtgataaactacactttccctttaacaacagaggattatgtacacagaatcgggaggacaggaagagcgggtaaaaagggcgttgcacacaccttcttcacgccactgaacaagggtcttgcaggagaacttgtgaatgttcttagggaagcaggacaagtagtgccagctgatcttttgaagtttggcactcatgtaaagaaaaaggaatcaaaattgtatggagctcatttcaaagaaatagctgctgatgctcctaaagctacgaagatcacattcgataattctgatgacgaagactag

SEQ ID NO: 2561 - DNA, 1956 bp, Arabidopsis thaliana
atgcctcaatctggttttgcagcgagtttgaaatctactcttgagaaacatggagttttgcagaagattttgcttgttcttgctttgattgggacttgtatggttattggtgatggtgttctcacgcctgctatttcagttttttctgcagtatctggtgttgagctttcaatgtctaaggagcatcacaagtatatagaactccctgctgcttgtgtaattctgataggtttgtttgcacttcagcactacggtacacacagggtcgggttcttgttcgccccggtgattctgttgtggctaatgtgtatcagcgccatcggtgtttacaacattttccattggaacccgcatgtgtaccaagcactttctccttattacatgtacaagttcctcaagaaaactcaaagtagaggctggatgtctcttggtggtatcttactctgcattacaggttccgaagcaatgtttgcggatctaggacatttttctcaactctcaatcaagattgcttttacgtcacttgtttacccgtccttgatactcgcctacatgggacaagcagcttatctctctcagcatcatattattgaaagcgaatacaatatcgggttttatgtatcggtaccagaaagattaagatggccagttcttgtgatcgctatactcgctgctgtagttggaagtcaagcaatcatcacaggaacattctcgatcatcaaacaatgctctgcattgggatgcttccctaaagtgaagattgttcatacgtcatccaaaatccacggtcagatttacatccctgagatcaattggatcttgatggttctctgtttagctgtcaccattggcttcagagacaccaagcggttgggtaatgcttcaggattggcggttataactgttatgctggtgacaacatgcttaatgtcactagtgattgtactttgctggcacaagagtgtcatctttgcaatcgtattcgttgtattcttcggcacaatcgaatctctctacttctctgcttccttaatcaaattcctcgaaggcgcatgggttccaatcgccctcgctttttgcttccttctcgcgatgtgtacttggcactacggaacactcaagcgctatgagtacgatgtgcaaaacaaagtctcggtcaactggctcctcagtcttagtcaaaccctcgggatcgcacgtgtccgtggccttggactcatccacaccgagctcgtctctggtgtccccgcgatattctctcattttgtcaccaacctccctgccttccaccaggttctcgtcttcctctgtgtcaaatctgttccggttccgcatgttcgtcctcaggaacggtttctagtaggacgcatcgggccaaaagagttccgcatataccgttgcattgtccggttcgggtaccgtgatgtccacaaagacgatttcgagtttgaaggcgatcttgtatgtagcattgccgagtttatccgtactgaagctgaaaccgccgccaccgctgcagagaccaacggagaggatgatgatagaatgtcagtagtaggtacttgttccacatacatgcaaggaattgaggatcactacgaaagcgatattgatgaccctgataaaccagggacgtcagagattcgatcaccaaaaccaaagaaaaagagtaagagtaaggtcaaaaagagagtgaggtttgttgtcccggagactccaaagatagaaaaggaaactaggcaagagttaatggagctaacagaggcacgagagggaggcgtggcttatataatgggaaacgcttatatgaaagcgaagccaggatcaggattactcaagagactcgccattaacattggctacgagtttcttaggaggaacactagaggtcctagaaacatgcttacctcgcctcacgcttctactttagaagtcggtatgatctataatgtctaa

SEQ ID NO: 2562 - DNA, 465 bp, Arabidopsis thaliana
atgttgcaggacttgtatgtgaacattggttggcctttgtatcgacgacatggtcatgcttttgaggctttcaagatcttagtgacggatcctgattcagtgttgggtcctctcacccgtgagatcaaagaagttgggcctgatgggcaagaggtgactaaggttgtacctgctgttacggaagaagtgaaagatgcacttgtgaagaacattaggaggagaatgacaccacaaccaatgaaaatccgggctgatatcgaattgaagtgttttcagtttgatggagttgttcacattaaggaggctatgaaaaatgctgaagccgctggaaatgaagactgtcctgttaagattaaattggttgctccacctctgtatgtccttactactcagacacttgacaaggttaggcaatcttctatcttgcactatgatttacttggtttggtaattggtatattatag

SEQ ID NO: 2563 - DNA, 1251 bp, Arabidopsis thaliana
atgggaactggaagctcagagaattatctcaatttcgacataaagaatgctcctttcgatgtttatagaacagaacgtggtggtgaagttacttatcatggtcctggtcagcttgaggaagtagttattcgtgttctttcttcggctttcgccatcaatgcttctcgtctcgacggttttactggagtttgggttggcaacaaaaaaatggcggcgataggtattcgtgtgtcgaaatggatgacatatcatggtctagctcttaatgttacaacagatttaacaccctttaactccatagttccatgtgggataaggaaccgtggggttggaagcgtaaagggtttgattgaggatggagaacattataataagcttgaagatttgcagttgttagatatagctcatgagtcgttactaaaggaattctctgaagtttttcagcttcagatggaaaagcaaacaagatttgatttctctatttctctctccaaagaaagcttatctgcttcttggattgaccacaaagggatggctctggaagctgctttctccatgagtttttgctccttctctgtccctaaagcaatcttctgtgagagagaaacttcatcttttcaacgaatcacctcgagagcaaagggaattgcgggtgagagtcaagttcaaagctctgatggagttgagactcaagtcaaggaaacttctcccaaagtatttgataaactgcctgaaagaaatttagatacttggagcggtggcagagaaacagcaagaggactttcaggttcagtagtaagaaacactgtacgaaaagatactactttacgacatatctcaccttctagtcattcaacaaaggttagaggagataagccagagatttcagggggtgagaagaaagctattgtagatagaagcaaggcctacgtaaagctgaaatctttagggaaagaagtgagagacgcaggctatgtaccagagactaagtatgttcttcacgacattgatgaagaagctaaagagaaagccttgatgcatcatagtgaacggttagctattgctttcgggattataaacactcctccagggacgacaataagggtgatgaagaatctgaggatatgtggagattgccataacttcataaagatattatcgagtatcgaagatagagagatcattgtaagagataacaagaggttccatcattttagagatggtaactgctcttgtggagattattggtag

SEQ ID NO: 2564 - DNA, 723 bp, Arabidopsis thaliana
atgtgtacgttagagaaacgcggcgatctcttcctcctaaccctaaccggagacggcgaacacagattccaccccgacacaattgccaccattctctcccttctcgaacaagccaaatctcaatccacccgtggatccatcctcatcaccaccgccaacggcaaattcttctccaacggattcgatcttgcatgggctcaaaccgccggatccaaaaccggagccgcaaaccggcttcaccaaatggttgaatcattcaaaccggtggtagcagcgcttctcgatctccctatgccgacgatcgccgccttgaacggccacgccgccgccgcgggattgattttggctttgagccatgattacgtgttcatgaggaaagatcgtggggttctgtatatgagtgaagttgacatcgggctttcgatgccggattatttctcggcgttggttagggctaagatcgggacgagtgcggcgaggagagagctgttgttgagtgggaagaagattagaggagaagaagcggtgggtttggggattgttgactcggccgcgtatgatagtgaggaaggtgttgttgtggctagtgtgcgccttggtgagaaattggcggcgaagaaatggagcggtgaggtttatgcgtcgataaggaagagtttgtatccggagctttgtgggattcttggtttagagactagagtgtttgcaacacctaagctctaa

SEQ ID NO: 2565 - DNA, 1053 bp, Arabidopsis thaliana
atggaaacttcctgttttacccttctcggtctccttgtctccctctccttcttcctcactctctccgcccaaatgaccggaaacttcaactgcagtggctcaacctcgacgtgtcaatctctcgttggttactcaagcaagaacgcaacaacgttgcgcaatatccaaaccctttttgccgtcaagaacctccgctcgatcctcggagctaacaatctcccactcaacacctcacgtgaccaacgcgtgaacccgaatcaagtcgtacgtgtcccaatccattgctcttgctccaatggaaccggtgtctcgaaccgggacatcgaatacaccatcaagaaagacgacatactctctttcgtcgcaactgagattttcggtggtctcgttacgtacgagaagatcagtgaggttaacaaaatccctgacccgaacaaaatcgaaatcggtcaaaagttttggatccctttgccttgtagctgtgataaattgaacggtgaggatgttgttcactacgcacatgtagtcaaactagggagctctctcggtgagatcgctgctcagtttggaacggacaacacgacgttggctcagctcaatggaatcattggtgactctcagcttcttgctgataaacctctcgacgtccctctcaaagcttgtagctcttctgtgaggaaggactcgttggatgctcctctgcttctgtctaacaactcatacgtcttcactgcaaacaattgcgtcaagtgtacttgtgacgctttgaagaattggactttaagctgtcaatcatcatctgagattaagccttcgaactggcaaacctgcccaccattttcacaatgtgatggagctttgcttaacgcctcttgcagacaacctcgtgattgcgtctatgctggttactccaaccaaaccatcttcaccacagcttccccagcttgtccagattctgctggtcctgataactatgcatcaacgctcagctcaagcttcaatttcgtgattgtgttgattcagtgtgctctgctttgtctctgccttctctag

SEQ ID NO: 2566 - DNA, 2097 bp, Arabidopsis thaliana
atggaaggtaaatctccagacctggaatcgatagggtctggtacaacaacaaagaggtcaagtgtttcatcaggaagtcgatctcgtactcgtagagatttccttagcagattcactgactctgcacatttcactgaaaagcttgaagattggtttgcttcaacattagaaaactcggcgagcgaaggaccggtctttgatgttccttttgagttggttgagcttcaaaagtttgattatgcattagaagggatttctttccagcagcttactcggatgccaagtcctgtttacgcttcttcgtctaatgctctggaggctaaggcttatctagctattgaggattttctacacgccactgttaagagcttgtgggaggcgttttggagtcaggaagagcctgttcctttctctgttggttgtttatacaatcagaatcttaagttttatcaggctgagagagctttagctcttgggaagcttgaaggtctttccgccacaggtattttgcttaaaaatcctcggcatcctcacgggaaatgggatcacattcttgaacttgctcttctaaggtctgacattggaagctttgcacaggatagtgatcgtctgccttctttacctgtcttaggcgaggctcttttctatgctgttcgtatactcatcgcaaggagtgtgagccgtttagatttttctcaaagctcaaactgtgtcttcattcttctagttgattcgcagtatggaggtgttgtaaaagttgaaggggacgtaaataaattggattttgacttgaacaatgtttatgagtgcgcagcagattggataaagaagcattctaagatagcagtgtcaccagttgacagaatatggaacaagctgggaaatgccaactggggagacattggtgctttgcaagtggtgtttgccacttaccatagtataatgcagtactttggggcacccagacattccattgaagacttagctgctgaccatagttctcgccttcactcaagacgacaggagaggcagttgggagatactagtctcagtgaaaatggtatgtttaggttccagcagagtaccatgtctcctgaaattgtcgaagttcaagaagaatcaaccaaaatcgagcctgaaccttcgatgaaactggaagttggatcggttctatggttggaggagtcaaactatcaaaaaggttatcagattaacgaaatattgactaatggtacacttccttatcatattgcatcgccagtggatgatgcagggaagtctgtgtttctgtatgttggttctcctccttcacagcttgagccagcttgggaagacatgaacttatggtatcaggttcagagacagactaagatattaagtataatgaaacagagaggactctctagcaaatacctgccgcagctccatgggtctggtcggatcattcatccaggccaatgtcaaaaaccaagttcaggtggacgatgtgatcatccttggtgtggaactcccattcttgtgactactcctgttggcgagacagtagctgatttggtgaacgagggtcggtttggtccagaagaagctattcgatgttgccacgattgcttatctgcactttcttcatcctcttcagctggaattcgacacggtgatatccgcccagaaaatgtagtttatgtcacttctggtgtaagacatccttactttgtactaattggttggggtcacgcggtgcttgaggatagagatcgacccgcaatgaatcttcacttctcctcgacttacgcactccaggaagggaaactctgtgctgcctcagatgcagagagcttgatatacatgctttatttctgttctggagacttccctgaattggattcagttgaaggagctcttcaatggagagagacctcttggtccaaaagattgattcagcagaagctcggcgatatctcaaccgttttgaaagcattctctgactatgttgacagtctatgtgggacaccttatccattagattacgatatttggttgagaagattgaagaggaatctttcagaagaccatgggaaagaaattgaatcttcaggctaa

SEQ ID NO: 2567 - DNA, 375 bp, Arabidopsis thaliana
atggctcactggttgtcatccctagtcattgcattaacattcacaagctttttcactggtctctcagctagtcgccaccttcttcaatcaacaccagctattaccccaccggttacaacaacatttccaccacttcccacaaccacaatgccaccatttcctccttcaacttctcttcctcagccaactgcgtttccgccattaccaagctcacaaataccttctttacctaacccagcacaacccattaatatcccaaacttcccacaaatcaatatccctaacttcccaatttctatcccaaacaacttcccattcaatcttcccaccagcattccaacaatcccattcttcactccaccaccttccaaatga

SEQ ID NO: 2568 - DNA, 987 bp, Arabidopsis thaliana
atgacttcagatgctctcactataccatctgagcttgaatctgccttgcggctcaggactgtacaatactttattacaaaaaggccttggcttgatctttatggagtccatgtgaggcctgtgccaccattcggaagtacaagccgtaaacctcattttgatccagctttgattcatcgttgcttgcctgatgagcttcttttcgaggtgtttgctcggatgatgccttatgacttaggtagagcatcttgtgtttgtagaaagtggaggtacacagttcgaaaccctatgttctggcgtaatgcctgcttgaaagcttggcagactgctggggttatcgaaaactataagatcttgcagtctaaatatgatggatcatggaggaaaatgtggcttcttagatccagagttcgtactgatggtctttatgtgagtaggaatacttacattcgagctggaattgctgagtggaagattacaaatccagttcacattgtttgttactaccgctacataaggttctacccttctggcagatttctttacaagaactcttcacagaaattgaaggatgttgccaagtacatgaactttaaggcttctaaatctgaaaatctttacaaaggcacttatacactgtcaatgtcggatgataagatcgaagcagctgttctgtacccagggacacgccctactgtcttaaggattcgtttaaggttaagaggaacagctattggagcgaataacaggatggatttgctgtcacttgtgacaagtggtgtgaacgatgaggaaataagcagcacagaagaagacattcttgggttagttgaaggttgggaagacgatgaaactcacaacccggatatacctgccgtctcacacaagaggggtatgactgcattcgtcttcgttcctttcgaagaggttgacgaatcggttctgaacttgccaccggagaaaatggattactatgtcactggctaa

SEQ ID NO: 2569 - DNA, 2493 bp, Arabidopsis thaliana
atgtcttcttgggcctctttcatcttccttttcattttctcctttctcactagcttcagagtttttgctcaagatcctacttacagataccacagctgtcccaatacgacaattttctccagagacagcgcttacttctctaaccttcaaacccttctgtcctttctctcttcccccgacgcctcctctagctactccagtggattccgaaacgacgccgtcggaacctttccggacagagtcaccggactttttgattgtcgtggagacctcccgccagaagtttgccataactgtgtcgcctttgccgtcaaggacaccttaattcggtgtccgaacgagagagatgtcacgctcttttatgatgagtgtacgctaagatactcgaaccttgtggtaacatctgctctagatcccacttatgtataccatgtttgtcccagctgggcaacttttcccagaagcagcacttacatgactaatctcataacccttttgtctactctctcttccccctccgcctcatactccactggattccaaaacgccacggcaggaaaacaccccgacagggtaacaggacttttcaattgccgtggagatgtctcaccggaagtttgccgtagatgcgtctcttttgccgtcaacgaaacctcaactcggtgtcctatcgagaaagaagtcacactctattacgatcagtgtacactcagatactctaaccggaatatcctctcaacttctaataccaatggaggaattatcttggctaacagtcagaatatgacatctaacgaacaagcccggttcaaagatttggttttaaccacgatgaaccaagccaccatcgcagctgccaacagttccaaaagattcgacgcgagaagtgccaattttacgacgttgcatagtttgtacacactggttcagtgcactcatgatcttacaagacaagactgtttgagttgtctgcaacagatcatcaatcaattacccactgaaaaaattgggggacaatttattgtaccgagctgtagttcaagattcgagctttgcctgttctacaatcaatccgccgttacaacacctcaaccgcagcagaattcagctcctccaccaccgccaacttcaattccttcaccacgacctggtctgaacagtcgatttcctttgattacatgtttaagcgcagtttcttttgagaagttcaaagatttgctaaaaccagggttcatatgtattctaataaaaattgtttctgagaatacaggaaaaggcggaaactcctctgtcataattattgctgttgttgtttcaatcactgcccttcttctgctctttgtagctgtttttagtgtccgcactaagaggagaaaaaagatgattggagcgataccgttgttaaacgtaaagagaaaagacacggaagtcacggaaccacttgctgaaaatggggatagtattacaactgcaggctcacttcagtttgattttaaggcaattgtggcagcaacgaataactttttgccgattaacaagcttggtcaaggtggattcggcgaagtttacaagggtacatttcctagtggagtacaagttgcggtgaagaggctatcaaagacatctggacaaggtgaaagagagttcgaaaacgaagttgttgttgtggcaaagcttcagcatagaaatctggtaaggctgcttggttattgtctggaaggagaagagaagattcttgtctacgagtttgtgcacaacaaaagcctcgattactttctttttgacactacgatgaaacgacagctagactggacacgacggtacaagatcattggaggaattgctagaggaattctttatcttcatcaagattcacgactcacaatcatacatcgtgacctcaaagcgggcaacatcctcttggacgctgatatgaaccccaaagttgcagattttggaatggcgaggatttttgggatggaccaaacagaagccaatacgagaagagttgtgggaacctatggttacatggctcccgagtatgctatgtacggccagttctccatgaaatcagatgtgtacagttttggtgtcttagtatttgagattataagcggcatgaagaacagtagtctctatcaaatggatgatagtgttagcaacttggttacatatacttggagactatggagcaatgggtcacaattagaccttgtggatccgtcatttggagataattatcaaacacatgatattacgaggtgcatccatatcgctttactatgtgttcaggaagatgttgatgatcgtccaaacatgtcagcgatcgtccaaatgctcactactagctcgattgttctcgccgtgcctaaacaacctggatttttctttcggggtaggcatgaacaagtaggagaagtaggttcatctgtggataggcttgctctctgttcaatcgatgatgcttccattactagtgttgctcctcgttga

SEQ ID NO: 2570 - DNA, 954 bp, Arabidopsis thaliana
atgaatgcacacatgctcaatctccttgtcatagtcatttttgtagtttctttcgatgtccaagcactcagtcctcactactacgaccatacttgtccacaagccgaccacattgtaaccaatgcagtcaagaaagccatgtcaaacgaccaaactgtccctgctgcgcttttgaggatgcatttccacgactgtttcgtcagaggatgtgatggctcagttctcttagactctaaggggaagaacaaagcagagaaagatggacctcctaacatctcactccatgcattttatgtgattgacaatgcaaagaaggcattagaagaacaatgtcccggtatcgtctcttgcgccgacattctttcacttgcggcaagagatgctgtcgctctctcaggagggcctacatgggcagtgccaaaagggagaaaagatggaagaatatcaaaggcaatagaaacaagacaactaccagctcctactttcaacatttctcaattgcgtcaaaattttggccaaagaggcctctctatgcatgatcttgttgctctctctggaggtcatacactaggattcgcccactgttcatcgttccagaataggctccataaattcaacacacaaaaggaggttgacccaacactaaacccctcattcgcagccaggttggagggagtgtgcccggcccataacacggtgaagaatgctggatcgaacatggatggaaccgtgacgtcattcgacaatatctactacaagatgcttatccaaggcaagtcactattctcatccgacgaatcgcttcttgcagtaccctctactaagaaactcgtggccaaatatgcaaattccaacgaagagttcgagagggcttttgtgaaatcgatgatcaagatgagtagtatcagtgggaatggcaatgaggtcagacttaactgcagaagggttcgctag

SEQ ID NO: 2571 - DNA, 2829 bp, Arabidopsis thaliana
atggagggtttcctaacggatcagcagagagagatgatgaaagttgcaactcagactgcagatgatcttccaccctcacaaaaacctcactcggttttacttgagcatctgcctaaaccatctggtggtgggaaagcttctggtgcgtcaaatgctgtgaagcacagaaggtctcatgcgggaaggtctattcgctctaagaaggatggaggtggtgggaaaggaaattggggaaaacttattgacactgatggagactatcacattgacccgaatgatcctaattatgacagtggagaggaaccattcgagcttgttggtgcaactctgtcagacccattagatgattacaagaaagctgcagcttccatcattaacgaatacttcagcaccggtgatgttgatgtggcagcagctgacctcattgaacttggttcaagtgaatatcatccctacttcatcaagcggcttgtctcggtagcgatggacaggcatgacaaagagaaggaaatggcctcggttttgctttccgcattgtatgctgatgtcattaacccgaaccagataagagatggatttgtcctgctgctcgagtcagccgatgactttgtggtggatatacctgatgctgtcaatgttcttgctttgttccttgcacgtgctgtcgtggatgacatacttcctccagcttttcttcctagggctgccaaggcacttccaataacttctaaaggttaccaggttgtccaaactgcagagaaaagctatctatcagctgcacaccatgctgagctagtagaaagaaggtggggtggacagactcgaaccactgttgaggaagtcaagaagaagattgctgacattttgaatgaatatgtggagactggagagacttatgaggcatgtcgttgcgtaagagagttgggtgtttctttctttcaccatgaggttgtgaagagggccttagttactgccttggaaaaccacgcagcagaagcacctgtattgaaactgctaaatgaagcagcttcagaaaacctgataagctctagtcaaatggtgaagggattttcaagattaagagaaagccttgatgatcttgctcttgacattccttcagctagaaccaaatttggtttgattgtgccaaaagctgtctcaggtggttggcttgatgcttcgtttggttatccctctggtgaatgtggacgacaacagaacgaggatgagaaactaaagcggttcaaggaagacattgtgaccatcattcatgagtatttcaactctgatgacataccagaactcatacgcagtcttgaggatttaggagcacccgagtacaacccaatttttctaaagaagctgataacacttgctttggacaggaagaatcacgagaaagaaatggcatctgttcttctctcatctcttcacatcgagatgttcaccacagaagatgttgcagatggtttcgtcatgctcctggagtctgcagaagatacagctcttgacattctggatgcgtccaacgaacttgctctgttcttagctagagctgtgatcgatgatgttttagcaccttttaacctggaagagatcagtagcaaactacgccctaactcaagcggaactgaaaccgtgaagatggctaggtcactcatctttgctcgacatgcaggagagaggcttctaagatgctggggaggtgggagcggttgggcagtggaagatgcaaaggacaagatatcaaatctcctggaggaatacgaaagctcagggctggtatcagaagcatgcaaatgcatccatgagctaggcatgcctttcttcaaccatgaggtggtgaagaaagcactggtgatgggtatggagaagaagaaggacaagatgatgctggatcttctgcaggagagtttcagtgaaggactcataaccacaaaccagatgaccaaagggttcacaagagtcaaagacggacttgaagatcttgctttagacatcccaaacgcaaaggagaaattcaacgactacgtggagtatgggaagaagaatgagacaacaaggaagggaagtctcgaagctaacatgaaattcgtaataccaaaactacccttcacactctctctcttcctctccctctcttttctcatcatcttcctcttcgccttccccaccacattcctccgccgtcctctctcctcctcttcctccgtcacctccgttgccgacgaaggaatacggatccgtcaccatggatactcctcctacgaagcatacatcaaacaccagctcaacaaaactcagaacccgaagctacgtaaggtatggacaacgcgcgactgggacaggaaagttcgtgtgttctccactttcttccgacgtctcagcgatcgcggtcttctctcaaatcaatcaaaagctctctcgatcggtgctcgggttggacaagaggttgcggcgttgagattgatcggcgtggaagactccgtcggaatagatctggttccgcgaccacctctcgtggtgaaaggtgacttccacgcgcagccgttcgacgaagagacattcgatttcgaattctcaaacgtgttcgatcacgcgctttacccggagaagttcgttggggagatcgaacggactttaaagcccggaggggtgtgtgtgttacacgtgtcgatatctgggaagacggataagtactcggctaacgatttgcttagtgtgaaaccattggtgaaattgtttaagagatccaaggttgtggagatgaggaagatcgatgggtttgggcttgacactgagattgtttttagaaagaacatgaactaa

SEQ ID NO: 2572 - DNA, 1440 bp, Arabidopsis thaliana
atggagtctaagtggctctttggtaggaaacaagaagctgaagttggacccttttctgcttggaatataacaggaacttatagaggtttgccgcatgcccttctccattttttttacgtcttttacacttcaggattgtctacgatgttgtggcttaatgttttagactacttatcaaatgtaaagcgggtattttcaggaacttggaagtttctgaattccttaaatagctcttcgaagtttcaagactttcaaaaagaaaatggtaattctgtggttgagttagtagcagttccaacgaagataactggtgtgcattatgttcagcttggaattttctcctctcaagtgtttcaagaatctccaagagacagattactgaaacggaaactttctccagtaaatgagatggagaagcactgtaatatcgaaatagcagctcaagtatcccgtgtggcttctagtgaaaataatggagacaaaaattattatcacatggaaggattgatggaaagtcctggggtaggcgatgacggagattgtttttcccctttgttactgaacgcaacttctgtaaatgttgaagtctactataacaaagctgtgaactatacactgatggttcttctgttgatccggcaaatggagcacgtgttaaacctaaagcttactacttctcatgcagaatctctatttaatgcatttgcaaccgctgcgttcttcaagttcgtagtcttttcgatttttgagatgagatatcttctggctatatggaaagcaacccgtccttccaatagcggagagggttgggaaacaatgaggagagaactgtcctttctgtacagtcgtttctatgggatccttcttggaggcattttgataatgtaccagttccacaactacatgcagccgattctccttctcatgtactcattttggataccacaaatagtcgccaatgttgtccgggattcaagaaagcctctgcacccatattacatcttgggcatgacagctacacggttagctataccgttatatgtttttggatgcccacacaacttcatgcgtgtagagcccaacaagcattattttggttcacgctgctttgttccccgtcagatgctaccagagaaatacaactaccaccgaagatttaatcgggatgtaagccgcaccactgattgtgttatctgcatgaccgctattgatctcagacagcataccagtgattgcatggtactgcagttttttcctgcttctcttaactatattttttccccaatagacagaatcatgagtgtggttgttctgaaaacagagatggatggatataaaaatggagtgtccaacttgtcggcggtctcttcctccagcatagaggatgttttcggtttgttaggatgtacagacttcactcagattattgcgggtctatag

SEQ ID NO: 2573 - DNA, 612 bp, Arabidopsis thaliana
atgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaa

SEQ ID NO: 2574 - DNA, 1404 bp, Arabidopsis thaliana
atggaagaagagcttgccatgcttagacagctcatcggtcagcttcaagagctcttgcacaacggctctcctcctcctccttcttcttcttcatctctgtcgtcttcttctccgtcatttttggttctccaccatcctcagtatcagaacggatggtgtttgccctgtattgaggatacttctgctgatgattgttgtgatattgtaatggctggtggaaagaggcctgggatcttcaagatgttagaaactgtcaagcctcccgtcaaacgaactcgaaaagaacggactcaagggaaatcatgtacggaagtagatgagataagtgggaacatggatcaagaaatatggcaggaattccctcaagatctctttgaagacgttgtttccagactaccaatggctacttttttccagttccgtgcagtttgccgtaaatggaatgctcttattgattcagatagcttctccagatgcttcactgagcttcctcagaccatcccatggttctacaccataacccacgagaatgtcaactcaggacaagtgtacgacccttctttgaagaaatggcaccatccgattatcccagcactacccaagaagagtattgttttgccaatggcttctgcaggaggtctagtgtgcttcctcgacattggtcataggaacttctacgtgagcaacccgcttaccaagtctttcagggagttgcctgctaggtcgttcaaggtctggtctcgtgttgcggtaggaatgactctgaatggaaactccaccagtcatgggtataaggtcttgtgggttggatgtgaaggagagtacgaagtctatgattccctgagtaatgtgtggaccaaacgagggaccatcccgtccaacataaagctcccggtgttgctcaactttaagtcacagccagtggctatccacagcacactttacttcatgttaacagatcccgaagggatattgtcctatgacatggtctctgggaaatggaaacagttcattatacctggcccaccagacctgagcgatcacacgctggctgcgtgcggagagcggttgatgctggtgggtctactgactaaaaacgctgccacttgcgtttgcatatgggagctgcagaagatgacactgttgtggaaggaggttgacagaatgccaaacatatggtgcttggagttttacggaaagcacattaggatgaattgtctgggcaacaaaggttgtctgatattattgtccttgaggtccagacagatgaaccgtctgataacctacaatgctgtgactagggaatggaccaaggtccctggctgcaccgttcctcgtgggaggaaaagactttggatcgcttgcggaacagcgtttcatccctcccctacagctagggcttga

SEQ ID NO: 2575 - DNA, 1626 bp, Arabidopsis thaliana
atgggaaattcaaaaccactccctacaatttcttgtattatagtttcagtcttgtatttttcattctattgcataacaccaacttcttcatcagcctccatccaagatcaattcataaactgtgtcaaaagaaacacacatgtttcttttccactcgagaaaacgttattcacccctgcgaaaaacgtctctttgttcaaccaagtccttgaatcgacggctcaaaatctccagttcttggcaaaatccatgcctaaaccgggattcatattcagaccgattcaccagtctcaagtccaagcttccatcatttgttcaaagaaactcggaattcattttcgtgttagaagtggcggtcacgatttcgaggccttgtcttatgtttcacggattgaaaaaccgtttatattactcgacctgtcaaaattgaaacaaatcaatgttgatattgaatccaatagtgcttgggttcaacctggtgctacgcttggtgagctttactacagaattgcagagaagagcaagatccatggatttcccgcgggtttgtgcacaagtgtaggcataggtgggtatatgacaggcggtggatacggtaccttgatgaggaagtatggtcttgcgggagataatgttctagacgtaaagatggttgatgcaaatggtaaattactcgacagagccgcgatgggtgaggacctattttgggcgattagaggaggcggtggagcgagtttcgggatagttctagcatggaagatcaagcttgttcctgttcctaagactgttaccgtcttcactgtcaccaaaacgttagaacaagacgcaagattgaagactatttctaagtggcaacaaatttcatccaagattattgaagagatacacatccgagtggtactcagagcagctggaaatgatggaaacaagactgtgacaatgacctacctaggtcagtttcttggcgagaaaggcaccttgctgaaggttatggagaaggcttttccagaactagggttaactcaaaaggattgtactgaaatgagctggattgaagccgcccttttccatggtggatttccaacaggttctcctattgaaattttgcttcagctcaagtcgcctctaggaaaagattacttcaaagcaacgtcggatttcgttaaagaacctattcctgtgatagggctcaaaggaatattcaaaagattgattgaaggaaacacaacatttctgaactggactccttacggtggtatgatgtcgaaaatccctgaatctgcgatcccatttccgcatagaaacggaaccctcttcaagattctctattacgcgaactggctagagaatgacaagacatcgagtagaaaaatcaactggatcaaagagatatacaattacatggcgccttatgtctcaagcaatccaagacaagcatatgtgaactacagagatctagacttcggacagaacaagaacaacgcaaaggttaacttcattgaagctaaaatctggggacctaagtacttcaaaggcaattttgacagattggtgaagattaaaaccaaggttgatccagagaacttcttcaggcacgagcagagtatcccacctatgccctactag

SEQ ID NO: 2576 - DNA, 705 bp, Arabidopsis thaliana
atggcgattgctctctcgtcgtcgtcgacgatcacgtccattactctgcagccgaagctgaagacgattcatggattagggacagtacttcctggttattcggtcaaatctcactttcgtagtgtctctctccggcgtagcgccgtggtcgtgtcggccattaccggagcttcttccggagctggaatagggaaaggtacagctgattcgctagatacagtgaaagtcttggatttgagaggaaatgagattccgatttctgatttatggaaagataggaaggccgttgttgcatttgctcgtcattttggatgtgtgctctgtcggaaacgagcagcttatcttgcagaaaagaaggatgtgatggatgcatctggtgttgctcttgttctgatcggaccgggaagcatcgatcaggctaatacttttgtggaacagactaagtttaaaggagaggtctatgcggatccaaaccacgcatcatacgaggcgcttgagttcgtttcaggggtttctgttacatttacacccaaagctgctatgaagatactagagtcttacatggaaggataccgccaagactggaaactctcgtttatgaaagatacagttgaaagaggcggctggcaacaaggcggaatcttagttgctggccctgggaaagataacatctcttatatacgcaaggtaatctctttcgtctaa

SEQ ID NO: 2577 - DNA, 1668 bp, Arabidopsis thaliana
atgacttggagtgatgaccagagttacttactcattgtagaaagtcaaacgtggcaacacagctttgcacgcttcattgacatacacgtcgacgaaaaaaccatatccgctcatcgagaaagtcggaatttttccgagaaaattcaaaagggcgaaaaaaagagcttttgcgtacagttttcgaattggtctccttcgtacggtgagtttgatgctgatgaaatgggttatgcaatgagtagacttgagatagaatccgatctatgtgatactggaaaagacgtttgtggagttggtagtagtagtggtagtcacagatcaagtgaacatttggctgatctagaccatgaaatcagccaggttactaaattgaaatctagtcctcatcaacggtatagccgtgaagtccctgggagacatcagttacctgtgtctactgtgaggatgttggcaggtcgagaaagtaatttctctggaagaggaaggttttcagccgctgattgttgccatatgctaagcagatatttgcctacaaaaggtccttggcttgtagatcaaatggacagccgagcatatgtctctcagttttcaactgatggttctctctttattgcggggtttcagggtagccgtattcggatttacaatgtagagaagggttggaaagttcaaaaggatattcttgcaaaaagcttgcgttggactgttactgatacttctctatcccctgatcagcgaaatctggtttacgcaagcatgtcacctattgttcacattgttgatgttggatccggttcaaccgagtctcatgcaaatgttacggagatccatgatggcttagacttctcttctgatgaagatggagggtactcttttggaatattctctgtgaaattttcaacagatggccgagaagttgttgctgggagcagtgatgattccatttatgtttatgaccttgaagcaaatcgagtttcactccggactgttgcacacacgtctgatgtaaatactgtgtgctttgctgatgaaagtgggaacctgattttatctggaagtgatgataatctctgcaaagtgtgggataggcgttgtttcattgggagagataagccagctggtgttttagtgggacacctcgaaggtgttacctttatcgatagccgtggagatggtcgctatttcatatcaaatggtaaagaccaaactatcaaattgtgggatatcagaaaaatgtcctcaagcgcacctgcaaggcatgaggtgctaagaaactatgaatgggactacagatggatggattatcctactgaagcaagagatctaaagcacccactcgatcagtcagtgtcgacatataaaggtcactcagttttgcgtactctcatccgttgttacttctctccagcgcatagtactggccaaaagtacatctacacaggatcgaacgacagttccgtctacatatacgacttggtaagtggagataaagtggcagtgctaaagcaccatagctcacctgtaagagactgtaattggcacccatattacccaacgcttataagctcttcgtgggacggagatcttgtgaagtgggaatttccggggagcggtgaggcgccgattatgagtaagaagagggttcgaaggagacatttctactactga

SEQ ID NO: 2578 - DNA, 2703 bp, Arabidopsis thaliana
atggaccaaacccaggaaaacacaagcagaatagttggtaccttcggttacatggctcctgaatatgcaatacatggccagttctcggtgaaatctgatgtgtatagcttcggagtgttggtgcttgagattataagcggtaagaagaacaacagcttttacgagacagacggcgcacatgacttggtcacacatgtaagtttaaaggccattaaggattatatttacctcgttaacaataagaaatgtgatagacagaaaaaagctttgctgtggtgtctgcacaagaatgcggcaaaacagggttttttgtaccacaaagtaggtatgaaacaaaccggggccttctcctctcttctcttccttccaatgtttcagctcgaggaggattctacaattcttcgattggccaaggccctgatcgagtgtatgctctggggatgtgcattgaaggtgctgaaccagatacacgtgtctcaaccagacagaagcctggcctggccggagaaacggattttgtgtatggtacgatactccaatagttctttttttggatcactcaaggcagaaccgcatttctatatccacaacgtggatgatattacatccaatttaacagagtttgatcaagtgtgggaagagttagcacgtcgtatgatagctagtactacttctccatcatctaaacgcaagtactacgcagcagacgtagcagccttgacagctttccagataatatatgcactaatgcaatgcactccggacttatctttggaggattgccatatctgtttaagacaaagtgttggtgactatgaaacatgctgcaatggaaagcaaggtggcattgtgtaccgagccagctgtgttttccggtgggagctttttcccttctctgaggcttttagtcgtatttcgttggcacctccgcctcaatccccagcatttcccacgcttccggcagtaaccaatacagcgaccaagaaaggtagcataacaatctcgataggaattgtctgggcaatcattattcctactgtcattgttgtcttcttggtactgcttgcgctaggatttgttgtttataggaggaggaaatcataccaaggatccagcactgatatcaccattacacactcactgcaattcgatttcaaagcgattgaagatgcaacaaataaattctcggagagcaacataattggtcgcggtggatttggagaagttttcatgaagggatctagacaatgggatgacatatgctgtctaattcaatttatgcagggtgtccttaacggtactgaagttgcaattaagaggctgtcaaaagcatcgagacaaggtgcacgagaattcaaaaatgaggttgttgttgttgcaaaactccatcataggaatcttgttaagcttctcgggttttgtctagaaggagaagagaaaatacttgtttacgagtttgtccccaacaagagcctcgactacttcctctttgaccctacaaagcaagggcagttagactggactaaacgatacaacattatccggggaatcactcgaggaattctgtatcttcatcaagactcacggctcacgatcatacatcgtgacctcaaagccagcaacattctcctagatgcagatatgaacccaaaaattgctgattttggaatggcgagaatttttgggatcgatcaaagtggagctaatacaaaaaaaatagctgggacacgcggttacatgcctccagaatatgtgaggcaaggtcagttctcaacaagatcagatgtttatagtttcggagtcttagttcttgagattatatgtggtcgaaataacagattcatccaccagtcagacactacagttgagaatttggtcacatacgcttggaggttgtggagaaacgattcaccattagaactcgtggatccaaccatttcggagaattgtgaaaccgaagaagtgacaagatgcatccacattgcgttgctgtgtgttcaacacaatcccacagatcgccccagcttgtcgacaatcaacatgatgctcataaacaattcgtatgttttacctgatcctcaacaacctggattcttctttccaataataagcaaccaagaacgagatggcctcgactctatgaacaggtccaatccacaaactatcaatgatcttatgagtcttcgtttttttttgtctttaattcttcgtattctcatctctgatagcgttgctctgatttttccaatcaatggctttcctgttgtgtttgtaccaagcgggaaaactggcgtttttacacccaatgataagtatgatacaaaccgtcgccttctcctctcttctctagcttctcatgttgtagctcgaggtgacttctacagtaattcacttggccaagtctatgatcgggtgtatgctttggggatgttcatctcagttgttgaaccaaaggtttgctcaaactgtatcgaccttgcttctaaagaggtgttagaggaatgtaccaaccagacagaaggcattgcctggcccgaaaatgggattctttgtatggtacgttactccaaccgttcgttttctggatcacttgagatggaaccaaagtatatatgcatgtacaatactggagatatcggatccgaaaactttgataacctgtgggacgacttgacaagtcgtatgatagctggagttatatga

SEQ ID NO: 2579 - DNA, 1971 bp, Arabidopsis thaliana
atgtcttctctgatctgtttcattttccttttccttttctcattcatcactagcttcacagcttctgctcaaaatcctttttacctatatcataattgttctatcacgacaacttactcaagtaacagcacttactccaccaatctcaaaacccttttgtcctctctctcttctcgtaacgcctcttactccaccggattccaaaacgccactgcgggacaagcccccgacatggtcaccggacttttcctctgccgcggaaacgtctcacctgaagtttgccgtagctgcatcgccttgtctgttaacgaatcgttaagtcggtgtccaaatgagagagaagccgtgttctattacgagcagtgtatgctcagatactctaaccggaatatactatccactctaaacaccgatggaggagtgttcatgcagaacgctaggaatcctatatcagtcaaacaagatcggttcagagatttggtcttgaaccccatgaacttagctgccattgaagccgcgaggagtatcaaaagattcgctgtgacaaaatttgatttaaatgcattacagagtttgtacggaatggttcagtgcactcctgaccttacggaacaagactgcttagactgcctacaacaaagcatcaatcaagtaacctatgacaaaattgggggaagaacttttttgccgagctgtacgtcaagatacgataattacgagttttacaacgaattcaacgttggaaaaggcggaaactcctctgtcatagttattgctgttgttgttccaatcactgtcctttttcttctattcgtagctttttttagtgtccgccgcgctaagagaaaaaagacgattggagcgataccgttgtttaaagtaaagagaaaagagacggaagtcacggaaccacctgctgaaactacagatggggatgatattacgactgcaggctcacttcagtttgattttaaggcaattgtggcagcaacggatatctttttgccgattaacaagcttggtcaaggtggtttcggcgaagtttacaagggtacatttcctagtggagtacaagttgcggtgaagagactatcgaagaattcaggacaaggtgaaaaagagtttgaaaacgaagttgttgttgttgcaaagctccaacatagaaatttagtaaaactgcttggttattgtttggaaggagaagaaaagatacttgtctacgagtttgtaccaaacaaaagcctcgattactttctttttgaccctacgatgcaagggcagctagactggtcaagacggtacaagatcattggaggaattgctagaggaattctttatcttcatcaagattcacgactcacaattatacaccgggacctcaaagcgggcaacatcctcttggacgctgatatgaacccaaaagttgcagattttggaatggcgaggatttttgggatggaccaaacagaagccaatacgagaagagttgtgggaacctatggttatatggctcccgagtatgctatgtacggcaagttctccatgaaatcagatgtgtatagttttggggtcttggttcttgagattgtaagcggcatgaagaacagtagcctcgatcaaatggatggtagcattagcaacttggttacatatacttggagactatggagcaatgggtcgccatcagagcttgtggatccgtcatttggagataattatcaaacaagcgaaattactaggtgcatccatatcgctttactatgtgttcaagaagatgctaatgatcgtccaactatgtctgcaatcgtccaaatgctcactactagctcgatcgctctcgccgtgcctagaccacctgggtttttcttacgaagcaagcaggaacaagcagaaagagcatgtccatctatggatacatctgacctcttttcaatcgacgaagcttccattactagtgtagctcctcgttaa

SEQ ID NO: 2580 - DNA, 2460 bp, Arabidopsis thaliana
atggaacctgcaactcttactcgttcttcctctcttactagattcccttatcgtcgtggtttatccactctccgactcgctcgagtcaactcgttctcaattcttccacctaaaactcttctccgtcaaaaaccgcttcgtatctctgcttcccttaatcttccaccacggtcgattcgtctacgtgctgtcgaagatcaccatcacgatcatcatcacgatgacgagcaagatcatcacaaccaccatcatcatcaccatcaacacggatgctgttctgtggaattgaaagcggagagtaagcctcagaagatgttgttcggattcgctaaagctatcggatgggttagattggccaattacctcagagagcatcttcatctttgctgctccgccgctgcaatgttcctcgctgccgccgtctgtccttaccttgctcctgaaccttacattaagtctcttcagaacgcattcatgattgttggttttcctcttgttggagtttcagcatctctcgacgcacttatggatatagctggaggaaaagtgaacatccatgtcttgatggcacttgcggcttttgcatctgtgtttatgggaaatgctttggaaggaggattgcttctagctatgttcaatcttgctcatattgctgaggagttctttactagtcgatcaatggtggatgtcaaagaattgaaagagagtaatccagattctgcattgttgatcgaagtacacaatggcaatgttccaaatatatctgatttgtcatacaaaagcgttcctgtgcacagcgtagaagttggatcctatgttttggttggaactggtgagattgtgcctgtagattgcgaagtctatcaaggtagtgctacaattacaattgagcacttgactggggaagtcaagccgttggaggcaaaagctggagatagagtgcctggtggtgcaagaaatttggatggcagaatgattgtaaaggctacaaaggcatggaatgattcgacgcttaacaagattgtacagctgaccgaggaagcacattctaataaacccaaacttcagagatggctggatgagtttggcgagaattacagcaaggttgtcgttgttttgtcacttgcaattgccttcctaggtccatttttgttcaagtggccttttctcagcaccgcagcatgtagaggatctgtttacagagcattgggacttatggtggccgcatcaccatgtgctctggccgtagctccattggcttatgctactgctattagttcctgtgcaagaaagggaatattgctgaaaggtgcacaggttctagatgctcttgcgtcttgccatactattgcttttgacaaaactggtaccttaacaaccggcggccttacttgtaaagcaattgaacccatttatgggcaccaaggaggaactaattcaagtgtaataacttgctgcattccaaattgtgaaaaagaagctcttgcagttgcggctgccatggagaagggcaccacgcatcctattggaagagctgttgtagatcacagtgtgggtaaggatcttccttctatttttgttgaaagcttcgaatattttcctggtagaggccttactgctactgtcaacggtgttaagacagtagctgaagagagtagattacgaaaagcatcacttggttctatagagttcattacctcacttttcaaatctgaagatgaatctaaacagatcaaggatgctgtaaacgcgtcttcgtacggaaaggacttcgttcatgctgctctttctgttgatcaaaaggtaacattgattcacctcgaagatcagcctcgtccaggggtgtcaggagttatagcagaacttaaaagctgggccagactccgagtaatgatgttaactggggaccatgattcaagtgcttggagagttgcaaacgcagtgggtattaccgaagtctactgcaacctaaagccagaggataagttaaatcatgtaaagaacattgctcgggaagcaggtggaggtttaattatggtaggagaagggattaatgatgctccagctctagcagctgcaacagtggggattgttcttgctcaacgagcgagtgccactgcgattgccgttgctgacatcttactgcttcgagacaacatcaccggtgttccgttctgtgtcgctaaatcccgccagacaacatcattggtcaagcaaaacgtagctcttgcattaacatcgatattcttggccgctcttccttcagttttagggtttgtcccattgtggttgacggtacttctacatgaaggcgggactcttctggtgtgtctaaactcagtacgtggtctaaacgatccatcatggtcgtggaaacaagacatagttcatctaatcaacaagttacgctcacaagaaccaaccagtagcagcagcaacagtttaagctctgcacattag

SEQ ID NO: 2581 - DNA, 708 bp, Arabidopsis thaliana
atggcggtagaagacactcccaaatctgttgtaacggaagaagctaagcctaattcaatagagaatccgattgatcgataccatgaggaaggtgatgatgccgaagaaggagagatcgccggaggagaaggagacggaaacgttgacgaatcgagcaaatccggtgttcctgaatcgcatcctctggaacattcatggactttctggttcgataatcctgctgtgaaatcgaaacaaacctcttggggaagttccttgcgacccgtgtttacgttttcaactgttgaggaattttggagtttgtacaacaacatgaagcatccgagcaagttagctcacggagctgacttctactgtttcaaacacatcattgaacctaagtgggaggatcctatttgtgctaatggaggaaaatggactatgactttccctaaggagaagtctgataagagctggctctacactttgcttgcattgattggagagcagtttgatcatggagatgaaatatgtggagcagttgtcaacattagaggaaagcaagaaaggatatctatttggactaaaaatgcttcaaacgaagctgctcaggtgagcattggaaaacaatggaaggagtttctcgattacaacaacagcataggtttcatcatccatgaggatgcgaagaagctcgacaggaatgcaaagaacgcttacaccgcttga

SEQ ID NO: 2582 - DNA, 1149 bp, Arabidopsis thaliana
atgtcttcagatcaactaagcaaattccttgatagaaacaaaatggaagacaataaaagaaaagtattagatgaagaagcgaaagcttctctagacatatggaagtatgtctttgggtttgcagatatagcagctgcaaagtgtgccattgatcttaaaataccagaagccattgaaaaccatccttcttcacagcccgtaacactagccgaactctcctccgccgtctccgcctctccctcgcatctccgccgtataatgaggtttcttgtacaccaaggaatctttaaagaaatccccacaaaagatggtttagctacaggctacgttaatacgccactctctcgccgtttgatgatcacaagacgtgatggaaaatcgctggctccttttgttctcttcgaaacaactcccgagatgctcgctccatggttgagacttagctcagtcgtttcttcgccggtcaacggttcaactccaccaccgtttgatgcagtgcacggtaaggacgtgtggtcgttcgcgcaggataatcccttcctcagcgatatgatcaatgaggccatggcttgtgatgcaaggcgcgtggtgccacgtgtagccggagcttgtcacggcttgtttgatggcgtgactacgatggttgacgtaggaggtggtacgggagagacgatggggatgcttgtgaaggagtttccttggatcaaaggatttaactttgatcttcctcatgtcattgaagttgctgaagtcttggacggtgttgagaatgttgagggcgatatgtttgattctattccggcttgcgacgccattttcatcaagtgggtgttacacgattggggagacaaagattgcataaagatattgaagaattgcaaagaagcggtccctccaaatatcggaaaagtgttgatagtggaatcggtgatcggagagaataaaaagacgatgatagtggacgaacgagatgaaaagttagagcacgtgagattgatgcttgatatggtgatgatggctcacacaagcacaggcaaagaacggactttgaaagaatgggactttgttcttaaagaagctggctttgctcgatatgaggttagggacattgatgatgttcagagtcttataatcgcgtatcggtcttaa

SEQ ID NO: 2583 - DNA, 1776 bp, Arabidopsis thaliana
atggtaaccgaagctttcgaattcgtcgccgttcctttcaattccgatggctggggacctccagacgcttccgacgtttcctcctccgcctctcccaccagcgtcgccgccgctaatcttctcccgaacgttcctttcgcttccttctcccgttccgataagctcggccgtgtagctgattggactcgcaatctctctaatccatccgctcgtcctaacaccggatccaaatcagatccgtctgcagttttcgatttctccgctttcgcaatcgacgaaggcttcggtctcgcttcctccggtggtaatcccgacgaagacgcagctttccgtctcgtcgacggtaaacctccgccgcgtcctaaattcggacctaaatggcgtttcaatcctcaccacaatcggaatcagcttcctcaacggcgagatgaagaagttgaagctaagaagcgtgatgctgagaaggaacgagctcgtcgtgatcgtctctacaataacaaccgtaacaacatccatcaccaacgccgtgaagctgccgctttcaaatcatccgttgatattcagccggagtggaacatgcttgagcagatccctttctcaacattctcgaagctctcgtacacagttcaagaaccagaagatcttcttctctgtggtggccttgagtactacaaccgccttttcgatcgcataacgccgaaaaacgaacgcagactcgagcgtttcaagaacaggaacttcttcaaagtcactactagtgatgatcctgtgattaggcgtttagctaaggaagacaaagctactgttttcgctactgatgctatattagctgctcttatgtgtgctcctagatctgtttactcttgggatattgttattcaacgtgttggtaacaaactgttctttgacaagagagatggatcacagcttgatttgttgtctgtgcatgagacatctcaagagccattgcctgagtctaaagatgatatcaattctgctcattctctaggtgtggaagctgcttacatcaatcagaacttttcgcagcaggttttggttagagatggaaagaaggaaacttttgatgaagccaatccatttgctaatgaaggtgaagagattgcttctgttgcttataggtatagaaggtggaagcttgatgataatatgcatcttgttgcgaggtgtgagttacagagtgttgctgatctcaacaaccaaaggtcgtttcttactttgaatgctcttaacgagtttgatcctaagtactctggtgttgattggagacagaagcttgaaactcagagaggtgcggttttagctacagaattgaagaacaatggaaataagttggctaaatggactgcacaagctttattggctaatgctgatatgatgaagattggttttgtctctagggttcatcctcgtgatcatttcaaccatgttatattatctgttttggggtataagccgaaggatttcgctggacagattaatctcaacacttctaacatgtgggggattgtgaaatccatagttgatctgtgtatgaaactaagcgaagggaagtatgttcttgtgaaggatccatcgaagcctcaagtgaggatttatgaggttccacctgatgctttcgagaatgattacgttgaggaaccgttgcctgaagatgaacaggttcagccaactgaggaaaacacagagggagcagaagcaagtgtagctgcaactaaagaaaccgaggagaagaaagctgatgatgctcaagcttga

SEQ ID NO: 2584 - DNA, 306 bp, Arabidopsis thaliana
atggcaacgataaggaacttgaagataaaaacatcaacatgtaaaaggattgtgaaagagcttcactcttatgagaaagaagttgagagagaagcggctaagactgctgatatgaaggacaaaggtgctgatccctacgaccttaaacaacaggaaaatgtgttgggtgagtctaggatgatgattccggattgccacaaacgtctcgagtctgcattggctgacctcaagtccactttggtaaactacattttccattgttattgcttgctaagcgtcggtctagctttatgtattagtttataa

SEQ ID NO: 2585 - DNA, 1143 bp, Arabidopsis thaliana
atggattcaaataatcatctctacgacccgaatcccaccgggtcgggtcttcttcgttttagatcagctccgagctctgttctcgccgcttttgttgacgacgacaagattggtttcgactccgataggttgctttcaagattcgtgacctctaatggcgttaacggagatctgggttcacctaaattcgaggataagtctccggtttcgttaacgaacacctctgtttcatacgccgccactctgccgccaccgccgcagcttgagccgtcgagttttctgggtttgccgccgcattacccgaggcagagtaaagggataatgaactcggttggtttggatcagtttctcggtatcaataatcatcacaccaaaccagttgaatctaatcttctccgtcaaagcagctctccagccggaatgtttactaatctctctgaccaaaacgagttaaagcactttggactcaacaaatctaataagtgtttactatatacttacaaatttgcaggttatggttcaatgaggaatttgatgaattacgaagaagatgaagagagtccatctaattccaatggattaagacgccattgcagtctctcttcaaggccaccttcttcacttggaatgctttctcaaatacctgaaatcgcacccgaaactaattttccatatagccattggaatgatccatccagctttattgataacttatcctcacttaaaagagaagccgaggacgatggaaaattgtttctcggagctcagaacggagagtccgggaatcgtatgcagttactgtcgcatcatttgagcctaccaaagtcatcatcgacagcctcggacatggtttcagtggataagtatcttcagctacaagattctgttccttgtaaaatcagagccaaacgtggttgcgctacacatcctcgaagcatcgctgaacgggtaagaagaacgcggataagcgagcgaatgaggaagttacaagagcttgttcctaacatggacaagcaaaccaacacttcggatatgttggatttagctgtggattacatcaaagatttacaaagacagtataagattttaaacgacaacagagctaactgtaagtgtatgaacaaggagaagaagtcaatatag

SEQ ID NO: 2586 - DNA, 822 bp, Arabidopsis thaliana
atgactactctttcctttgctcagacatgttctaaatacaagttctccagcaacaatgtctttgactcttgcaacgatcttccttttcttgattccttcctccattacacttacgagtcttccaccgggagcctccacattgcttatcgccacactaagctcacctctggtaaatgggttgcttgggctgtgaacccaacgtctacgggaatggtgggagctcaagccatcgttgcttatccacaatcagatggtactgtcagggtttacacttctcccatcagaagctaccagacgagtctactagagggtgatctgagtttcaatgtctctggtttgtctgcaacttaccagaacaatgagatcgttgtgttggcaagtctgaagcttgcacaggatcttgggaatggtggaaccattaacacagtgtggcaagatgggtcaatgtctgggaacagtcttctgcctcatccaacttctggcaacaatgttcgatcagtgtcaactctcaatctggtatccggtgtttcagcagctgcaggaggagctggaggaagttccaagcttcgcaaacgcaatattcatggaatattgaatggagtgagctggggaatcatgatgccactaggggcaatcattgctcgatacttgagagtagccaaatcagcagaccctgcttggttctacattcacgtttctgccaggcttctgcttacatcatcggtgttgccggatgggccactggtctcaaactcggtggcgactcaccagggattcagtacagcacccaccgtgccatcgggatcgctctcttctctctag

SEQ ID NO: 2587 - DNA, 1035 bp, Arabidopsis thaliana
atgcgcagcctcactctaggtctgactctcagatcctcctcctcctcttctcttccattcacctgcaactcccgcttctgctctcctcctcctccttcttcgtcctttagactctacaaacgattccatttccttaaaccatgctcttccctaaagcaaaccaagaagaagaagcaacagtctctcccatctaccgctccgcctcctcagagtctccggtggttcttcaattctaaatccactaatgatgaaaacgacgaagatgatgttaagtctgagagcgatgatgatggcggatcggaaggtgatgctgctattaagggtactatcttagccggagttttgttgattggtactgttggtggattcgccggcgttggatatgtctacagggatcagatcaatactttccttactcaattctccacttacatcgaaggttatggtacggctgggtatgcgttattcattgccgtctatgctgggcttgagatactagccattccagctctcccattgacgatgtcggctggtcttctcttcggtccactcattggcactatcatagtttctatcagtggaactatggctgctagtgttgctttcttaattgctagatattttgcccgagagcgcatccttaagttagttgaagacaacaagaagttcctcgccattgataaagcgattggtgaaaatgggtttagagttgttactctccttcggctaagccctctacttcctttctctcttggcaattacctgtacgggttgacgtctgtgaagtttgtgccttatgtattaggaagctggttgggtatgcttccaggctcttgggcttatgtcagcgccggggcttttggacgagcaatcattcaagaagaatctaatgttggcttgcctggaggaaacggccagcttttaactctcggggtgggtctgttggttactgcattggctggaacatatgtgacaagccttgcaaaggatgctataaaggatattgatgatgatgagaagagagatgcaaagtag

SEQ ID NO: 2588 - DNA, 750 bp, Arabidopsis thaliana
atggaatcgctaacatctatttctccttccataattcttcctccggccaccactactacgatccccgtttcaacttcacgatcagtgttgattcgtcttccttcacgccgttcttcttaccttttcggcttgtccagctccgggagacggatttcgatttctagaagaagacacttcgttagctgtaaatcgaccggcggcggaggaggaggatcagataagcttggtggcgatgaagaagagagcgaggaagttgagaaggcgcttcacttggatggtacgatccctgggacttccgatgagtttgtaaggcaagtttcgtcgcgtgcttacgacatgcgtcggaaacttgagcagacgtttgattccactagctatgacgcaatccttataaacagtgaagtagaaaaagagcttggactgttgttccctagtaggatcagcaaccagacaaagcaggctagacccaaaactaaattcgatatgctcgtagaagacattcgagatggagtactggttttcgaagatgtgaatgaggctgttagatactgtgacctattacaagggggagggaaagggtgtgaaggtgtcgctgagattgaggcctcctctgtttttgatctttgtcggaaaacaaggtctctggcagtgctcttccgccgtggaagaacaccacctacacctcagacgctggaacgtaatctcggatcccggaagcgttctcttgaggacttgagggataataaatag

SEQ ID NO: 2589 - DNA, 477 bp, Arabidopsis thaliana
atggcagttaggtgtttagccgtgttcctcgttgctctcatggtgtctcaagcagtcaccgcaacaagaccggctccaaccaagaatgtcggagctggtcttgacgaccaaaagaactttgtagcgttcgctggtgtcggtggagctgctggaattggtggagccggtggtgttggagctggtcttggtggtgtcgccggtggagttggtggtgttgccggagttttgcctgttggcggtgtaggcggcggaattggtggtctaggcggtggtgtaggtggtcttggcggtctaggtggtctaggtggtggttcaggtcttggtcatggagtaggtggaattggtggtgaccctggtattggtagtggtatcggtggactcggcggtgcaggtggtctaggcggtataggcggtgttggtggtttgggtggaattggcggtggaagcgattgcggtggcgtaattcctcaccattga

SEQ ID NO: 2590 - DNA, 1530 bp, Arabidopsis thaliana
atgagtagcctttccaaactggaggcttttgatatagatggaaattcattttctggaactattccctcttctctcttcatgatcccttcgttggacagacttaacctgggaagaaaccacttcagcggtccacttgagattgggaatatatcttcacaatctaatcttcaaattttatacattggagaaaacaatttcgatggaccaatcccaagatctatatcgaagctagtcgggctctcagaacttagcctttctttctggaacacaaggaggagcatcgttgatttcagcatcttcttgcatctcaagtcactagagtcacttgacctctcctatctgaatacaagaagcatggttgagttcagtcttttctcacctctcatgtcacttggttatttggatctttcggggattagtttgaagttcagttcaactctccatcttccctcctcactcatagaatacttgattttaacgtcctgcaatatttccgagtttcccacgtttctacaaaaccaaaccagtttggagtatttagacatctctgccaatcaaattgaaggccagctatcaggacaacttcccaagtctctgatcaaatgcactgacctcgagtttctgaacgtggaagataacagaatcaatgacaaatttccattttggttgagatcgttgtccaatctacagattcttgtccttcgttctaatgagttctatgggccaatattttctcctggagattctttgagtttccccaagttgcgaatctttgatatttcggaaaatcgcttcactggagtcttgccatcagattactttgttggttggagtgcaatgttatcggtcgtaagcatttatgatagtacacgtgggtatgcggttctaggagctatccgagaagcctaccataaatctgtggttctgacgaacaaaggattaaatatggagctggttgggagtggtttcacaatctacaaaaccattgatgtctccggaaacagactcgaaggagatattccagaatcgattggtatactcaaggaactgattgtgctcaacatgtcaaacaacgctttcacaggccatattccaccatctctatcaaacttgagcaatctccaatcattggatctatctcaaaacagattatccggcagtatcccaggagagctcggggaactcacatttctagcgcggatgaacttctcttacaacaggcttgaaggtccaataccacaaaccactcagattcaaacccaggatagttcttcatttacagggaatcccagtctatgtggtgctcctctcgaagaaccctgcggccgagaagaagatgaagaagcaacgaagcaagaacaagatgaagacaaggaagaggaagatcaagtatttagctggatagcagctgaaataggctatgtacctggtttgttttgtggactcgccatcggccacattctcacttcatataaacttgactggttcatgagaatcttttcctgcttttcttctccgctgataaaatga

SEQ ID NO: 2591 - DNA, 1617 bp, Arabidopsis thaliana
atggcctcaattcttaatcaaacccaggagttgcaagaatcttctaaggttcttgggcatttaagatgtgaaaacttctttctattccccggagaaaacactttgtcagatggtttgaggggtgtgttatattttctcggtcttgcctactgctttattgggttgtcagccatcactgcacggttcttcaagtctatggagaatgtcgtgaaacattcccgtaaagtggttacaattgatcccattactaaagctgaagtcatcacatacaagaaagtttggaactttactattgcagacatcagtttgttggcgtttggaactagcttccctcagatttctttggctaccatcgatgcaatacggaatatgggggagcggtatgctggaggtcttggtcctggaacacttgttggctcagctgcatttgatcttttccccatccacgctgtttgtgtcgttgtgccaaaagctggagaactgaaaaagatatccgacttaggtgtttggctagttgagctcgtatggtctttttgggcttacatctggctatacataatcctcgaggtgtggtcaccaaacgtaattacacttgtggaggcattattgacagtactgcaatacggattgcttctagttcatgcgtacgcccaagacaagcgatggccttacttgtctttaccaatgtcaagaggtgataggccagaggagtgggttccagaggagattgatacatccaaagatgacaatgacaatgatgttcatgatgtgtattcggatgctgctcaagatgctgttgaatcgggaagcagaaacattgttgatatcttctctattcattcagctaacaatgatacagggatcacttatcatactgtggcagatactccacccgattctgcgactaagaagggtaaggcgaagaattctactgtttttgacatttggaaacatcaattcgtggatgcaataacggtaaaaatcttcaacttaccaatggatagcatttatcttcgaatcgcgaaatctttctggcatttactcctcgccccttggaaactgctttttgcatttgtgcccccctgcaacattgctcacggttggatcgctttcatctgctctctcctcttcatcagtggagtagcctttgttgtcacaagatttactgaccttataagctgtgtcactggaataaacccatatgtgatagcattcacagcactcgcaagtggaacttcatggccagacttagtagcaagtaaaatcgctgcagagcgacaactaaccgcagattcagctattgcaaacatcacctgcagtaactcggtgaacatctatgtggggattggagttccgtggctgataaacacagtctacaactactttgcatacagagagcctttatacatagaaaacgctaaaggattaagcttttcgcttctgatattctttgcgacatcagtgggatgtatcgtggtgcttgtgttgagaaggttgattataggagctgagcttggaggtccaaggctatgggcttggcttacttctgcctatttcatgatgctttgggtcgtcttcgttgttctttcttctttgaaagtttcaggcgtcatatag

SEQ ID NO: 2592 - DNA, 1302 bp, Arabidopsis thaliana
atgtcgagtttggaggagccgctaagctttgacaagttgccaagtatgagcactatggataggattcagagattttcttccggtgcttgtcgccccagggatgatgtcggtatgggacaccgttggattgaaggaagagattgcactacctctaacagttgcattgatgatgataaaagctttgctaaagagtcattcccgtggagaaggcatactcggaaattatctgaaggagagcatatgtttaggaatatttcgtttgctggaaggacttctactgtttctgggactttaagggaatccaaaagttttaaggagcagaagtatagcacatttagcaatgagaatggcacgtcgcatataagtaataagatctctaaaggtataccaaagtttgtgaagattgtagaagttggtccaagagatggcctgcagaatgagaaaaatatagtacccacatctgtaaaggtggaactaattcagagattagtttcttctggattgcctgttgtcgaggctacaagttttgtatcaccaaagtgggttccccagcttgcagatgcaaaggatgtaatggatgcagtaaatactttagatggggctcgattaccggttctgacaccgaatctaaaaggctttcaagcggctgtatctgcaggtgcaaaggaagttgcaatctttgcatcggcttctgagtcattctccttgtcaaatattaactgtaccatcgaagagagtctcttgagatatcgtgttgttgccactgctgcaaaggagcattcggttccagtccgtgggtatgtatcttgcgttgtggggtgtccagtagagggacctgttctaccctcaaaagtggcttatgttgtgaaagaactctatgacatgggctgctttgagatttctctgggtgatacaattggaatcggcactcctggttctgtggttccaatgcttgaagccgtgatggcagttgtgccagcggacaagctggctgttcacttccatgatacctatgggcaagctcttgcaaacatattggtgtctctccagatgggaataagcatagtagactcatcaattgccggattaggcggctgcccatatgcaaaaggagcttcaggaaatgtagccacagaagatgtggtttacatgttgaacggtttaggcgtccacaccaatgtcgacttgggaaagcttatagctgctggagatttcatcagcaagcatctcggtcgtcccaatggttcgaaggctgccgttgccctcaaccgtcgtatcacagctgatgcctccaagatatga

SEQ ID NO: 2593 - DNA, 1938 bp, Arabidopsis thaliana
atgttgcttttgaaacaaagctcagctgctgttcttgtcgttggaaatacaactccagtccttcacacttctcgctccacctacagagttggaccttttccagtgaccagaacgcagtcgttccagagtttgactatggcaaatttgcagaagcttcccacttcttcgtctgggaaattgaatacggcttcagctgtgccctgtagctctcacgatgcttctcctatcagtgagaatcgcgagaataaacatgtccatggagtttctgagaaaattgtgggagttcttgggggtggacaattgggtcgtatgctttgccaagctgcttctcagttggctatcaaagtgatgattttagatccttctaaaaattgttcagcaagtgcattgtcctacggtcacatggttgatagctttgacgacagtgctacagtagaagaatttgcaaaaagatgtggagtcttaactgtagaaattgaacatgttgacgtggacacactagagaagcttgagaaacaaggagtggattgccaacccaaagcttctactattaggataatacaggataaatacatgcaaaaggttcatttctctcagcatggcatcccacttccagaatttatggagataagcgatattgaaggagcaagaaaagcaggtgaacttttcggttaccctcttatgatcaagagcaaacgattggcttatgatggacgtggaaatgcagttgccaacaaccaagatgagctttcttctgctgtaacggctcttggaggtttcagtcgtggtttgtatattgagaaatgggcaccttttgttaaggagttagctgttattgtggctagggggagagatggttctatggtttgttatcccgttgttgaaaccattcacagggataacatatgccatatagttaaagcacctgcagatgtgccttggaagattaacaaacttgccaccgatgttgcccaaaaggctgtcggttctttagaaggtgctggtgtttttgcagttgaactgttcttgacagaggatagtcagattctgctaaacgaagttgcacctagaccacacaacagtggccatcaaacgatcgagtgctgttatacttcacagtttgaacaacacttgcgagctgtggttggtcttccacttggtgatccgtcaatgagaactccggcgtccattatgtacaatattctgggagaagatgatgtaattgatggagaagcaggtttcaaattggctcatcggcttattgcaagggctctgtgtattccaggtgcatctgttcattggtatgacaagccagaaatgagaaagcagagaaagatgggtcacatcactcttgttgggcagtctatgggcattttggaacaaaggttacaatgcatattaagtgagcaaagccaccaagtacacgagacacctcgtgttgctatcatcatgggttcagacacggatcttcctgttatgaaggatgctgccaaaattctggacctgtttggtgtgacacatgaggtaaagatagtttctgctcatcgcaccccagagatgatgtatacatatgcaacctcagctcatagtcgaggcgttcaagtcattattgcaggtgctggtggtgctgctcacttaccaggtatggttgcttcactcactcctttgcctgtgattggtgtccctgtccgtgctacccgtttggatggagttgattcacttctttccatcgttcagatgcctagaggtgttcctgttgcgacagttgcaataaacaatgcgaccaacgcagccttgcttgcagttcggatgttgggaatctctgatacggatcttgtctcaaggatgaggcagtaccaggaagacatgagagatgagaacctgaataaaggagagaaactggagacagaaggttgggaatcatatttgaaccagtga

SEQ ID NO: 2594 - DNA, 1602 bp, Arabidopsis thaliana
atgctaatactgtttgagacgccaggtggttttgccatcttcaaagtattaaacgaaggaaagctctctaatgttgaggatttgggtaatgagttctcgaccgcaaagttagcccgaaagatggtgaagctagtagcttttgacaagtttgacaacacagctgaagctcttgaagcagtggctaaattgcttgagggaactccaagcaagggtctacgcaagtttttgaaagctaactgtgttggtgaaacattagctgttgctgattctaagcttggaaatatcatcaaggagaaactgaaaatagtctgtgttcacaacaatgctgttatggagctgttaagaggtatcagaagccagctaactgaacttatatctggattgggtgatcaagatctaggtccaatgagcttggggttgtctcacagccttgccagatataaactaaagttcagttccgacaaggtggataccatgataatccaagctattggtctgcttgatgatcttgacaaagagcttaacacttacgctatgagggttcgtgaatggtttggttggcattttcctgagcttgctaagatcgtacaggacaatatcttatatgccaaggctgttaaactaatggggaatcggattaatgctgcaaagctagacttctctgagatattggctgatgaaattgaagcagaactgaaagaggctgctgtgatatctatgggaactgaagtcagtgaccttgatttattgcacatccgagaactctgtgaccaggttctttctcttgccgagtacagagctcagctttatgactacttgaagagcagaatgaacacaattgcaccaaatctaactgcccttgtcggggagctagtcggtgctcgcttaatatctcacggtggtagtttgttgaacctcgcaaagcaacctggaagcacggttcagattcttggagctgaaaaagccttatttagagcccttaagaccaaacacgctactccaaagtatggtttaattttccatgcatctgttgttggccaagctgcaccgaagaacaagggtaaaatttcacggtcactagctgcaaaatctgttcttgctatccgttgtgatgctcttggtgactcccaagacaacactatgggagttgaaaaccgtttaaagcttgaagcacggttgagaactctcgaaggaaaagatttaggacgtctatctggctcagctaaaggcaaaccaaagattgaagtatatgacaaagataaaaagaaaggatccggaggtctgatcactcctgctaagacatacaacactgctgcagactctcttcttcaaactcccacagtggattcagagaacggtgtgaaagagaagaaagacaaaaagaagaagaagaaggctgatgatgaggaagaagccaaaactgaggagccctcaaagaagaaatcgaataagaagaagacagaagcagaacctgaaaccgccgaagagcctgcaaagaaggagaagaagaagaagagaaaacacgaggaagaggaaactgaaatgcctgctaagaagaaggaaaagagtgagaagaagaagaagaagaaaactgaggtctga

SEQ ID NO: 2595 - DNA, 1566 bp, Arabidopsis thaliana
atggagaaaagcggcttctctcccgtcggtctaagggttcttgtcgtagacgatgatccaacttggctcaagattctcgagaaaatgctcaagaagtgttcttacgaagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataatgatgtcggtggacggcgaaacaagccgagtgatgaagggagtgcaacacggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacaaagctggtcccaagaagatattggatctcatgaatgttccatggctcactagagaaaatgttgcaagccaccttcagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgacctcaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaaattctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaggcgattctgagaagcttgaactgggaacttccagaatcacatcattctgtttctttagacactgacttagacttgacttggcttcaaggcgagcgttttcttgcaaacaccggactccagtttcaagattacagtagtagcccatcactcctatctgagctcccagcccaccttaattggtatggaaatgagcggctgcctgaccctgacgagtattccttcatggtagaccaaggtttattcatatcttaa

SEQ ID NO: 2596 - DNA, 933 bp, Arabidopsis thaliana
atggcgacggtacaattgtccacccaatttagctgccaaaccagagtttcaatctcaccgaactctaaatctatctccaagcctccgtttctggtaccggtgacctcaattattcaccgcccgatgatctccaccggaggaatcgctgtttccccccgtagagttttcaaagtccgagccacagatacgggagagataggatcagctctattggcggcggaggaagcaattgaagacgtggaagagacggagcggctaaagagatcgctcgtggattcgttgtacggaacagatcgaggtttaagcgcatcgagcgaaaccagagctgaaatcggagatctaatcacacagctcgagtctaagaaccctactccagctccgacggaagctcttttccttctcaacggcaaatggatcctcgcctacacatcgttcgtgaatttgttcccgttgctatcacgaggaatcgtaccgttaataaaagtcgatgagatctctcaaaccattgattcagataacttcaccgtccagaactctgttcgtttcgctggtcctttaggtacaaactcgattagcaccaacgctaaattcgaaatccgaagccctaaacgcgtccagattaagtttgagcaaggcgtaattgggacgcctcagctaacggattctattgagataccggaatatgtagaggttcttggtcaaaagattgatcttaacccgatcagagggttacttacctcggtgcaagacacagcctcgtctgtggctagaaccatatcaagccaaccaccgttgaaattctctttgccggcggacaatgcgcagtcttggctactcacgacttatctagacaaagacattcggatctctagaggagacggtggaagtgtctttgtgcttatcaaagaaggaagccctctcttgaatccttga

SEQ ID NO: 2597 - DNA, 1653 bp, Arabidopsis thaliana
atgggtagatccaacgagcaagatctgctctctaccgagatcgttaatcgtgggatcgaaccatccggtcctaacgccggctcaccaacgttctcggttagggtcaggagacgtttgcctgattttcttcagtcggtgaacttgaagtacgtgaaacttggttaccactacctcataaaccatgcggtttatttggcgaccataccggttcttgtgctggtttttagtgctgaggttgggagtttaagcagagaagagatttggaagaagctttgggactatgatcttgcaactgttatcggattcttcggtgtctttgttttaaccgcttgtgtctacttcatgtctcgtcctcgctctgtttatcttattgatttcgcttgttacaagccctccgatgaacacaaggtgacaaaagaagagttcatagaactagcgagaaaatcagggaagttcgacgaagagacactcggtttcaagaagaggatcttacaagcctcaggcataggcgacgagacatacgtcccaagatccatctcttcatcagaaaacataacaacgatgaaagaaggtcgtgaagaagcctctacagtgatctttggagcactagacgaactcttcgagaagacacgtgtaaaacctaaagacgttggtgtccttgtggttaactgtagcattttcaacccgacaccgtcgttgtccgcaatggtgataaaccattacaagatgagagggaacatacttagttacaaccttggagggatgggatgttcggctggaatcatagctattgatcttgctcgtgacatgcttcagtctaaccctaatagttatgctgttgttgtgagtactgagatggttgggtataattggtacgtgggaagtgacaagtcaatggttatacctaattgtttctttaggatgggttgttctgccgttatgctctctaaccgtcgtcgtgactttcgccatgctaagtaccgtctcgagcacattgtccgaactcataaggctgctgacgaccgtagcttcaggagtgtgtaccaggaagaagatgaacaaggattcaaggggttgaagataagtagagacttaatggaagttggaggtgaagctctcaagacaaacatcactaccttaggtcctcttgtcctacctttctccgagcagcttctcttctttgctgctttgctccgccgaacattctcacctgctgccaaaacgtccacaaccacttccttctctacttccgccaccgcaaaaaccaatggaatcaagtcttcctcttccgatctgtccaagccatacatcccggactacaagctcgccttcgagcatttttgcttccacgcggcaagcaaagtagtgcttgaagagcttcaaaagaatctaggcttgagtgaagagaatatggaggcttctaggatgacacttcacaggtttggaaacacttctagcagtggaatctggtatgagttggcttacatggaggccaaggaaagtgttcgtagaggcgatagggtttggcagatcgctttcggttctggttttaagtgtaacagtgtggtgtggaaggcaatgaggaaggtgaagaagccaaccaggaacaatccttgggtggattgcatcaaccgttaccctgtgcctctctaa

SEQ ID NO: 2598 - DNA, 741 bp, Arabidopsis thaliana
atgagcaagaaacattgctcagaattattaccaaataagatgtttagaaaccaagactcgaaatacttgatcccggtgcagaaagaagcgccaccggtgacaactttaccgatgaaagcttcaacggtgaaatctccacacaactgtgaggccattctcagagacgcagatcctccgatctctctctcctctgttaatctctctgaacagctacggtctggtgttttcttgaaacccaagaaacagatcaaatattgggtggacgagagaaacagcaactgcttcatgctctttgcaaagaacctctctataacttggtctgatgacgtcaactattggacttggtttaccgaaaaagagtcaccaaacgagaatgtggaagctgtgggattgaaaaacgtttgttggctcgacatcacgggaaaattcgacacgaggaacctcactccggggattgtttacgaggtagtctttaaggtgaagctagaggatccggcctatggatgggacacgccggtgaacctaaagctagtcttgcctaacggtaaggagaaaccacaagagaaaaaggtgagtttgagggaacttccaaggtataaatgggtcgatgtcagagttggcgagttcgtacctgagaaatccgctgccggagagatcactttctcaatgtatgagcatgcggctggtgtttggaagaaagggctctccctcaaaggtgttgcaattcgtcccaaacagtaa

SEQ ID NO: 2599 - DNA, 427 bp, Arabidopsis thaliana
acttgttcaagcattgttttcgaattttttcatgcatcaaagctcgttaagactagatgggggatccctacatagcgggtgggacccacggcgaatggttcatcaactcttcaaaaaagaatatatacgattgcattgcatatactaacggatgcgatcataccagcactaatgcaccggatcccatcagaactccgcagttaagcgttcttgggcgagagtagtactaggatgggtgacctcccgggaagtcctcgtgttgcatccctctttatatgtttaacctttttttttttggttaaaactttatgactccataacttttagaccgtgagccaaacttggcatgtgataccttttcggaaagcccaaagacagccctccgacgaaagaagcaggacaacttttccattgactttttgtcgac

SEQ ID NO: 2600 - DNA, 909 bp, Arabidopsis thaliana
atgaccaacatgactcttcgcaagcatgttatatactttcttttcttcataagctgctctcttagcaaaccctccgatgcatccagaggtggcatagccatctattggggccaaaacggaaacgaaggtaacctctctgccacgtgtgccaccggccggtatgcttacgtcaacgtcgcctttcttgtgaaattcggaaatggccaaacaccggagctcaaccttgccggccactgcaaccctgcggcgaacacttgcacccattttggctctcaggtcaaagattgtcagtctcgtggcatcaaggttatgttgtctctcggcggcgggattggaaactactcgattgggtcgagggaggacgcaaaagttatcgctgattatctgtggaacaacttcttgggaggaaaatcatcatcacgtcccttaggtgatgctgttctagatggtatcgatttcaatatcgagcttggctctcctcaacactgggatgatctcgccaggactctctcaaagtttagccacagaggaagaaaaatatatctaacaggagctcctcaatgtccatttccagacagattaatgggaagtgctctcaacactaaacgttttgactatgtttggattcaattctacaataatccaccgtgttcatacagttcaggtaatactcaaaacctcttcgattcatggaacaagtggaccacttcaatcgcagcccaaaaattcttcttgggtctaccggcagctcctgaagctgccggaagtggctatatcccaccagatgtactgacttcacagattcttccgactttaaagaagtctaggaagtatggaggtgtaatgctttggtctaaattctgggatgataaaaatggatacagttcatctatattggctagtgtgtga

SEQ ID NO: 2601 - DNA, 1362 bp, Arabidopsis thaliana
atggctaaagtttattggccttatttcgatcctgaatatgagaacttgagctccagaatcaatcctccaagtgtttctatagataacactagctgcaaagaatgcactcttgtcaaggtggacagtatgaacaaacctggaatactacttgaagttgtgcaagtcctaaccgatctcgatctcactatcactaaagcttatatctcttctgatggtggatggttcatggacgtattccatgtcaccgatcaacaaggaaacaaggttactgatagcaaaaccatcgattacatcgagaaggtgttaggaccaaagggtcatgcttcggcttcacaaaacacttggcctggtaaaagagtcggtgtccattcattaggcgaccacacatcgatagagattattgctcgtgatcgtcctggtctcttgtcggaggtttcagccgtactagcagacctcaacattaatgtggtggcagctgaagcatggactcacaaccgtaggattgcgtgtgtcctctatgtgaatgacaatgcaacttctagagccgttgatgatccagaaagattgtcttccatggaagaacagcttaacaatgtgctgcgtgggtgcgaagaacaagatgagaaatttgctcggacgagtctctccattgggtcgactcacgttgatcgaaggcttcatcagatgtttttcgctgatagagactacgaagcagtgactaagcttgatgattctgcttcttgcggattcgagcccaaaatcacggttgagcattgtgaagagaaaggttactccgtgataaacgtgagctgcgaggatcgaccaaagctcatgtttgacattgtatgcacgcttacggatatgcaatacattgtgtttcacgccacgatttcatcaagcggctctcatgcttctcaggagtatttcatcagacacaaagacggttgcactcttgacacagaaggagagaaagagagagttgtcaaatgtctggaagctgcaatccatagacgagtcagcgagggttggagtttggagctctgcgcaaaggacagagttggattactgtcggaagtgacaaggattctgagagagcacgggctatcagtgtcgagagctggtgtgacaacagtaggagaacaagccgtcaacgttttctatgtgaaagatgcttcagggaatccagtggatgtgaagacgattgaggcgttacgcggagagattggacacagtatgatgattgacttcaagaataaagttccgagcagaaaatggaaagaagaaggtcaagccggaacaggaggaggatgggccaaaaccagtttcttctttgggaatttgctggagaagttactgccttga

SEQ ID NO: 2602 - DNA, 1032 bp, Arabidopsis thaliana
atggggttcaagaggaagaaagatgatggtgatggtgaggaaatggaatctgatgttcgtggaaagtctactttcagtgggggtgagaagaggaatgtgatacttccttcgatgattaagaacaaagataagagatcaaaagtgtatgcgaagcagaagcatgagaagaaattggagaagcagaagaagattagagctcgtgatgctgctgagaaacgagctttagagcttggagaagagcctccacaaaagatgattccgaagacgattgagaatacaagagaatctgatgaaactgtttgcagacctgacgatgaagaattgtttgcggatattgatgctgatgagtttaatccagttctgagacgtgagattgcacctaaggtcttgctcacaacatgtcgtttcaattccactagaggacctgctttaatatctgagttgctttcggtgataccaaactctcattatcaaaagagaggaacctatgatttgaagaagattgtagaatacgcaacgaagaaagattttacatctcttattgttgttcatacaaatcgtagagaacctgatgcgcttcttatcatcggtttgccaaatggtcctactgctcatttcaaattgtcaaatcttgttctaaggaaggatattaagaatcacggaaatcctacaagccatcaaccagaactggttttgaataactttacaacgcgtttagggaatcgtgttgggagattttttcaatcactcttccctccggatcctaatttccgtggtaggagagttgtaacattccacaaccagcgtgactttatatttttcagacatcaccgttacatatttgagacaaaggaaagcaagagtgataaaggaaaagaagagacaataaaacctcgtcttcaggaatgcggtcctcgattcacgcttaagctagttactctacagcatggaacttttgacaccaaaggtggagaatttgaatgggttcataagcctgaaatggacacgagcaggagaaggttcttcttataa

SEQ ID NO: 2603 - DNA, 1305 bp, Arabidopsis thaliana
atggaaaaccgtaagtacagaaacttagaaccgaaagtacaggttgaaaaactgatattaatggtcggaaaacctgaaaatacagaacggaaaaccagaaagcctaagcttcgaatcgatccaagcttgaccttaattccaggcttatccaacgacgtcgggagactgattctctccttcgtcccttaccctcacatctctcgtatcaaatcaacctgtaaatcatgcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtag

SEQ ID NO: 2604 - DNA, 753 bp, Arabidopsis thaliana
atggcgacttcttcgatcactatcccgaccattagaactccgattcatcgatcaaaatttctaggccaaacacatcaattttcaactgtaaaccggtcggttttcccgcctccaaaacagcagtcaaaactgtatcaagtaaaggccatgggtaaattcaatctatgggaagtgatgggaggaagaggattatgcaacggagagaaaggtattgagaaggagctccagaggaacattgaagacgagcaagagacatcaaaggctgagaacaacgagacagagagagagagcgatgacagtaacttgtcttttaaagtacctgaagatggtttcgagaaagagatgatgggtctcacaggaggatttcccggtggcgaaaagggtttaaaaacgtttatcgaaaaaaatccaccacctcctccaccaccaccacctgcaaaacaaggaagcgatgcatccgcggttgctacagataagaagccgaaagcgcccaagctaccccttctcatgccggggatgattgctatagtcaagaaccagaacagtccgtatcacatgtattgtggaattgtgcagaggatcactgatggaaaagctggtgtcttgttcgaaggaggaaactgggaccgtctcattactttcaggcttgaagagcttgaacgaagagaaaaaggtccaccgggtaagaatccaaagtcttgtattctcgagcctcttatcgaacagatgcaaaaggaagaggcagcaccataa

SEQ ID NO: 2605 - DNA, 684 bp, Arabidopsis thaliana
atgggaatcggtgaagaaagcacaaagcctatttgggggagcgtgagccacacgtcttcaggctacgctctcaacggcaaaatcatgctctcctccgtgatcgttctattcgtcgccgttattatgatcctctgcttccacagctacgcccgttggttattccgtcgtcacaaccgtcgcattcgccgccgtattcgttctcacctccgcactctctccgcctcaccccgagaccaagctctcgaccaggctgttctcgacaagattccgatcttcgtttactcctccaagaatccaccaccaccagaagagaaggaggagtgctccgtctgcttgtcggagttcgaggaagaagacgaaggccgtcttcttcctaaatgtggccactcttttcacgtcgactgcatcgatacttggttccgttccagatccacttgcccgctttgcagagctccggttcaacccccgtttcaggtcattgaaaccggttcttcttcttcttcttcgccgttgacatttccgacggagggttgcgagagagaaccgattgacctcgccggtatcattgtggatatttccagagaagttgaatttgaaggctcaaatccgggtctacccatcgaaaacggatcaaagtttccgggtagtcgggttttgtctttaaaaaggctatggagcatctga

SEQ ID NO: 2606 - DNA, 1389 bp, Arabidopsis thaliana
atggtgggaagcattgaggcaaagagtctgcaatcaaacgggtctgttcatcatattggtcttaatttggaggagaaacttgatgaatttcgtcgtcttttggggaaatcagaaaaagatccgttaaggattgtaagtgttggtgctggtgcttggggaagtgtttttgcagcacttcttcaagaaagctatggaggtttcagggataagtttcagatcaggatatggagaagagctgggagagctgttgatagagaaactgcagaacatttgtttgaagtgatcaattcaagggaagatatcttgaggagattgataagacgctgtgcttatctgaaatatgtcgaggcaaggcttggtgataggacactctatgctgatgagatattgaaagacgggttttgtcttaacatggttgatacgccgctttgtcctcttaaggttgtgacaaatctgcaagaagctgtgtgggatgctgatattgttgttaatggattgccttcaactgaaacacgtgaagtgtttgaagagattagtaagtattggaaagagagaataacggttccgattattatctctctgtcaaagggtattgaaactgctcttgaaccagttccacatatcataactccaacaaagatgattcatcaagcaactggtgtgccgattgacaatgtcctgtatcttggtggaccaaacattgctgctgaaatttacaacaaggaatatgccaatgctagaatctgtggagctgctaaatggaggaagccactagctaagttcttaagacaacctcatttcattgtttgggacaatagtgatcttgtgacacatgaagtaatgggaggtctcaagaatgtctacgccattggagctggtatggtagcggcgctcactaacgagagcgctacaagcaagtcggtgtattttgctcattgtacatctgagatgatatttataactcatttactagcagaagagcctgagaaacttgcagggcctttgctagctgacacttatgtgaccttattaaaaggacgtaatgcatggtacggtcaaatgctggcaaagggtgaaataaatagagacatgggtgatagcataagcggcaagggaatgattcagggtgtttctgcagtgggagcattttaccaattgcttagtcaatcaagcttaagtatattgccctctgaagagaagaaacctgtagctccggtcgaatcatgtcctattttaaagacactttacaagatactcatcacaagagaacaatcaactcaggccattctgcaagcattaagggatgagacattgaacgatcccagagaccgtattgagattgcacagagccatgcattctacaggccttcccttcttggtcagccttga

SEQ ID NO: 2607 - DNA, 1077 bp, Arabidopsis thaliana
atggtgtttggaaaagggtcaaaccttgacagattccttcattgcacaacacctgtagtgccaccccaatctctatccaaggcggagattaggagtttgaataggatttggcatccatgggagagacaaaaggttgagtttttcagattgagtgatctatgggattgttatgatgaatggagtgcttatggagctggtgttccaattcgtctctctaatggagaatctcttgttcaatattatgttccctatctctctgctattcagattttcacctctcgttcttccttgatccgcttaagggatgattctgaagatggggaaagcagagattcgtttagtgattcatatagtgatgagagtgaaagtgataaactttcgagatgtgcttctgatgaaggacttgaacatgacgctctcttgcatcctaatgatcggttgggatatctttatctgcaatactttgagagatcagctccttatgctcgagttcctctcatggataagatcaatgaattggctcaaaggtacccgggactaatgtcgttgcgaagcgtagatctttccccggcaagttggatggcggtagcgtggtaccctatttaccatattccaatgggaaggaccatcaaagatttgtccacttgtttcctcacttatcacactctttcatcttctttccaagatatggagccagaagaaaatggcggggaaaaggagaggatccggaaggaaggagaaggtgtaactttgcttccttttgggttagccacttataagatgcaaggcaatgtttggctctcggaagacgatcaaggtcaagatcaagagcgagttctttcgcttctaagtgttgcggattcttggctaaaacagctaagagtccaacaccatgacttcaactacttctcaagaatggctcacctggcaaggagattacttttttccctggtcgcaatataccgtgtttgtccagtggttggagtagcagtggcagccgtgaagaggactgagcgtttccttaacacacaagtacagcggtttcaacgttttgggtgtagaatagctttaaagtag

SEQ ID NO: 2608 - DNA, 1167 bp, Arabidopsis thaliana
atgatcaaaacaatcacatctctacgcaaaactctggttctacctcttcatttacatattcgtacgctacaaactttcgccaagtacaacgcacaagctgcatcggctttgcgagaagagcgtaagaaacctctttatcaaaatggagatgatgtatatgcggatttggattgggataatctcgggtttggtctaaatccagctgattacatgtatgtcatgaaatgctcaaaagacggcgaattcactcaaggagaacttagtccctatgggaatattcagctaagtccttctgctggagtcttaaactatggacaggcgatatacgaaggtacaaaagcatacaggaaagaaaatgggaagcttcttttgtttcgtccggatcacaacgctatccggatgaagcttggcgctgaacggatgctcatgccttctccttcggttgatcagtttgttaatgcagttaaacaaaccgctcttgcaaacaaacgttgggttcctcctgcagggaaagggactttgtacattaggcctttgttgatgggaagtggtccaatacttggtttaggtcctgcacctgaatatacattcattgtctatgcatctccagttggtaactacttcaaggaagggatggctgctcttaacctctatgttgaggaagaatatgtccgagcggctcctggtggagctggaggcgtcaagagcatcacaaattatgcgccagttttgaaagcactgagcagagccaagagtcgggggttttcagacgttctttatctcgactctgtcaagaagaagtacttagaggaggcttcttcttgcaacgtctttgttgtcaagggtcggacaatctcaactcctgcaactaatggaacaattcttgaagggattacgcggaaaagtgtgatggagatcgcaagtgatcaaggttatcaggtagtagagaaggcagttcatgtggatgaagtaatggatgcagatgaagttttttgcaccggaactgctgtagtagttgctcccgtgggcactatcacatatcaggaaaaaagagtagagtataaaaccggggatgaatctgtctgccagaaactgcgttcagtcctcgtaggtatccagacaggattgattgaagataacaagggatgggtcacagatatcaactga

SEQ ID NO: 2609 - DNA, 834 bp, Arabidopsis thaliana
atggaagatctcgaccatgagtacaagaattactgggaaaccacaatgttcttccagaatcaagaactcgaatttgacagttggccgatggaggaagcgttttcgggttccggcgagtcgagttcgccagacggagcggcaacgtcgccggcttcttcgaagaacgttgtctccgagagaaacagacggcaaaagcttaatcagagactttttgctctccggtcagttgttcccaatataagcaagttggacaaggcatctgtcatcaaagattctatcgactatatgcaagaacttattgatcaagagaagactctagaagcagagatcagagagctagaatcacggtcaacattgctagaaaatccggtaagagattacgattgcaattttgcggaaactcatctgcaagatttctcagacaataatgacatgagatcaaaaaagtttaagcagatggattacagtactagagtacaacactaccccattgaagttctcgaattaattattccaaattgtttttatataaacatgaaaaaacagatgaaagtgacatggatgggagagaagacggtagtggtatgcataacatgtagcaagaaaagagagacaatggtgcagctttgtaaagtgttggagtctttgaatctcaacattctcactactaacttctcttccttcacctctcgtctctccaccaccctcttcctccaggtcactctctccctctctccctctctcatatctttatttggcaatgtgattactagtacaaactacaaaattctaaatgcatctagagaatactgtacgtgtcttgttttggtttga

SEQ ID NO: 2610 - DNA, 810 bp, Arabidopsis thaliana
atgttcgaagaaatacttcataaatctgaaggaaaacaaatagttatgtttcttgattatgatggtactctctctcccattgttgatgatcctgatcgagctttcatgtccaagaagatgcgaaatactgtgaggaaacttgcaaagtgttttccaacagccatagttagtgggagatgcagagagaaggtttctagttttgtgaaattaactgagttatactacgctggaagtcatggcatggacatcaaaggaccagagcaaggatctaaatacaagaaagaaaatcagtctcttctttgtcaacccgcaactgaattcctcccggtgataaacgaggtttataaaaaactagtcgagaacactcaatcgattccaggagcgaaagttgagaacaacaaattttgtgcgtctgttcactttcgatgcgtagaagaaaataaatggagtgacttggcccatcaagttcgatcagtcttgaagaattaccccaagctcatgcttacccaaggaagaaaagtattggagattcgtccaatcattaagtgggataaaggcaaagcactcgagtttttgttagaatcactaggatatgataattgtaccgatgtttttcctatatatattggagatgatcgtaccgacgaagacgcctttaagatactgagagacaaaaaacaaggtcttggaattcttgtgtccaaatacgcaaaggagactaatgcttcttattctttgcaagagccagatgaggttatggtttttttagaacgtttggtggaatggaaacagtcaaggtgtggggcatga

SEQ ID NO: 2611 - DNA, 228 bp, Arabidopsis thaliana
atgtcgtttctttatgggaaccatgtcttgaaaggtggattagggaggattactgatagtattgttcctggagatggtgttgttgtgttctcgatgtctgatgttccgttagggtttgggattgctgcgaagagtacacaggattgtaggaaattggatcctaatggtattgttgtgcttcatcaggctgatattggagagtatttgaggggtgaagatgacctttga

SEQ ID NO: 2612 - DNA, 1425 bp, Arabidopsis thaliana
atggcgaagcagcaagaagcagagctcatcttcatcccatttccaatccccggacacattctcgccacaatcgaactcgcgaaacgtctcatcagtcaccaacctagtcggatccacaccatcaccatcctccattggagcttaccttttcttcctcaatctgacactatcgccttcctcaaatccctaatcgaaacagagtctcgtatccgtctcattaccttacccgatgtccaaaaccctccaccaatggagctatttgtgaaagcttccgaatcttacattcttgaatacgtcaagaaaatggttcctttggtcagaaacgctctctccactctcttgtcttctcgtgatgaatcggattcagttcatgtcgccggattagttcttgatttcttctgtgtccctttgatcgatgtcggaaacgagtttaatctcccttcttacatcttcttgacgtgtagcgcaagtttcttgggtatgatgaagtatcttctggagagaaaccgcgaaaccaaaccggaacttaaccggagctctgacgaggaaacaatatcagttcctggttttgttaactccgttccggttaaagttttgccaccgggtttgttcacgactgagtcttacgaagcttgggtcgaaatggcggaaaggttccctgaagccaagggtattttggtcaattcatttgaatctctagaacgtaacgcttttgattatttcgatcgtcgtccggataattacccacccgtttacccaatcgggccaattctatgctccaacgatcgtccgaatttggatttatcggaacgagaccggatcttgaaatggctcgatgaccaacccgagtcatctgttgtgtttctctgcttcgggagcttgaagagtctcgctgcgtctcagattaaagagatcgctcaagccttagagctcgtcggaatcagattcctctggtcgattcgaacggacccgaaggagtacgcgagcccgaacgagattttaccggacgggtttatgaaccgagtcatgggtttgggccttgtttgtggttgggctcctcaagttgaaattctggcccataaagcaattggagggttcgtgtcacactgcggttggaactcgatattggagagtttgcgtttcggagttccaattgccacgtggccaatgtacgcggaacaacaactaaacgcgttcacgattgtgaaggagcttggtttggcgttggagatgcggttggattacgtgtcggaatatggagaaatcgtgaaagctgatgaaatcgcaggagccgtacgatctttgatggacggtgaggatgtgccgaggaggaaactgaaggagattgcggaggcgggaaaagaggctgtgatggacggtggatcttcgtttgttgcggttaaaagattcatagatgggctttga

SEQ ID NO: 2613 - DNA, 480 bp, Arabidopsis thaliana
atgagattggagaagtgttggttttgctcttccacaatatatcctggtcatggtattcaatttgtccgtaacgatgccaagatattccggttctgtaggtcgaagtgtcacaagaacttcaagatgaagagaaacccacgtaaagtgaaatggactaaagcattcagagctgcacacgggaaggacatgactaaggatacaacatttgagtttgagaagaagagaaacagacctgagagatacgacaggaacgttacagagaatacactcatggccattaagaagattgctaagatcagaaccgcaagggaagccaaacatatcgaaaataggttgaagccaaacaagcagaagaaactcaatgacgatatgaaagaacttgatcagaacattcatatggtccaggctcccggggcacagaagatcaaagttgatgtttccgaaaagaagtctgttcaaaacgaagccatggaagagtga

SEQ ID NO: 2614 - DNA, 1161 bp, Arabidopsis thaliana
atgaacgcagcgcttgcaacaaccaccgccacaactcccgtactccgccgtgagacgcctcttcttcattattgttctctcacaacaaaatcgccggtttaccaaatcaacagagttagattcggatcttgcgtgcaaacagtcagcaagaaattcttgaaaatctcggcgagctctcagagcgcttcagcggcggtcaatgtcacggcggatgcttcgattccgaaagagatgaaggcgtgggtgtatagtgactacggcggagttgatgttctgaagctggagagtaacattgttgtgccggagattaaagaagatcaggttttgattaaagttgttgcggcggctcttaatcccgtcgatgctaagagacggcaagggaaatttaaagccactgattcgcctctcccgactgttccgggatacgacgttgccggagtagtggtgaaagtgggaagtgcggtgaaggatttgaaagaaggagatgaagtttatgctaacgtgagcgagaaagcattggaaggtccaaagcagtttggttctttagcggagtacacggccgtggaagagaagttattagctttaaaacctaaaaacatcgattttgcgcaagctgcagggcttccgttggcgatagaaaccgctgatgaaggtttagttaggactgaattctcagccggaaagtcaattcttgttcttaatggtgccggaggagtagggagtcttgtgattcagttggcgaagcacgtgtatggagcttcaaaagtagctgcaactgcgagtacagaaaagctagagctagtgagaagcttaggtgctgatttagctattgattacacaaaggagaatatagaagacttgcctgacaagtacgatgttgtctttgacgccattgggatgtgtgataaggcagtgaaggtgattaaggaaggagggaaagttgtggcattgactggagctgtcacgcctcctggttttcgattcgttgttacatctaatggcgatgttttgaagaaacttaacccatatattgagagtgggaaggtgaagcctgtggttgatcccaaaggaccgttcccattctcacgcgttgctgatgctttttcatacttagaaacgaaccatgccacagggaaggtcgttgtttatcccattccttaa

SEQ ID NO: 2615 - DNA, 510 bp, Arabidopsis thaliana
atggcatatgcaactattctcatgatcttctcggtggtggcactaatgtccggcgagagagctcatgcagcagtggactgctcatcgttgatactaaacatggctgattgtttgtcgtttgtgactagtggtagtacagttgtcaagccggaaggaacatgttgttcagggcttaagactgtggttaggacaggaccagaatgtctatgtgaggctttcaagaacagtggttctcttggtttaactcttgatctttctaaagctgcttctcttccttctgtttgtaaagttgctgctcctccttctgctcgttgtggcctttctgtctctggagatcctcctgctactgcccctggtttatctcctacggccggagcaggagcacccgcgttgtccagtggtgcaaatgcggcaactccagtttcgtccccgaggagttccgatgcgtccttgctctctgtatcttttgcatttgtcatcttcatggcactcatttcttctttctattga

SEQ ID NO: 2616 - DNA, 576 bp, Arabidopsis thaliana
atggacgaaagcggaggtgatagtggttcagtggccacacctgttcaacagcgagcacatgaggcatggaggatttaccaacactatcttgacaagactacacctcatgcaaattacagatggattggaactcttgtcgtcgctcttatctactgtttgagggtttactatattcagggtttctacatcatcgcctatggtcttggaatctaccttctcaatctgcttatcgggttcttgtcccctcttgttgatcctgaagctggtggggtctctgatgggccttctctgcctactagaggttctgatgagttcaagcctttcattcgccgtctccccgagttcaaattctggtactccatgacaaaggctttctgcatagctttcctcatgacattcttctcggtgtttgacgttcctgtgttttggccaattctgctgtgctattggatcgttctctttgttctcaccatgagacgccagatcgcccacatgatcaagtacaaatacatccctttcagcttcggcaaacagaaatatggtggacggagcagcagcggctcacgtgcggattga

SEQ ID NO: 2617 - DNA, 756 bp, Arabidopsis thaliana
atgccgatcagaaacatcgccattggccgtccagatgaagccacccgtcccgatgccttaaaggcggcgttggctgagttcatttcaactttgatctttgtcgtcgccggttcaggctctggcatggctttcaacaagctcactgaaaacggagccaccactccttctggtctcgtagctgctgcagtggctcatgcctttggactcttcgtcgctgtctcagttggtgccaacatctctggtggacacgttaaccctgccgtcactttcggtgctttcattggtggtaacatcactctcctccgtggtatcctctactggattgctcagcttctcggctccgtcgtcgcttgcctcatccttaaattcgccaccggtggcttggctgtgccggcttttggtctctctgctggagtaggagtgttgaacgctttcgttttcgagatcgtgatgacattcgggcttgtttacaccgtctacgctacagccattgaccccaaaaacgggagtcttggaacaattgctcccatcgcaatcggtttcattgttggagccaacatcttagctggaggagctttctctggagcctccatgaatcccgccgtggctttcggaccagcggtggtgagctggacatggaccaaccactgggtctactgggccggacctctcgtcggcggtggaatcgctggactcatctacgaagttttcttcatcaacaccacacacgagcagctcccaaccacagactactga

SEQ ID NO: 2618 - DNA, 1185 bp, Arabidopsis thaliana
atggaaattccgaggcaagaaattcatatcgaaatcgataactcaataccgagtagtaaagagtttaaaactggcctagctgatgctaaacccgttgtcttgatgtccgctttgcgtagtctccacgcgggctatttcaggataagcctctctctttgcagccaagctcttctgtggaagataatgatcgcgcctgagtcaccgagcatgtctcatatgcacagcaaactcccatctatggcgttccatctcttgtggtacttagcacttgtaacacaagtgtcactctgttttttgtatgccttgaagtgcattttcttctttgacaaggtgaaggaagagttcttgcactatatcggagtgaactatctctacgctccatctatttcatggcttctcatgcttcaatcagctccaatgatggaaccaaatagcgttttgtatcagacactattctggatctttgctgttccagtcttgacactagacataaagctttatggccagtggttcacaacggagaagagatttttgtcgatgctagcaaacccggcaagccaagtatcggtaatcgcaaacctcgtggctgcacgaggagcagcagagatgggttggaatgagtgtgctctatgcatgttctcactcggaatggttcactatttggttatctttgtcaccctctatcaacgcttaccgggaggaaacaacttcccagccaagttaaggccaattttcttcttgttcgtcgctgcaccagccatggcaagtctagcctggaactctatttgtggaacttttgatgccgtagcgaagatgttgttcttcctttcacttttcatcttcatgtccctggtctgtaggccaaatcttttcaagaaatcaatgaaaagattcaatgtcgcgtggtgggcttactcgttcccactcacttttcttgcgttagactcggttcagtatgcgcaagaggtgaaagatccggtcggttctggcttaatgcttatcttctcatctatctcagttttgatcttcctcggtatgatggtactgacagcagcaaacagcaatagactactcagacacgatcctatattaaacaagaacttactcacttctatttgttctgtattctctgattttacttgtcaaccataccttgttaacctcatcctcaagtattcttcatga

SEQ ID NO: 2619 - DNA, 552 bp, Arabidopsis thaliana
atggagatggactcagaagaaactaatccaataatgagctcttcgcctccgggaagaatatctctccggccgatgactctttccgacgtcgatgactacatggtttgggccacagatcctaaagtggctcgattttgcacttgggagccttgcacgagccgagacgaagctatcaaatacataaccgatcgtgtcctgacacacccttggctccgagccatctgcttagaagacgaccgtccaatcggctacatcttgatcatggcggttgataacatcagaaaagagattggttatgtcctagcgagaaagtattggggaaaagggtttgccacggaagcagtgaggctagtgaccgcggaggtattcgaggaatttccagagattgaaaggcttgaggcacttgttgatgtggacaatgttggatctcaaagggttcttgaaaaagttgggtttactagagaaggtgtgatgaggaagtttatatgtatcaagggaagtgtaagagacactgttatgtttagtttcttgtctactgatactttgaagtaa

SEQ ID NO: 2620 - DNA, 1491 bp, Arabidopsis thaliana
atggccgggactggattgtttgctgagattcttgatggagaagtatacaaatactacgctgatggtgagtggaaaacttcttcctcaggtaagagtgttgccatcatgaacccggccacgaggaagacacagtacaaggttcaagcatgcacgcaagaagaagtgaacgcggtgatggaactggcgaaatcagctcagaaatcgtgggcgaaaactcctctttggaaaagagctgagcttcttcacaaggctgcagcaatccttaaggacaacaaagctcccatggctgagtctcttgttaaagaaatcgctaaacccgccaaagattctgttactgaggttgtgaggtctggagatttgatctcttattgtgctgaagaaggtgttaggatcttaggtgaagggaagtttcttctctccgatagcttccccggtaatgaccgtactaagtactgcctcacttccaagattccactcggtgtggttttggctattcctccattcaattatccagttaatctcgctgtatcgaagatcgctcctgctttgatcgccggaaactcccttgtcctcaaacctccaactcaaggagctgtttcttgccttcacatggtacattgctttcacttagccggtttcccaaaaggtcttatcagctgcatcaccggaaaaggatctgagatcggcgatttcctcactatgcaccctgctgttaactgcattagtttcacgggtggtgataccggaatctcaatctcaaagaaagctggtatgatccctcttcaaatggaacttggaggtaaagatgcatgcattgttctagatgatgctgatcttgatttagttgcttccaatatcatcaaaggaggattctcttacagcgggcagagatgcactgcggttaaggtagtcctagtgatggaatcagtagcggatgagcttgttgagaaagtgaaagctaaagtggccaaactcacggtgggaccgcccgaagagaactccgatatcacggcagtggtgtcggaatcttcagctaatttcattgaaggattggtgatggatgctaaggagaaaggagcaacgttttgtcaagagtataaaagagagggtaacttgatttggccgttgcttttggataatgttagaccggacatgaggatcgcgtgggaggaaccattcggtcctgttgtgccggtcttgaggatcaattctgttgaagaagggattaatcattgcaatgcaagcaactttggccttcagggatgtgtattcactaaagacatcaacaaggcaatactgatcagtgatgcaatggagacaggaaccgttcagatcaactctgcgccagctcgtggaccggaccacttccctttccagggacttaaggacagtggaatagggtcacaaggtgtgacaaatagcatcaatttgatgactaaagtgaagaccactgtcattaacttgcctacaccttcttactctatgggttag

SEQ ID NO: 2621 - DNA, 825 bp, Arabidopsis thaliana
atgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaa

SEQ ID NO: 2622 - DNA, 1692 bp, Arabidopsis thaliana
atggccgtctcatcattccagtgccctaccatcttctcctcctcctcaatctccggctttcaatgccgttctgatccagatctcgtcggttctcccgtcggtggatcatctcgccgtcgtgtccatgcctccgccgggatttcttcctcattcaccggggacgctggattatcctccaggatcttaagatttcctcctaatttcgtccgtcagctgagcattaaagcccgtagaaactgtagcaacatcggtgttgcacagatcgtggcggctaagtggtccaacaacccatcctccgcgttaccttcggcggcggcggctgctgctacctcgtctgcatctgcggtttcttccgccgcatctgcagccgcagcctcgtccgccgccgccgcccctgtggctgccgcgcctcccgtcgtgctgaaaagcgtcgatgaggaggttgtggtggccgaggaggggatcagggagaagataggtagtgtacagctgacggattccaaacattctttcttgagctccgatgggagcctcactgttcatgccggtgaaagattaggccgtggtatagtgacggatgctatcactactcctgtagtcaacacatctgcctacttcttcaagaaaactgctgagcttattgacttcaaggagaaaaggagtgtgagtttcgagtatggtcgttatggtaaccctacgactgtggtacttgaagataagataagtgcacttgaaggggctgaatcaactttggttatggcatctgggatgtgtgcaagcactgttatgcttttggcattggttcctgctggtggacacattgtcactactactgattgctacaggaagactaggatcttcatggagaattttcttcccaagttggggatcactgtcactgtgattgatcctgctgatatcgcagggcttgaagctgcagtgaatgagttcaaggtatctctgttcttcactgagtccccgacaaacccattccttagatgtgtcgacattgagctagtttcaaaaatatgccacaagaggggaactctggtttgcattgatggcacctttgcaacacctctgaatcagaaagcccttgctcttggtgctgatcttgtcgtgcactctgctacaaagtacattggaggacacaatgatgttcttgctggatgcatctgtggttcactgaagttggtttcagaaattcgcaatctgcatcatgtgttgggaggaacacttaacccaaacgctgcgtacctaatcatccgaggcatgaagacattgcatcttcgtgtacagcaacagaattcgaccgcttttagaatggccgaaattttagaggcacatcctaaggtgagtcatgtgtactatccaggccttccaagtcatcccgaacatgaactcgccaagcgacaaatgactggttttggaggtgtggtcagtttcgagattgatggagacattgaaacgacaatcaagtttgtggattctctaaagattccttacattgcaccatccttcggtggctgcgaaagcattgttgaccaacctgctatcatgtcctactgggatctgccgcaagaggagagactaaagtatggaatcaaagataacttggttcgtttcagctttggagttgaagactttgaagatgtcaaagctgacattcttcaagctctcgaagccatctga

SEQ ID NO: 2623 - DNA, 1407 bp, Arabidopsis thaliana
atgaatgatgctgagaagctgtacaagaagcttacacgagtaaaatccggaagcatatctcgccaaaagtctaggtggggtgggtttctagggatgtttgggaataatgttgatgtggttgaccattaccaaaagaagcttgataagttagaagatgacatgagattgaaacagtctttattagcaggagaggaagttccagctgcttttgtttcctttaggacaagacatggtgctgcaatagcaacaaacattcagcaaggaatagatccaacacaatggctaactgaggcagccccggagcccgaagatgttcattggccatttttcactgcatcgtttgtgagaagatggatctccaatgtagtggtgcttgtggctttcgtagctcttttgatcctatacattgtccccgttgtattggttcaaggtcttgctaatcttcaccagttggagacttggttcccttttctaaaaggaatattaaatatgaaaatcgtgagtcaagtgattacgggatatcttccgagtctcattttccagcttttccttcttatagtaccacccattatgcttctactttcctcaatgcaaggattcatttctcatagccagattgagaaatctgcatgtatcaagcttctaatctttactgtatggaacagtttctttgcaaatgtactgtccggatctgccctttatcgtgttaatgtgttccttgaacctaagactattcctcgtgtgcttgctgcagctgtgccagcacaggcatcgttctttgtatcttatgttgtgacctctggatggactggtttatcatcagagatcctccgtttggttcctcttctttggagtttcataacgaaacttttcggcaaggaagatgacaaagaatttgaggttccttcaactcctttctgccaagaaatcccaaggattctattttttggactcctcggtataacttacttcttcctttcgccattgatactgcctttcttgttggtctactattgtcttggatatatcatctaccgcaaccagctcctaaacgtatatgcggccaagtatgaaactggtggaaagttttggccaatagttcacagctatactatcttctctttggtactaatgcacattattgcagtcggattattcgggcttaaagagcttccagtggcatcttctttaacaattccccttccggttctcacggtccttttcagcatttactgccaaagacggtttttaccaaatttcaaatcttatcctacccagtgtctggtaaacaaagataaagcagacgagagagagcaaaacatgtctgaattctattcggaactcgttgttgcttaccgagatcctgcactttcggcatcacaggactcgagagatatctcaccttga

SEQ ID NO: 2624 - DNA, 1746 bp, Arabidopsis thaliana
atggagaaagtgaccaactcagacttgaaatcctctgttgatggtggcgttgttgatgtgtatggagaagattcagccaccattgagcacaacataactccttggtctctctctgtttctagtggatattcattgctgagagatcctcgctacaacaaaggacttgctttcactgagaaagagagagacactcattacttgcgtggtcttctccctccagttgttcttgatcaaaagcttcaggagaagaggctgttgaacaatatccgacaatatcaattcccattacaaaagtacatggctctgacagaacttcaggaaagaaacgagagactgttttacaagctattgatagataatgttgaggagctacttcctattgtttatactccaactgttggtgaagcttgtcagaaatttggaagtattttcaggcgacctcagggtttattcatcagtttaaaagacaagggaaagattctagatgtgttaaagaactggcctgaaaggaacatacaggttattgttgttactgacggtgaaaggattttaggattaggagatcttggatgtcaggggatgggtataccggttggtaagttggcgttatattcagcacttggaggtgttcgtccttcagcgtgtttacctgtcaccattgatgtgggaacaaacaatgagaaactgttgaatgatgagttctacataggactcaggcaaaagagagcaacgggacaggaatatagtgaactcttgaatgaattcatgagtgctgtgaaacagaactatggtgaaaaagttcttattcagtttgaagattttgctaatcataatgcctttgagttgcttgcaaaatacagcgatactcatctcgtcttcaacgatgatatacaggggacagcatcagttgttttagcaggattagtttccgcacagaagttaacgaatagcccacttgcagagcataccttcctctttcttggtgctggtgaagctggaactggaatagcagaactcatagctctctatatgtcaaaacagatgaatgcttcggtagaggaaagccgcaagaaaatctggcttgttgattccaagggattgattgttaactcccgcaaagattcacttcaagactttaagaaaccatgggctcatgaacatgaaccagtcaaagacctcttaggtgctatcaaggcaataaaaccgactgttctgattggatcttctggcgttggacggtcttttacaaaagaagtgatagaagccatgtcctccattaatgagagaccactgataatggctctctctaaccccacaacacaatctgaatgtacagccgaagaagcttatacttggagtaagggccgtgccatttttgctagtggaagcccttttgatccagttgagtatgaaggaaaggtgtttgtatctacacaggcgaacaatgcgtacatattcccgggctttggacttggtttggttatctctggagcaatacgggtacatgacgatatgcttctagctgctgctgaggcattagctggacaagtaagcaaagagaactatgagaaaggaatgatatatccttcattctcttccatccggaaaatatcagctcagattgcagccaatgtagcaactaaggcgtatgaactaggattggcagggcggcttccacggccgaaagatattgtcaaatgtgcagagagtagcatgtacagccccacataccgtctctaccgttga

SEQ ID NO: 2625 - DNA, 804 bp, Arabidopsis thaliana
atgttagttgcgtatcctgcgggaactatcaacaaattccaaatccctattagctgctatgccgctttgcgcagattcaagacctcgccttttggtcctctgattagttgttctgtctccccaagatcaatagttccttgtagcaatgtagagtgttatcattcatctttttctacaaaatatcaaattcagcctcgaaggagatggatgttttgtaactcacgcaacaactcgatttcatcggatgatgagtaccgttcatcacccaacatagctataagtcttttaagacgttacaggaccgtgattggacgcggtgaaggcgaaaccttaaaagaattcatatccgctggtgtgaatgcatatgcgctcggctgcacagatgaagatttgagaaaagaactaatggctatgaaagattcgggtttagagattgagagaatggagaattacggcggaagcacacagactaaatccaaaattacgctgtctgaggtagatgaatgcatattgtggcttaggattgtattcatcacgatcttgtgtacgccgcaaccaacagtcataagatggtcatcgactccttcggtttctgatgaaattctaagcaaatggagaggcttttgcgcggttatagcaaatgcatactatattagaggaatggcttggctgcctgtgaagactcttcagttggagcagatggcggtgacaggacaatcagaggagccgtccgttgtggccagccgaatgagactggtgtttagcactctcgaggtagtgagtcctcaatggccacgggtttaa

SEQ ID NO: 2626 - DNA, 2181 bp, Arabidopsis thaliana
atgccctctcaccccaacttcatcttcaggtggattggactgttttccgataagttccgtcgacaaacgactgggatcgatgaaaacagtaacctccaaatcaacggtggagattcgagcagcagcggcagcgatgagacgccggtgctaagctccgtcgagtgttacgcttgcacacaagtaggcgtcccagctttccattcaactagctgcgatcaagctcacgcgccggagtggcgtgcctccgccggctcttctctagttccgatccaggaaggatctgtccctaacccagcccgaaccagattccgacgtctcaaaggtccgtttggtgaagttctcgatcctaggagcaagcgcgtgcagagatggaaccgcgcgttgcttttagctcgtgggatggctttagcggtggatccgctcttcttctacgcgctttccatcggccgaactaccggaccggcgtgtctttacatggatggtgcgttcgccgcggtggtcacggtgctccgcacgtgtctcgatgctgttcatctttggcacgtgtggcttcaattcagactggcctacgtctcgagagagtcgcttgtcgttggttgtgggaagctcgtttgggatccacgcgccatcgcgtctcactacgcacgctctctcactggcttctggtttgatgttatcgtcatcctccctgtccctcaggcagtgttttggttagttgtgccgaaactgataagagaagagaaggttaagctgataatgacgattctgctgctaatattcttgttccagttcctccccaagatttatcactgcatctgtttgatgagaaggatgcagaaggtcactggttacatttttggaactatttggtggggttttgctcttaatctcatcgcatatttcatcgcttctcatgttgctgggggatgttggtatgttctcgcaatacagcgtgttgcttcttgcataagacaacaatgtatgagaaccgggaactgcaatctgagtctggcttgcaaagaagaggtctgttaccaatttgtgtcaccgacaagcacagttggatatccatgcttatctggaaaccttaccagtgtggtcaataagcctatgtgcttagactctaacggaccattccgatatggtatctaccgttgggcacttccagtcatctccagcaactctcttgcggttaagatcctttaccccatcttctggggcctaatgactctcagcacatttgcgaatgatcttgagcccacaagcaactggctcgaggttattttcagtatagttatggttctaagtggcttgttacttttcacgctgttgataggaaacattcaggtgtttttgcatgcggtaatggcgaaaaaaaggaaaatgcagatacggtgtagggatatggaatggtggatgaaacgtaggcagttaccttcccggttaagacagagggttaggcgatttgagcggcagagatggaatgccttgggtggtgaagacgagctagaacttatacatgatttgcctccgggtcttcgaagagatatcaaacgatatctttgctttgatctcattaacaaggtgccattgttcaggggcatggacgacttgatcctcgacaacatttgcgatcgggctaagcctcgagtcttctctaaagacgaaaagatcatccgtgaaggagatcctgtacagagaatgatattcatcatgcgtggacgagtcaaacgtatacagagcctaagcaaaggcgtcctagccactagtacactagaaccaggcggttacttgggcgacgagctactctcatggtgcctacgtcgcccgtttctggaccgtcttcccccttcctcagcaacatttgtctgcctagaaaacatcgaggcattctccctcggatccgaagatcttaggtacattaccgatcatttccgttataaattcgcgaacgagcggcttaagcggaccgcaagatactattcctcaaactggaggacgtgggcagcggtaaatattcagatggcgtggcgccggcgtaggaaaagaacccgtggtgaaaacatcggcggttcgatgagtcctgtgtcggagaatagcattgaaggtaacagtgaacgccggttacttcagtatgcagctatgttcatgtccattcgaccgcatgatcatctcgaataa

SEQ ID NO: 2627 - DNA, 771 bp, Arabidopsis thaliana
atgggttcgtcttcttctttctcctcttcttcctcgaagcttctctttcgtcaactctttgagaacgaatcttccacctttacttatcttctcgccgacgtttctcatcctgataaacctgctttgttgattgatccggtggacaagactgtggatagagacttgaaactgattgatgagttaggactaaagcttatctatgctatgaacactcatgttcatgctgatcatgtcactggtactggacttcttaagacgaagctcccgggtgtgaaatccgttatttcgaaagcaagtggttccaaagctgatttgtttcttgaacctggtgacaaagtatctattggtgatatataccttgaggttcgtgctacacctggacacactgcaggatgtgttacatatgtgactggtgaaggagctgatcagccccaaccaagaatggcttttaccggggatgctgtactcatccgtggttgtgggaggactgactttcaggaaggaagctcagatcaactctacgagtctgtacattcacagatatttacattgccaaaggacacattgatctatcctgctcacgactacaaaggtttcgaggtaagtacagttggagaagagatgcaacacaacccgcgtctaactaaagataaagaaacattcaaaaccattatgtcaaatctgaatctgtcgtatccgaagatgattgatgttgcagtaccagcaaatatggtctgtgggttacaagatgtgccttctcaagccaactaa

SEQ ID NO: 2628 - DNA, 273 bp, Arabidopsis thaliana
atggcaatgaagtcagtttctaccttggccgtttttgccatcctctttttggttatcgttgaaatgccagagataaaagcgcaaggtagcaagtgtctgaaagaatatggcggtaatgtgggtttcagctattgtgcgcctaggatatttccgtcattctgttatcggaactgccgtaagaataagggcgcgaagggaggtagatgccgttcgggaggggcaggagctggtagtatgatatgtttatgcgactactgcagcgacaaaccttaa

SEQ ID NO: 2629 - DNA, 309 bp, Arabidopsis thaliana
atgggtgtaacattagaaggacaaagaaaggaatcaatttgggttttgatgagaagacaaagggctcgaagggcacttgtgaagaagatcatgatccgaccaaggaagagtgtagaagcttctagaagaccttgtcgcgcaatacacagacgagtgaagacgctaaaagagcttgttcccaacaccaaaacatcagaaggtttagatggactctttagacaaacggcagattatatcttggctttggaaatgaaagtgaaagttatgcagacaatggttcaggttttgaccgaaactaactgtgtttaa

SEQ ID NO: 2630 - DNA, 237 bp, Arabidopsis thaliana
atgtcgggagcacaaggagcagagccgatggattcaagaacggcgacaacgtacgagtcagtggaaggaggacagaacaagacgaagcttgatataaggtcaaaggaagacgaaggtgggattcaagttgacaagcttcaagacaaggtctctgatgctgctggtcttggcggacctgtctttggtgctggtaaagacgacaagaagcaggatcttggtgttaccggtaccggctag

SEQ ID NO: 2631 - DNA, 909 bp, Arabidopsis thaliana
atggagaaccaagacaagatacaaaatgtcttggacatcatgagacttgctctcgtcatcatcgctgctgtgatgcttttccttgcgtttatcggatttcttctctctatttttggactgcaatgccttgtatatacgttggtgatccttggttggattctcgtcacggttaccttcgtcttatgtggtggatttttacttctacacaacgttgtaggggatacgtgtgttgcgatggaccaatgggtccaaaacccaacagctcacacggctctagacgatattctaccgtgtgttgataatgcaaccgcgagagaaacattgactcggactaagcttgtaacataccagttggtcaatcttcttgacaatgccattagcaacatgaccaacaggaatttcccgcctcaattccggcctctttattacaaccagtcaggtccactaatgcctctactctgtaaccccttcaacgctgatctctctgaccgccaatgccagcctggtcaggtccatctgaacaatgcaaccgaggtgtggaagaacttcacttgccaaattgtaacaccgggaacatgtagtacaccgggacggttgacaccaaagctttacagccagatggctgcagcggttaatgtaagctatggtttgtacaagtacggaccgttcttggcagacctacaagggtgtgacttcgtgaggtctacattcactgatatagagagggatcattgtccgggacttaagagatacacacaatggatctatgtgggtcttgtggtggtgtctgcttctgtaatgtcatctttggtgttttgggttatatatgcgagagagaggaggcaccgggtttacacaaaagactacaacgctatgcactctgaagatccacgaagcaagggccactga

SEQ ID NO: 2632 - DNA, 1119 bp, Arabidopsis thaliana
atgagcaacgacaaggatagcttcaacgtctccgatcttactgctgctcttaaggacgaggatcgagctggccttgtcaatgctctaaagaacaagctgcagaatctggctggtcagcgttctgatgtgctcgagaatctgactcccaatgtgagaaagcgcgttgatgccttgagggatatacagagccaacatgatgaactagaggcaaaattccgtgaggagagagctattcttgaagccaagtatcaaacgctgtatcagcctttgtatgtcaagcgttatgagattgtgaatggcactactgaagttgaactggctccagaggatgataccaaggtggaccaaggagaggagaaaactgcagaagagaaaggagttccaagtttctggctgacagctctgaaaaataacgatgttatttccgaggaggtcacagagcgtgatgaaggggctctcaaatatcttaaagatattaagtggtgcaagattgaagagcctaaaggattcaaacttgagtttttctttgacacgaatccgtattttaagaacactgtcttgacaaagtcttatcatatgattgatgaagatgagccactgcttgagaaggctatggggacagaaattgattggtatcctggaaagtgtctaactcagaagattctcaagaagaagcctaagaaaggttcaaagaatactaaaccaatcaccaaactcgaagattgtgaaagcttcttcaacttctttagtcctccagaagttccggatgaagatgaagatatcgacgaggaaagagctgaggatcttcaaaacctgatggaacaagattatgacatcggatctactattcgggaaaagattattcctcgtgctgtctcatggtttactggtgaggctatggaagcagaggattttgaaatagatgacgatgaggaagatgacattgatgaggatgaagatgaggaagacgaagaggatgaggaggacgatgatgatgaggatgaagaagaaagcaagaccaaaaagaagccatcaatcggcaacaagaagggagggagatctcagatagttggtgaaggtaaacaagatgagaggccacccgaatgcaagcaacagtaa

SEQ ID NO: 2633 - DNA, 753 bp, Arabidopsis thaliana
atggtgaagattgagataggaagtgtgggtgactcctttagtgtagcatctcttaaggcttacttgtctgaatttatcgcaactcttctctttgtgtttgctggcgttggctctgctcttgcttttgccaagctcacatccgatgcagccttggaccccgctggtcttgtcgctgtcgctgtggctcacgcctttgcccttttcgttggtgtttccatagccgccaacatctccggcggacaccttaaccccgccgtgacactcggtctcgccgtcggtggcaacatcacagtaataaccggtttcttttactggattgctcaatgccttggctccatcgtcgcgtgtctcctcctcgtcttcgttaccaatggcgagagcgtaccgactcatggagtagcggccggtttaggagctattgaaggagtagtgatggagattgtggtgacctttgctctggtctacacagtctacgccacagcggctgatccaaagaaaggttcactcgggaccattgctccaattgctatcggtttcatcgttggtgccaacatcctcgcagcgggtccctttagcggtggttccatgaacccggccaggtcatttggaccagctgttgtcagtggtgacttctctcagatatggatctactgggtgggtccactagtcggtggtgcacttgctggactcatctacggagacgtcttcatcggatcctacgctccagctcccaccacagaaagctacccttga

SEQ ID NO: 2634 - DNA, 747 bp, Arabidopsis thaliana
atggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctagaggaaagccaagaggtagatattttggttcctgaagcgacgacaacagaaaagggggacaccttggcttttgacgttgatcaactttggagtcttttcgatggagagactgtgaaatttgattag

SEQ ID NO: 2635 - DNA, 528 bp, Arabidopsis thaliana
atgtctttaagtcgtagagatcctcttgtggtcggcagtgttgttggagatgttcttgatcctttcacgaggttggtctctcttaaggtcacttatggccatagagaggttactaatggcttggatctaaggccttctcaagttctgaacaaaccaatagtggagattggaggagacgacttcagaaatttctacaccttggttatggtggatccagatgtgccgagtccaagcaaccctcaccaacgagaatatctccactggttggtgactgatatacctgccaccactggaaatgcctttggcaatgaggtggtgtgctacgagagtccacgtcccccctcgggaattcatcgtattgtgttggtattgttccggcaactcggaagacaaacggtttatgcaccggggtggcgccaacagttcaacactcgtgagtttgctgagatctacaatcttggtcttcctgtggctgcctcttacttcaactgccagagggagaatggctgtgggggaagaagaacgtag

SEQ ID NO: 2636 - DNA, 774 bp, Arabidopsis thaliana
atgggaagatcaccatgctgcgagaaagctcacatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgtgaagagattggtatggttaataattgtgagagtagtggaacgacgtcggagaaggattatgggaacgaggaagattgggtgttgaatttggaactctctgttggaccgagttatcggtacgagtcgactcggaaagtgagtgttgttgactcggctgagtcgactcgacggtggggttccgagttgtttggagctcatgagagtgatgcggtgtgtttgtgttgtcggattgggttgtttcgtaatgagtcgtgtcggaattgtcgggtttctgatgttagaactcattag

SEQ ID NO: 2637 - DNA, 3012 bp, Arabidopsis thaliana
atggggaaaaacaagagagagaggaaagatggagaagagaaatctccacacgctgccgccactgtttgcgtctctggcttgccttattccatcaccaacgcacagcttgaagaagcctttagtgaagttggcccagtcaggcgttgctttctggtcacaaataaagggtctgatgaacaccgcggctttgcgtttgttaaatttgctttacaagaagatgttaatcgtgccattgagttgaagaacggttctactgttgggggccgtaggattactgttaaacaggctgcacatcgaccttctcttcaagagcgtcgaacaaaagcagctgaagggatctctgtacctgataattcccagggacagagtgacaaggacacttcaatccctgagacagacgagaaagtatctccacccgagaaaaaattagagaagccagttgagcgcaaaaaagtagagaaaccaattgagcgcaaacaagtagagaagccagttgagcgcaaaaaagcagagaagccaattgagctcaaacaagtagagaagccatttgagcgcaaacaagtagagaagccagttgagcgcaaacaagtagagaagccagttgagcgcaaacaagtagagaagccaattgagcgcaaaagaccaacaaagcttcatgttgatttacctgataaagaaacatgttcagataagcaaagagttgcaagaactgtaatatttggtgggcttgctaatgctgagatggcagaggtagtccatagtcgagtcaaagagattggcactgtgtgctctgtcagatatcccctacccaaagaagagctccaacaaaatggtcttacccaagacggatgcagggcagaagcatcagctgttctctttacgagtgtcaaatctgcttgtgccgctgttgcaaaattacatcaaacagaagtaaagggaaatctcatttgggctcgtcagcttggtggggagggttcaaaggctcagaagtggaaacttattatccgaaatcttcctttccaggctaaacctagtgatattaaagtggtcttttcagcagtagggtttgtctgggatgtttttattcctaaaaattttgaaactgggctacctaagggttttgcatttgtcaaattcacgtgtaagaaagatgcagcaaatgcaattaaaaagttcaatgggcacatgtttggtaaaaggcctatagctgtagactgggcggtacctaaaaatatttacaatggtgctgctgatgccactactgcttcagcagatggtgacaaagaaggaagtgatggggacagtgaaaacagtagtgttgatttggaggaggttgatgaagctgtagaaagccaccctcctccaggagatgatactgatgatgatgaggacggcagtaacaaactgactgaatcagatgcactggacaaagatgttgggaccgatatgaactttgaagatgaagcagatgttgccagaaaggttcttaagaacttgcttgcttcttcaaaaggttctactgctacacctgagggagagacagaggaatcggataaaagtaaactgaaaagttcatcaactaagccagttgctgactcttctggtgtatctgaacctttgaaatccggtaaaactaaagtggtggctcctaaagagacgcaggataatgatgattttgagagaactttatttataagaaacctcccatttgatgttactaaggaagaagtcaaacagaggtttacagtatttggggaagttgaatctttatccctggttctccacaaggtcacaaaacggccagaagggactgcttttgtcaagttcaaaacagcagatgcatcagttgcagccatttcagctgccgatactgcctcaggtgtcggtgtccttcttaaaggcaggcaactaaacgttatgagagctgtgggtaagaaagctgcaaaggacatagaactcaaaaagacagaggagaagaatgttgaccatcggaatctttatcttgctaaagaaggtcagatccttgatgatacacctgctgctgagggtgtgtctgcggaagatatggacaagcgacgaagattgcatgaaaacaagatgaaaatgcttcagtctcctaacttccatgtatctcggacaaggcttgtgatttataatttgcccaagtccatgaatccaaagcaactaaacaggctcttagttgatgctgttacctcacgagctacaaagcagaagccgtgtattcgacagatcaagttcttacaaaatgagaagaaaggtaaagttgatactaagaactactcccgtggagttgcctttgttgagttcacggagcatgaacatgctcttgtagccctgagagtacttaacaacaatcctgagacatttggtcctcaacaccgccctgtcatagaatttgctgttgataatgtccagaagctgaagatacgagaagctaagcagcagcagtttcagcaacgcgagaaacacaatgaatctgatcagcagcaggcgaacggcgaagcacaggcacctgacaataaatacaaacgaaaaacgagggaaggggataacactggtccaaggaaagagaatgcagccaggtttaagaagggaccacgtgaagagagtaaagaagaagcaaaatccaatatagcagtaaaagataatgcagcagagaagaagagacctatacgcacacaggaaaaaccgtcttcaaacaagaaaggccaattgatgagacagaaagagacaactgagaaaccagatccgaaaatttccaaagatttgagcgaaccaaggaagaggaagttcggggaggatagaggtgaagagaatagaaatgggcagaggaagaggaagaagcaaggtcaaggtcaaggtggtgcagaagttgtggacaaacttgatctgttgattgagaaatacaggtctaagttctcgcagagctcagccaaaaccggcccacaaaaacagagttccggtcaagtcaggaggtggttcgaatcttga

SEQ ID NO: 2638 - DNA, 1698 bp, Arabidopsis thaliana
atggattctgaagaagacatgctcgatgcgcacgatatggagtctggagaggatgatttctacagcggtggaactgatgattgtaatgatagtgatgatggtgaacctgattatgggtttgttgaggaagatgctgatgattctgctatgatcgcctctcatcgctctcagaaaaacttttgtgttctgagggaagaagatattcgcaggcatcagatggataatattgaacgagtttccgttgttctctcgataactgaggttgaagcgagtattctacttcgtcactttcactggagtgtcggtagagttcatgatgagtggtttgctgatgaagagagagttcggaagactgttggcatattggagagtcatgttgttccaccatctgatgacagtgaacttacatgtggaatctgtttcgattcctaccctcctgagaaaatcgcttcagtttcttgtggccatcctttctgcactacatgctggacaggttatatcagcacaaccattaatgatggcccgggatgtttgatgctaagatgtcctgacccatcttgtcttgctgctgttggtcatgatatggttgacaaattagcgtctgaagacgaaaaggagaagtacaacagatattttcttaggtcttatattgaagacaacagaaagggtctggaaattatgatgtttcctgcttgtgctcgtttagcttttgctggaatgatacttgccaattcaaagccttgtccgagatgtaagaggccaattgaaaagaatcagggctgtatgcacatgacatgtacaccgccttgtaaatatgaattttgttggctatgtcttggtgcatggatggatcacggggaaagaactggtggtttttatgcttgtaaccgttatgaggtggccaagcaagaaggacagtcgaggcaaaaggctatggctgatctgcagcaagcgcagatgcagaatgtaagacttgttatgttctttagaattttgcttctttctgaatctcttcgtctattcatctcaaagcttagtgataaacagtgcacaccagagtctcagctcaaattcattttagaagcttggcttcagatcatcgaatgtaggcgagtcttgaaatggacttatgcatatggatactacctacctgagcatgaacatgccaaacgacaatttttcgagtatttgcaaggtgaagctgagtcaggtttagagaggctccatcaatgcgtagagaaagacttggttcagtttctcattgcggaaggtccatcaaaagatttcaatgatttccggacaaaactagctggtttgaccagcgtgacgaaaaactactttgagaatttggtgaaagctctggagaacggtcttgctgatgtagactcacatgcggcttgcagcagcaaatcaacaagctctaaatcaacaggttgcagtagcaaaacaagagaactggtggatcctcgccaaggtacaaaacccgaattgatcgtatgcaattgtacaatgcacacgctcgaggaaaagcccaaactgcatgcacatagtggaattctaattcttctgtcatgcgtgtatgcgatttggatcatcggatttgtgacaagtttcctacttatgtatagtgtaaaagaatatgaaaaagatgaacaacgcagagttaagcccattaaatcacactttttgcacttgtag

SEQ ID NO: 2639 - DNA, 1602 bp, Arabidopsis thaliana
atgaaggctcgtagtggtcacgagatgaagaagacgttgacgtggtgggatctcatgtggtttggtatcggtgcagtcatcggctctgggatattcgttctcactggactcgaagcacgtaatcattccggtccagccgtcgtgttgtcttacgttgtctctggtgtctccgccatgctctccgtcttttgttacaccgagttcgccgttgagattcccgtcgcaggcggttcttttgcctacttaagagtggagctcggcgacttcatggccttcatcgccgcgggaaacataatcctcgaatacgttgtcggtggagctgccgtggctcgatcgtggacctcttacttcgccactctcttaaaccataaacctgaagacttccgcatcatagttcacaaactcggcgaagactatagccacttagatccaatagccgtcggcgtttgcgccatcatttgtgttttagctgtcgttggcacaaaaggctcctcaagattcaattacattgcttctataatccacatggtcgtgattctctttgttatcatcgccggatttactaaagccgatgtgaaaaactacagcgatttcactccttacggcgttagaggagtgtttaaatccgccgcggttcttttctttgcctatattggatttgatgcggtttcaacgatggctgaggagacaaagaatccagggagagatattcctattggtcttgttggatcgatggtggttactacggtttgttattgtctcatggcggttacgttgtgtcttatgcagccgtatcaacagattgatccggacgcgccattctcggttgcgttttctgccgttggatgggattgggctaagtacattgtcgcctttggggctcttaaaggtatgacgacggttttgttagttggggccattggtcaagctaggtacatgacacacatagcccgagcccatatgatgcctccatggctagctcaagtcaacgcaaagaccggaacaccaattaacgcgaccgtggtaatgcttgccgcgacagctctcatagcattcttcacaaaactgaaaattttagccgatctcttgtctgtttccacacttttcatcttcatgttcgttgctgtggctcttctcgttagaagatattacgtcaccggagaaacatcgacccgtgaccgtaacaagtttttagtgttcttaggtttgattcttgcgtcctctaccgcgactgctgtttattgggctttggaagaagaaggttggattgggtattgcattacggttcctatatggtttctgtctacggttgccatgaagtttcttgtaccgcaagctagggctccgaaaatttggggtgttcctttggttccgtggttgccttctgcttccatcgctattaatatcttccttcttggttccatcgatacaaaatcgttcgttaggtttgcaatctggacaggtattctgctcatatattacgtcttgtttgggttgcacgcaacgtatgatacagctaaggcgacgttgaaggagaagcaggcattgcagaaagctgaggaaggtggtgttgttgctgataattcttgttctgcaacttaa

SEQ ID NO: 2640 - DNA, 2313 bp, Arabidopsis thaliana
atgggatccgccgccgaactcacggagcccaccaccgggaccgagaagcttcaccagccaatagaagttgaagaagatgacgaacaaattgttgatttggagaggaaaacattccgtcatggaaagggacacgatactagtgtggacagtagtacaatcaccaacaccagctcgtcgtcgtcttctagcttttccggtgatggtggaacggaagagacccccgatttccacagcaacggcgatggagaacataccgatttagtaaatttggaggtcccggagctagaaactgaaatcgtatttcaccaagagcatgacgacgggaagaattgcatcgtcttcttcgacggagaacaaggaatttggaaatgtcgccactgcgattggacctacaaagagggatctttgttatgcaaaggttctgagtcagctggtgccatacctgatgctcatgaggagtctcaaactgctgacttgaatggggagcaaacgcagttagaacctgaaaacggttcaacttctgaggataacgaaagatctcgtgaaattgaagaagtactagatggtgatgtctctaaagacttggatgctgttgatccactcgctggtgaggtgatagaggaggaggtggacttcgaagatgttgaatatcatgatgtggagaatatgatggataagcaagagacacatgatttgtactgtccaaactgcgattcttgcatcaccaaaaaggttatcctcaaaagaaggaaacggaagatccgtcgtcatgagctgggagattcaaagcggcctcatttgactgagcctctttttcattcggaagacaatttgccatctctagatggcggtgaaaactctgcaaatgagtcatttgtcttcaagtgcttgtcatgctttaccatatttattcccaaaggagttgaggggttaaagattcagccaaaccctcaagtggaagctacaggcgattccaattggttcagttcaatatttggcctcaacaaaaaggaatcagctattcagcaaggtggggcatcatctagtgtcttggaagctaatccgccaccacgtgagtccattgtcccagtagttaatccatcgcgtggtaacctaagtcctatgcgaaaggatacgacaggctcagccgttgttcagcctgatgcagccacttcgattcaagttgcaaaatcaaacgatacaagcgaaattgtaaacaatggagctattgttggagacgggcaaaagtttctggctcctatggtggaggagcaaacacagcaaaagattgacaatgatgattctagtacagcagacgggaatcacacgtcagacaaaggacgtctctccccaattcaaccatctcatggcatgagtatactaaacacagtgactaacggacccgacggattgaaagtagaaactacaattcatgaagaaggtgcccctcttctgtttgaaggaaaagacactcctgacacaagcacggcagattttggtctgaccaaagtaacaggtgtgatggacacaggtgacagaggagttattaccggtccagcaaatcctgaaattgatatttcagcagggaatttgctggaagaagggtctctaagggaaccgttaatgagacgagttgttgttcaaggacgtaaactggaaatcttgaaaagcattgtctacggaggtctactagaagccatcacaagccttggtgttatttcatctgccgctggttctggtgcttcaatgttgaatattctggtcttggggcttgcaaacttgcttggcgggcttattcttattattcataatctccaagaacttagagaggaggaacccataagaacaacaacagaagataaccagactaacggtagagaagaagaagaaggtcggtataagcgactccttggacgaagagaaaatttcacacttcacgcaacagtcgcaatcttatccttcataatcaccggaatactccctcctgtagtctactatttctcattcagtgaaaaacacaacaaagactacaaagttgcttcagttttcggggcatctctattctgcatcgtcttgctcgccatagccaaagctcatgtgaggtacccgagaggcagctacctgaagagcattctgtactacgggtcaattgctgtatcggtgtcggggatttcttatgtggttggtaactttctggaacagttgcttgagaagcatggatggtctgatggatcggaaacacctgtgggacagatgatgctttcatcacttatgggaagaaaagccggctttggatactcatcatcgtactga

SEQ ID NO: 2641 - DNA, 405 bp, Arabidopsis thaliana
atggtggaagacacaaagacacaaatggcagcagcgatatcagcgactttggtattcgctgcaagacgacgtccattgttctgtagcttatcatcatcgtcttcttcgaaaccaaacacgagaaagcttgttctatactccaaacctggttgttgcctctgcgatggtcttaaagagaagcttcacgctgccttcactctctccaccggtcctgattcactcaacgacgttactcttcaggtaagagatataactacgaatcccgagtgggaacgagcgtatcagtatgagataccagtgttggctaaagagaattctgatgggaaagaggaagttttaccgaggttatctccacgtttaagtgcagaactcattcagaagaagctacttgctgcctttagttga

SEQ ID NO: 2642 - DNA, 4095 bp, Arabidopsis thaliana
atggagcagaacgagttcatggaggcaataatgtacgttaatggtgttcgtagagttttgcctgatggattagctcacatgacgcttctcgaatatctcagaggattgaccgggacaaagctcggatgcggcgaaggtggttgtgggtcttgcaccgtgatggtgtctagttatgaccgagagtcaaagacatgtgtgccttcttatactgttcataccggaaacttttattgcaggcattatgctgtcaacgcttgcctagcacctctctactctgtagaagggatgcatgtaatatccattgaaggagttggtcatcggaaacttggcttgcaccctcttcaggagtcattggcatcttcgcatggttctcaatgtgggttttgtactcccggttttgtcatgtcgatgtatgccttgttgaggtcaagtaaaaactcaccttctgaggaggagattgaagaatgccttgcaggaaatttgtgtcgttgtactggttatagacccatcattgatgcgtttcgggtttttgcaaaatctgatgatgctctatacagtggtttatcttcacttagccttcaggacggttcaaatatttgtccatctactggcaaaccttgttcttgtggatcaaaaacaacaagtgaagcagctacttgtaatgaagatagatttcagtcaatctcttatagtgatatagatggagctaagtatacagataaggagcttatttttccccctgaacttctgctgaggaagttagctcccttaaagttagggggaaatgaggggattacctggtatagacccgtaagtcttcagaacttgcttgaactcaaagcaaattttcctgatgcaaaactactggttggtaacacggaggtgggaatcgaaatgagactaaagaggttacagtatccggtgctaatctctgctgctcaagtcccagaactcaacgcattgaatgtcaatgacaatgggatagaggttggttcagctttgagactttctgaactcctgaggttattcaggaaggtagtaaaggagcgtcctgcacatgaaacatcagcatgcaaggcttttatcgaacagctgaagtggtttgctgggacacaaataagaaatgttgcttgcattggtggaaacatctgtacagctagtccaatatctgatttaaatcctctttggatggcttcaagagcagagtttcggataatcaactgcaatggagatgttagatctatacctgcaaaagatttcttccttggctatcgtaaagtggatatgggaagcaacgagatcttgttgtcggtattccttccatggacaaggcctttagagtatgtgaaagaatttaagcaggcccatcgcagggatgatgatatagctattgtcaatggtggaatgcgtgtgtttcttgaagagaaagggcaacaattgtttgtttctgatgcatctattgtttatggtggtgtggctcctctttcgttgcgtgcaagaaacactgaggaacttctaattggtaagaattggaataaatgtcttctgcaagacgcacttaaggtcatacagagtgatgtcttgattaaggaaggtgctcctgggggaatggtggagtttcgcaaatctctaaccctaagcttcttctttaaatttttcttatgggttactcatcatgtaaataatgtaaatcccactatagagacctttccaccctcgcatatgtcagctgtgcaacttgttcctcggttctctagaattggaaaacaagactatgagacagtaaaacagggtacatctgttggcttgccagaggtccatctttcggcaagaatgcaggtcacaggggaagcagaatatactgatgataccccattgccgccttgtaccttgcatgctgctttagtgctaagtaaagttccacatgcccgcatcctttcagttgatgattcggcagccaaatcttcatctggttttgttggtctgtttcttgccaaagatgttcccgggaataatatgattggaccaattgttgccgacgaagaattatttgctacagacgtggtcacgtgtgtgggacaagtcattggtgtgcttgtcgcggatacacatgaaaatgcaaaaactgcagcaagaaaagttgacgttaggtatcaggaactgccagcaatattatcaatcaaggaggcgattaatgctaaaagtttccatccgaacacagagagaaggcttagaaaaggggatgtcgagctgtgctttcaatctggtcagtgtgacagaataatagagggagaggttcaaatgggtggtcaggaacacttttacttggagcctaatggtagtttggtttggactatagatggaggcaacgaagttcatatgatttcatccacacaagctcctcaacagcaccagaaatatgtgtctcatgttcttggtcttccaatgtctaaagtggtatgcaaaaccaaacgacttggtggtggctttggtggtaaggaaacaagatcagctttcattgctgcagcagcttctgttccttcctacctattgaatcgacccgtgaaactcatactggacagagatgtggacatgatgattactggtcatcgccatagtttcgttggaaagtacaaggttggatttacgaacgaagggaaaatattggcgttggaccttgaaatctacaacaatggtggaaactctatggatctctctctttctaatcttgaacgtgccatgtttcactcggataacgtttatgagatcccacatgtgaggatcgttgggaacgtttgctttactaattttcccagcaacaccgctttccgagggtttggagggccccaaggtatgcttataactgaaaattggattcagagaattgcagctgagctggataaaatccctgaagaaatcaaagagatgaactttcaagtggaaggatcgatcacacattactttcagtcacttcagcactgcacattgcaccaactctggaaagaactgaaagtatccagcaacttcctaaagactcgtagagaagcggacgagtttaatagtcataatcggtggaaaaagcgtggtgtagctatggttcccacaaaatttggcatatcctttaccacaaagttcatgaatcaggccggtgctcttgttcacgtttacaccgatgggactgttttggtgacacatggaggtgttgagatgggccaagggttgcatacaaaggttgctcaagttgctgcaacggcctttaacattctccttagttcggtttttgtgtcagaaacaagcaccgacaaggttcctaatgcgtcacctactgctgcttctgcgagttctgatatgtatggtgctgcagttttagacgcttgtgagcagattatagcaagaatggagcctgttgcatctaaacacaatttcaacacattctctgagctagcaagtgcctgctactttcaacgtatagacctatcagctcacggttttcacattgttccagaacttgaatttgattgggtatctggaaaagggaacgcatatagatattacacatatggagctgcctttgctgaagttgagatagatacattgactggtgattttcacacaagaaaagcagacataatgttggatctcggatattctcttaacccaaccattgatattggacaaatagaaggagcgtttgtacaaggactaggttgggtagctctagaagaactcaagtggggagatgcagctcataaatggattaaaccaggaagtttactcacttgcggacccggaagctacaaaataccttccatcaacgacatgccgttccaactgaatgtttctcttctcaagggtaatccaaatgcaaaggcaatacattcatctaaagcagtgggtgagccaccgttctttcttgcagcatcagccttctttgcaataaaggaagcaatcaaagcggctagaagcgaggtaggtctcaccaactggttccctctggagactccagccactccagagcgtatcaggatggcttgtttcgacgagttttcagctccttttgcaaattcagatttctgcccaaagcttagtgtttga

SEQ ID NO: 2643 - DNA, 4080 bp, Arabidopsis thaliana
atgggttcactgaaaaaggacggcgagatcggagatgagtttacggaggcgttactgtacgttaacggcgttcgtagagtcttgcctgatggattggctcatatgacacttctcgaatatctcagaggattgaccggtacaaagctgggatgcggcgaaggtggttgtggggcttgcacggtgatggtgtctagttatgacaggaagtcaaagacctctgtgcattatgctgtcaacgcttgcctagcacctctctattctgtagaagggatgcatgtaatatccattgagggacttgggcatcgcaaacttggcttgcaccctgtccaggagtctttggcatcttcccatggttcccaatgtgggttttgtactcccgggtttatcatgtccatgtattcgttgttgaggtcaagtaaaaactcaccttctgaggaggagattgaagaatgtcttgcaggaaatctatgtcgttgtactggttatcgacccattgttgatgcgtttcgggtttttgcaaaatctgatgatgctctctactgtggtgtatcttcacttagccttcaagatggttctactatttgcccatctactggcaaaccttgctcttgtggatcaaaaacaacaaatgaagttgccagttgtaatgaagatagatttcagtcaatctcttatagtgatatagatggagctaagtatacagataaggagcttattttcccccctgaacttttgctgaggaagttaactcccttaaagttaaggggaaatggggggattacctggtatagacccgtatgtcttcagaacttgcttgagctcaaagcaaattatcctgatgcaaaactactggtaggtaatacagaggtgggaatcgaaatgagattgaagaggttacagtatcaggtgctgatctctgttgctcaagtcccagaactcaacgcattgaatgtcaatgacaatgggatagaggttggttcagctttgagactttctgaactcctgaggttattcaggaagatagtaaaggagcgtcctgcacatgaaacatcagcatgcaaggcttttatcgaacagctgaagtggtttgctgggacacaaataagaaatgttgcttgcattggtggaaacatctgtacagctagtccaatatctgatttaaatcctctttggatggcttcaagagcagagtttcggataaccaactgcaatggagatgttaggtctatacctgcaaaagatttcttcctcggttatcgtaaagtggatatggggagcaacgagatcttgttgtcggtattccttccatggacaagacccttagagtatgtgaaagaatttaagcaggcccatcgcagggatgatgatatagctattgtcaatggtggaatgcgtgtgtttcttgaagacaagggtcaacaattgttcgtttctgatgcatccattgcttatggaggtgtggctcctctttctttgtgtgcgagaaagactgaagagtttctaattggaaagaattggaataaagatcttctgcaggatgcgcttaaggtcatacagagcgatgtcgtgattaaggaagatgctcctgggggaatggtggagtttcggaaatctctaaccctaagcttcttctttaaatttttcttatgggtttctcataatgtcaataatgcaaattctgcgatagagaccttcccaccctcccatatgtcagctgtgcaacctgttcctcggttatctagaattggaaaacaagactatgagacagtaaagcagggaacatctgttggctcgtcggaggtgcatctttcagcgagaatgcaggtcacaggggaagcggaatatactgatgatactccagtacctcctaataccttacatgctgcctttgtgctaagcaaagtgccacatgcccgcatcctttcaatcgatgattcggcagccaaatcttcatctggttttgttggtctgtttcttgccaaagatattcctggggataatatgattggaccaattgttcccgacgaagaattatttgctacagatgtggtcacgtgtgtgggacaagtcattggtgtggtcgtcgcggatacacatgaaaatgcaaaaactgcagcaggaaaagttgacgttaggtatgaggaactaccagcaatattatcaatcaaggaggctattaatgctaaaagtttccatccgaacacagagaaaaggctaagaaaaggggatgtcgagctgtgttttcaatctggtcagtgtgacagggtaatagagggagaggttcaaatgggtggtcaggaacacttctacttggagcctaatggtagtttggtttggacagtagatgggggcagcgaagttcatatgatttcatccacacaggctcctcaaaagcaccagaaatatgtgtcgcatgttcttggtcttccgatgtctaaagtggtatgcaaaaccaaacgaattggtggtggctttggtggtaaagaaacaagatcagctttcattgctgcggcagcttctgttccttcctacctattgaatcgacctgtgaaactcatactggaccgagatgtggacatgatgataactggtcatcgtcatagttttcttggaaagtacaaggttggatttacgaacgaaggaaaaatattggcgttggaccttgaaatttacaacaatggtggcaactctttggatctctccctttctgttcttgaacgtgccatgtttcactcggataacgtttatgagatcccgcatgtaaggattgttgggaatgtttgctttactaattttcctagcaacactgctttccgagggtttggaggcccccaaggtatgcttataactgaaaactggattcaaagaatcgcagctgagcttaataaaagccctgaagaaatcaaagagatgaactttcaagtggaaggatcagtcacccattactgtcagactcttcagcactgcacattgcatcagctctggaaagagctgaaagtatcgtgcaacttcttaaaggcccgcagagaagctgacgaatttaatagtcataatcggtggaaaaagcgtggtgtagctatggttcccacaaaatttggcatatcatttaccacaaagttcatgaatcaggccggagctcttgttcatgtttacactgacgggactgttttagtgactcatggtggtgtggagatgggtcaaggattgcatacaaaggtcgctcaagttgctgcatccgcctttaacattccacttagctcagttttcgtgtcagagacaagcactgacaaggttcctaatgcgtcaccaactgctgcttctgcgagctctgatatgtatggtgctgcagttttagacgcttgtgagcagattatagcaagaatggaacctgttgcatctaagcacaatttcaacacatttactgagctagtaagtgcctgctactttcaacggatagacctatcagctcatggttttcacatagttcctgatcttgggtttgactggatatctggaaaagggaacgcctttagatattacacatatggagctgcctttgcggaagttgagatagatacattgactggtgatttccacacaagagcagctgatataatgttggacctcggatattctcttaacccagccattgatgttggacaaatagaaggagcgtttgtacaaggactgggttgggtagctttagaagaactcaaatggggagatgcagctcataaatggattaaaccaggaagtttactcacttgcggacccggaaactacaaaataccttccatcaacgacatgccgttcaacctcaatgtttcgcttctcaaggggaatccgaatacaaaggcaatacattcatctaaagcagtgggtgagccaccattctttcttgcatcatcggttttctttgcgataaaggaagctattaaagcggctagaaccgaggtgggtctcacagactggttccctctagagagtccagccactccagagcgtatcaggatggcttgtttcgacgaattttcagctccttttgtaaattcagatttctaccctaatcttagtgtttga

SEQ ID NO: 2644 - DNA, 2466 bp, Arabidopsis thaliana
atgcgtattgttgcatgcttgctcttgataacagccttattctcaagctatggctatgcagctattaccacgtcaagtcctttgtcgataggggtaactttgagctctcctggtggatcatatgagcttggtttcttcagttctaacaactctgggaatcagtatgttggaatctggttcaagaaagtcactcctcgggttattgtttgggtggctaacagagaaaagccagtctctagtactatggcgaatctcacaatcagcagcaatggaagtcttatcttgcttgatagcaaaaaagatctggtgtggtcatctggaggagatcccacatctaacaagtgtcgtgctgagcttttagacaccggaaatcttgtcgtcgtagataatgttactggaaattatttgtggcaaagttttgagcatcttggtgatacaatgctacctcttacatctctcatgtacgatattcctaacaacaagaaacgtgtgctgacttcttggaagagtgagaccgatccatcgcctggggagtttgtagctgagattacaccacaagtaccctcgcaaggccttataaggaaaggctcgtcaccttattggagaagcggtccatgggcgggaacaaggttcactgggataccagaaatggatgcatcgtatgtgaatccattgggaatggtccaagatgaagtcaacggcacaggagttttcgctttttgtgttctgagaaatttcaatttgtcatacatcaagctaacgccagaaggatcattgaggattacacggaataatggaaccgactggatcaagcactttgagggtccgctaacctcgtgtgatctatatggtagatgtggaccttttggcttgtgtgtgagatccggtactccaatgtgccaatgcttaaaagggttcgaaccaaaatcagatgaggagtggagaagtgggaattggagtcgtggatgtgtgagacgcacaaacttatcttgtcaaggaaactcttctgtagaaacgcagggcaaggacagagacgtattctatcatgtatccaacataaagcctccagattcatacgaattagcaagctttagcaatgaagaacaatgccaccaaggctgtctcaggaactgttcttgcacagccttttcctatgtcagtggaataggatgtttggtgtggaaccaggagctgttggacacagtgaaatttattggcggaggagagactctttcccttcgtcttgcacattctgaattgactggaagaaagcgaatcaagattatcactgttgccactctcagcctttctgtttgcttgattttggtgcttgttgcatgtgggtgctggagatacagagtaaaacaaaatggttcaagtcttgtatccaaagacaatgtagaaggcgcttggaagagtgatttacaatcacaagatgtctcaggtttaaatttctttgagattcatgacctacaaaccgccacgaataatttcagcgtgttaaataaactcggtcagggtggatttggtacggtttataaggggaagcttcaggacggaaaggaaatagctgtaaaacgtcttactagcagctctgtacagggcacagaggagttcatgaacgagataaaactcatctcgaaattacaacacagaaacttgcttcggcttttgggatgctgcatcgatggagaagagaagctattggtctatgaatatatggtgaacaaaagccttgatatctttatatttgatttgaagaaaaagcttgagattgattgggctacgagattcaatatcattcaaggaatcgctcgtggacttctctatctccatcgtgactcattcctcagagttgtacaccgcgatctgaaggtcagcaatattctcttggatgagaaaatgaacccaaaaatatcggattttggattggctcggctgtttcatggaaatcaacatcaagacagcactggtagtgttgtaggcactctaggatacatgtctcccgagtatgcttggactggtacgttctctgaaaaatccgacatttacagcttcggagttctgatgctcgaaatcatcactggcaaggagatttcaagtttcagctatggcaaagataacaaaaaccttctttcatatgcatgggactcgtggagcgaaaacgggggagtgaatctactggaccaagatcttgatgattctgattcagttaattcagttgaagcaggaagatgtgttcatattggtctgctctgtgttcagcatcaagctattgatagaccaaacatcaaacaagttatgtcaatgctgacttcaacaacggatcttcctaagccaacacaaccaatgtttgtattggagacaagtgatgaggattcttctctgtctcactctcaacgctccaatgatctctcctctgttgatgaaaacaaatcttctgaagagctaaatgcttcctcatga

SEQ ID NO: 2645 - DNA, 384 bp, Arabidopsis thaliana
atggagtcttaccaaaaccagtccggagcgcagcagactcaccaacagcttgaccaatttggaaatccatttccagccaccaccggagcctatggaactgccggtggagctccagccgtggctgaaggtggtggtttaagtggcatgcttcaccgttctgggagtagctctagctctagctcggatgatggactaggtggaaggaggaggaagaagaagggaataacggagaagattaaagagaagctgccgggtcatcacgactccaacaagacttcttctttaggttctacaacgacggcctatgataccggcaccgttcaccacgagaagaaaggcatgatggagaagatcaaagagaagcttccgggtggtcatcattag

SEQ ID NO: 2646 - DNA, 321 bp, Arabidopsis thaliana
atggagcctacgaacactagctattcgatcaccactcatacgccgaacgttcaattaactcaaaatcatcaatcgttccaactaatctaccgaagtactcggctaagaagaaagaagacggacgaatccgagccaaagccgtacaagcgcgagataccttcgggacagcctaggcggatccatgctttccaacgaagcacgcccatccaacctaggcgagacaagggttcacatttcgttcatcacccttggccggctttcgaacagccggactcccatcaaaagatggttgccaagaacatcttcgttacggtttgctaa

SEQ ID NO: 2647 - DNA, 1527 bp, Arabidopsis thaliana
atgggttcggcgaacaacgagtacgagtttctgagtgagattgggctgacttctcacaacttgggatcttacgttgctggcaaatggcaagccaacggacctcttgtttcaactctcaatcctgctaacaatcagccaattgctcaagttgtggaagcttctctagaggattacgagcaaggtttgaaagcttgcgaggaagcagctaaaatatggatgcaggttacggctcctaagagaggtgatatcgtcagacagattggggatgcactaagatccaaacttgactatcttggtcgtcttctttctcttgaaatgggaaagatccttgctgaaggtattggagaagttcaggaagtaattgacatgtgtgattttgctgttggtttgagccgacaactcaatggatcggttataccttcagaacgccctaaccacatgatgttggagatgtggaatcctcttggcattgttggtgttatcacagcgtttaattttccctgtgcagttcttggttggaatgcttgtattgctcttgtctgtggaaactgtgtagtctggaaaggtgctccaactacaccgttaataactatcgcaatgaccaagctagtagctgaagttttagagaaaaacaacttacccggtgccatttttacggccatgtgtggtggtgctgaaattggtgaagcaatagccaaagacacacgcattcccttagtatcctttactggaagctccagggtgggctcaatggtacaacaaacagtgaatgcgagatctgggaaaactttgcttgagttgagtggaaacaatgcaatcatagtcatggacgatgctgatatacagttagcggctcgatctgttctattcgctgcggttggaactgctggtcaacgttgcacaacttgccgtaggctgcttttgcatgagagtgtctatgacaaagtactcgagcaactgcttacctcatacaaacaagtcaaaatcggcaatcctcttgagaaagggacattgttaggaccattacatactcctgaatcaaaaaagaactttgagaaaggaattgaagtcatcaaatcccagggtggtaaaatactaacgggaggtaaagcagtcgaaggtgaaggaaactttgtggagcctacgataatcgagatatcagcagatgctgctgtcgtcaaagaagagctatttgctccggttctatatgttctaaagtttaagtcatttggagaggctgttgcgataaacaactcggttcctcaaggtctaagcagctcgatattcactcggaaccctgaaaacatcttcaggtggatcggaccactgggaagtgactgtggcattgtgaatgtgaacataccgacgaatggagctgagattggtggagcttttggaggcgagaaagcgactggtggtggtcgtgaagctggaagcgactcatggaaacagtacatgcgtcgatcgacttgtaccatcaactatggaaacgagttacctctagcgcaaggaattaacttcggttag

SEQ ID NO: 2648 - DNA, 654 bp, Arabidopsis thaliana
atggcgagcattagcaacgagcccgagcgtgagaacagagacgaagaagagactggagccaacgaagatgaagacaccggtgctcaggttgctcctatcgtcaggcttgaagaagtcgccgtcaccaccggtgaagaagacgaagacaccatcctcgatctgaaatcgaagttgtatcgatttgataaagatggaagtcagtggaaggagagaggtgctggtactgttaagtttttgaaacatagagtttctgggaagattcgtctcgttatgaggcaatcgaaaactttgaagatctgtgctaatcatcttgttggatcgggtatgagtgttcaggaacacgctgggaatgataagtcttgtgtatggcacgctcgtgatttctccgatggtgaattgaaggatgagctcttctgtatccggtttgcttcagttgagaattgcaaagcatttatgcaaaagttcaaggaagtagctgaatctgaagaagagaaagaagagagcaaagatgcctctgataccgctggtcttcttgagaagttaacagtggaagagaaggaaagtgagaagaaaccagtggagaaggcagaggaaaacaaaaagagtgaagctgttgaagaaaagaaaacagaggagtctgttccctcagcttaa

SEQ ID NO: 2649 - DNA, 723 bp, Arabidopsis thaliana
atggaagctagaattgatgaaggtggggaggctcaacaattctatgggtccgtaggtaaaagaagtgtggagtgggatttgaatgattggaaatgggatggtgatctctttctcgccacccaaactactaggggacgtcagtttttccctctaggaaactcgtccaatagctcctcctcctgctctgatgaaggcaatgacaagaagaggagagctgttgccattcaaggagacactaatggtgctcttactttgaatcttaatggtgaaagtgatggcctttttcctgccaagaagaccaaatccggagccgtttgtcaggtcgaaaactgtgaagctgatcttagtaaagttaaggattatcatagacgccataaggtctgtgagatgcattccaaggctactagtgccactgtcggaggtatcttgcagcgcttttgtcagcaatgtagtaggttccatcttcttcaggagtttgatgaaggaaagagaagttgtcgtagacgtttggctggccataataaacgtcggaggaaaacaaatcccgaacctggcgctaacgggaatcctagtgatgatcactcaagcaactatctcttgattactctcttgaagatactctccaatatgcatagtatggtgttttactctgctcatctctatgttgtcttaaagtttgtatcagctgctaaatttctatccctttgcagaccataccggtga

SEQ ID NO: 2650 - DNA, 1881 bp, Arabidopsis thaliana
atggctgctcttacgcgtaacaagaagaagggttccaattcacagactccgccactgaataagcagactaaggcgtctccgctgaagaaggcggctaaaacccagaagcctccattgaagaagcagaggaaatgtatttcggagaagaagcccctcaaaaagcctgaagtttccacagacgaggaagaagaagaagaagagaatgaacagtctgatgaagggtctgaatcaggttctgatttgttctctgatggtgatgaagaaggaaacaatgatagtgatgatgatgatgatgatgatgatgatgatgatgatgatgatgaggatgcagaacccttagctgaagactttctcgatggtagcgataatgaggaggtaaccatgggttctgatttggattctgactctggtggatccaaactcgagaggaaatctagagctattgatagaaaacgtaaaaaggaggtacaagatgcagacgatgaattcaagatgaacattaaggagaaacctgatgagtttcagctaccaacccaaaaggaacttgaagaagaggcacgtcggccgccagatcttcctagcttgcaaatgaggataagagagattgttagaatcctgtcgaattttaaggacttgaagccaaaaggagacaagcacgagaggaatgattatgttggacagcttaaagctgatcttagttcttactacggctataatgagtttcttattggaactttaattgagatgtttcctgttgttgaactcatggaactaatcgaagcttttgaaaagaaaagacctacatctatacgtactaacactcttaagactcgaagacgggatctggctgatatacttttgaacagaggagttaatctagacccattaagcaagtggtcaaaagttggacttatcgtttatgattcacaagttccgattggtgcaactcctgaatatttggcaggattctatatgttgcaaagtgctagttcgttcttgccagtgatggcccttgctcctcgagaaaaagaacgagttgtggacatggctgctgcccctggtggtaaaacaacatatgttgctgcactaatgaaaaatacaggcataatatatgcaaacgagatgaaagtacctaggcttaagtcactttctgccaatctacatcgcatgggagtgacaaataccatagtttgtaactatgacggacgagaggttatatcaaaagacgaatcagttaaaacttccaaaagtgctgatgacataaagaaatttgcccatttgcaaaagcaacttatacttggtgcgattgatttggtagacgccaattccaaaaccggtggatatattgtttactcaacatgttcagttatgatacccgagaacgaagctgtcatcgattatgctctgaaaaacagggatgttaaactcgttccatgtggacttgattttggccgaccaggttttagagaacaccggttccacccttctttagagaagactagacgtttctatcctcacgtgcacaacatggatggattctttgttgcaaagctgaagaagatgagcaatgcaatgcagccttcaggaaatgatgagccagctgtaacaatggagcaagctcaggtgtcgtctagtgatgatgatgatgagaaagctgaggccattgaggagttggagaagccacctgttgccagtgggcaacccaagagagagagtaacactaaagaagacacgaacaaacgaaaaaatccaaggtcaaaggaaattcacaaaggcaaaaggaataaaaacacaaaaaccgaaagtggtaatgtggaagaacccaggaagcaaaagaagaagagatcacaatggaagaatgagattgctcaagctaggtaa

SEQ ID NO: 2651 - DNA, 3366 bp, Arabidopsis thaliana
atggcttcatcctcatcgagaactagaagcagtagacctccaagtcccgcttcttccacttcttcttctcatctcagcaaccgtctcattcctcgttctaactctacctctgcttcctcattgattacctccgccgccggaatcgcctcccgatctatgacgcctagtcgcaccttctccgactcgggccttatcggctccggcagctttggaattggatcgcctgttccctacccgtcagaggagcttctcggtgaccctatggacgatactattagctctgagcgggatagtatctccgtcaccgttcgttttcgtccgttgaggtatgctagatctgatctcgccatggaccagatctattgcagagattacagttttcatgtagatgcaattggagtcaattctttattgggagagtatcaaagaggagatgaagttgcttggtaccctgatggtgatacattggttaggcacgagtataacccactcacagcttacgcatttgataaagtttttggaccacaggcaactactattgacgtttatgatgtagctgcgagaccagtagtcaaggcagcaatggaaggtgttaacggaaccgtttttgcttacggtgttactagcagtggaaagacacatacaatgcatgtaagggttttaaaaaagaagaatccttatacgcctttctctctagtttttcttcaaaacacatgtgctatgaattgggatctcttcttcaacttggtccccctttggtatctgctgggtgatcaagaatctcctgggatcataccgctagcaataaaagacgtgttcagtatcatccaggatgtaagtggtcttaacgggactccaggaagggagttcctgctccgtgtttcatatcttgaaatatacaatgaggtgataaatgatttactggatccaacaggccaaaacttacgtgttagagaggattcccagggcacttatgttgagggtatcaaggaagaagttgttttgtctcctggccatgcactatcattcattgcagctggggaagaacatcgtcatgttggttcaaataatttcaatttgttgagcagcagaagtcacactatatttacactgatggttgaaagtagtgctactggagatgaatatgatggagttatcttttctcaactcaatttgattgacttagctggatctgagagttcgaaaactgaaacaactggattgaggaggaaggagggttcatacatcaacaagagtcttctaactcttggaactgtgattggaaaacttagtgagggtaaggcaactcacattccatatcgtgactctaagctaactcgtcttctgcaatcttcattaagtggtcatggacatgtgtcgctcatatgtacaattactcctgcgtccagcagtagtgaggaaactcataacacattgaagtttgccagcagggcaaagagtatagaaatatatgcttcacgcaatcagattatagatgagaagtcattaattaagaaatatcaaagagaaatctcaaccctcaaactagaacttgatcagcttagaaggggtatgcttgttggtgtcagtcatgaagagttaatgagcttaaagcaacagttagaagaagggcaagtgaaaatgcaatcaagattggaggaagaagaagaagccaaagcagctctaatgagcagaatccaaaagcttaccaagctcatactagtctctaccaagaattctattcctggatattcgggtgacatacctactcatcagcgcagtctctctgcgggtaaagatgataaattcgattctctactgttggaaagtgataatctgggatctccatcttcgaccttagctcttctatcagaaggttctttaggttttaaccacaggcgatcttctagcaagttgaatgacgaaaactcgccgggtgcagaatttactcaaggtgtcatgacgccggacgaaatcgaccttctggttgaacaagttaagatgcttgctggtgagatagctttcagtacgagcacactaaagcgtttggtggatcagtccgtaaatgatccggaaaactcacaaactcagaatctggaacgcgagattcacgaaaagcaaaggcaaatgagaggcttggaacagctcataattgagagtggtgaagcttccattgccaacgcatcattagttgagatgcaacagaaagttatgagtctgatgacccagtgcaatgagaagagctttgagctggagatcaaatcagctgataattgcattctccaagaacaactacaggaaaagtgtaccgagaacaaagaactacatgaaaaggtgaatcttctagagcaacgcttgaatgcagtatctagtgagaaatcctctccatcttgttccaataaagcggtatctggagagtatgcagacgaactaaaaaagaaaatacaatcgcaggaaattgagaacgaagagttgaagctagaacacgtgcaaatcgtggaagagaacagtgggttacgagtacaaaatcaaaaactagctgaagaagcttcatatgctaaggagttagcctctgcggctgctgttgagctgaaaaatcttgctagcgaagtaacaaaactctcactacaaaacacaaagctagaaaaagaattagcagctgcaagagacttggctcaaacgcgtaaccccatgaacggagttaatcgcaagtataacgatggggcaaggtcaggaagaaagggaaggatttcctcaagtaggtcaagtggagatgagtttgacgcatggaatctagacccagaagatcttaaaatggagttgcaagtaaggaaacaacgagaagtggctcttgagtctgcattggcagagaaagagtttatagaagatgaatacaggaaaaaagcagaagaggcaaagcgaagagaggaagctttagaaaacgatttggcaaacatgtgggtacttgttgccaagttgaagaaagacaatggtgcattgcctgaacccaatggcactgaccctggaagagaattagagaagagtcaaagccatgcggttctgaaagagagacaagtctcgagtgcaccgagacaacctgaagtagtagtagtagctaaaaccgaagagacaccaaaagaggaaccactcgttgctcgtctcaaggcacgaatgcaagaaatgaaagagaaagagatgaaatcgcaagcgaatggagacgcaaactctcacatttgtaaagtatgtttcgaatctcccactgcggcaattctactcccttgccgtcatttctgctgtaagtcacaacttcatctccatgaaacctcatgtctcttcttttatcaaagagttgtattaaaaagatga

SEQ ID NO: 2652 - DNA, 2139 bp, Arabidopsis thaliana
atgaaccaaaacaactccgtttgggttgtggctttcctctgtgaatcctttttctctttcatatggcttcttattaccagcataaaatggagtcctgcttcatataaatcatatcctgaaagacttgatgaaagggttcatgaccttccatcggtagatatgtttgtgactactgcggatcctgttcgggagccgccgattcttgtagcaaacacgttgctttcgctgttagcagtgaattatccagcgaataaacttgcttgttatgtatcggatgatggatgctcacctctcacttacttctctctcaaggaagcttctaagttcgccaagatttgggttcccttctgcaaaaaatataacattaaagttagagctccttttagatattttttgaaccctccagccgcaacagaaagttctgaattcagtaaagactgggaaataaccaagagggagtacgagaaattaagcaggagggtggaagatgccactggagattcccattggttggatgcagaagatgactttgaagatttctcgaatacaaaaccaaatgatcattcaactatagtaaaggtggtatgggagaacaagggaggtgtcggagtcgagaacgaggttcctcattttgtatacatttcaagagagaaaagaccaaattatcttcatcattacaaagctggagccatgaactttctggtaagagtgtcagggttgatgacaaatgcaccatacatgttgaacgtagactgtgacatgtatgctaatgaagcagatgtggtgcgccaagcaatgtgtatatttctacaaaaatcaatgaattcaaaccattgtgcttttgttcaattccctcaagagttctatgattctaacgccgacgaactcaccgtcttacaatcatatttgggacgaggaattgcgggaatccaaggacctacatatgcaggttcaggatgcttccacactagaagagttatgtacggtctatcaatagatgatttagaagatgatggaagtctttcttcacttgcaacaaggaagtatttggctgaagagaatttagctagagaatttgggaactctaacgagatggtgacatcggtggtcgaggcattacaaagaaaaccaaatccgcaaaatacccttgcaaactccctcgaagcggctcaagaagtgggacattgtcattttgagtaccaaactagctggggcaaaactattggttggttatacgaatcaacagcggaagatgcaaacacgagtatcggaatccattcgagagggtggactagctcatatatatctccgaaaccaccagcgtttcttggggctatgccaccgggaggtccggaagcgatgctccagcagcggcgatgggccacaggactgctcgaagtccttttcaacaaacaaagtccgttgatcggaatgttttgtaggaaaataagatttcgacaaagcttggcttatttatacattttcacttggggtctaaggtcaatccctgagcttatttattgtctcttgcctgcttattgcctactccacaacgctgccttatttcccaagggagtttatttaggtatagtcgtcacacttgtgggaatgcattgtctttactctctatgggaatttatgagccttggtttctcagtacaatcgtggtttgcctcccaatcattttggaggataaaaaccacttgcagttggttatttagcatccctgatatcatactcaagctacttggaatctcgaaaactgttttcatagtcactaaaaagactatgcccaagacaatgtcaggatctggatccgaaaaatctcaacgagaagttgattgtccaaaccaagattccggtaaatttgaatttgatggctcgctttatttcttgcctggcacatttatccttttagtgaatctagccgctctagccggttgttcggtgggtctacaacgtcacagaggaggtggttcgggtttagcagaagcttgtggatgtattttggtggttatattgtttcttccatttctaaagggtatgtttgagaagggaaaatatggtatcccatggtctactctttctaaagctgcctttttagcagttttatttgttgttttctctgtgggaaactag

SEQ ID NO: 2653 - DNA, 450 bp, Arabidopsis thaliana
atggcggatcagctcacagacgatcagatctcagaattcaaggaagccttcagcttattcgacaaggatggtgatggttgcattaccacaaaggagcttggtaccgtgatgcgttccctcggtcaaaacccaaccgaagctgagcttcaggacatgatcaacgaagttgatgcggatggtaacggaaccattgatttcccggagttcttgaacctaatggctaggaaaatgaaggacactgactctgaggaagaactcaaggaagctttcagagttttcgacaaagaccagaacggtttcatctcagctgctgaattgagacatgtgatgactaacctcggcgagaagcttactgatgaagaagttgatgagatgattaaggaagctgatgttgatggtgatggtcagatcaactacgaagagtttgtgaaggttatgatggctaagtga

SEQ ID NO: 2654 - DNA, 963 bp, Arabidopsis thaliana
atgagacctcctctaactggaagtggtggtgggttcagtggtggaagagggcgtggtggatacagtggtggtagaggtgacggtggattcagtggtggtcgaggtggcggtggtagaggaggaggaagaggtttcagcgaccgtggtggtcgcggcagaggaagaggaccaccacgtggtggtgctcgcggcggcagaggaccagctggccgtggaggcatgaaaggaggaagcaaagtgattgtggaacctcacagacacgcaggagtgttcattgcaaagggtaaagaagatgcccttgttaccaagaatttggttcctggtgaagctgtctacaacgagaagagaatctctgttcagaacgaagatggaaccaagactgaatacagagtttggaatcctttccgttcgaagttggctgctgctattcttggtggtgttgataacatctggattaaacctggtgctaaagttctataccttggtgctgcttctggaaccacagtctctcatgtgtctgatcttgttggccctgaggggtgtgtgtacgcggttgagttttctcatagaagtggtagagatttggtgaacatggcaaagaagagaaccaatgttattccaatcatcgaggatgctagacacccagctaaatacagaatgcttgtaggcatggttgatgttatcttctctgatgttgctcagccagatcaggctaggatcttggctttgaatgcatcatacttcctcaagtcaggaggacactttgtgatctcaataaaggcaaactgtatcgactccaccgttccagcagaagctgtgttccagactgaagtgaagaagcttcaacaggagcaattcaaaccagctgagcaagtgacgcttgagccatttgagcgtgaccatgcatgtgtcgttggtggctaccgtatgcctaagaagccaaaggctgctactgctgcttag

SEQ ID NO: 2655 - DNA, 1767 bp, Arabidopsis thaliana
atggagattgctccatctacaagtagattcaagctctacgatcaattcgagcttctggagtttcctgacaagtacgtcgtcaaacccatcgaatcgcctgaggaaggcttctccgtcaatcggcgcgatggcaatatcaaacctcttgatgaaaacgcatcttctgggagtcctactagagtctctactatctatggcgtaggaggaactattaggctcttagcaggaacatacttgctagttataacgtctcgggaggaagttggaaattttctcggtttaccgatttttagagttacggctatgaaattcttaccttgcaatgaggctttgaggtttgctactgctcaagaaaaaaaggacgaaacatattttaggactctgttacaagcacttgagacaacccctggattgtatttttcgtatgaaacagatctaacattgaatcttcaaagaaggtgcaagctagctgaaggttggaatcgtaagcctatgtggaagcaggctgaccctcgatatgtttggaactggcatcttttggaggacttaattgaatgcaaactggatggttttattattcctatacttcaaggaagttaccaagttgctgagctaaagctcaagaattctcctgctgtggtatcgataatgtccaggcgctgtacacgacgtctaggtacacgtatgtggagaagaggagccaatcttgaaggggacgctgctaattttgtcgaatctgaacaaatagtggagattaatggtttcaagttctcattattgcaggttcgaggttcaatcccacttctttgggagcagatcgttgatttgagttataagccacggcttaagataaataagcatgaagagacgccaaaagttgtacagcgccatttccatgatctttgccaaagatatggagaaattatggcagttgacctaacagatcagcatggagatgaaggtgcattaagcaaagcatatgccaccgagatggagaagcttcctgatgtgagatatgtctcctttgacttccatcaagtctgtggaactacaaacttcgacaacctgggggtactgtatgagcagattggggatgaatttgaaaagcaaggatatttccttgtagacgcagacgagaacatcctagaagagcagaaaggagttatcagatctaactgcatcgactgtcttgaccgcacaaatgttacccagagtttcatgggccaaaaaagtctgaatctacaacttcaaaggatcggagtgtgcgattccacagagtgtatatccacgttcgaagatgattacacaaagttcagaacaatttgggctgagcaaggggacgaggttagtttgcaatatgccgggacatatgctcttaagggcgacctcgtaaggtacgggaaacagactatgactggagctatcaaagatggcctcagtgcaatgtcgagatattatctgaataatttccaagatggtgtaaggcaggatgctttggacctcataagtggtcgctacacagtgggcacacacagcccttcacaactccagcccattggatcacaaccgtcttttctgccggtagcatcagcattgttgataggtggtgtaacagtgacatctttcacaattcatcaagcgggaagaaacacgcagcagtatctggcgtcggctttgtgggctggagtgactgcaggagttgtggcgatgatcaaagccaatggaaggcacttgacttcaaggcctcgtctttgccatctaatttga

SEQ ID NO: 2656 - DNA, 1074 bp, Arabidopsis thaliana
atgtatgtgtgtgagtataaatataagttggttcttgaacatcattgcatgttgattaatcacacagcacaaataagagttagaaaaatgggagtgtacttaggtaagtattgttatataatgataataatgttagtgttggtgttgggaaaagaagtgagaagccagttgttaaaaaatggttattattcaacttcatgtccaaaagctgagtcgatagttagatccactgttgaatctcactttgattctgatcccacaatttcccctggcttgcttaggcttcatttccatgactgttttgttcagggttgtgatggttcggttttaatcaaagggaaatctgcggagcaagctgctctaccaaatcttggtctaagaggtttagaagtgatcgatgatgctaaagcccggcttgaggcggtgtgtccaggagttgtgtcatgtgcagatatacttgcacttgctgctcgtgactctgttgacttgagtgatgggccaagctggcgagtaccaacgggtcgtaaagacgggagaatctcgttggcaactgaagcatcgaatctaccttctccacttgactctgttgctgttcaaaagcaaaagtttcaagataaaggattggatactcatgatctagttactctactaggtgcacatacaattggacaaaccgactgtctcttcttccgttaccgtttatacaacttcacggtgaccggaaactccgatccaaccataagcccatcgtttcttacacagctcaagactctttgtcctcccaatggagacggttcgaaacgtgttgctcttgacattggtagcccctcaaaattcgatgaaagtttcttcaagaacttacgcgacggaaacgctattctagagtcggaccaacggctttggtcggacgccgagacaaatgccgtggtgaagaagtatgcgagtcgtcttagaggtttgttagggtttaggtttgattatgagtttggtaaagctatgattaagatgagttccattgatgtaaagactgacgttgatggcgaggttaggaaagtttgttccaaggtgaactag

SEQ ID NO: 2657 - DNA, 1539 bp, Arabidopsis thaliana
atggatggatcaggcacaggcagtagaagtggggtagaatcgattctaccaaattacaagcttgggagaactcttggtattggttcctttggtagggtgaagatagctgagcatgcattgacaggacataaggttgctatcaagatcctcaatcgtcgcaaaatcaagaacatggagatggaggagaaagtgaggagagagatcaaaatcttgagactatttatgcatcctcacatcatccgtctctatgaggttatagagactcccacagatatttatcttgtcatggagtatgtgaactctggtgagctatttgactatattgttgagaagggtagattgcaggaggatgaggcgaggaacttttttcagcagataatatcaggagtggaatactgccatcgaaacatggtggttcacagagacctcaagcctgaaaacttgcttttggactctaaatgcaatgtaaagattgctgattttggcctgagcaacataatgcgagatggtcattttttgaagacaagttgtggaagtccaaattatgccgctccagaggtaatttcgggcaagttatatgctggccctgaagtagatgtctggagctgtggtgtgatactctacgctcttctctgtgggacgcttccatttgatgatgaaaacattcccaacctttttaagaagataaagggagggatatacacattacctagccatttatctcctggtgctagagatttgatcccccggatgcttgtagttgaccccatgaaacgagtaaccatccctgagatccggcaacacccttggttccaagctcatcttccgaggtatttagctgttcctcctccagatactgtgcaacaggcaaaaaagattgacgaggagattctccaagaagttatcaatatgggatttgacagaaaccacctcatcgaatcgctccgcaaccgaacccagaatgatggcactgtgacgtactatctgatactggacaatcgtttccgtgcctctagtggttatctcggggctgagtttcaagagaccatggaaggtactccccgtatgcatccagcagaaagcgttgcttcacctgttagccatcggcttccaggactgatggaatatcaaggagttggcttgagatctcaataccctgttgagagaaaatgggctcttggacttcagtctcgggctcatccccgtgaaataatgacggaagtcctgaaagccctgcaagatttgaatgtatgttggaagaagatagggcactacaacatgaagtgcagatgggttcctaacagcagcgcagatggtatgctcagtaactcgatgcacgataacaactactttggagacgagtccagcataatagagaacgaagcagctgttaagtcgcccaatgttgtcaagtttgaaattcagttgtataaaactcgggacgacaagtatctactggatttgcagagagtacaaggtcctcagttcttgttcttggatctgtgtgctgcttttcttgctcagctccgagtcctctga

SEQ ID NO: 2658 - DNA, 705 bp, Arabidopsis thaliana
atgggagagaaagaggaagtgaaactattaggagtatggtacagtccatacgccataagacctaagatcgctcttcgtctcaaatcagtggattatgattacgttgaggaaaatctgtttggatccaagagtgagcttcttctcaaatcaaacccggttcacaagaaagtccctgttctcctccacaacaacaaaccgattgtcgagtctctcaacatcgttgaatacattgatgagacgtggaactcatctgcaccgtccattcttccttcacatccttatgatcgtgctcttgctcgcttttggtctgacttcgttgataacaagtggtttccggcgttgagaatggcggcgatcactaaatcggaagacgcaaaagcgaaagccatggaagaagtggaagaagggttgttgcaactcgaggatgcgtttgtttctataagcaaagggaaaccctttttcggcggtgaagcaatcgggtttatggatatttgctttggaagctttgtggttctcttgaaagctagagaaaagtttaaagcagaaaagcttttagacgaatcaaaaactccttctctttgtaaatgggccgaccggttcttgtccgatgaaacggtgaagaatgtggcaccggagatcgaaaaagtagctgagtttctacaagaacttgaggttagagctcaatccgcagcttcaagatcttga

SEQ ID NO: 2659 - DNA, 81 bp, Arabidopsis thaliana
atggttgtaaccttacttcttgtaacaaaggcagtttatttcccagctttagtttctaacagtaaatgctgtagaaattga

SEQ ID NO: 2660 - DNA, 441 bp, Arabidopsis thaliana
atgggagatgtagttttgttcatagatgaaacatatttgaaatcgagttttaatcgctgtagaatctgtcacgaagaagaagctgagagctactttgaagctccttgttcttgttcaggaaccatcaagttcgctcacagagattgcatacaacgatggtgtgatgagaaaggaaacacaatttgtgaaatttgtctccagttttcggttattttgttgataaagcatgcatttgatgcggtttatggaactgaagagtatccctatacaatattcacggctataggcatactattaccaatgctcgttatcattcgaaccatcacagctattcaaaggagtctccgatatcaaattctcgaatcagaagaagatacattgagctctgaagaagaagatcatggtttggaggaggaagagcaacaacaacatatagcttga

SEQ ID NO: 2661 - DNA, 2184 bp, Arabidopsis thaliana
atggagactcatagaaagaactcggtcgtcggcaacatcctccacacgtgtcatccttgccggcgcaccattccatatagaatctacgccatatttcacacgtgtggcatcatagctctcatgtatcaccatgtacactcacttgtcacagcaaacaacactcttataacatgtcttcttctcctctccgatattgttctcgccttcatgtgggcaaccacaacttccctccgcttaaacccggttcatcggaccgagtgcccggagaaatatgcagctaaaccggaggactttccaaagctggacgtgtttatatgcacggctgatccgtacaaggagcctccaatgatggttgttaacaccgctttatcggtgatggcttacgagtatccgtcagataagatctcggtgtatgtatcggacgatggaggatcgtcgttgactttctttgctcttattgaagctgctaagttctctaagcagtggttgcccttttgcaagaagaataatgttcaagatcggtctcctgaagtttatttctcttcagagtcacattctcgaagtgatgaagctgaaaaccttaagacaaacatattaaaatgtgaggtggaacagatgatgtacgaagacatgaagagtagagtagaacatgtggtggagagtggaaaagttgaaactgcgtttatcacatgcgaccaatttcgtggggtattcgatttgtggaccgacaaattcagtcgtcatgaccatcccacaattattcagctacgagtatcaggggtgatgacaaattcaccgatcattctaacactagactgtgatatgtattcgaacgacccggcaacactggttcgtgctttgtgctatttaacagatcctgaaatcaaatccggtttaggatatgtgcagtttcctcagaaatttctaggaataagcaaaaatgatatatatgcttgtgaaaacaaacgcctcttcattattaatatggttgggtttgatggtctaatgggtccaactcatgtgggaactggttgtttctttaatcgacgagctttctatggacctccatatatgttgattttaccggagataaatgaactaaagccttatcggattgcggataagtctatcaaagcccaagatgttttgtcattagcacacaatgtagcaggatgtatctatgagtacaataccaattggggatccaagattggattcagatatgggtcattagtagaagactactacacagggtttatgctccattgtgaaggatggagatcagtattttgcaacccaaaaaaagctgcattttatggagattccccaaagtgcctagttgatcttgtgggtcaacaaatccgttgggcagttgggcttttcgaaatgtccttttcaaagtatagcccaattacctatggaatcaagtcactggaccttttaatgggtttaggttattgcaactctccgtttaagccattttggtcaattcctctgaccgtctatggacttttaccacagcttgcactcatttctggagttagtgtcttccccaaggcatctgatccgtggttttggctttacatcattttattctttggggcttatgcccaagatctatcagactttttattggaaggaggaacttatcggaaatggtggaacgatcaaagaatgttgatgataaaaggactctcttcattcttctttggttttatagagttcattctcaaaaccctaaacctctccacacctaagttcaacgtcaccagtaaagccaatgatgatgacgaacagaggaagcggtacgagcaagaaatctttgatttcggaacctcttcgtccatgttcttgcccttgaccacggttgccatagtgaatctgcttgcttttgtctgggggctttatggtattctcttctgcggaggagaactctaccttgagctgatgctggtgagcttcgcggtggtgaattgcttaccgatctacggggctatggtgttgaggaaagatgatggaaaattatcaaaaagaacttgtttcttagctgggaacctccacgttggttcttattgtgtcaagttacttcgtcctcaagtaacttcaccccttaggttaattcacaacaataatacgtctggctggttcaagcggaagaaacacaatatgaatgaatctgtgtaa

SEQ ID NO: 2662 - DNA, 2580 bp, Arabidopsis thaliana
atgcatacgttttactatttcatcaaaccaacaaaaaagtttgagaggagctcctcgagtatgtgtccgtatttattaccagacagtcgatatgtaataaaatattatataaggaaaaaaataaaaaaaaatggaggtgagcataaattcgctaaaaaagaaaagaaagaaaggtgtttgaatggaacttggtgcaatgggggcaacaacacaaattcaaagaataaattctcagcagcaatagcttctcaacgcaacaaagcaaagcttttgctctatcaatcttcagccttttcttcttcgatttcacaagtttcatcatctcggtctggagatagagaattcccaaatggtgatttctattctggggaagtgaaaggaataattcctaatgggaagggaaagtatgcatggtcagatggaactatctacgagggtgattgggatgaaggcaaaatctctggtaaagggaagcttatttggtcatctggagctaaatatgagggagatttctctggtggataccttcatggttttggcaccatgacctcacctgatgagtctgtctacagcggagcctggagaatgaatgtgaggcatgggcttggcaggaaagagtattgtaactcagatctatatgacggtttgtggaaagaaggattacaagacgggcgtggtagttattcttggaccaatggaaataggtacatagggaactggaaaaagggtaagatgtgtgagagaggagttatgagatgggaaaacggtgatctttatgacggtttttggttgaatggctttagacatggctctggagtttataagtttgctgatggatgtttatattatggtacctggtcccgaggcctaaaagacgggaagggagtcttttatcctgctggaactaaacaaccatctctaaagaagtggtgtcgctctcttgaatatgatgacactggaaagtttgtactttctcgcagtgcatcggtaaatgttgaggagctaaggagtttaaacactgtgacacaaagtctttctgtgaaaacttcagctggtgaaaccacctgtgatcctccaagagactttacatgtcatgggccagtatctaagtctgcacggttttctggctcaggccaaagcgagggacaagataagaaccgtattgtttatgaaagggaatacatgcaaggagttttgattagagaaactattatgagttccgttgacaggtcacacaaaattaaacctccaaatcgtccaagagaagtcagggctaggtctttaatgacctttcttaggggggaacacaattattacttaatgctaaatctccaacttggtatcaggtatactgtaggaaaaattacaccagtgccgaggcgagaagtgcgtgcttctgactttggtaagaacgctagaacaaagatgttcttccctagagacggctccaattttacccctccacacaaatctgtcgacttctcctggaaagactattgtcccatggttttcaggaatttaaggcagatgttcaagttagatgctgcagagtacatgatgtctatttgtggtgatgatggcctgacagaaatttcttcccccgggaaaagtggcagtatcttctacctttctcatgacgacagatttgtgatcaagactttaaaaaagtctgagttgcaggttctactcagaatgttgcctaagtactatgaacatgtaggcgaccatgaaaacacacttataaccaaattttttggagttcacagaataaccctcaagtggggtaaaaaggtacgctttgtagtcatggggaatatgttttgcacagaattgaagattcatcgtcgttatgatctaaagggttcaactcaagggagatttactgaaaagatcaaaatccaagagaagaccacattgaaagatcttgatctagcttatgaatttcatatggacaagctgttacgggaagcccttttcaagcaaatttacttagactgctcgtttttggaatcgctgaacatcattgactacagtcttttactgggattacattttagagctcctggccaacttaatgatatccttgagcctccaaatgcaatgtcagatcaagaaagcgtttcttcagtagatgtcggtttgactcaggaacactccattcctccaaaaggattgcttttggtaactcatgaacccaattccgtgaatactgcaccgggtcctcacatcagagggagcacactcagagcattttccgttggcgagcaggaagttgatcttattcttcctggaactgcaaggctgcgggtacaattaggagtgaacatgccggcacaagctcatcacaagcttattgaggacaaggaagagtcagcgacaattgagctttttgaagtatacgatgtggttgtgtacatgggaatcatagatattttgcaggagtataacaccaagaagaaagtggaacatacttgcaaatctttgcagtatgatccgatgacaatatctgtgaccgaaccttctacttactcaaaacgctttgtcaattttctacacaaggtgttcccagaagaaaggtag

SEQ ID NO: 2663 - DNA, 1440 bp, Arabidopsis thaliana
atggactcagagcaattgagagagtacggacatctgatggttgatttcattgctgattactacaaaaccatcgaagatttccctgttcttagccaagttcagcctggttatcttcataagcttttgcctgattctgcacctgaccaccctgaaactctggaccaagttcttgatgatgttcgagcaaagatattgcctggagtaacgcattggcaaagcccgagtttctttgcttattatccttctaacagcagtgttgctgggttcttgggtgagatgttgagtgctggtcttggcattgttggttttagttgggttacttctccagctgccacagagctagaaatgatcgttcttgattgggttgctaaacttctcaacctacccgagcagtttatgtccaaaggaaatggaggtggagttatacaagggtcagctagtgaagctgttcttgttgttctgattgctgcacgcgacaaggttttaagaagcgttggcaaaaacgcgcttgagaagctcgttgtctactcctctgaccagactcattcagctttacagaaggcttgccagattgctggaatccatccagagaattgcagggtgctgacaacagactcttctacaaattacgctctgcgtccagaatcgcttcaagaagctgtttctagggatcttgaagctggattgattccattcttcttatgtgctaatgttgggaccacttcttcaaccgcagttgatccattagctgcactggggaagattgctaatagcaatggaatttggtttcacgtggatgcagcatatgctggaagtgcctgtatatgtccagagtatcggcaatacattgacggtgtagaaactgcagactcttttaacatgaatgctcacaaatggttcctcactaacttcgattgttcccttctttgggtaaaggatcaagattctcttacattagctctttcaacaaatccagagtttctcaaaaacaaggcctctcaggcaaacttggttgttgattacaaagattggcaaatccctctcggacgaagattcagatcattgaaactatggatggttttaaggctctatggatctgagaccttgaagagctatataagaaaccatatcaaactggctaaagaattcgaacaacttgtctctcaagatcctaacttcgagattgtcacacctcggatctttgctcttgtctgtttccgcctcgtgcctgtgaaagacgaagaaaagaagtgtaataaccgaaaccgtgaactcctagacgcagtgaactcttcagggaaactcttcatgtcgcacactgctttatcggggaaaatcgtactacgttgcgcaataggagcgccattgacggaggagaagcacgttaaggaggcgtggaagattattcaggaagaagcatcttacttgcttcacaagtaa

SEQ ID NO: 2664 - DNA, 1152 bp, Arabidopsis thaliana
atgtctttgtaccttttttacaggttactttgttctgttgaaggaaaatacttgattcaggaaacaacacacgattcgacgaccagggaggatgacgatttcaaggacaacagtgagattgttgagtgtgtaaacttctcttgtgatatgcctatattgagtggtcgaggattcatggagattgaagaccaaggactcagtagcagcttcttccctttcttagtggttgaagatgacgatgtttgttctgaaatccgtatacttgaaaccacattagagttcactggaactgattctgctaagcaagctatggatttcatacatgaaatcggttggcttcttcacagaagtaaacttggggaatcagacccaaatccaggcgttttcccattaatacgcttccagtggctaatcgagttctcaatggatcgagagtggtgcgctgtgatcagaaagctattaaacatgttctttgatggagctgttggtgaattttcttcctcctctaatgccacactgtcagaactgtgccttcttcacagagccgtgaggaaaaactctaagcctatggttgaaatgctcttgagatatattcccaagcaacaaagaaacagcttgtttagacccgatgctgctggtccagccggcttaacacctcttcatattgcagctggtaaagacggttcagaagatgtgttggatgcgctaacagaagatcctgcaatggtggggattgaagcgtggaagacatgtcgagacagcacaggcttcacaccagaagactacgcacgcttacgcggtcacttctcatacatccacttgattcaacgcaagatcaataaaaagtcaacaactgaagatcatgttgtggtcaacatcccagtttctttctcagacagagagcagaaagaaccaaaatcaggtccgatggcttcagccttggagatcacacagattccatgcaagctctgtgaccataaactggtgtatgggacaacacgcaggtctgtagcgtacagaccagctatgttgtcaatggtggcgattgctgcggtttgcgtctgtgtggcacttctgtttaagagttgcccggaagtgctctatgtgtttcaaccgttcaggtgggagttattggactatggaacaagctga

SEQ ID NO: 2665 - DNA, 867 bp, Arabidopsis thaliana
atggccgagaaagtccatgagatcgccggaaagataactcctttctgccggaaaatagttcacgtgaacagaaaatggagaatcatcgagagggtatcgatctttggagatttctttaggtttctatggagaaaaattgtttcttgttcaagtatcatcgaaaaacctattctttaccggcgaatcgttcacaagatttcttccaccgcgggcgatatctttgacggagacgacgatactacgacagaacctactgtttccggtagaaggtttggttcaagttcggattcggatttggttagtctcaagatcagtttattaggcgattgtcaaacagggaagactacttttgtagtaaaatatgttggagatgagaatcaaagtttcttggagatgacgggtttgaatttgatggacaaaactttttatgttcaaggagttactatttcgtttagcatttgggatgtgggaggtgatgaaaagagatcaaaagatcatataccaattgcttgtaaagatgcagtagcaatcttgttcatgtttgatctaaccagtcgatctactcttaacagtgtcttcgggtggtatagccaggcaagaaaatggaacaagacggcaattccgattctaataggaacaaaattcgatgactttgttcggctcccacccaatcttcagtggaccatcgtcactcaggcaagagcatatgcgaaggtgatgaatgcgtcattgttcttctcaagtgcgacacacaacataaatgtgaacaagatcttcaaattcattttggctagactttttaatttgccttggaagattgacagaaatttgaccttaggtgaacccattatcgactacgattcctaa

SEQ ID NO: 2666 - DNA, 1344 bp, Arabidopsis thaliana
atggtgattgcattattagacgtagtgagtagtgatgatgctaaagagcaaaagatgaaggacaagattatctctttgccaggccaacctcctaacctcaacttctctcaattttctggctacgtcactgttgatcccgcggccggacgggctctcttttattggctaaccgaagctcctaggcctagcggaacgaagcccttagtcctatggctcaatggtggtccaggatgctcctctattgcttatggtgcttctgaagaagttggtccatttcgggttaatccagacggaaagactttgcgtctaaatctatatgcttggaacaaagtggcaaatgtgttatttttggattcaccggcgggagttggtttctcttacacaaacacttcgtcagacgaactaaccgtgggagacaagagaacaggggaggatgcttatagattcttggtgagatggttggagaggttccctgagtataaggaacgggctttttacatcgccggcgagagctacgctggacattatattccggagctagcccaactgatcgtcaaccgtaacaaaggtgccaaaaatccaactatcaatctaaaagggattctgatggggaatcctcttgtcgatgactacaatgacaacaaaggaatgcgtgactactggtggaatcacgggcttatatcggacgaaagctacaatgacctgaccaaatggtgtctcaacgactccatcctatttccaaaactaaactgcaacgctgctctgaaccaagccttgtctgagtttggtgacattgacccttacaacatcaatagccctgcatgcaccacgcatgcatcatcaaatgagtggatgcaagcatggcggtatagagggaacgatgagtgtgttgtgggatacacacgcaagtatatgaacgatcccaatgtgcacaaatccttccatgcccgtctcaacggcagtactccttggacaccttgcagtcgtgtgataagaaagaattggaaagactcacctaagtccatgcttcctatcatcaagaatcttcttcaagctcatctccgcatttggatcttcagtggggactcggacgcggtgttgcctctaagcgggacgaggcattcgattaatgcaatgaaattgaagagtagcaaaaggtggtatccatggtaccattcacacggcctagtaggaggttggagtcaggtttatgaggatggcttgctaacgtacacgacggttagagcagcagggcatgaggtgccattgtctcagcctcgtctcgctcttttcctcttcacccacttcctagccaaccactctcttccctcctctccctcttaa

SEQ ID NO: 2667 - DNA, 789 bp, Arabidopsis thaliana
atggcgtctccttcgcttctgcagtcttccgcttcttcgtttcacggacgtttctcaccattagcggctccatcctccgcacgaatgctctctccgccgctcagaaacgtggtgaaagtctcggcgtctggaactgtactggtcgagaaatctgaagccgagaaaactcaacgcctcaaaaccgcttacctcgagaggattatccctgcgctcaaagaagagttcaagtacgttaatattcaccaggttccaaaggtacagaagattgtagtgaattgtggtattggagatgcggcgcagaacgacaagggtttggaggctgcgatgaaggatatcgcgcttatcacagggcagaaacctattaagacacgagctagagcttccattgctactttcaagatcagggaagatcaacctcttgggattgctgtcactctcagaggagatgtaatgtactccttcttggatcgtcttatcaacttagcccttccgagaactcgagatttccaaggtgtgagtcccagtagctttgatgggaacggaaactacagtattggtgtgaaagaccaaggtgtattccctgaaatcaggtttgatgccgttggaaaaacgagaggaatggatgtatgcatcagcacaacggctaaaagcgatcaagaaggacagaaactattggctctaatgggaatgcctttcagggaaggaggtggtggcagcacaggcgcgatagtgcggaagaagaaactaaagtctcatcactttgatgctaaaggaaaaggaaagagatga

SEQ ID NO: 2668 - DNA, 1449 bp, Arabidopsis thaliana
atggcggacgttagaaaccctacaaaaaatcatcatggtcatcatcatcttcatgctctcttgatcccatatccatttcaagggcatgtaaacccatttgtacacttagccatcaagctcgcgtcacaggggatcaccgtcactttcgtcaacactcattacatccaccaccagatcacaaacggctccgatggagatattttcgctggagttaggtcagagtctggccttgacataaggtacgcgacggtttccgatggtttaccggtcggatttgaccggtcgttgaaccatgacacgtaccaatcgtcgctgttgcacgtgttctatgcgcatgtggaagagcttgtggcgagtcttgttggaggagacggcggtgtgaatgtgatgatcgccgacacattctttgtttggccgtctgtggtggctaggaagtttggtttggtttgtgtctcgttttggaccgaagctgctttagtattttcactttattaccatatggatctgcttcggattcatggccattttggtgctcaagaaacccgcagcgatctaatcgactacattcccggagtcgccgcaattaacccaaaagacacggcgtcgtatcttcaagaaaccgacacgtcatcagtagttcatcaaatcatcttcaaagcattcgaagacgtgaaaaaagtcgattttgtactctgcaacacaattcagcaattcgaagacaaaacaatcaaagccctaaacacaaaaatcccattttacgcaatcggaccaatcataccattcaataaccaaaccggttcagtcacaacctcactctggtctgaatcagattgtacacaatggctcaacactaaaccaaaaagctccgtactttatatctcctttggtagttacgctcatgtcacaaagaaggatcttgttgagatagctcacgggattttgttgagtaaagttaatttcgtttgggtggtgagaccagacattgttagttcagacgaaaccaatccattaccagaagggtttgaaacagaagctggagatcgtgggattgtaataccatggtgttgtcaaatgacggttttgtcacatgagagtgttggtgggtttttgacacattgtggttggaactcgatattggagacgatttggtgtgaggttcctgtgttgtgttttccattgttgactgatcaggttacgaataggaagcttgtggttgatgattgggagattgggattaatctttgtgaagataagagtgattttggtagagatgaagttgggaggaatattaaccgtttgatgtgtggtgtttcgaaagagaagatcggacgggttaaaatgagtttggaaggtgcggtgagaaacagtggatcttcttcggagatgaatttaggtttgtttattgatggacttttgtctaaggttggtttatctaatgggaaagcttaa

SEQ ID NO: 2669 - DNA, 1557 bp, Arabidopsis thaliana
atgacagatattttcactttctttacgatccaaaatcgtaatgaccacttcgactttgttttagctacaatagtcatatcctctgttttttggtatatatgggtttacgtcaaatcgaaacgactgtttccaccgttaccaccgggacctcggggtcttcccatcgtcggaaacctcccattcctccacccggagcttcacacctactttcacagtctagctcaaaaacacggacccgttttcaaactatggctcggcgcaaaactaaccatcgtgataacctcttccgaagcaacgcgggatattctaagaactaatgacgtcatctttgcgaacgacgacgttcccgtcgcaggctcactcagcacgtatggtggcgtagacattgtctggtcaccgtacggaccagaatggccaatgctaagaaaaatctgcattaacaaaatgttaagcaacgccacgttggattcaaattcttttagtgcacttcgccgccaggagaccaggcgaacagtccggtatttggcagaccgggctcgggccgggttggcggttaacgttggagaacaaatatttgtcacgatattaaatgtggtgactcagatgttgtggggagaaactgttgcggacgacgaggagagagagaaagttggagctgaatttttggaattgattacggaaataattgatgttgtgggaaagccaaatgtctctgattttttcccggttttgagccggtttgaccttcagggtttggctaagcgtgtgcgtagatcggctcagaggatggaccggatgttcgaccggattataagtcaacggatgggaatggataagggaagtaaagggaacggtggagattttttgatggttttgttgaatgctaaggatgaagatgaaaacatgtccatgaaccatgtcaaggccttgctaatggatatggtgcttggtggtacagacacatctttgaacacaatagagttcgcaatggcagagcttataaacaaactggagatcatgaagagagctcaacaagagcttgacaaggttgtggggaaaaacaacatcgtcgaagaaaaacatatcactaaacttccatacattctctccattatgaaagaaaccctaaggcttcacccagctcttcctcttctaatacctcgctgcccatctgaaaccacggttataggtggctacacaattcctaatgattctaaggttttcatcaatgtgtgggcgattcatagaaatccgaacgtatgggagaatccgttggagtttaatcctgataggtttcttgataaaggttacgactttagtggtaatgactatagttatttcccgtttggatctggccggagaatttgtgcgggaatggccatggccgagaaagttgttctttacaatcttgcaacgcttttgcattcttttgattggagaattggggaaggagagaaagtggagctcgaggagaagtttgggattttattgaagttgaagaatccacttgttgcaacacccgtgctaagattgtcggatccaaacctttttctttaa

SEQ ID NO: 2670 - DNA, 4212 bp, Arabidopsis thaliana
atggctgggaagtcgaacaaatcgaaggccaagagagcggctcagagcactaccaccaattccactactgatgttaaatccgatgctcctgctcctcctgttgctgctactgttcctgctactgctccggttactgctgctgctgctccggttgctactgctgctgctccggttactgctcccgataatggcaccctcactgctgttgactctgcggtgcctgaagccaatgaagttgctcctacgattcctaaggctgacgaaagtgagtcacaagttgaaaataacgatgcccaacccaagcaaggtgaactccgtctttatcctgtgtctgtcaaaacacaaagtgggggtaaaatggagcttcaattgaaccctggagactctgtgatggatataaggcagttcctccttgatgctccagagacgtgctacttcacttgttatgagttgttactccgcaataaagatggagagactcatcatttggaagactacaatgagatctctgaagtagctgacatcaccattggtggttgctccttggaaatggttgcagcattgtatgatgatagatctatcagagcgcatgttcaccgtgccagagatcttttgtctctttcaacacttcactcttctctatcaacaacacttgccttgcagtatgacgcagcactgaacaaagttcagaaccctggagataaaccaaagtctgacgttccagagctggaatgtttgggttttatggaagatgtgcctggctctctcaagaagttaataaattctacatcagaagagatcagatctgtggaaaacattgtgttctcatcgttcaaccctcctccaagccacagaaggcttgtaggagatctaatatatttagatgttgtgaccttggaaggtaacaagtactgcataacaggcacaaccaaaacattttatgttaattccagctcagggaatattctcgatccaagaccaagtaaatctggatttgaagcagctacgctgattggactattacaaaagcttagctctaagtttaaaaaagctttccgtgaagtcatggaaaagaaagcctctgctcatccgtttgaaaatgttcaatcgcttttgccaccacactcatggctaagaacttatccagtacccgatcacaagcgtgatgcagcgagagcagaagaagcacttaccatttcctatggtagtgagttaattggcatgcagagagattggaacgaagagttgcaatcttgcagagagttccctcacacttctcctcaagagagatttgtttccttaattgaaaatttccttcgttgcaggatattacgagacagggcactttacaaagtgtcttctgattttgtcgatgcagcacttaacggagctattggagtaatcagccggtgtataccacccataaacccaactgatccagagtgtttgcacatgtatgtgcacaacaacatctttttcagttttgctgttgatgccgacattgaacagctctccaagaaacgtccatctaatcaaatgacggagaaggtgtcctcatctgaaaaggtttcatgcacagaaggaacctgcgataatgaagagcataacaactgtaatgaggcgccacttgttgagaatgagcaggctacgtatgcctctgcaaacaatgatttgaaaggcacaaaattatatcaagaagctgatgtcccagggctatataatctggcaatggccattattgattacagaggccatagggttgttgctcaggtttgttcaaatactggaacttccaagtccttattcttgagattgtctagtgttctaccgggaatccttcaaggggataaatcagatgcgcttttgtacggttcagtcgacaatggcaagaaaatatgctggaatgaagattttcatgctaaggtgctagaggccgcaaagcttcttcacattaaggaacattctgttatcgatgcatccgaaactgtctttaagttggctgcaccagtagagtgcaaagggattgttgggagtgataacaggcattatctcttggacttgatgagagtgacacctcgtgatgccaattatacgggcccagagtcacgcttttgtgtcctaagaccagaactgatcacatcattttgccaggccgaatcattggaaaaatcaaaatttaaaaccaaggctgatgaagggggcgatgattcttctaatgttagtgctgatacttctaaagttggtgatgcattgatcgatggagaggcaaatggggcttcaaattctgatcagaaatctatttcagacaagcaaaataccactgccgaagattatgcagccgggtcttctgaaagttccaaatcatgtgatcaaatagcatttaaccccaatgtcttcactgacttcacattaggtggcaatcaagaggagatagctgctgatgaagaaaatgtgaagaaagttagctcataccttgtggatgtggtccttccaaagtttatagaagatctttgcactctcgaagtttctccaatggatggtcagactttgacagaagcactccatgctcatggtgttaatgttcgttacattggaagagtaatagatttgctcgaccaggttgctaatggggtgaagcatttgcctcatttgtgggacctttgtctgaatgagattactgtaagatccgcaaagcacattttgaaggacattctaagagatatagaggatcacgatattggatcagcagtctcacatttcctcaattgtttctttggaaactatcaaactgctgggggaaaagctagcgccaacagctctactgccaaaaatcaaaagaaggatcaacccatcaccaagaagggtcaaggaagagggaagggaaaagcttcttcaaagaaaagtttttcatcgtatatgatggttgactccaacattctatggtctgacattcaggaatttgccaaagcgaaatatgaggttggtgtcagtattgctgctcgcaaatacgacttcagtgcaaacacgccttttgagacgtcagatattttggatcttcggcccgtaattaagcactccgtccctgtatgctctgaggctaaagatcttgttgagatggggaaggtccaactggctgagaggcattttcgatacttcaacaggtacctggctatggttttgtaccatgcaggagatatggctggggccataatgcagcaacacaaggaactcattattaatgagcgatgccttggtttggaccatcctgatactgcccatagctatggcaatatggctcttttctaccatggactgaatcagacagaacttgctctacaaaacatgggtcgagccttgcttctacttggcctttcatctggccctgaccatccagatgttgcagctacatttataaatgttgccatgatgtatcaagacatgggcaaaatggacacagctctacgttatcttcaagaggctttgaagaaaaatgagagacttcttggtcctgaacacattcagactgcagtatgctaccacgctcttgccattgcgttcaactgtatgggtgcattcaagctctcacaccagcatgagaagaaaacatacgacatacttgttaaacaattgggagacgatgattctaggacacgagactctctaaattggatgaagacgtttaagatgctatacattttgtttggatttctcaaattttctggttgggttttgaatcagatgactgcacaaaagcagaaaggacaggcagctaatgcagccaacacgcaaaaggctatcgatctcctaaaggcacatccagacctgatacatgcgttccaaaacgcagctgctactgggaggacaaatgcactgaactctgctgtccttggggagactcaaccacggggcagaggttttgatgaaagagcagctcgtgctgcagctgaagttaggaagaaagcagctgcaaaggggctactggttcgcccccagggtggtgttccagttcaagccatgccaccgctctctcagctccaaaacatgatcaataccgccacagtttcgtctgagaaaggtggagaaaacggggaggcaaaggtacaagagaagaaagaatcctctgaaaatgggaaaacagaaaacctggctcctgcaggattaggtgctggtttaacatctttggataagaagaagcaaaaagccaaaaaataa

SEQ ID NO: 2671 - DNA, 474 bp, Arabidopsis thaliana
atggcgagcgagggagttgtagttgtcggaggggagagagaaggggctgagatcgtgtacggggcggaggaatgttacaagcaatcattggagcttctagaggagctagggtttccaaaaggagtcatgcctttgaagaatcttgttgagtgtggaagagttagagccactggttacgtttggatgaagcaagacactccttacgagcatttcttcgaagccaccaacactcgtgtctcctacggtctcgaagtcaccgcctatgtcgacaagtgttgtatgaagaagatgacaggagtgaagagtaagcagatgtttttgtgggtaccgatcgtggagatgagtatggaggagccaaaaagcaagaagatttacttcaagactcctatgggaatcggcaggtctttccccgttaccggattcatggacgaggaagagaaacgcaacttttacttggagaatcccaaaaactaa

SEQ ID NO: 2672 - DNA, 1050 bp, Arabidopsis thaliana
atggcaacttctgcaatatctaagctcttagtgtctgatttcgcctcctccgttcacatcccttcaaactatgtccgaccaatctccgaccgtccgaacttgtccgaggtcgagagttctggcgattccatccctctgatcgatctccgggacctccatggacctaatcgagccgtaattgtccaacaacttgctagtgcgtgttccacttatggtttctttcagatcaagaatcatggagtaccagatacaaccgtcaataaaatgcaaaccgttgcgagagagttcttccatcaacccgagagcgaaagagtcaaacactactccgcagatccaacaaagacaacgagactctccaccagtttcaacgtcggcgcagacaaagtcttgaactggagagacttccttagactccattgctttcccatagaagatttcatcgaagaatggccatctagtcccatctctttcagagaagtcacagctgaatatgccacgagcgtaagagctttggttttgagacttcttgaggccatctcagagagtttaggccttgaaagcgaccatataagcaatatattaggcaaacacgctcaacacatggcgtttaactactatccgccgtgtccagaacccgagctaacttacggacttcccggacataaagacccaaccgttatcactgtccttcttcaagaccaagtctctggtttgcaagtctttaaggatgataaatgggtcgctgttagtccaattcccaacactttcatcgtcaatatcggcgaccaaatgcaggtcataagcaatgataaatacaagagtgtgctccatagagccgtagtaaacaccgagaacgagcggttatcgattccgactttctatttcccttcaacagatgcagtgattggtccagcacacgagctggtcaatgaacaagactctcttgccatttacagaacctacccgtttgttgagtattgggacaagttttggaacagatcacttgctactgcgagctgtctagacgccttcaaagctccaacaacctaa

SEQ ID NO: 2673 - DNA, 1449 bp, Arabidopsis thaliana
atgccttctttagagaaatctgtaacaataatctcaagaaacagagtcttcccagaccaaaagtcaaccctcgttgacctcaagctctccgtctccgatcttcccatgctctcttgccactacatccaaaaaggttgtcttttcacgtgccctaaccttcctctccccgcgcttatctcacacctcaaacactctctctcaatcactctcacccacttccctcctctcgctggccgtctctcaacctcctcctccggccacgttttcctcacctgcaatgacgccggcgccgattttgttttcgcccaagcaaaatccatccacgtgagcgacgtgatcgccggaatcgacgttcccgatgtagtcaaagagtttttcacctacgacagagctgtgagctacgagggacataacagaccaatcctcgccgttcaagtgacggaactgaacgacggcgttttcatcggatgctccgttaaccacgccgtgactgacggaacctcgctgtggaatttcattaacaccttcgcggaggtttctagaggtgctaagaatgtgacacgtcagcctgattttacgcgggagtctgtgctaatctcaccggctgtgctcaaagtccctcaaggtggtccaaaggtgacatttgacgaaaacgcgccgttacgtgaacggatattcagtttcagtagagaatcgattcaagagcttaaagctgtggtgaacaagaagaaatggttgacggttgataacggcgaaatagacggtgttgagttgttagggaaacaaagcaacgataaacttaacggaaaagaaaacggtattttaacggaaatgttggagagtttgtttgggagaaacgacgccgtttcgaaacccgtcgcggttgagatctcgtcgtttcaatctctatgcgcgttgctttggcgtgcgatcacacgtgcgaggaagcttccgagttcgaaaacgactacgtttcgtatggctgtgaattgtcgtcaccgtttgagtcctaaactgaatccggagtatttcggaaacgcgattcaaagcgttcctacgtttgcgactgcggcagaggttttgtcacgtgatcttaaatggtgcgctgatcagcttaaccagagtgttgcggctcatcaagacgggaggattcgtagcgttgtggcggattgggaagcgaatcccaggtgttttcctcttggaaatgccgacggagcttcggttactatgggaagctctccgaggtttccgatgtatgataatgatttcgggtggggaaggccggtggcggttagaagtggacggtcgaataagtttgatgggaagatttcggcgtttccggggagggaaggaaacgggactgttgatttggaggtggttttatcgccggagactatggctgggattgaatctgacggtgagtttatgcgatacgtgactaataagtaa

SEQ ID NO: 2674 - DNA, 1374 bp, Arabidopsis thaliana
atggatcggaatcaaaagatggatcacgttatcggcgggaagtttaagttgggtaggaagcttggaagtggatcattcggtgaactttatttagggatcaatattcaaactggagaagaagtcgcagttaagctggaacctgtgaagacgaggcatcctcaactgcagtatgaatcgaaaatatatatgtttcttcaaggaggaacgggtgttccccatctgaaatggtttggagttgagggtgaatacagttgcatggttatcgatcttcttgggccaagcttggaggacttattcaattactgcaagcgaatattttcattaaaatctgttttaatgcttgcagatcaattgatatgtagagttgagtatatgcattcgcggggttttcttcaccgcgatattaaaccagacaactttttgatgggtcttgggcgcagagcaaaccaggtgtatatcattgattatggccttgctaaaaaatacaaggatcttcagacacaaaagcatataccatacagggaaaacaagaatcttacaggaactgctcggtatgcaagtgtgaacacacaccttgggattgagcaaagtagaagagatgatctggagtcacttggttatgtgttgatgtattttctacgaggaagtcttccgtggcaaggtttaaaagctggtacgaagaagcagaaatatgacaagattagtgaaaagaagatgcttacttctgtagagactctttgcaagtcgtatccatcagagttcacatcgtacttccattactgtcgttcattgagatttgaggacaaaccggattattcatatctgagaagactttttagggatcttttcattcgtgaaggttatcagcttgattatgtgtttgattggacaatctcgaagtatcctcagattggctctagttcgagaccaaggccaactccaagaccagcgttggaccctccaggaccacctgcagaaagagctgaaaagcctacagtcggacaggacctgcgaggaagatttacaggtgcaattgaggcattcaccagacgaaatgtttcaagccaaggcgctcttggtgatcgctctagacacagatcttctgatgatataccctcttctgccaaggaagtgcacgagtctcgaaatggaagtacctcaaagagaggtgtgatatcaagcaccagacctggctcatcagctgaaccaagcgagaaccactcaagccgactattttcaagtggttcacgtcatgccacaacccaacgggttccacagagctatgaatctgcagctgcagcaaggcctgggcatgaggatgccattagaaacttcgagctccttaccatcggctctggaaagaagaggaaatga

SEQ ID NO: 2675 - DNA, 1728 bp, Arabidopsis thaliana
atggctacctcctccgcttggaagctcgatgaccaccccaagctccccaagggtaagaccatcgccgtaatcgtcttagatggttggggtgaatctgcccctgatcagtacaactgtatccacaacgctccaactccagccatggattctcttaaacatggagctcctgatacttggactttgatcaaagctcacggtactgctgtaggacttcctagtgaagatgatatgggaaacagtgaggttggtcataatgctcttggtgctggtcgtatctttgctcaaggtgctaagctttgtgaccaagctcttgcttctggcaaaatctttgaaggtgaaggttttaaatacgtttctgaatctttcgagacgaatactttgcatcttgttggacttctcagtgacggtggagttcactctcgtctcgatcaactacagttgttgattaaaggatctgctgaacgtggtgctaagagaatcagagtccatattcttactgatggtcgtgatgttttggatggttctagtgttggatttgtggaaacccttgaagccgacctcgttgcattacgtgagaatggtgtggatgctcagattgcatctggtggaggacgtatgtatgtgactttggaccgatatgagaatgattgggaagttgttaaaagaggttgggatgctcaagttcttggagaagctcctcacaaattcaaaaacgctgttgaagctgtgaagactttgaggaaagagcctggtgctaatgaccagtatttgcccccgtttgtgattgttgatgaatcagggaaagcagttggtccgattgtggacggtgatgctgttgttaccttcaacttcagggctgatcgtatggttatgcatgctaaggcacttgagtacgaagattttgacaaatttgaccgtgtgaggtacccaaagattcgttatgctggtatgcttcagtatgatggagagcttaagctaccaagccgttaccttgtttctcccccggagattgatagaacatctggtgaatatttgactcacaatggcgtcagtacttttgcttgcagttccagttgcttgctcattataggtctatactatgctttgcatttttgccaatatgagaccgtcaagtttgggcatgtcaccttcttctggaatggaaatcgatctggatatttcaacgagaaattggaggagtatgttgaaatcccaagtgacagtggaatatcattcaatgtccagccaaagatgaaagctctggaaattggtgagaaggcaagggatgcaatccttagtggcaagtttgatcaggtgcgagttaacattccaaatggagatatggtgggtcatacaggtgatattgaagccacggttgttgcatgcgaggctgctgatcttgctgtgaagatgatttttgatgcaatcgaacaagtgaaaggaatttatgttgtgactgctgatcacggaaacgcagaggacatggtgaagagggataaatctggcaagcctgctttggataaggaagggaagcttcagattctaacctctcacacactcaagccagtgccaattgctattggaggtcctggtttggctcaaggagtgagattccgtaaagatctggaaacaccggggcttgcaaatgtagctgcaacagtgatgaacctccatggatttgtggctccctctgactatgagcccaccctgattgaagtagtggagtag

SEQ ID NO: 2676 - DNA, 684 bp, Arabidopsis thaliana
atggcgaccgaggacgtgaagctgatcggctcatgggcgagtgtttacgtcatgagggcgaggatcgctctccacctcaaatctattagctacgaattccttcaggagacgtatggttcaaagagcgaattgctcctcaaatcaaacccggttcacaagaagatgccggttctgattcacgctgacaaaccggtgtgcgagtccaacatcatcgttcattatatcgacgaggcttggaactcttctggaccttccattctcccgtcccatccatacgaccgggccattgctcggttttgggctgcctacatagacgatcagtggtttatctctgtgagaagtatcctaacagctcaaggagacgaagagaagaaagcagccatagctcaagttgaagaaaggaccaagcttctggagaaagcattcaacgattgtagccaaggaaaaccgttcttcaacggtgaccatatcggttacctcgacattgccttggggagcttcttaggttggtggagagtcgtcgagttggatgccaatcataaatttcttgatgagaccaaaactccctctctagtcaaatgggcagagcggttctgtgatgatcccgctgtgaaacctataatgcccgagattacaaagctcgctgaattcgcaaggaagctctttcctaagcggcaagcataa

SEQ ID NO: 2677 - DNA, 1830 bp, Arabidopsis thaliana
atgaagagagcccaacaatcggcaagagaaacaaagcaagaagctaaagatgctagcaaagcgaagagcggtttgttcgcttcttgttccttctcttcacttggtttagataccaagctctctgaccagctcaaagaaaggatgggttttgaagctcctactcttgtacaagctcaagcaattcctgttattctctctggtcgagatgtacttgttaatgctccaaccggtactggaaagactatagcgtatttggcacccctcatccatcacttgcagggtcattctcctaaggttgatcgttctcatggaacttttgctttggtgattgtgcctacacgggaactatgccttcaggtgtatgaaaccttggagaagttactgcatcggttccattggatagtccctggctatgttatgggaggagagaaaaaggctaaagaaaaggctagattaaggaaaggaatatccattctaattgcaaccccgggacgccttcttgaccatttgaagaacacagcttcatttgtgcacaaaaatctgcgttgggtcatctttgatgaagctgatagcattctcgaattaggttatgggaaggagatagaacagataattaagcttctaggttcagggcaaaacgagcaaggggaagaagatgatattgttccaaagggtattcagaagcagaacttgttattgtcagcaacattgaatgataaagttaacgatcttgcaaaacttagtttggacgatccggtaatgattggtcttgacaacaccaaattgcaacaaaatctatcaatagagtctcctgcggctcctgactctgatgcggaagatatggtaattcatgttaacaaatccgcaaaccctttatctgaggactatggaataccatcacagctggtacagagatatcttagagtgccatgtggtgcacggcttgtggcacttctttctgttctcaagaacctttttgaaagagaagcttctcaaaaggtggtcgtcttcttttcgacacgtgatgctgtagattttcattactcacttctgagtgaattccagtggccaccgaattctgagacagaagaggaggggactaaagagttgtttctcaagtgcaaaacgttccggttacatggaagtatggagcaggaggatagaagatctgcgtttgggacctttaaaacagagaagcaggctgttctgttgagtacagatgttgctgctagaggcttggatttcccaaaagtaagatgtattatacaatatgactgtcccggggaagctaccgagtatgtgcatagagttggtagaacagctcgtattggtgaaaaaggagaagccttgttatttctacaaccgattgaaatagactatcttaaggagctgaagaaacatggtgcatcacttacagagtaccctcttatgaaagtacttgataaatttcccatacccggcaatatgccccgaatcaaaaaggtcctatctctagaatcccatccatgggtcatatctctgcagagagctcttgaatcccttacttacgccgagccaaagatgaagagcctggccaagaatgcatttgtctcttgggttaggggatatgcagctcacaagggagagctcaagagtattttcgtggtgaagaagcttcacttgggtcatgtcgccaagagttttgctctgagagaacaaccgtctttagttgggaaatcacatcacaaggaaacaatgaagagaaagagagacgaacgtcaaaaagggcaacaaggtaagaagagaaagaagatgagtggtactggcaatagaagtacacaaaaaacttga

SEQ ID NO: 2678 - DNA, 1614 bp, Arabidopsis thaliana
atggagatttccactgctctaatgattctttcggccatcacggcgtatttcttatggctcacattcatatctcgttgtcttaaaggtccacgtgtttggcccatattgggtagtctccctggtcttatagagaactgcgagcgaatgcacgactggatctccgacaacctccgtgcttgctccggtacgtatcagacatgcatctgcgccattccgtttctagctaagaaacaaggtctcgtcactgtcacttgcgatccaagaaacctcgagcatattctcaagaatcgttttgataattaccctaaaggtccaacgtggcaagccgttttccatgatcttctcggccaaggtatctttaactccgacggtgacacgtggctttttcagcgtaagaccgccgccttggagtttaccacaaggacactccgtcaagccatggctcgttgggttaatagagcgatcaaacttaggtttctgcctattcttgaaaatgctcggctcggctctgagccgattgatcttcaagatttgcttcttcggcttacatttgataatatctgcggcttaactttcgggaaagacccgcggacttgtgcaccgggtctaccggtgaacacattcgcggtggctttcgatcgagccacggaggcttcgctacaaaggtttatattgccggagatattatggaagttcaagagatggctccgactcggcttagaagtcagcttaacaagaagcttggtccaggtagataattatttgtctgagattattacgacacgtaaggaagaaatgatgactcagcataataatgggaaacaccacgacgatctcttatcgcggttcatcaagaagaaggagtcttactccgacgagaccctccagcgcgtggcgctcaacttcatcctagctggacgtgacacgtcatcagtcgcgctgagctggttcttctggttgattacgcagcatccggccatagaggataaaatcctccgtgagatctgtaccgttctggttgagacacgtggcgatgatgtggcgttatggacggacgagccgctttcgtgcgaagagcttgatcgattggtttttctcaaggcagcgttatcggagactttgaggctttatccttcggtgccggaggattcaaaacgcgccgtgaaagacgatgtgttaccggacgggacatttgtgccggcgggatcttcgattacttattcgatttactctgcggggaggatgaaatcgacttggggagaggattgtttggaattcaaaccagagagatggatttcgcaatcggacggtgggagattcatcaatcatgatccgtttaaattcgttgcgttcaatgctggccctaggatctgtctgggtaaggatctggcgtatctacaaatgaaatcaattgcatcggcggttttgctccgccaccggttgacggtggtgacggggcataaggtggaacagaagatgtcgttaactttattcatgaagtacggtcttttagttaacgtccacgaacgggatttaacggcaatcgcggcggatctacgagagtgtaaatctaacgtcgtcaatgacggggttggtaacggcgtttcaagttag

SEQ ID NO: 2679 - DNA, 2328 bp, Arabidopsis thaliana
atgacgaagaggagcaaaggagctaacgaagataagctgatagaaaccaaaagcaaaaacgtttctggaaaatctcagaaacagaagaaaccagtagaagcagaaagcttaaaagaggaagaccttctacaagcatccggaactgattctgattacgacggagatgtattcttcttgctcctcttctcttttagtttgcctggttctttgaattccgacgatttcgactccgatttttccgattcagaggatgatggaacacatgaaggaacagaagatggagatgtagaattttccgatgacgacgacgtgcttgagcatgatgggtcaattgataacgaggatgatgatggaagtgaacatgtaggtagtgacaataatgaggaacatgggagtgatgaagattctgagcgaggtgaagcggttgaagagagcgattcctcagaagatgaggttccatctagaaatacagttgggaatgttcccttaaagtggtatgaagatgagaaacatattggttatgacctcactgggaagaagattactaagaaagaaaaacaagataaactcgactcttttcttgcaactatagatgactctaagacttgttggtgtcataatgctgatgaaagtttttggggatttaggcgcaaaatttatgatgaatataatgacgaggacgttgagctgactaaagaggagagcaagatcgttcagagaatactcaaaggggaagctccacatgcggactttgatccatatgcaccttatgttgagtggttcaaacatgatgatgcaatacatccactctcaagtgcaccagagcccaagcgaagattcatcccttcaaaatgggaggccaaaaaggttgttaagattgttagagcaatacgtaaggggtggatcaagtttgataagcctgaagaagagcccaatgtataccttttatggggtgatgattcgacatctgatcaaaagagcaagcatttaacttatattcctccacccaagcttaaattgccaggacacgatgaatcatacaatccttctttggaatatattccaacagaggaggagaaagcctcatatgagttgatgtttgaggaagatcgtccaaaattcattcctacaaggtttacatctttgagaagcatccctgcgtatgagaatgcactgaaggagtcttttgagcgttgtttggatctatacctatgtccaagagttcgaaagaagagaataaacatcgaccctgaatctttgaagcctaagctacctagtaggaaggatcttagaccttatcctaactcctgttatcttgaatataaaggccatacaggggctgttacttcaatatccactgatagttctggcgagtggatagcctcaggttcaactgatggatctgtccgtatgtgggaagtggagactggtagatgccttaaggtctggcagtttgacgaagctatcatgtgtgtggcttggaatcctctttccaggcttccagttttagccgttgccatgggacgagatttgttttttctgaacactgaacttgggactgatgaggaacaggaaattactaaagagaggcttcactcaggaaacatcccagaaccagacgcatctgttgcagcaattgtaacctggctacctgatgagttatatggagggattaagataagacattttaagagcatatcgtctattgactggcatcgtaaaggagactatctctcaacagtgatggcatccggggaaacacggggagtggtattgcaccaactgtcaaaacagaaaacacaaaggctcccatttaagattcgtggacttccagtctgtacactttttcatcccagcctttcttacttcttcgttgcgacaagaaaggacgtgcgtgtttacaatcttttgaagccaggcgaggccaccaaaaagcttgagacaggattgagagaaatctcatcaatggcgattcatcctggtggtgataatctgatagtaggaagcaaagaagggaagatgtgttggtttgacatggatctatcttcgaaaccatacaagactctcaagaatcatcctaaagacattacaaatgtggcagttcatcgatcatatccgttatttgcttcgtgctcggaggattcaacagcttatgttttccatggaatggtgtataatgatctgaaccagaatcctctgattgtgccattggagattctaagaggtcattcttcaaaaggaggagtcttggactgcaagtttcatccgagacaaccatggctattcactgcaggcgctgactctattatcaaactctattgccactag

SEQ ID NO: 2680 - DNA, 1422 bp, Arabidopsis thaliana
atggctcatcgtgatcggttaattagaggtcgtcgacttgcaaatgaagatcaatcactcgttactttctctgacggcaacgaaactgttcgtgttgatgccctaggattttttaaggttaatgtttttatggagacttgtgaattgtttatgagagatttgcattacgctaatgtgactgttgggacgccgtctgattggtttatggttgctttagatactggaagtgacttgttttggttgccctgtgactgcaccaattgtgttcgtgaattgaaagcacctggtggctcgagtttggaccttaatatttatagccctaatgcttcatcgacaagtactaaagttccttgtaatagcacattatgtacaagaggtgatcgatgcgcttcccctgaaagtgattgcccataccagatccggtatctttctaatggtacctcttctactggagtcttggtggaggatgtacttcacttagtttcaaatgacaaaagttccaaagctattcccgctcgtgttacttttggatgtggtcaagttcagaccggtgtattccatgatggtgcagctccaaatggtcttttcgggcttggcttagaagacatatcggtgcctagtgtactagcaaaagaaggaattgcagcaaactcattctcaatgtgttttgggaacgatggagctggtaggatcagttttggagataaaggtagcgtagaccaacgggaaacaccattgaacataagacaaccacatcctacttacaatatcaccgtcactaaaataagcgttggaggaaataccggcgatcttgaatttgatgctgtttttgactctggaacctcgttcacttatctgactgatgcagcttacacccttatttcagaaagctttaattctctagctctggacaaacgttatcaaacaactgattctgagttgccttttgagtactgttatgcattaaggttgcctctttactctggtcaccatcacccaaacaaagacagcttccagtatccagctgtgaatctgacaatgaaaggcgggagctcgtatcccgtttatcacccgttagtagtaatccccatgaaggacacagatgtctactgtttagccattatgaagatagaagacattagcatcattggacagaacttcatgactggctatcgcgttgtctttgatcgtgagaaactgattctggggtggaaagaatctgattgttacaccggtgagacatcggctcggacgcttccatcgaaccgttcctcctcctcggctagaccgccagcttcttcgtttgacccagaggcgacaaacataccatctcaaagaccaaacacgtcgacgacttctgctgcttattctctctctatctcactttcattgttcttcttctcaattttggccatcctttaa

SEQ ID NO: 2681 - DNA, 56 bp, Arabidopsis thaliana
ctaagctatacatcattcgaagatgtgtcgtcatgcttctttgttggcacgattga

SEQ ID NO: 2682 - DNA, 1464 bp, Arabidopsis thaliana
atgggattctggggttctgattttgtgttgttaacatatgcaggacttgaagtgaaacctgggaagcctcaagcttataatccaaaaaatgaacaaggaaagattcacgtgacccaggcaactctaggtacgggtttgagcaaagaaaagagtgtgattcagtgttcaataggagacaaggctcctattgctttgtgttcattgttgccaaacaaaatcgaatgttgccctctgaatcttgagtttgacgatgatgatgagccagtggaattcaccgtgactggtgacagaagtatccacttgtctggattcttggagtattatcaggacgatgaagatgattatgagcatgatgaagatgattcagatggtattgatgttggtgagtctgaggaagacgattcgtgtgaatatgatagtgaagaggatgagcaattggatgaatttgaagacttccttgatagcaatcttgaaaggtatcggaatgctgctgccccaaagagtggagttataattgaggagatagaagatgaagagaaacctgccaaagataataaggcaaaacaaaccaagaagaagagtcaagctagcgaaggtgagaatgcaaagaaacaaatcgttgccatagagggtgcccatgttccagttttggaaagcgaagatgaagacgaagacggtttacctattcctaaaggaaaatcatctgaagtagagaatgcgtcaggtgagaagatggttgtagataatgacgaacaaggtagtaacaagaaacggaaggccaaggctgctgagcaagatgatggacaagaaagtgcaaacaagagtaaaaagaagaaaaatcagaaagagaagaagaaaggggaaaatgtcttaaatgaggaagctggacaagttcagacgggaaatgttctgaagaagcaggatattagccaaatttcttcaaacacaaaagctcaagatggaactgcaaacaatgccatgagtgaaagctccaagaccccagataaatctgctgagaagaaaactaaaaataagaaaaagaagaaaccaagtgacgaagctgcagaaatttctggtactgttgagaagcaaaccccagcggactccaagtcttctcaagtacggacatacccaaatgggctcattgttgaagagttgagcatgggaaaacccaacggcaagagagctgatcctggaaaaacggtttctgtgcgctatattggaaaacttcagaagaatgggaagattttcgattccaacattggaaaatcaccatttaagtttcgtctaggtattggatcagtcattaagggatgggatgttggagttaatggcatgcgcgttggtgacaaaaggaagcttacaattcctccatcaatggggtatggtgtgaagggtgctggtggccagattcctcctaattcttggctgacttttgatgtcgaactgattaatgttcaataa

SEQ ID NO: 2683 - DNA, 2235 bp, Arabidopsis thaliana
atgttgttccctcctcttcgttccctctttctcttcaccctcttgctctcctccgtttgtttcttacaaatcaaagcagaccacgacgatgaaagcgacttgggcagtgatatcaaagtagacaaacgtctcaagttcgagaacccgaagctacgtcaagcctacattgctcttcaatcatggaaaaaagcaatcttttctgatcctttcaacttcacagctaattggaatggttcagatgtttgctcctacaatggaatctattgtgctccttctccttcatacccgaaaacccgagtcgttgctggcattgacctcaaccacgctgacatggccggttacttggcttccgagctaggtctcctctctgatctcgctctgttccacattaactcaaaccgtttctgcggtgaagtccctctcacgtttaaccgcatgaagcttctctacgagcttgatcttagcaacaaccgattcgtcggtaagttccctaaggttgtcctctctttgccttcccttaaattcttggatctccgctacaacgagtttgaaggcaagatcccatcaaagctcttcgatagagagcttgacgctatattcttgaaccataaccggttccggttcgggattcccaaaaacatgggaaattcccctgtttctgctctggttcttgcggacaacaatctcggaggatgcataccgggaagtatcggtcaaatggggaaaacactcaacgagcttatcctctccaacgacaacttaaccggttgtttacctcctcagatcggaaacctcaagaaagtgacggttttcgacatcacttcaaaccgtctacaaggtccgttaccatctagcgttggtaacatgaagagcctagaagagcttcacgtggctaacaatgccttcacaggagttattcctccaagtatctgccagctttctaaccttgagaactttacttactcttccaactacttctccggtcgtcctcctatatgcgcagctagtttgttagccgacattgtggtgaacggtaccatgaactgcatcaccggtttggctcgtcaaagatcggataaacagtgctcatctttgcttgctcgccctgtggattgcagtaagtttggatgttacaacatcttctctccaccaccaccgacgtttaagatgtcacctgaagtccggacacttcctccaccgatttacgtgtactcatcgcctcctccaccaccgtcgtcaaagatgtcccctaccgtcagagcatactctcccccaccaccaccttcgtccaagatgtcaccctctgtcagagcatattcaccaccaccgcctccttattccaagatgtcacctagcgttcgagcttaccctcctccaccaccaccatcaccatctcccccaccgccttacgtatactcatctcctccaccgccctatgtgtactcatctcctcctccaccgccgtatgtgtattcatcccctcctccaccgccttacgtatactcatctcctccaccgccttacgtgtactcatctccacccccgccttacgtatactcatctccacctccgcctcctccaagtccaccaccaccgtgtcctgaatcatctccaccaccgcctgttgtatactacgcacccgtgacacaaagccctccaccaccatcaccggtatactatccaccagtaacacaaagccctccaccaccatcgccagtatactacccaccggtgacaaacagtccaccaccaccatcaccggtatactatcccccagtaacatacagtccaccaccaccatcaccagtttactatccccaagtaacaccaagtcctccaccaccatcgccgctatactatcccccagtaacaccaagtccaccaccaccatcaccagtttactatcccccagtaacaccaagtcctccaccaccatcaccagtttactatcccccagtaacaccaagtcctccaccaccatcaccagtttactatccatcggaaacacaaagtcctccaccacctactgagtactactattcaccaagccagtctccgccaccaacaaaagcatgtaaagaaggccatccaccacaagcaacaccaagttacgaaccacctccagaatattcatactcatcatcaccaccaccaccatctcctacgtcctactttccaccgatgccaagcgtctcatatgatgcatctcctcctcctcctccgtcttactactag

SEQ ID NO: 2684 - DNA, 927 bp, Arabidopsis thaliana
atggcggatatctcgggaaacggctatggcaacgccagagaagaagtagtaatggtgaatctcaaggatgaagtcgaacatcaacaagaaatggaagacattcataacccaagacccttgaagaaacaagactctctactctcagtctctgtccctttcttacaaaagttgatcgcggagtttcttggaacctactttttggtattcaccggttgtgcatcggtggttgtaaacatgcaaaacgacaatgtcgtgactcttccagggatcgctatcgtttggggactcaccattatggtcctcatttactctcttggtcacatctctggtgctcatatcaatccggccgttaccattgccttcgcctcttgtggccgtttccctctcaaacaggttccagcttatgtcatatcacaagtgataggatcaacgctcgcggctgcgacattacggttgttgttcggacttgatcacgacgtttgtagcggaaaacacgatgtgtttatcggatcatcaccagtgggatcagatcttcaggcgtttacgatggagtttatcgtcactttctatctaatgttcatcatttctggcgttgctaccgataatagagcgaaacttaacattgggaccaaatgctgcaatattcagatcggagaacttgctggattagcaataggatcaacggtgctacttaacgtgctaattgccgcaccggtatcgagtgcgtcgatgaatccaggaagaagtttaggacctgcactggtctatggttgctacaaaggaatttggatatacttagttgcgccaactcttggtgcgattgcgggtgcatgggtttataacacagttagatataccgataaaccattgcgagaaatcactaaaagtggttcatttctaaagaccgtgagaatcggtagcacttga

SEQ ID NO: 2685 - DNA, 1692 bp, Arabidopsis thaliana
atgaattccgatggacccaaatccggtaagaagagacgagagattcgtgctaaacttgtgaagaagttgacgagtgacgaagatggctcgggaaagctagtcaaggacaacaataagagtctaaagaggggaagagaaggcaaatctgatgttgatgagcctcttattaagaaaccagcttctactacgcctctagtgactcaaattgctaaaacttcagattcttatttgtcaaagacaagatttgatcagttcccactgtctcccttaacgttaaaaggaattgaggatgctggatttaagacaatgactgttgttcaggaggctactcttcctctcattctccaaggtaaagatatccttgcgaaggccaaaacaggcactgggaaaacagttgcatttttgcttccatcaattgaagctgttatcaaagctcctcctgcaagccgtgataataggcatcccccaattattgtgcttgtggtatgtcctactcgggaacttgcttgtcaagctgctgcagaagcaaacatcttgctcaagtatcacccatctattggtgttcaagttgtgattggaggcactaagcttcctacggagcaaaggcgcttgcaaaagagtccttgccagattctcgtggctacacccggaaggctcaaagaccatatcgacaacacttctggatttgcaacaaggttgatgggtgtgaaagtccttgtgcttgatgaagctgatcatctcttggacatgggtttccgaagggaaattgagaggataattgctgctgttcctaagcagagacaaacatttttattttccgccacagtatctgatgaggtccgccaaatatgccatgttgctctgaaacgggatcatgaattcgtcaactgtgttcaagagggtgctggggagacgcatcaaaaggtttcacaaatgtacatgattgcatcattagatagacatttctcgcttctatatggtcttctgaaaaaacacatcacagataatgtgggctataaggttattattttctgtacaactgctatggttacaagattggtggctgatctgcttggtaagctaagccttaacgtcagagagatccattctagaaaaccgcagagttacagaaccagagtttctgatgagttccgcaagtccaagagtattatccttgtgacatctgatgtatctgctcgtggtgttgattaccctgatgtgtccttagtcgtacagatgggattgccatcagacagggaacaatatatacatagacttggcagaactgggcggaaaggtaaggaaggagaaggtgtactattgttggcaccgtgggaagagtactttctatcttctgttaaggacttgcccatcacaaagtcttctttaccgccaatagaccatgaggctgtgaaaaaggtgcagaaagggcttatccaagtggaaatgacgaacaaggaggcggcatatcaggcatggttgggttactacaaatcgcagaagaagattgctagagacacgaccagactggtggagttagctaatgagtttagccgcagtatgggacttagcatccctccggctatccctgtaaatattcttggcaagatgggtctcaaaaacgttcctggtattagagtcgctccaggttttgacaagaaacctgcaaagagaaattatcgttcccgctag

SEQ ID NO: 2686 - DNA, 1563 bp, Arabidopsis thaliana
atgtccgccaagatttcaatattccaagctcttgtctttctattctaccggtttatcctccggcgatatcggaactctaaaccaaaataccaaaatggcccttcttctctcctccaatccgacctatcacgccacacattgatcttcaacgtagaaggagctcttctcaaatccgactctctcttcccttacttcatgttagtagcatttgaggcgggaggcgtaataaggtcatttctcctcttcattctctatccattgataagcttgatgagccatgagatgggtgtcaaagtgatggtaatggtgagcttcttcgggatcaaaaaagaaggttttcgagcggggagagcggttttgcctaaatactttctagaagatgtcggactcgagatgttcgaagtgttgaagagaggagggaagaaaatcggagtgagtgatgatcttcctcaagttatgatcgaagggttcttgagagattacttggagattgacgttgtggtcgggagagaaatgaaagtcgttggaggttattatctaggtatcatggaggataaaaccaaacatgatcttgtctttgatgagttagttcgtaaagagagactaaacaccggtcgtgttattggcatcacttccttcaatacatctcttcaccgatatctattctctcagttttgccaggaaatttatttcgtgaagaaatcagacaagcgaagctggcaaaccctaccacgaagccagtaccctaaaccattgattttccatgatggccgtctcgcgatcaaaccaaccctaatgaacactttggtcttgttcatgtggggtcctttcgcagccgcagccgcagcagccagactcttcgtctctctttgcatcccttactctttatcaatcccgatcctcgccttttccggttgcagactaaccgtcactaacgactacgtttcatctcaaaaacaaaaaccaagtcaacgcaaaggttgtctctttgtttgtaaccataggactttattggaccctctctatgttgcattcgctttgagaaagaaaaacatcaaaactgtaacgtatagtttgagtagggtatctgagattttggctccgatcaagacggtgagactgacccgtgatcgggtgagcgacggtcaagccatggagaaattgttaaccgaaggagatctcgttgtttgtcctgaaggaaccacttgtagagaaccttacctgcttaggtttagccctttgttcaccgaggttagtgatgtcatcgttcccgtggctgtgacggtacacgtgaccttcttctacggtacaacggcgagtggtcttaaggcacttgacccgcttttcttcctcttggatccttatcctacctacaccatccaatttctcgaccctgtctccggtgccacgtgccaagatcctgatggaaagttgaagtttgaggtggccaacaatgttcagagtgatattgggaaggcgttggatttcgagtgcacaagtctcactagaaaagacaagtatttgatcttggccggtaataatggagtagttaagaaaaattaa

SEQ ID NO: 2687 - DNA, 1623 bp, Arabidopsis thaliana
atgaagttttggtcacgaccattaacgtttcttataattattatctatctcataattcaacaagtcaactcatcaccaccgtcattatctataccggagcattttctccgatgcctcgacactcaaccatccgaccacggcagtcccaactcaagaaccgccgtgatcccaacaaactcatctttctcaacaaacctaatgaacggcgtcagaaacctccggttcgcttctgtctccacaagaaaaccagaagttatcgtcgccgccgtcaccgaaactcacataagagcaacaatctcttgctgcaaactcctaaacctcgagctaagaatccgaagcggaggccacgactacgaaggcttctcctacacttctccggtacctttcgtaatcttagacatgtacaacttcaacaaaatcgatatcaacatgaaagacgaaaccgtttggatccaatccggagcttcactaggtcagctttactataacattgcaagtaaaagcaaagtccacgcttttcccgccggagtttgtcctaaagtcggcgccggaggacatttcagcggcggaggattcggtaacctcatgagaaaatacggtttatccattgatcatataatcgacgctcaaatcatggacgccaacggtaaagtgtaccgtaaccgtcaagctatgggagaagacgtgttttgggctattcgcggcggaggcggcggaagctacggagtcattcttgcctggaagataaaactcgttagggttccggagaaagtcacagtttttaaactagaaagaacggtgagagaaggagccgttgatttagttcataaatggcaacaagtagctccggttatcgacagagatttgtttatccggttagagattaaaccaataaaccggaaaatctcaaaaggtaagacgattaaagtctccttcatcggaatgtttcttggtttacctgagagacttttaaacataacgaaacagagtttccctgagctacatttaacgaaagaagattgtatggtcaagaaatggatcgaatctagtgttttctgggcgaattatccagaaaaagcaccgatagagttacttctcaaaagagtatcaaccaacgaatactactggaaacgtacttcagattttgttcaagcaccaatctcaaaacagggtcttgcaaagatttttcaaacaatgattgatcattcgccacttccacgacgagtttggatgcaatggaatccatggggagggaaaatggctgagatagcgtctgatgcgacggcgtttgtgcatagaggtggtaatgttttcatgattgagcatttcatgaattggtatagacctggagatgagcttgaagagaagttcttggcgattgcaagaagttttaaagaagctatggctccgtttgtttccaagaatccgagagaagctttctttaattatagagatgtcgatatcggaattactacgccggggtataatgcgacgtatgaaggagctaaggtttatggggatagttatttcaaagggaattatttgagattggttaagattaaagcccggttcgaccggactaattttttccggtctcagcaagggattccggttcttgcttag

SEQ ID NO: 2688 - DNA, 390 bp, Arabidopsis thaliana
atgggttccaatgtttcatctgtgcatgatgttcattcatcaatggaaattaccagtaatggatttgttgtggaaatcgaatcaagaagacaatggaaatctctctttgattccatgaaaggctcaaacaaattgctagtaattgatttcacagctgtatggtgtggaccttgtaaagcaatggaacctagagttagggagattgcttcaaagtactcagaagctgtgtttgctagggttgatgtggataggctaatggatgtggctgggacatatagagctattacacttccagcttttgtttttgtgaagagaggagaagagattgatagggttgttggagccaaacctgatgagctcgtgaagaagattgaacaacatagggtttaa

SEQ ID NO: 2689 - DNA, 1302 bp, Arabidopsis thaliana
atgagtttgaaaataaagtttctgcttctgcttgtcttgtatcatcatgttgattctgcctctatcgtcaagtttcttcctggttttgaaggccctcttcctttcgaacttgaaaccgggtacattggtattggtgaggacgagaatgtgcaatttttctactatttcatcaaatctgaaaacaatccaaaagaagatcctcttcttatatggttaaatggaggacctggatgttcttgtcttggtggtattatttttgagaacggaccggtgggtttgaagtttgaggtgttcaacggaagtgctccttctttgttctctactacatattcatggacaaagatggcaaacattatattcttggatcagccagtaggatctggcttctcctactcaaaaactccaattgataaaactggtgacataagtgaagtaaagaggacccatgagtttcttcaaaagtggctaagcaggcatccacaatatttctccaaccctttatatgtagttggagattcttattccggtatgattgtcccggccctcgttcaagaaatctcacaaggaaattatatatgttgcgaacctcctataaatctacagggttatatgcttggaaaccctgtaacatatatggactttgaacaaaacttccgcattccatatgcttatggtatgggattaatctccgacgaaatctatgagccaatgaagagaatctgcaacggaaattattacaatgtggatccatctaacacacaatgtttgaaacttactgaagaatatcataagtgcactgccaaaataaatatccatcacatattaacaccagattgcgatgtaaccaatgtaacatctcctgattgttattattatccatatcatctcattgaatgttgggctaacgacgagagcgttcgcgaagctcttcatattgaaaagggtagtaaaggaaaatgggcgcgatgtaatcggactattccatacaatcacgacattgtaagcagcataccatatcacatgaataacagcatcagtggataccgatctcttatttacagtggtgatcacgacatcgcggtcccttttcttgcaactcaagcctggataagatctctcaattactcccccattcataactggaggccatggatgataaacaatcaaatcgctggatacacgagagcttattccaataagatgacatttgctactatcaaaggaggtggacacacggcagagtatagaccaaacgagacctttatcatgttccaaaggtggatcagtggccaacccctgtaa

SEQ ID NO: 2690 - DNA, 1491 bp, Arabidopsis thaliana
aaatgagtttgtggtatatcattgttgcattcgtcttcttttcatctatgatcattgtaaggatcattagaaagacaaagaagaatctaccacccggacccccaagacttcctataattggaaacttgcaccaactaggatcaaaacctcatcgttcgatgttcaaattatccgaaacatatggacctctaatgtccctaaagtttggaagcgtgtctactgtggtggcatctacaccagagacagtgaaggaagtcttaaaaacatttgacgtagaatgttgttcgcgaccaaatatgacctatcccgcaagagttacgtacaatttaaaagatctatgcttttctccttatagcaaatattggagggaggtacgaaagatgacagttgttgaactctacaccgcaaaaagggtgcaatcatttcaacatacaagaaaagaagaagttgcagccctcgttgatttcatcaaacaagctgcttcattggagaaaccagttaacttgaacaagaagttaatgaaactatcaggaagtgtgatttgtagagttgcatttggtatcaatcttcaaggaagtaaacttgagaatacttatgaggaagtcattcaaggaactgtggagttggtggggagttttgcagcagcagattactttccggttgttggtagaatcatcgataggatcacagggttacatagcaaatgtgagaagcttttcaaggcaatggatgcattttttgatcaatctataaagcatcacctagaagatgagattattaaagatgatataattgacttgcttctcaagatggaaaggggagagactacacttggggagtttcaacttactcgcgaccacaccaaaggaattcttgagaatattctcaacgctggaatagacacttctgcacaagttatgacatgggtgatgacatatttgatttcaaacccaagagttttgaagaaagcgcaggccgaggtgagagaagtgataaaacacaaagatgatatcatagaagaagatatagaacgactccaatatctgaaaatggtaattaaagaaacgtttaggataaacccacttgtgccacttctaattccaagagaggcttcaaaagatgtaaagatcggaggttataatattccaaagaaaacatggatccatgttaatatatgggctattcataggaatccaaacgtttggaaagatccagaagctttcattcccgagaggtttatggatagccagattgactataaagggttgaactttgagttgttgccgtttggtagcggaaggagaatatgccctggtattggaatgggtatggccttggttcacttgactcttatcaatcttctttatcgattcgattggaagcttccagaaggaatgaaggtagcagatgttgatcttgaagaatcatatggacttgtttgtcctaagaaaatcccacttcagcttatcccggtccttacccaatggactt

SEQ ID NO: 2691 - DNA, 1845 bp, Arabidopsis thaliana
atggattcagatttcggaatccccagagaactctcccctcttcagcaacttcgatctcagtacaaacctgagcttcctccttgtctccaggggactactgtccgcgtggagcttggtgatggaaccactgtggctgaagctgctgattcacataccatggctcgtgctttcccgcataccttaggccagcctttggctcacttcctcagggaaactgctcaagttcctgatgcgcacatcattaccgagcttccttcagttagagttggaattgtgttttgtggaaggcaagctccaggtggacataatgtgatctggggtcttttcgaggctctcaaggtgcacaacgcaaaaagcactttgctaggatttttgggtggttccgagggtctatttgcacaaaagactctagagattacagatgatatacttcagacttacaaaaaccaaggtggttatgatttgctcggaagaactaaggatcagatcaaaacaactgagcaggttaacgctgcactcaaagcttgcacagatttgaagttagatggccttgttatcattggaggcgtaatatcaaacacagatgcagctcatctcgctgaattttttgctgctgcaaaatgctcaactaaggtggttggtgttccagttactacaaatggagatctcaaaaatcagtttgtggaggcaaacgtgggttttgacaccatatgcaaggtgaactcacaactcattagcaatgcctgcactgatgccctttctgcagagaagtattattatttcatccgcctcatgggtcgtaagcactctcatgttgcccttgagtgtacactccagtctcatccaaacatggtgatactgggcgaggaggttgcagcatctaagctcacaatttttgacattgctaaacagatctgtgatgctgttcaagcaagagcagtagaagacaagaatcatggagtcatcctcattcctgaagggcttatagtcagtattcctgaagtctacgctctgttaaaggaaattcacgggctgctgaggcagggtgtatctgctgataagatttctactcagctctcaccttggtcatctgctttgtttgaatttcttcctccattcattaagaaacagctacttctccatcctgagtctgatgattctgctcagctatcccagattgagacagagaaacttcttgcgtatctcgtggagactgaaatgaacaagcgcttgaaagaaggcacatacaaggggaagaaattcaatgccatatgtcacttttttggttaccaagctcgtggatctcttccatcgaaattcgattgtgattacgcctacgttcttggacatatatgttaccacatccttgcagctggtctgaatggttacatggcaacagtgaccaacctaaaaagtcctgtgaacaagtggaaatgtggtgctacacctattacagcgatgatgacggtgaagcattggtcccaggatgctagttatactttaacttcaattggtagacctgcaattcatccagctatggtggatttgaaaggcaaagcatacgacctcttgagacagaatgcacaaaaattcttgatggaagatctgtacagaaacccaggaccgctacagtacgatggtcctggtgcggatgctaaagcagtgagtctctgtgttgaagatcaagattacatgggacgtatcaagaagctgcaggaatatcttgaccaagtgaggacgatagtgaaaccaggatgttctcaagacgtattgaaggcagcactgagtgtgatggcttcggtgactgatgttcttactactatttcttcaaatggtggtcaatga

SEQ ID NO: 2692 - DNA, 1443 bp, Arabidopsis thaliana
atggaggaatccaaaacacctcacgttgcgatcataccaagtccgggaatgggtcatctcataccactcgtcgagtttgctaaacgactcgtccatcttcacggcctcaccgttaccttcgtcatcgccggcgaaggtccaccatcaaaagctcagagaaccgtcctcgactctctcccttcttcaatctcctccgtctttctccctcctgttgatctcaccgatctctcttcgtccactcgcatcgaatctcggatctccctcaccgtgactcgttcaaacccggagctccggaaagtcttcgactcgttcgtggagggaggtcgtttgccaacggcgctcgtcgtcgatctcttcggtacggacgctttcgacgtggccgtagaatttcacgtgccaccgtatattttctacccaacaacggccaacgtcttgtcgttttttctccatttgcctaaactagacgaaacggtgtcgtgtgagttcagggaattaaccgaaccgcttatgcttcctggatgtgtaccggttgccgggaaagatttccttgacccggcccaagaccggaaagacgatgcatacaaatggcttctccataacaccaagaggtacaaagaagccgaaggtattcttgtgaataccttctttgagctagagccaaatgctataaaggccttgcaagaaccgggtcttgataaaccaccggtttatccggttggaccgttggttaacattggtaagcaagaggctaagcaaaccgaagagtctgaatgtttaaagtggttggataaccagccgctcggttcggttttatatgtgtcctttggtagtggcggtaccctcacatgtgagcagctcaatgagcttgctcttggtcttgcagatagtgagcaacggtttctttgggtcatacgaagtcctagtgggatcgctaattcgtcgtattttgattcacatagccaaacagatccattgacatttttaccaccgggatttttagagcggactaaaaaaagaggttttgtgatccctttttgggctccacaagcccaagtcttggcgcatccatccacgggaggatttttaactcattgtggatggaattcgactctagagagtgtagtaagcggtattccacttatagcatggccattatacgcagaacagaagatgaatgcggttttgttgagtgaagatattcgtgcggcacttaggccgcgtgccggggacgatgggttagttagaagagaagaggtggctagagtggtaaaaggattgatggaaggtgaagaaggcaaaggagtgaggaacaagatgaaggagttgaaggaagcagcttgtagggtgttgaaggatgatgggacttcgacaaaagcacttagtcttgtggccttaaagtggaaagcccacaaaaaagagttagagcaaaatggcaaccactaa

SEQ ID NO: 2693 - DNA, 993 bp, Arabidopsis thaliana
atggatattcgtagtgatgatgcaaaaaaacctatgatgatgtggttcttagggatgctgttgttttccatggtggccgagtcaaatgctcaactgtcagagaattactacgcctcgacatgtcctagcgtagagctcatcgttaagcaggcggttactacaaaattcaaacaaactgtcacaacggctcctgcaacgttgcggatgttctttcacgactgcttcgtcgagggatgtgatgcgtctgtgtttatagcatctgagaatgaagacgcagagaaagacgcagatgacaataaatctctcgccggagacggatttgacaccgtgattaaagctaaaaccgctgtagaatctcaatgtcccggagttgtgtcatgtgccgatatactagctctcgccgctagagacgtcgtcgtgctcgttggagggccagagtttaaggtggagctagggagacgagacgggctcgtgtcgaaagcgtctagagtgaccggcaagttacctgaaccagggcttgacgtgagaggtctagtccagatcttcgctagtaacgggctttcattgaccgacatgatcgctctttcaggcgcacatacaattggatcctctcactgcaaccgtttcgccaaccgtctccacaatttctcgacgttcatgccagtggaccctacgatggacccggtctacgctcagcagctgatacaagcctgctctgaccccaacccagatgctgtagtagacattgacctaacgtccagagataccttcgacaatagctactaccagaacctcgtggctcggaaaggacttttcacctccgatcaagctctgtttaacgatctctcgtctcaggctacggtggtcaggtttgctaacaacgctgaagaattctacagcgcttttagctctgctatgaggaatcttggccgcgttggggttaaggttgggaatcaaggcgagattcgaagggactgctctgcttttaactag

SEQ ID NO: 2694 - DNA, 957 bp, Arabidopsis thaliana
atgatgacgagtatggaagggatggtggagaaaggagtattggatgatattataagaagattgttagaaggtaaaggaggcaaacaggttcagctttccgagagcgagattcgtcaactctgctttaacgctcgtcaaatcttcctctctcaacctaatctccttgatctccatgccccaattcgcatctgcggtgatattcatggtcaatatcaagatcttttgaggttgtttgaatacggaggttatcctccttcagcaaactatctattccttggtgattacgttgacagaggcaaacaaagtcttgagaccatatgtttgcttcttgcttacaagatacggtacccatcgaagatatatctgttgagagggaaccatgaggatgctaagatcaacaggatttacgggttttatgacgagtgcaaacggagattcaatgtacgactctggaaggtgtttactgattgcttcaactgtttacctgtagctgcacttattgatgagaagatactgtgtatgcacggtggtttgtcaccagatttggataatttgaatcagattcgagagattcaaaggcctattgagattccagacagtggtcttctttgtgatttactttggtcagatcctgatcagaagattgaaggttgggctgatagtgatcgaggtatctcttgcacttttggagctgataaagtcgctgagttcttggataagaatgatcttgacctcatttgccgaggccatcaggtagtagaagacgggtatgagtttttcgcaaaacggagattagtcacgatattctcagctccaaactatggtggggagtttgacaacgctggtgcgttattaagcgttgacgagtctcttgtatgttcctttgagattatgaaaccagccccagcttcaagcagtcatcctctcaagaaggtaccgaagatggggaagtcttga

SEQ ID NO: 2695 - DNA, 804 bp, Arabidopsis thaliana
atggagggttattcaagaaacggtgaaatctctccgaagctgcttgacttgatgattccacaagagagaagaaattggtttcacgatgagaaaaactctgttttcaaaacagaggagaagaagcttgagctaaagcttggaccacctggtgaagaagatgatgatgaatcgatgataagacacatgaagaaagaaccaaaagacaaatctatcctctctctcgctggcaaatacttctctccttcttccaccaaaaccacatcccataaaagaactgctcctggtccagtggtgggatggcctccggttcgatccttcaggaagaatttagctagtggaagttcttcaaagcttggaaatgactcaaccacctccaatggtgttaccctcaagaaccaaaagtgtgatgctgctgctaagacaacagaaccaaagagacaaggaggcatgtttgtgaagatcaacatgtatggtgttcccattggtcgtaaagttgatctcagtgctcataatagctatgagcagttatctttcacagttgacaagctcttcagaggtcttcttgcagctcaaagagactttccatcatccatagaagatgaaaaaccaatcactggattattagatgggaatggagaatatactcttacatatgaagacaatgaaggagacaagatgcttgtaggagatgttccatggcaaatgtttgtgtcttcggtgaagaggctgcgtgtgattaaaacttctgagatttcttcagcattaacatatggaaatggtaagcaagagaaaatgagaagatga

SEQ ID NO: 2696 - DNA, 1014 bp, Arabidopsis thaliana
atggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtag

SEQ ID NO: 2697 - DNA, 5577 bp, Arabidopsis thaliana
atggctcaaagaagggaacctgatccgcctccaccgcagaggcggattctgcggactcagactgttggtagtctcggagaggctatgcttgatagtgaagttgttccctcttctttagttgagattgctccgattctacgtgtggctaatgaagttgaagctagtaatccacgagttgcttacctatgtcgtttctacgcatttgagaaggcgcataggcttgatccaacttcaagtggtcgtggtgttcgccagtttaagaccgcgcttcttcaacgattagaaagggagaatgaaacaactttggcaggaaggcaaaagagtgatgcacgtgaaatgcagagtttctatcaacactactacaagaaatacatccaagctttgctgaatgctgcggataaagctgaccgtgctcaacttacaaaggcctatcaaactgctgccgttctctttgaagtcttgaaggctgttaatcaaacagaagatgtggaagtggctgatgagattttggaaacgcacaataaggtggaagagaagacccagatttacgtgccttacaatatacttccccttgaccctgatagtcagaatcaggcaataatgagattgcctgagatacaagctgctgtagccgctcttagaaatacaaggggattaccatggacagcaggtcacaagaagaaactcgatgaagacattctagactggcttcagtctatgtttggttttcagaaagataatgttttgaatcaaagagagcacttgatcttgttacttgctaatgtccacatccgacaatttccaaaacctgaccaacaaccaaagttggatgatcgtgccttgaccatagtgatgaagaaacttttcagaaactacaaaaagtggtgcaaatacttgggtcggaaaagcagcctttggttgcctactattcagcaagaggtacagcagcgtaaactgctctacatgggactttatctattaatatggggagaagctgcaaacctgagattcatgccagaatgcctctgttatatatatcaccatatggctttcgagctttatggtatgttggccggtagtgttagtcccatgacaggggagcatgtaaagccagcgtatggtggtgaagatgaagctttcctgcagaaagttgtgactcctatataccagacaatatcaaaggaagcaaagagaagtagaggaggaaagtcaaagcattctgtgtggagaaactatgatgacttgaatgaatatttttggtcaattcgatgttttcgcttagggtggccaatgcgggctgatgctgatttcttttgtcagacagctgaagaacttcgacttgagagaagtgagataaaatcaaacagtggagatcggtggatgggcaaagtcaattttgtggagatacgctcgttctggcatatatttagaagttttgatagattgtggagcttttatatcctgtgtttgcaggcaatgattgttattgcatggaatggatccggagagttaagcgccatttttcagggtgatgtcttcctaaaggttttgagcgtcttcattacagcagctatactaaagcttgcacaagctgtccttgacatagccctcagctggaaggcaagacatagtatgtcactctatgtgaaactcagatacgtcatgaaggtaggtgcggctgcagtatgggttgtagtcatggcagttacttatgcgtacagctggaaaaacgcctccggtttttctcagaccataaagaattggtttgggggacacagccataattcaccttctcttttcatagtggcaattcttatctacttatccccgaacatgctttctgcgttgctgtttttgtttccattcattcggcgctatcttgaaaggtctgactataagataatgatgctgatgatgtggtggtctcagattaagccccttgttggtccaaccaaagatataatgcgaatccatatatccgtctacagctggcatgagtttttccctcacgccaagaataatttaggagtcgtcatcgcgctctggtcaccagttattctcgtttatttcatggacactcaaatatggtatgctatagtttcaactctggtcggaggtttaaatggagctttccgccgtcttggagagatccgaacacttggaatgttgaggtcgagatttcagtccataccaggggcctttaatgattgcttggtaccacaagataacagcgatgatacaaagaaaaagagatttagggcgaccttctctcgcaagtttgatcagctcccatctagtaaagacaaggaagcagcgcggtttgctcagatgtggaacaaaataatcagtagtttccgagaagaggacttgattagtgatagggaaatggaactattgcttgtgccatattggtctgaccctgatttggatcttatccggtggccaccttttctattggctagtaagatcccaatagctttggatatggctaaagacagcaatggaaaagaccgtgaactgaaaaagagattagctgttgacagctacatgacttgtgcagttagagagtgctatgcctcttttaagaatctcatcaattatttggtggtcggagaacgagaaggacaggtcataaacgacattttctccaagattgatgaacatattgagaaggaaacgctgataacagaattgaacctgagtgctcttcctgatctgtatggccagttcgttcggctaatcgaatatttgctagaaaacagggaggaggacaaggatcaaattgtaattgtcttgctgaacatgttagaattggtgactagagacatcatggaagaagaagtcccaagcgcaaatatttcagtcaacttcgattcccagtttattctcaaacggaagcttggaaagaaaaagcaaattaagaggcttcatcttttgcttactgtcaaggagtcagctatggatgttccatccaacttggaagctcgaaggcgtcttactttcttttcaaattcactattcatggacatgcctcctgcacccaagatccgcaacatgctttccttctcggtccttacaccatacttttcagaggatgttcttttctccatatttggcttagaacagcaaaatgaagatggagtttctatactcttttacttgcagaagatcttcccaggtttcacttttccatctctgagtccatggcttacatcagatgaatggacaaactttctggaacgagttaaatgtggcaacgaagaagaactaagagcaagagaggatttggaagaggagcttcgtctttgggcatcttacagaggccaaactctgactaaaactgtgcgaggaatgatgtattaccgaaaggctttggaacttcaggccttccttgatatggcaaaggatgaagaattattaaaaggctacaaggctctcgagttaaccagtgaagaagcatcaaagagcggagggtcactttgggcgcagtgtcaagcacttgcagatatgaagttcacctttgtggtttcttgtcaacaatacagtattcataagagatctggcgaccaacgtgctaaagacatattgagacttatgacgacgtatccgtctattcgtgtcgcctatatcgatgaggtagagcaaacacataaagaaagttataaggggacagaggagaaaatttattactcagcgcttgtaaaagctgctccacagaccaaaccaatggattcttctgaatctgttcaaacactagatcagctcatttatcggattaagcttccgggaccagctatactaggagagggaaagccggaaaatcagaaccatgctatcatatttacccgtggagaagggttgcagacgatagacatgaatcaggacaactacatggaggaagctttcaaaatgaggaacttgctgcaagagtttcttgaaaagcatggaggcgtaagatgtcctacgattcttggtcttagagagcatattttcactggaagagtacgattccattacggacatccagatatttttgatcgtctgtttcaccttaccagaggttttaattctactctgcgtgaaggaaatgtgactcatcatgaatatatacaagttggtaaagggagagatgtgggcctcaaccagatctcaatgtttgaggcaaaaatcgccaatggaaatggcgagcaaactttgagtcgcgacctttataggctaggacaccgatttgatttcttccggatgctgtcttgttatttcaccacaattgggttctacttcagtaccatgttaaccgtgcttacggtgtatgtgtttctttatggacggttatatctagtacttagtgggcttgaagaaggattgagtagccaacgagctttccgtaacaataagcctcttgaggcagctcttgcttctcaatcatttgtgcagattggttttttaatggctttgcctatgatgatggagattggacttgagagggggttccacaatgcattgattgagtttgtgctgatgcagttacaacttgcttccgtctttttcacgtttcagctcgggacaaaaacacattactacggaaggacattgtttcatggaggcgcagagtatagaggaactggtcgagggtttgtggtcttccacgcgaaatttgctgagaactataggttctattcccgtagtcactttgtgaagggcattgaacttatgattcttctactggtatatcagatctttggtcaatcatataggggtgtggttacttatattctgatcactgtttcgatatggttcatggtggtgacatggctctttgctcctttccttttcaatccgtctggttttgagtggcaaaagattgttgatgactggacagactggaacaaatggatttataaccgaggaggaattggtgtccctcctgagaagagttgggaatcttggtgggagaaagagttagaacatcttagacattcaggggttcgtggtatcacccttgagatctttttggccttgcgcttcttcatctttcaatatggacttgtgtatcatctcagtaccttcaaaggaaaaaatcagagcttttgggtttatggagcgtcatggtttgtgatcttattcattctactgattgtgaagggtttgggcgttggaaggcgaagattcagcacgaatttccagcttctattcagaatcataaagggtcttgtgttcctcacatttgtggcaattctcataactttcctcgcacttcctctgataacaatcaaagacttattcatctgcatgcttgccttcatgccaactggatggggaatgcttctcattgcacaagcgtgtaagcctctgatccaacagctagggatatggtcatcagttaggacgctagctcgaggctacgagatcgtgatgggcttgcttctgttcacaccagttgcgtttttggcctggtttccttttgtgtctgagttccagacaagaatgctctttaaccaagcctttagtagaggtctacaaatctctcgtattcttggtggtcaaagaaaagaccggtcttcaaaaaacaaggagtga

SEQ ID NO: 2698 - DNA, 1551 bp, Arabidopsis thaliana
atggcctttacgaacgtttgcctatggacgctactcgccttcatgctgacttggacagtgttctacgtcacaaacagggggaagaaggcgacgcagttggcggatgcggtggttgaagagcgagaagacggtgctactgacgttatcatcgttggggctggagtaggcggctcggctctcgcatatgctcttgctaaggacgggcgtcgagtccatgtaatagagagggacctgagagaaccagagagaatcatgggtgagtttatgcaaccaggaggacgactcatgctctctaagcttggtcttgaagattgtttggagggaatagatgcccaaaaagccacgggcatgacagtttataaggacggaaaagaagcagtcgcatcttttcccgtggacaacaacaattttccttttgatccttcggctcgatcttttcacaatggccgattcgtccaacgattgcggcaaaaggcttcttctcttcccaatgtgcgcctggaagaaggaacggtgaagtctttgatagaagaaaaaggagtgatcaaaggagtgacatacaaaaatagcgcaggcgaagaaacaacagccttggcacctctcactgtagtatgcgacggttgctactcaaaccttcgccggtctcttaatgacaacaatgcggaggttctgtcataccaagttggttttatctcaaagaactgtcagcttgaagaacccgaaaagttaaagttgataatgtctaaaccctccttcaccatgttgtatcaaatcagcagcaccgacgttcgttgtgtttttgaagttctccccaacaacattccttctatttcaaatggtgaaatggctactttcgtgaagaacactattgctcctcaggtacctttaaaactccgcaaaatatttttgaaagggattgatgaaggagaacatataaaagccatgccaacaaagaagatgacagctactttgagcgagaagaaaggagtgattttattgggagatgcattcaacatgcgtcatccagcaatcgcatctggaatgatggttttattatctgacattctcattctacgccgtcttctccagccattaagcaaccttggcaatgcgcaaaaaatctcacaagttatcaagtccttttatgatatccgcaagccaatgtcagcgacagttaacacgttaggaaatgcattctctcaagtgctagttgcatcgacggacgaagcaaaagaggcaatgagacaaggttgctatgattacctctctagtggtgggtttcgcacgtcagggatgatggctttgctaggcggcatgaaccctcgtccgatctctctcatctatcatctatgtgctatcactctatcctccattggccatctactctctccatttccctctccccttcgcatttggcatagccttcgactttttggtttggctatgaaaatgttggttccccatctcaaggctgaaggagttagccaaatgttgtttccagtcaacgccgccgcgtatagcaaaagctatatggctgcaacggctctctaa

SEQ ID NO: 2699 - DNA, 1200 bp, Arabidopsis thaliana
atgacgaccggagatctcgttaatatccatcctactgagcttaaattcccctttgagttgaagaaacaaagttcgtgttcgatgcaattgaccaacaagacaactactcaatgtgtcgcttttaaggttaaaacaaccaatcctcgcaaatactgtgttcgtcctaacactggtgttgtcttgcccggtgattcctgcaatgttacagtcaacaacacaaaagatgattgttgttttgtttcagtgacgatgcaagcccagaaagaggcaccacttgatatgcaatgcaaagacaagttccttgttcagactgttgttgtctctgatggtactacttccaaagaagtcctcgctgaaatgttcaacaaggaggctggtagagtgattgaggatttcaaactgcgagttgtttacattcctgctaatcctccttcacctgtccctgaaggttctgaagaaggcaactctcctatggcttccctcaacgatattgcctctcaatctgcctcactctttgatgacgtgtcaagaacgtttgaagaaacaagtgagaaatcttcagaggcatggtctatgatttccaaattgacggaggagaagacttctgctactcaacaaagtcagaagctccgtctcgaactggtacgcgttgaccccagtgcactaagaaatgctgaggaaagaaacaagcaagaagcagtcgggtggtcattccttgctcttgatgctgctggtgggtctgctcggttgcgtgattggctacttattgaaccggatataaacgccatgggcactagtttcaagataaacctaatgggtatctcgaaagctttgcgatctcttctcatcttgctgctccttaacataacattcttcttcggccatgttacaccaggagccaccgtcaagccatgccctccccctcccgcaaaacaagccaccacgaaatgtccaagagacacactcaaatttggagtgtgtgggagctggttaggtctggttagtgaggtcatcggtacaccaccgagccaggagtgttgctcgctcatcaaaggtttggctgactttgaagctgccgtttgtctgtgcactgcacttaaaaccagcattctcggagttgctcctgtcaaaattcccgttgctctcactctgcttctcaactcttgcggcaaaaatgttcctcagggattcgtctgctga

SEQ ID NO: 2700 - DNA, 6114 bp, Arabidopsis thaliana
atggattatgatgacagtgactttcaaaaccagaatctccatttagctggtgaagccaacaacaaatttccaccagttttacagccttatgctcttccaaagtttgattttgatgatacactcaacacgcatctgaggtttgatagtttaggtgaatctgaagcttttcttggtattgagggtaacgaagataataactggattgaggatttctctcgtggaagtagtggtatagtgtttagttcaggtgcaacggagtcctgtgccatttctaggcacaataatgtttggtctgaggctacttcgtcggaatctgttgcaatgcttttgaattcagttggacaggacgaagttattgtaagagaggatactatcaagaaatctgacacttctcatgaactaggctgcacaatggaaacagtagagcctggtcagacatcccatgaaagaagtctttccaaagaggaaacggtgaacttacaacccaacccctctgtggatgatactccaggagagtcctctgtggtaaagacagatgatggacaggagcaggttctggttaaagatgactcaccaacggctgtagaagaggcatctgtggaggaaaagaattccatcttgacttctaataccgcgacggtagaggctatagatactactgatcttggtaaaataggaactgagacgacggataatcttcttgaccaaacagaagagaaagccaatgtagaatcaaggatggaagatgattgtagcgatgggaatgtacagactattattacttgtagcggtgagttgaataatcagagcactttacttccagagacttccaatgatgaaaatgttatcagcgaccacattcaaagtagttataaccgcaatgatctaactgcagatgcacggtcaattttggttgaaggtcattctgatagccatatagactcagcttccgaagttgaaaaagtggaagctgaaaatattggcaaaactgcaaagcctgatttgaaggagatagagctatctgatgtcacagtactagaaagaggggaccaagctccctctactcttgaggtaggtggacaagatgtttctgggaccgaatgccaagatctccttgtcagcactgttcatactagcgtagctgttgaagcgtctttggaacttgctggggaattgacaactataacaaacagtgtttccattgagaagcccgagttgcttagtcatcaacatatggaagttattacaagtgaacatgagtctacttttcagatagagactgagacatatccgcagatacacgtatttgaaacttcagagagtgtttatatttcaacgatggactcaatggttgaagctagagaaggtggtgtgtctaagaagagtgacaatgaaggtagtgctcgcacttctaatctcgagcaaagcatggaactgcctgtcaatgccaatgatagagatcaagatgtcaagaactctcagatcctatctgaaagcgttgtgtctggttctgttggctatgtttcaggaggctctacttcagagttggcggagtcagaatctcaatctgacagcattccaacagacaagtcagagactatgattgacagttctctcaatctcgaagaattacaacctctaagtcaagatggagcacctgctgtcagtctcacatcttcaatagatttacatatggtaaagacatcctctgatgacagtgaccaaggcagttactctgaaaccaagaaggtttatggtgaacctgaaaatggtcaaaccgttccacctgtggatgcaagttgttcagggagtcagatggaccaagaagctaggaagcgtgctgaaggtactaagcaaagtacatactctgttgaaggctgtcctcgctctgaagggtcaaaggatgcagtagatgctgatggtgttggacaagttttgcagcagcagtctgaggaattaatttttgaagagaatgtagtaacagaagctgtaaaagctcctgagactctgtcagttctggacaaggataacaaaaatgaaatgcctattactagctccttgcctattcttgggagtgaagctggaaaagatggccaggaagaggataatactgctgcttctggtgggattatggcagctgggactcctgttacacaccccaaaggtgatgcaatcgtactaggagactcccgtgcttctacatgttctgagtcttctgtaaagtcttatgtaactgcaatagaagatgctgctactaatttaaagactcctcttgattctttccccactgttaagacttccgaacttcaatttaataacacagagacaaacagtgtcaaaaagccagaagatcagaatatttcgggttttatgtctgctggatctccggtcttgaatagaaatgagacctccagcagtgaaatgaacttaactcctgatcagctgaaagcagggaaaatttccaaagctgttatattttcacaagctacccttgtctccccgattgtggtgggatctccttcaacatctagcttagataaaacagctgcaaagtcttccaaagcaaaatctgagcggaaacccaggcgaacatctaaatctgtaggaaaagagacttctagaaaaggaactagtgtaaaaggggctacacctattgaacagtttcaaagtggaggcaaaacaaatgctgttaatcaaagtttggcttctcatattcagatcacacaatctactgagaaacagcgaagtcttcagagccctgctctaaaagcttttgggtccctttcaacccctacggcaagtctaccggatttgaactcttctgctctctcaagtattctgcgtcgacctttcacggacttgcaacaagtgcaactacgtgcacagatttttgtatacggggctctgatccaaggaacagcaccggatgaagcttatatgatatctgcatttggtggtgcagatggtgggaagggcagctgggagaaatcatggcgtacttgtgttgtaagggctcagaaatcgcttgttgctactcctgaaacgccactgcaatcacgtccagggaagacagagaccccttcagcaggtcacaccaatagcaaagagagttcagggacaaaccccatgattccactctcatcacctttatggagtttatcaacttccgtagatactttacaatcaagtagcgttcagagaggttcagctgctactcaccagccattgctttctgcatcgcatgctcaccaaactccaccaactcagaatattgttggacataataccccttggatgtcgcctctccctttccgtaacgcttggcttgcttctcagcaaaccagtggatttgatgttggttcccgtttccccgtctatccaatcactgaccctgtaaaattgactcccatgaaagaatcatccatgactctttctggcgcaaaacatgttcagagtggaacttctagcaatgtttccaaagtgacaccaacacttgagcctactagtacagttgtagcacctgctcaacattctacaagggtaaaatcaaggaaacggaagaagatgccagtctctgtggagtctggtccaaacattttgaattcgttaaagcagacagaattagctgcctcacctcttgtgccttttacacctactccggctaatctgggttataatgctggcaccctgcccagtgttgtttctatgactgcagtccctatggacctggtatctacgttccccgggaagaaaataaaatcatctttcccatctccaatttttggtggtaaccttgtacgtgaagtaaagcagagatctgtcttgtcagaggatactattgaaaaacttaaggaggctaagatgcatgcagaggatgcatctgctcttgctactgcagctgttagtcatagcgaatatgtatggaagcagatagagcaacaaagtcatgctggcctccagccagaaactcaagacagattagcttcggctgctgttgccatagctgctgcagctgcggtggcaaaagctgcagctgctgccgccaatgttgcagctaatgctgcattgcaggccaagttaatggctgaagaagcatcccttccaaatgcttctgatcagggactcccaaagtcatatgatagcatattacccggtcagggtacccctgcttctatcttgaagggtgaaggtgcagtggtgaactccagttcggttcttattgctgcgagagaggcatctaagaagagggttgaagctgctacagcggccaccaagcgtgctgaaaatatggactccattgtaaaagcagcagaattggcatcagaggctgtttctcaagctggaatacttgtttcaatgggtcatcctccgttgctcaataagctggtggaggcgggtccaagtaattactggaggcaggctcaagaatctcaggaagtacagccctgtaaaacggttgtcttagaaaaagaaactgtgtctactagtgagggaacttttgctggtcccaaaattgtgcagactgagtttggtggctctgtgaatacggcagatggtgtgtccggtccagttcctgccactggaaagttaaagggacaggagggtgataaatatgcagacttggctaaaaacaatgatgtggtttttgaaccagaagttgggtcaaaattttcaattgacgcccaacagactatcaaagcaacaaagaatgaggacatcaaggagggttctaatgtagaggttttcaaagaagaacctggattaagaaccgcatggtactctgccaatgtattgagcttagaggatgataaagcttacgtgttgttcagtgacctatctgtagaacaaggaacagacaagcttaaggagtgggtagccctcaaaggggaaggtgatcaggcccctaaaataagacctgctcgttctgttactgccttgccatatgaaggaaccaggaagagacgtagagctgctcttggggatcatatttggaaaattggggatagggtagactcgtgggtgcatgacagttggttggagggtgttatcacagagaagaacaagaaagatgaaaacacagtgactgtgcattttcctgcggaagaagaaactttgacgatcaaagcttggaatcttcgtccttctcttgtgtggaaagatggaaagtggattgaatgttctagttcaggagaaactatcagctcgtcacatgagggtgatactccaaaggagaagcgtcctagattaggaactcccgctcttgtggctgaagtaaaagacacgagtatgaagattgttgatgatccagacttggggaaaccgcctcagactggtgttcttaacctcggtgtttcagagaatacttttaacattggaaagagtaccagagaggagaacaaacccgatccactccgaatgaagagaaccggtttgcaaaagcaaggatcaaaagtgatttttggtgtccctaaacctggaaagaaaaggaagttcatggacgtgagcaaacactatgtttcagaggcaagcactaaaactcaggaaaggaaggaaccagttaagcctgtgagatcaattgtgccccaaaattctggaataggtagctggaaaatgccttctaaaactatctccatagagaaacagacaacaatatctaggcccaagactttcaaacctgcgcccaagcccaaagagaaaccgggtgctacggctaggataattccccgcaaggactcgcgtaatacaacagcatcagatatggaatctgatgagagtgcagaaaacaggggtcctggatctggtgtttcatttaagggaacagtagaagagcaaaccacatcatcctctcatgatactggttcgaagaatagttcctccttgagcactaataaagggagagtggctcctactgcaggaaggttagccaaaatcgaagaggacaaggcgttggctgaaaattcttcaaaaacatcagagggaatggagccacgtagatctatccgcaggatccagccaacttctagactactcgaaggtctgcaaacgtcgatgatgacctcgaagattccttcggtatcacacagcaaaagtcacctaagtcaaagcaaaaagtag

SEQ ID NO: 2701 - DNA, 2001 bp, Arabidopsis thaliana
atggcttccgtatctgcgtttaaatccgtttccgcaaatggaaagaattctatgtttgggaaattaggttacttggcgagacctttctgctcgaggcctgtggggaatgatgttattggtattgatttgggtactaccaattcttgtgtatctgtgatggagggaaagaccgctagggttattgagaatgcggaaggaagtcgaaccacaccatcggttgttgctatgaaccaaaaaggggaactccttgttggaacaccggctaaacgtcaggccgtgaccaatccaacaaacacgattttcggttctaaacgtttgattgggagacgttttgatgatccacagactcagaaggagatgaaaatggttccttacaagattgttaaggcacctaacggtgatgcttgggtcgaagccaatggacaaaagttttctcccagtcagattggagctaatgtcctcactaaaatgaaggaaacagctgaagcttacctcgggaaatctatcaacaaagctgttgttaccgttccagcttatttcaatgatgcacagagacaagccactaaggatgctgggaaaatcgctggtcttgatgtccagaggatcatcaacgaacctacagctgctgcactatcatatggtatgaacaacaaggaaggtgtcattgcagtgtttgatcttggaggtggaacctttgatgtttctatcttggaaatctcaagtggtgtttttgaggttaaagcaacaaatggagatacctttttgggaggagaagactttgacaacaccttgttggagtacttggttaatgagttcaaaagatcagataatattgatctgactaaagacaaccttgccctccagaggctgagagaagctgcagagaaggccaagattgagctctcatcgacaactcagaccgaaatcaacctgcctttcattacagcggatgcttcaggagctaagcacttgaacatcaccttaactaggtcaaagtttgaaggtttggtgggcaagttgattgagagaacaagatccccgtgccaaaactgcctgaaggatgctggagtcacaattaaggaagttgatgaggttcttcttgttggtggaatgacccgtgttcccaaagtgcaagagatagtttctgagatctttgggaagagtccttgtaaaggtgttaacccggatgaagcggttgccatgggagcagccattcaaggtggtatcctccgtggtgatgtgaaggatttgcttcttttggacgtggttcctctctcattgggtattgaaacattgggtgcagtcttcaccaagttgattccacgaaacaccactattcccacaaagaagtctcaggttttctccacagctgctgacaaccagatgcaagtgggaatcaaagttcttcagggagaacgtgaaatggcggctgacaacaaagtgcttggagaattcgaccttgttggcatcccaccggcacctagaggaatgccacagatcgaagttacattcgacattgatgcaaatggtattactactgtctcagcgaaagacaaagcaacaggtaaagagcagaatatcacaatcagatcttcaggtggtctctcagacgatgagattaacagaatggtgaaagaagctgagcttaacgcacagaaggatcaagagaagaagcaacttatcgaccttaggaacagtgctgatacaacaatttacagtgtagagaagagcttgagtgaatacagagagaagattccagctgagattgcctctgagatcgaaactgcagtgtctgatctcaggactgctatggctggtgaggatgtcgaggacatcaaggctaaggtcgaagctgcaaacaaggcagtgtcgaagatcggagaacacatgtctaagggatctggatcatctggttccgatggaagctctggtgagggtacaagtgggactgagcagacgcctgaagctgaattcgaggaggccagtggttcaaggaagtga

SEQ ID NO: 2702 - DNA, 606 bp, Arabidopsis thaliana
atggcaagaggtcgaaagctgacgatgagccagagcgagaggtacctaggaagcagctatagttacggtgacagtaacggaaactccgccaccgacgaatcagagctcacggaggaggacatctggtcacacgccgtcgatcacagcccggagatgctggaatctcatggagcgtggaacacacgcgatgctgtggtgaggaatgggcgcgtgggtggtggtttgtcgctggcgtttgaggacgcgtcatcttcgccgaggatcgtgcaccagatacgtggcggaggagaaggaggaggaggtggtggaggaggaggaagagttgagaggcagttggcgtcgtcggctccggtgaacgtgccggattggagtaagatataccgagtcaactcggttgagtcgatacacgagtctgatgaagaggaggaggaagattccgggatgatgatgccgccgcatgagtacttggcgaagagccaacagcgacggagcagaaaatctggcggcggtggctcggtgtttgaaggagttggaagaactcttaaaggacgagaattaaggcgcgttcgagacgcgatttggagccaaacagggttctacggctaa

SEQ ID NO: 2703 - DNA, 1962 bp, Arabidopsis thaliana
atgggtttaactcgaaatttcattttatggattcttttgtcatctctcttcacggcgattcaactaacgtcgtctcaacgcaacactccaccaccacgctctaaagacgccgatctctgcaacggcgtgttcgtttcctacacttacttaaccggtaccaagattaaaccaaacgacacgaagaaccagccgtaccggttcgaatcagagatcacggtcctaaacaacggccgcgacgagcttaaatcgtggcaagtctttgttaaattcgcccaccgcgagattcttgtttcagcgaccaacgctgttctctctgacggttctagcctcccggctagcgttgagaacgggacaatcttcgccgggtttccatcggcggatttgaagacggcgatcatgacggccggcgacgtaactcagatggaagcacgtgttgagctcgtgggtactcagtttggagttgctccgccgagtgttccgcttccgaagaacatcactcttgttaatgatggatggtcttgtcctaaacccactcaacaaggtagtaatgttctgcaagtatgttgcacaccgaatccgaacattacaacaagcaaaattggtcaaaagttccttcctaggcaagaaggagatctaaccataatgtacgatgtgaccagagcatatcagtcgagttactcagcgcaggtcactatcgagaatcataacctgcttggtcggcttgacaattgggatctaagttttatgtggatgaaagatgagtttctcttctcaaccaaaggagcttatccaagtgttgtcgattcgtcggattgcatcactggtcctcaagcaaaatactataaagatcttgacttctctaatgtcatgagctgtgcaagaaggccacacatcatagacctacccctgactaagtataacgataccaatgtcgggcgtatcccatactgctgcagaaatggaactattctgccacggtccatggatccagagaagtctaaatcggtttttcaaatagaagtttacaaaatgcctcctgatctcaacatctcctctataacacctccccagagctggcagattaaaggtaaccttaacccggattacaaatgtggccctcctcttcgtgtcagctcaagccagttccctgatacaagcggtttgccttcaaacaagagtgcatttgctagctggcaagtcgtctgcaacatcactcaaccaactcctcctaaatgctgcgtctcattctcttcttatttcaatgactcagtaatcccgtgtaagacctgcgcttgtggaggttgctctagcgacagagtggcgcgtacttgcagcacaacttctccagctcttcctcttccatatcaggctcttctaattccatttgacaaccgaaccaaacttaccaacgcttgggcagtgttaaaaaaccggaaagtcccggacccattaccttgtggagataactgtggagtcagcataaactggcacctagctacagactatcgaggcggatggactgctcgagtcacactcttcaactggggtgatactgatttcgtggattggtttaccgcggttgaactgagaaatgctgcacccggttttcagaaagcgtactcgtttaacggaagtatcatcgcggtcaacgggaagaacacaactgttttaatggaagggctccctggactgaactatctccttgcagagaaagacggaaaaaacccgagtgaagactttcggatacccgggaaacagcagtcggttatctccttcaccaagaaactgactcctggaatcaaagttggttccaaagatgggtttcccaccaaagtactcttcaacggccaggaatgttcactcccttctgtactacccacgagcaacagtcacaggaaacatgtatccacctttcttctcatcctgacaccatttttggctctactgtttcttcggatttaa

SEQ ID NO: 2704 - DNA, 2000 bp, Arabidopsis thaliana
ttctcttctttttcatccacaactatgttcttcacaacactttccatgtatgaatcagagaactcactaccctttttcacttggaagatctttgcagctggatcaaaagagtaagcaagcctatgcaagatccatatcgactttatggaatgttaacaatccacagaacaaacatatcaaacaaagcgactgtgacattttctttggaatgcaaagccttaagtggtacctttcctgtataatgtaactgcggcttgctatggctatccacagatgtctttggataaagttttggaagacgaggttgttgaagatacaggggaatcacaagtctttaacttgcttaatccagaatttgtagactttgatacttgtttagatcctatcacaaacgaacttccaacttccggtgactgaaaaaaagatgcaagtacaaaactttatcaaataataacatagctagcaacatgtatactatttgagtttttttagagtttctaagccaatcagaaggctctatttcgtacccactcgcagaaagagcgcgttgagcgagtgagagcgattctgtgggtaaacccctttccaattcatgactttttttatcgacgcacatctctccaaattctctatcgcgtgactcttttagtttttttccacaaaaccaaatgaaaccgaaccgaaatcagttttaatttcaaaaccaatgcaaaccaaaccgaatcagcaaatagtgtgaagcaacaattctggacagaaattttctcaacatcccaacaacgggaaaaagagaaaacaccacaactcaaaatcacaaaaaaaatatccaagaaaatcacaaaagcctttgacccttaaattgcactacaactcaaaaatcacagtaaactttcaaattgcaaaaatctcagaatcaaagccaaagaagattcctgaagatttctacttccatggcatccaatagatgaagaagaacatgaaaaacgaccgaaagagcttagctttactagttttagtaaaatttctcggcaacaaagtgacacataaaaaaagataccaaaaagaattgtagattccataagaacaaggacgatttgcaataattaaggtttatacagattagacttaccagttgaaatctgaaagcatgaatctcgttgtgagctcttcgtgtttgcctcgtccttttattatctttcttattttctcttctttgtgtgatttcaactcaccaacttttatattttactctgctgcttcgagatcaacgcattaaaagtaatggggtacatttagaatatttagattttaaggggttgaagttgtaattttgaagaagtggaagatcaataaaaaataatagaagaacagagacgacgaaacctgccggagaactgaggagagaaaaaaatccgtcgaaaatgggaatttgaattcgtcttctgttgatcatcgcttcacttctgcttccaggtcttcatcggaaccaatctcactttcactctctaatttctaatttgaaaatcgatcttatcaattgtgtgtgtgtgttttgttgcagagcttttactcagaagaagcttgatgatctcaaatctctctttgtttccctcgcttccaagtctcacagcaatgaccaatacgtctcgtaccctgttttccaggttttgacaaaaaaaaaaattgtgttctgttctcatctggtttttgtggttgatagttttgaattaagccttacacgatgtgtgtcggaatagtgtccaaatctcttgtttttctcaaactcgcaaaaactcaccaaaggaaactcaacaatttcactcgggagtgttgttcttcacttgtgttttttttgttggtatcaacgtgactgaaaagcatgggccatagaatgcgatgctatacagtatgtagagggagtaagactggcccgtgaatgcacataatgggccttaaactggcccatcaatgctttactctcctctctagctagcgaggag

SEQ ID NO: 2705 - DNA, 1620 bp, Arabidopsis thaliana
gagttttaaagttacattctttttcaatatcttctgttgtattacagatgaaatatcattgttcaggtgagtgattctttgattttctgttgtacaaatctattttagagagggaagatatatattaggctgtggaaaagccattgatgatcctttttgttgagaattcttttgtcattctggcgctcttgtgtttcaatcttttcttcttaataaaactcatcttgaagtgccaatttgatagtgtttaatctagtacatactctgttttctcattttgaattaatccgtagaaatattcacaacgaactctatcaatctctatcagagcctaagtcatgttcttttgagatacttttcattcagaccattcaagtagtctagaatgtgtacatgtcttaaaaatggctaaaaagattatgatcaatgtgacaaggtttgtgatgacattgatggcttttgactcattgggaatctaagctttggtattggagaagcaattatagttgttcatttatctcttccaagttccaagtcttctcgcaatgttattaaacctggtcaagaaagatcataaatgttttggttacaaaacagttacatgacaaaacaccgtcatttgaaaactactaatgggctgtattaaagcccatttacgtttttgttatggctaatcaaaaatcgggtcagattcaaagaccattggttcataactatttttcgtgtgtagttgagtttcaccgctgagaagaagaatctatggggaccctgacatccacacaggtgtcctgagaagaggaggcataacatttattacaccaattttatatttactaaaattagtgttttctaatcaaatattttactcataaagaagctcgtgaagtagtacttaacagtgttatttgtctcttgatctctctctttgattgcttcgaagttatcacttgcatattactactagactactaaatggtcccaccgactcttgtcttcatttccgatctgagtcggatctaatctcttcttcttcctcttgcttttgtgttcatctctctctctctcacccttgttaaatctgcatttaagagtctttcttcagctgagtgaaccaaaactatttaataattgttattcttttgacaagtcttctcttttttgttcaaagtcttcaacttttttttactatagagaactttttctctgtgtgtccactagaagcagcaactacaagagcttgaaaaaggtggatcatcattgggaatttaacaacaattttggtttgtgggttatcttcacttttctggtaaggtttggatcattatttcacttttctcttagattctctctctccttctaagtgaagtttggtacttttcaatcattgatggaagatttggtctttctttttgtttcttcaattatttgaaagcttcttcattttttaagtacacactactgtctacaagaatctgagtttgctcactaagagggtttagagaattacaaaaaggagaaagtgaaagtagctactagatctttcttcaagatattaatggctatggtttgattcaaatttacttgattttgtgtgaattaaggttcttgtgctgagcatta

SEQ ID NO: 2706 - DNA, 1557 bp, Arabidopsis thaliana
caacgtgatcggagctctgccctacttgaaagtcaatcgaaaggcgacttaagcagagcaggcttgatccttttcttacctgcaattctcattttgtaatctaaagttgtggtaatatccttttgtattgtgatataatttggtcaatgagttgatttttgtttcatatttgtgtcttctttttcttgtctcgcatgacaactattctaggtgtaacatatacctcatcaacgagtttggtcattgatcaatgatttgggttaagaaatcagagacagatatatcttaaaagacttcaaagtattataatcacaccaatctcacttatgacacttttcaagtctcacaacccaatccattatttttttgttgtcaaaagcattaagataaaatgcggctgtgatagtgactcactagctaatgcattgacaatgggagttcattagataaagaaaaaatacagtacagtgtaatgtttactatattaaatgttcggttctccggccaaatagatgtaaatctttgagtaattaaaaaaaaaaaatgttcactaactctggatttagttatatgggttgtcaaacttgtcattgcaacaacattcttataaattatagactataaaatataaatcatgatcaatattttattttacttacctatattaaattaaaatatccaaatttaaaaaattctaaacataaaattggaaaatttaaatcaaagtgacacctagttgtaaaattttaatagatttattttttaatgtcaaaaatgcaaacacaaaaaatattataatcatcttttttttttacatatattaaagtaataaattatgattggattcatatgtcaataatatatatgattgattaaaatcttctaaaccttttctattttgcactgtaaaaaaacattttctattataaacaaaaagaaattattgaacactttagatgatgtgttaacacattagtaaactaaatatcctaagacacttgatatttcatcataaaatgtaagaaaattgctaattcttgggggtgtttagcaattagcaatcttttataaatgttaagacacttgacagtaaacttaaatatcctaaagacacttgatattttataatttatgatgaaatatcacattttaatttgatacaaatattggaaccattttaattttataatatgtgacgacaaaaacagaccaaagccaaagaaaggagaaagagaaattagataagaagctagcgtccgaataatatgacacgtgtcaaattatccatcaatagccgtcattaaaaaagcaaaacgtgggacctaaacagcctatctcaaccaagtattgaaataaggaatgacaaaaatagcctcctacgtaaagacaccataaaggccaattcgggtactttctagaaactcaacatttgtttctattaaaaaaacaaatctctcaagcgcgtggctattcaatcgcgtccttttcgcgttcttttagatcttcaaatcaaaattcgttactctcttagattctcagggttttgtgttttttgga

SEQ ID NO: 2707 - DNA, 2000 bp, Arabidopsis thaliana
tagaccggttttaaaatacggtaattttttctttttatattcccccaaaattagccgcaaattaatcaccaccaactcattttcttcttggtaacgtttattattttttgtttctttatctattttaatttcacatttgcttaacttgtgtatcagtgtatatagtagttagcgtatacatgagtacaaacgaatacagaaactagagtcttattcaaaaatatgatgggcctttattattgtgaaggcccaagataaatcgcaatgatttgaggccgagccgacaggccttcatatgttttttaggtttcaggtttttctttcatcagatttcagtgtcttttttttttttttggcttccgtaagtgacgtcaaggtttaagtctttaagatatgaatgcaaaataaataatgataaaataagaaggatccgtactgggggtaagagaaaagaaggacaggcagagagttggtgggtcacactctatatgaataaatgaccgtacaaccaaacccacctgccactctttaatacctttaatcacacgtcagtttaaactttaaaccaaaaataaaattctttcttttgattttcataaacttgtctgttctcttttctataaatatcgctaatttttgtgtgtatttatttatatagaaaaatatggaaatagttggaaagtcgtactgaagaacattaataaaattattaaataagtatgtcgttttattttgtttttttttttctgtaaacatgccgtttagttaatgtaacattttcattaattaaaaacgaattagaaatatccaaaaacgcatggggacaagtgtgtcgtgaacaacttgtctagtgtgactccgaaattggtcgatgttttgtttctgcctcgatgtcttttatatccttgtatctatttgattttttttttctaagaaggaattatattgtacgtttgaaacatgcggataacgtttaggagacaagaagtgcttaaaacatttaaactaaccaaaatttatttgtaatgttgaggaacttacaattcttgtcgggcagataaactataaaaattaataacgtaaaaaaaaaaacgtttttatcaacaaaaaatacgttaaacagataacaaaacataaagttatcatggaaagaaattcattataatgaaataatcgacaaaaacgaagggcccgcgctgtactcgattgatatatcattcctgtactattctatttgacttcttggtcgtgtaatcttcaagaatattgaacttaaattagccgcagagatttcatccaaccatctgtaacctattgaccaatttactacaaaaacaaacaaaactcctaatttattagtactatatgtaaaatactttgaataaacttatcaagtctactgaaccaccaaccacatatatgtagaaggtttgcaaaacatttcctgtttctttcatctttgaccacaatgatgtaaggacaacttgttttaatcatactcgattttggttttaatcaaactcacggactatttcaattgattggttcaaactccactagctaaatatactatagtcaatattaatatacatcatgaaataaaatattttaaagacatttttttataaagtttaaagacataggtttaagtataaaaaaaaattattggtaatatataattaaagaaaaatggcaaataataatctcgtagttttcgttcacttgataaattctcttgtccatgtttaattttttatagtatatgatactaatattttttaattgtagtgtaacatagtatttgatttgtatactaaaataaatgtaaaatttatcgggctgttgtacctggcaagtacaccatatgtgtactctctcctcaatgctctcgtcataatctttccatgtcttcttctctctatatatattacttaactctttctcactctctctaattttaaatttatctatcattagtttaaaccgccggagaacaaaaa

SEQ ID NO: 2708 - DNA, 1013 bp, Arabidopsis thaliana
aaaattgaaaaggttccaattctttctggtttttttttagcttagtgtaatcatcattaaacagtattgaaattagttaataaaaaactttcacattactaagaaggcttgtttgtgtctcctaatctctcaaatctcaattttgtcccacgcacgcttggtactctctacaaagggaatacttgagggaggaattaaagtgtaaaatgaaagcttggggatctaattataatatcattgttcctacactcatttagatggattctgaatcaataataggtgaacaggtgggtataatatctgtggtgttgacatcattttacaattgatcaatttcaaaaatttggtgtacaactttttaaaggtttaacgttgtaagtatcgtaagaaggagaaagggagtgttataactcgtgctcatcatgtgtatagagacattaagtaggtgtggtttgttaaaaaaaagacaattgacttcgagtgggtgaccactaaaagcacactgcagtgagcagacgattcgaaccgttgattgttattaaaagaagcgtaaacaaacaaaacggagtcggacaaagaggtcagtgtccccaccaccactctcatagttgccacgtgggcgaatctgaaccatcacctcgtctcggtcgaattgcatgagactgtgattggagtattgttattaaaactttaatgtgaacatcaaaatcacatgtaacgttctaataagagatagagatagaaaaaagagatttggcgttagcgacaaggagaggccaggattggttataaatctcaaaaccaaagtgttaaccccatccaaaacccttatcctttttttctttttgttatatatcttctcttcacctttctttctcaaggctcaagattcttgattgctctgctgctccaaggtacctacctacctctgtctggattgactcactttttattactctttagatagtgatctcttattgtatatgtgtgtgtaattggatgaagggggatca

SEQ ID NO: 2709 - DNA, 2000 bp, Arabidopsis thaliana
aatttgcataatcacatatgtattaagcgtccgtttatgttcatctttaccaatcttaatcgtttcaaatcttccaatcaaggcatccatcattcaacaatataacaatttttttttatgtatccctatcttcttttttttgtaaaattttgtgtggccctatctatcaatagttcaatgccatacctatttaatcacactccgagatttggccaaagttgcaaattgccatatttttttgtatcattaacggtttaattttctattcattttgttaaaatatatggcaataatagcattggcaggtggaatacaataatacatcgtaaagacctcttagtctcgttagcggtaaaagcctccctttgatagagcgggtttgaaagacaatgcatgcgatgcgttgtaggatgttgtcttttcttgtgtgacagaagaaatagagaacacaacacatttgtctcgctattcatacatttgtccctcccaaatttctcaacttttttttgttatgatgtttctttcctcaaaatcatcgacactgattaggtgacagatatttcagaggtcaacctaggtttgtaaatctattattaatatatacaaattgtatcattataatagtaataataacggatttagattgttagtggatcaaaaacttttgacatccaaatgacgtttttggagttctgcaataatgttaatcccctcaaatgccgtaacacgaacggatttgcattttacttgagtagttttccattatcttttggcaaggaatttttttatcatttcactgctacagaattaattcagttttaagtatagtattattacttcaagttcttatttttcttttacttctacagcattaagtatagtacatattctcttcatatatctatgtaatttacttttgtcgtgaagcaacataggcaattataagctcacatgttcgtttaaacgtgttatgtgccatattcggtgggcgaagcaccacactatcaattatcaaatcaaaaattgattgtattatatatagaatgaattgttgatttattgttaatactcacaattagagaagtctgattcaagatacaatgctgactgtttgttggttacgatgttgattataatatagtaagattagtattgatttaaattaaaaagtatatactatatactaagattagtagtgagctaattttttatttaactattaactcaacaaataaattatcctccataatataaaaagaagtaatattgcatgcgtatgattttttctttaaattggctatatttatatactaacaactgtaatatttaattatctacatagccatagcttgcaggaatcatgtagctttggttataattaactttgtttatatgtgattcttatgcgtaccaatcataaacattttctaataatacggacaaaattaaagtcatcatgtataatgtattcatctgtatttgaagctattggaggtaacatggattatgaatattatagctaataatttatcataacttagataataactttttttaaaatgtactatgtcacctttagtttgaatcgccataatttaaacaatttttaaatagatctgtaaaataaaacttcctaattgttaacgaatttgggtatacgacatgcatatatataaagctcggggctaaatttataaaccacgaaacaattagggccgcaaaaaacttttaaaggtagaaattagttttgttatttatttttcaatttagatttacatattaaattccaaaaacaaatccttcaaaatcaaaattcgaatattcctttatatttattttcttccttcgtctccttcaaattcaatctttctccgtcattcagatttcgaggagacagagacagagaaaaggattcgtgtaaggaaaagcttttaaacttctctttctatttatccctcctttcttctatctctctctctctcgatatcgatacaagagag

SEQ ID NO: 2710 - DNA, 2000 bp, Arabidopsis thaliana
tgtcatattgaatatatggtttaaatatgttatatatagaggtggacaatccggtttacttggtttggtttttaggttttagaaagagtgaaaaccagtgttacattttcgttttgctataatgctagtttttttttttttttttttttttttaaaacctagtattaataatttctaataataatttgtgtgatacagactattcaatattataaatacctttcattcatatagataacattatgcatataaagttttgttaaattccagttgattgaggtcggcaacatttgaatactaatattttttatgtggtaacaagtaacaacaacaatttaacaacaactgataagatgttctttcgattatatgaagaaaacgtcgactccaaatacagagaaactatcaatataaaataacattattctcagtgtatacctatttgatagaagaccaatatatatcttggtagaagagatgatatgaaagtatcagattaagaaaagatttggtgtcggattaacgtcacatggtgttattttaaattgtatgccatttaataatcgtccattgtcaatgctgttaatataatacaaaaccaaatatatgttaactaacatagtccaggaaccgtttaatttgattaaaccaaatcatacgcacatgattgcgatgataaaccgaatctttaatattataaaaatcaatagatcgagtaaaacgttacattttaattattattattagctgatgctgtcctttatggacttttcttcttcgtttttttgttcttctacctaaaaccatgaaagagtggtttgcacataaatacataatgaatatagtatgaaaaaactgttacatttttttaattattttgaagctaattagtgaactcaataagttttctaatcataatttacctgttctctatcgtgacacaataaacaaagacagataagagttagttaaacgtgaaagaaggttagaattttggaaaatgaccaaatttgttattacttcaccaaattcggatcttgtcctcttgtcataaaatcatttcagatctgagttatttggtccaacgccaatactgaaaattaatgttattaaagtaaatcatatttattattttcaaccaatggggcctttcacaataacaaacaaagggccagctttaaagttttattgaaattttacatgccacataaattggttaaaatacattttcttcacgtttctcgctttttaagtccctttgaagtgggaatgatactcgcgtgacgaccaaactccatcgagcctctctctctctctctgtgatcagtttaatctactgaaagaaagaaagaaagaaagaaagatccgtattattaggtaagaatgagattcccttttacgtttcgattttgattcgtttgtgtttgattctcgatcgttttgcttcgatttagcttccttctgtttttacaagtctctcttgattagaaatgtttaggtttcaatgtttcatgatcatatttagaaaaaagtttcatggtgaccaaaaaagaaagaaaattttgatggctgagagatgtcagagtcttgttttgtttttttgataaattctctgtttgtgtgcttttaaaaagtcaaatataagaaattctttgaatcatttaaagccgtatttatgtccttttgacaagtcgatttaatgctttctagaagagagtttatcagatgttaagaagattcaaagttggattataacgaaaatttgtatacctcattagagatttttcaagtggtaaatactaatagaattcatgatcccgttttagatgtaagatttggttgtgtttatcagttttctattaatagccgatattattaaaaccttttgcttaatcttggatctgatttaatttgctttaaattggacttgaaagaaatctgaatttgatttgatcgtttctaggcttcgaagctgtctcaagattgttgtttaattaaac

SEQ ID NO: 2711 - DNA, 824 bp, Arabidopsis thaliana
tgttgtgcttggggagatttgaaatcagggttttgaggcaaaaggggttttaatttctgcgtcggacttcttttataaagtctaaacctaattgaggaacaaaggaattgctccggttctgtttggttacgagtttaaatgtatcctatccaagtttagagcctattcggaaaattattggcccaatttaggcccaaataaatagagaagaacgcttcgaatggaaaacccgataatacccttcttcgtctgcgtgcagatcacactgtttgatttctgaggagaatccattgtttccatttgaagaaaactctaactttctcgttgaagctttgagctctctacctctttatctccgggttagttttgatttggtgtggatcggtagtggaattttgctcttcgtcttgctatttcgtatgcgttgttgtttctcgattagcgaatcagatctttgttcttttgttagatttgataaatttcgatagattttaggtttggattgattgtgttattgaacttgaatgcttctggttgaatcatagatctagttttggctttgctttgttatgcattgtcgtgattgaaattcgaaaaagcaatggaagtgattacgaattgagattatgactttagaatcgatattaggatctaagaagattctgtggaaattgaaattgaaattttgaagaagattctgtggaatctaagaagtaaatgttgataatactgtttggtttcaagagttaagagtttagaagttggagatgtgtattgactgtggttggtttggtttgagataaagatgtgattgttttggtttg

SEQ ID NO: 2712 - DNA, 971 bp, Arabidopsis thaliana
gatctgcaattaacgcctttgggtatgtatttgctgagttttggttgaagtctaatgtttggctttagattagtagtgtgtttcttactctacaattgaaatatttttacgatgttggggaaaaataaagaagttaagaatacactatcctttcaccaattttattagctttagttctggttttggttctggttcctgatacaatgtcgtaatcgtcgtaggaaccttgttcagtttggttgtattagtactcaaacgtttcaaaaattgaaatcataaaagttcgaaatgtcatgtaacatcggaacaagaagatgtattagtactgtgctttctattgatgatcctcatcagtttggttggttcatatactgtagtttggttggttcatttttaattgccatttataaggtaatgaggagatttcgtcgatatgtgttgggattattgctttatttgccagagttttaaggtctcaattaacacaaactacacaaaattttaaactatagacggattagtcacaagattttatttggtgaaaatcacgtggacaaatacgattgtctttatatggtctaaatatcctgttttttgtttatttaatttaattagccttgaaatagttctgtctgggatgaaatttacgtgttgtcaaacaaaaaatccgtgccaaaaagatccaaactaaccagatttgagttctgttttaaataagatggaaataatcgctcattatatcataatctcaccacaaccagaactaatccaggtggatcaaaaatatattttgatacaagaccaaatcacaaaattcttccaagaaatgttatttgtatgtcggtacacaacatccgtccttgtcaactctcttcacgatcttattctttccaattatatatttcccaaaatatcttccagaaattttgaatttaactccgacgaccaaaagaaggaaactgaaaaagaca

SEQ ID NO: 2713 - DNA, 435 bp, Arabidopsis thaliana
ttgcaaagactacccaagtttttgttttttgagtcagaaagtgaaagacttggtggtagaatggatcctatatttgtttttcgtggatgtttttgtttttatttttgttgttgtgaagtaatttaatttacaagcttttcaaaaaaaatctttattcttatgcataatgaaaaattattgaagttttgaaagatttatcttgtattggacctctgattgccttacaacaaattatacatagttatcaaaatcctaatcaaaagagtaaaaaatctaatttatagagattttattatagttgtagtgttagttccatcgctaaatcccttgaacgacaacgtttattatttcttcttcggacgattgtttgaagaaatttaaaaacgacatctttttattacttcctcttcgaaagattgtttaccaacaagaaca

SEQ ID NO: 2714 - DNA, 558 bp, Arabidopsis thaliana
gaaaaacaatagcatattagcagaggagactgtttgggaattgtgtttgttttctgattatgtatcatgtttatttgttttcaatctctctcaacattttcaagattttgttgttcctttgtgtggaaaaaaaacaaatccgttgatgattttctcctcgcatctgtagatctactactaatcttgagacatgtaaaagcaaactgctagagcattgaaagggcaaactgctagaaaaaaaagagagaagaactcaacaccaatgatcggctatgctctaatctgaattctcaagtcaaaattgaaatcgccggtttgatcgaaccggatgtatttaacaaaataaacaaaataaacaaaaaaagaaggaaaaatagatcctcacgcgttaccgtagcgcgtatttttttcacaacaaaattcataagcagtgtgggtcccacaggtccactaagtttagtggtgggttgctccgtagctaatctcatctctcactctttttcttatccactatccatagaagaagaagaagaagactgttgacgacgacggcgatgg

SEQ ID NO: 2715 - DNA, 958 bp, Arabidopsis thaliana
aagagtagggtaagtttattcttctgtcaataaaaggcagtctagactcttgagactttgttgtcaaaacataaacgcgtttgacctcttagacgttttatgcgttttgatctgattgctgtttttgtatgatttcatcacgaagttgcactaaaacgtattgtagtatttcggagtatgaaacttgtcttgacatttgatgccaagattggaagctttgtactttccttcaaagaaacaatgctttgaattggatactcgattctttgccaataattggaaacaatttagtgtatgttggaattatcaacacttatcaccgatgtgtcctattttcttgcaatgattttgttgcatcacatgttatgttttttctttcattacttgcttagtttattggaacagaacagattcacttaaatccttataacaagaaccttcctcttttaaaatcgtgatcgaaagtagaaaacttatcaaacctaagtatatgctagacttgattgatcaaaaatacgaatctaattaaacccaaatcgccttcaaatttgatatttttctttagatttttctgtgtttgtacatcaattaaagttgggatccaaataacaaataaacatagatggcatttaagtaaataagtttgttatgtgtgtaaagaaaaaagcattacttatctgcgttccgtgttaaaacacgattctaacggagaaacaaaaacgcgtttacgctttttcaactatcatatcgacaaaacgccaagtggatgatggcggtttaaacgctatttaatgttgaaaaatcgcgtctatgtataattggagagacatgatgagagaaatatcactggaatctgaaccagacagtttctgatcttcttctccttagaggatctctcggagaagattcaaaaccaagaacaatctcagtctctatctctctctctgggtgcatttag

SEQ ID NO: 2716 - DNA, 2000 bp, Arabidopsis thaliana
ggtgaaattttataattgactgtttgggttgataagaatttacgatagaagtaggagttaaatcctagaatgacaatcaaaatataattatacaattaaatactaccacgagtgaaatcctataattgacgagtttgaatcgatattaatatgggatggtttactacgggtgatattttagaattgactggtttgggttgataataatttgcgatagaattaggagtgaaatcctagaatgacaattaaaatataattatacaattaaatactaccacgggtgaaatcctagaattgacgggcttgattcgatattaatatgggatggtgtactacgggtgatattttagaattgactggtttgagttgataataatttgcgatagaattaggagtgaaatcctacgatgacaattaaaatataattatacaattaaatactaccacgggtgaaatcctagaattgacgggtttgattcgatattaatatgggatggtgtactacgggtgaaatccgagaaacaacaatcaaaatacaattatacaatattaaacatttaacaaaataaacaaatacaacttaaaactttaaaatttgagttataaaatttcgtctcgcggtgaattatacatttaaatcaaacaatagcataaatttattaaatcatcctaaaaattatttaattattttttatttaataaaaatataggcccgcggtataccgcgggttaatatctagtaaccaatatttttacaggttaaatataaagaaataatttaagatcacaaatatattaaaacgtataaaaaatttcaaaagtatgatctcttaaatagaagttaaacaacattaagatgtgtaatcacataaatattttcaaaaacatgtaaaatgcattatatgaaatttccaagacaatgatttttatatctagacattgtaagcacgtaaatatttccaaaaacacgtgaaaaatataaaatgttgtcacgtaaaattattaaaacgttatgaaataattctaaaacattaaattgtaagtagataaataatactttagacattgtaaacacgtaaacgtttccaaaaacatgtaaatatatagaaaagcttgtaaaacacgtaaaatatctaaaagcttatgaagtttcaaaacttctaaacattttcaaaaaatttcataaatttatgaaaagttacaactgttcgataaattatatcacgttattatccactgatattctcaatagttagtacttttgcaatacatgtgttaggtttatatttttagaaaaaatcaaaatatttatttgtttaaacctttttgttgtttttattattcctcttagaaactaataaaatttcaaagttgtgttgaattgtttgactggctaagatattttctatttgcctacattaccaagtatagttcaaattcttaggaaaatatttctttttaaaattgtcttctatatttaagagattttcattaaaatgggatatataaggagatatcataagaattgtgaaattatatttgagaaaaaaatgaaaaacaaataaaataaataaaaagctgaaatctcactttgggctttgggccgaaacagataaaccaaaatcgtcatgtgaaatatgggcttaatattgatccaaatcaggtcggctaaattctgttattaattaagaaaaaccgccaatctcagattttttagcaaaccttttccacaatttccagacagttttagggttccgtcgttcttattcactctcgattcttcgcttagcttcgtcttcttcatcgaagatttatctctgtaagcttcaaaacctttttttttttttcgattcgattaatctgagattatttcctcactcgttttgattctgaatcagacaattcgctgtggatcttcggggcgggcgaatttcattgattttccattgaatctgcgaggttacatatccggatttgtgttatcggagctgaatttagga

SEQ ID NO: 2717 - DNA, 2000 bp, Arabidopsis thaliana
atttaagaaaaaaacaaacaaattggtatcttcatccatctaccatcatgcatgacaaatgaataaaagctgttgttatcatatgacgtctatagaatgcatattatatgtctcccttttattttatttccttgtcgtcattcttttattttattatactacattatatgcatttaaacatatattaaagacacacattatatgattcataaggtagaaacaattatttatcattcatcgggccaacaaattctatatccgcatgaaacacggaagtctaaatttaacaacgcaatgagtagactcttgtataaatgaatttcaacaaataattccatgtttcacctatcagagatttagaacaaaacacaaactgttgtaagaacagaaaaaaagtgttagttaaaatttgaattcaaatgtgacattacgtttaggctttatgaaactaattgtactttcatttcagatgagacatgacagcgatattcataaaagttttgctgaattaaattatgtgtatagtatgattttatataatcaaaggacatgagtttaaaatggaatttccttttcaagtgatgcatattggaatagttagtactgactttgcaatgttaatttacctaattaattagaacaacaaccaaacgcaagcactaataaacaaaagggtgtgttatctatataataacccatcttttgacctaaatttctgcattaattttctctttaataatttaacaagtgataaacaagtacacatggattaggttattatgtccaattcatgagcttgtctccgcttattgctcgctttaaaagctataacaatggaatctaattattgatatcatccatcttcttattatatacaaatacacaccaataataatgagaacaaagtataaagtgcgattcacacttgttccaactcattcttatgcacatataatagaaataacatataaacaaacacgcacatatacactaattttccataaaacgaaatttacaagtaaaaatgaaattttctttttcaacagtcaagttatttgaaaacattacgtcattcatattatatataattttttttggtgagatatctatcattgatgttatattacaacagtttaaaactatttaaccataaaagttacatgaatacatatacacgtcttagctattctagtaattttaatattttgaacaagcaaaataagtttttttaaaaatagaggaaaaatagagagaccacctgataaaacacttataatgggattctaaaggatagagatgagatgtcaaaagactcaatactacaataatggagcaatagttttctccacttggctaatataatatctaacacaaaaaaaacttcccacaatttttttttgtttttgctaaaggtaaacacatttccatattattactaaactttattttatacataaatgcaatgtgtatttaaaccaagaataatgttgtgctctaagattatgtaacgaaaaaaaaaatctagttatatatatatatatataatgatttatttctatataatatcttataacattgcaaaatattaatttataaacatataaaatattaaatcttgataaaccggaaataaatattattttgcaagtgagattacataatttgaagatttttttgtagagtgaatatgggaaaaatatatagagattctctctattggtaattggtatattatgagaaagatattgattttttttaattttaagtttgattaaagatattgtaaacatttatataattaaaaaaaaaagagaaggaaagaggaaggaggttgggttggtcgactttgctaagataagagaagagagactgactctctctctctctaactcttcattcttctctcttttaccttctctccaagaaatcttcactttctctctagaaaaaagttggaagctgactcgataaagactctctttttcttcttcttcctgcaa

SEQ ID NO: 2718 - DNA, 1919 bp, Arabidopsis thaliana
tgaatgtaaaaatagaaatatgtgtaccttatgagctttatgtgtatcaaaaacactgtgtaatgaaagacagatttgtgaattcctgtaatttgtcttggtgatcgaatgctcgtgtgagcttgaattctaagtgatgaaccttttgaacccaaatacacattacatctcatgcttcctacagaagaaacattgtaagctcatgactatttgttagatttctcaacaatcacattcacatactataaactccataacagaagaaacattgttagctcatgattatttgttagagttctcaactctatccaaatatgctttttgtttatatcaacttagataaatggttattgaaccacaccaagatacatgcattttacatttgagttttgatgaatattttctattcatcttttttccccctcatttttaccttctacattttttcatattgaacaaaaacaatcctgttaattttcttccctctcttttctagtaaaatcatttaaggattttttttgaaattagttgatgtctttcttatcacatttgttctatacttctactaatttttcttttgttcttttgcatactaatcttcacctacaaaatagagtactctctaaacagagtcttggaaagttttgtcttccttttatattctcaactataaagtttaaatgagacatagttctagaaaataacatctttgacattcaatggttcccttaattatatattgagctagaatttgaagaaaaatcaataccacattaatgtttacagattttaattcatatatggcttagtattctattattatatgattttctcaatttaattcattaaaatcaagtaatcagaatttcaaataatttattttatatttcaaaaaacttaaagaaaactttagatttgacatgtgacaaaattttcaccattctcttccaatataataaagaatggagctatcttcctaatcatatccacgtaagattgagatagaaacttgagctgcgtggggcatgcttaattttttctgtctcattgacccaaagatatatctgtattctagtggatacatacattatttactcattaccaactacaagtaaactcctttaattaatttttaaattctatatttggctcataaattattcctttttaaaatttatttttagttgatttttcattgcctactcaagatctaaaattttcctttacatataaaacctaaaagaaaacatataatgcagtttcaatccctctaccaaattttctgttgatactttcctcattaaggtaatcattcctctatcctctacttttcttatgtagcaaactttctctttctatcatgaattttggtttctccttagaatctttttggatcttgaatgcttctgatctgttttatttggatctttaaaaatatattcttcaccggaaatgccattgttttaatctcaatacatttcttaaggagatagaactagttctttgattgaaaaatctctgttttgttgccttagagatgaatgaagattttaatgaatgtaaacccaatgcgttaaaaaaggaaagatgtttttttttcttcttttgctatgagtttggtgtatatggtttgaatctttctttcataacgtattgttttctgagaaatctggtatgttttgttttcttgaatcttctagggttttccacatagctgattgatgaaaatgtcaatgaggtaaattaaaccaaccctttcttgtaacagttttcatgatttttgaaatggggttttaattggtttcttgttgtttctttatagcagcttgtgtggaaacctttgatgtttttttgtatgtggatgtgaattggtatactcgggtttattcgtaaaggaatgatcattcgattgaataaga

SEQ ID NO: 2719 - DNA, 713 bp, Arabidopsis thaliana
aataatacacgttgttgttgtctttttaagtttaatcggagaagagaaaaaagtttgaatttagtgtctgatgcgagtttaaaattcgggtgattgcaacagtcacgagtgcgatcccggtaggagtatcgcaatttctgcattaacatttacgtttgctaaggggtgggcattttaaccgaaccgaaccgatccgaaccaaccgaactcaaaccgacccaaactaaacccggattaacactaaaattattcggttaggcttcttctcaacccaaatagttcggtttaaaaactttcctatcacgacaataaattttgtttggtgtttacataaccgaattaatcgtaccgaatccgaacttaaaccgaaattcccaccgttaacctggctatactgaaactatatatatacgtatatatatatatatatatacatgcgatgttgacaaatgaacacaaaagtagataaactcaaaccggtagttattacattaactgtgtaataaagattcggtatatcccacccgcgaagaaaaggaatcatatcacgggttaacgaatccgggtcgggtacacggagcaatcataaagaagaaacaaaaactacgacgacaacttttttttggccttggttaaaaaattttcataagtgaacacagaagaagcggtggctctgagccggcgaaatctcctttctcatccctaaaattttc

SEQ ID NO: 2720 - DNA, 1214 bp, Arabidopsis thaliana
agtttctatatacatttcagtggtctataataaaagagtacttcacttgtcgatttttgattggttttaatatgttttatgtacgaaatattttcttatatataagtttgaaaacagaaaatagacatatgaaccccaataaagactaattaaagagagtactagagtagctcacttgtcgatttttgattggtttttattaaacacaaaatggataatatgatgagtttaaaaacagtctttctccatgctagtatgataatgatattgactgatcgatgaattcaaaggaatacatgttttagtttagttcatcaactttagcttaacgtacggttcttaaatcgaagccaaaattcaaataaatattaatatatatccaattttggtaatctctatcagattatagctttatgaaaataaaaaatttaacaatgattcaaattgctaaatgctaatatattggttaaagtgttattttctgcaaaagttcaaataatgttaagactatttctatgtagtttgatcatttcaatctcaaccacataaaaaacgacactatatattaattcgaagcccatatccattatcgaatatgatgaattgcttacaatcataaagtcaaagcccatatccattttataaatagagttagatatttatcttttttaggtcgcaacaccgcaatagatcttttccccaagtttcagacaaacataaagcagcagagaaaattttcaagtttcaaagagcttttccctcaccaagcaaaatttgggttagtgaaatctcaaattttgctatccaatttcgttaatccttcctttgttagagtcgatttcgttgtcctctgatctcatctcttgaatcaatcggctcctctaatcctttacctccttcacgtttcgtaattattcgatctgttttctgcagatttcgtgaatttaatttaatcgcctcctcgattttaatatttcgtgatttgatagaatctgttggaaatttcttgatgttgcgataatgggtcaaaaaatatatatgtgaagctgagatcagatttgtgtcgtattatgtcccaaagctatttaacaatgaatctgtgtttgctatttgcagatatttgtcagcaaaatctgcagctaaattgggacttgtcttgttagttcaaagattgaaacttttttggttaattgtttggcggaagaagatttaca

SEQ ID NO: 2721 - DNA, 2000 bp, Arabidopsis thaliana
ctttggtagagttcacctacaacattggttcgcatttgaaccgtgatttggccggttcaatttaaacgccggtttacgagttttaacctctggctgattaagtaaccaattttggcaaaatccaaagacgaaggcaaaactctctggctgatcaagaggattcgattaggctctttgaccttgtcaacaaagaccttttagaataaaagcattcaaagtatctatagaagctaaaaacattaaaagttacttatggaaaacgaattggcatgtcattgttccttgatgattgatgataaaaggtggaaaaaactcgaattttaaacttgtcttgtctcgacgctaaaatcttcatcccctgtagtcattcatcatgaaatattcgatcaggacacattattttcaaatttcaattatctaatatctctataaacttaaaatctattattattttcttatgttgattctccttttttccgtacgaaatgtcttcccactttcaaattggttttggagttttcatgctcttgagtctagtattcgtattactattgtgtattctgaatgtaaacgactagtgttcaggtcaatatatcaatgattattttctccattctcgttttgtttgatgcaaaaactaaagaacaaattctgtcaaaaatataagaatatatatcaatattgtgttgcactacataatattctttttactatgaatggccatctttttttaagaaaaaaatggacgaaaaaggcagagtttgtccaatgaaaactggataaatgacattagtaaatagcaaatgacatataatttatttataacttattaataggaaatttgcaaatgggtattttcttacaatttgtttcttttgttgtgtgtgtggtcaagatcttcttttaatacatgatcgagtgtagaaactctaattatatggcgatgatgaaatttgatagtggaagaacttttaaatatgataatttacaatgttgaattagatacaaatatcttaatttattaatggctgaaatgacttgatttattaattacataaaggtttaaatgcaaaagtaacctttgtgtacacatttgttttgaatagtttacaaagttactctaaaataatctgctttgtaatatgaaaatatcattttttggtaaagaatgatattgaaaacatgtttgcaaaacaacagacttacctgtcagatacatacacacatcaacttaaacatagtttgaccacactaaaaatgcctatgttcgttgacattcacgaacaaaagaaaaactatttacccataaattccgtgaaatttttgtctaactatgataaaaatccattattttggattaaaattcaaataaaatccaattgaaaacgctaccgaaactcaaaatgaaaaagacctacaaatatgttttggtttatataaacccatacatatgttacacggaaaaaaagaaaactactattacgtactggttttagacttttaggtttttaaccacatccaaattatccaaattgaatatgaaattttatgatttgatctatgtacacctttagttataataaagcatagtctcttttttttttattatgtttttatttcgtttttggaaactcatatgctgacgtaccaaataaatttgggatatataatccagtattgaaacaattattattataacaacagtggagtagtattttaatgcatttaatggaaaaaaagaaaacagagtaaacggataagcgtgtcgtggagaagaaggaccaaagcaaagtaaagaaagtcatatattcctgaaaatctataaaagacatttcgcatttatccacttcctcgattcaatcaaaactgcttcaagtaaaaagcctacgaaatagcatcggaccaaaagacaaactcaccgagtaaacatacgcaacctgtcgtgtaagtaaaaacaatttgatagtgatctctctatgtttggtggaggaagagggcct

SEQ ID NO: 2722 - DNA, 523 bp, Arabidopsis thaliana
tgattctatctttaccaagaaacacgaaccctaatttactacgaaattgagctcgcagattctctctatagtagcttcagagaagaaggaaacctatagaatcgtaccaaatccacttttcttcaacaaatccaaattctctaatctactagatctctaagaaaccactgcacgaaactcttgtttttagattttgatctaaagctgaggtattttgagtttgtttatcttctcccaaacttttcaatctcagacgtgggagattgaagaaactgatgctgtggtgtctggaaaggacccttataccctcactttgccgacgccggtttcacactcaaccgacactttctctttcaattaaccggtttagttttcattaaaccagaaaaatgattatcaattggtttaaatacatcctgagatattttaatttgaaccgttggattataaatttgtcaaaagagattggtaaagaagactttcatttgcttcgtctctccggttgttaccaccacacaacgcc

SEQ ID NO: 2723 - DNA, 2000 bp, Arabidopsis thaliana
tgatcaattacctgacacattgacagacgatcgatttttagacactgaaatatgggccgaaattttgaaggagtaatgtctggtaaagcaatgtttgataatgttatggactgctgcgcttgtagcagttagatttcattgggttataagatcgaattcaatatcccctaaaaagattgatgtaaactgtagctttgtagcagatcataaattatttcataaaacagctttcgacgggaaagtttataattttgatataggaaccggataataattgtatcagtaattcttaatcgggctttggatagtcccttcctttttagtgaattcgaatcgaaatgcaaaaataatgaggctgacgcgcttaattttctcaaatatccaaaaatggccaatttcaaaaggggttacctacagatttgtggcgcgtggtaataactcgcttatagtgcaagtggttattttgttttctaatagttaattatttaccatacaaattgtcttctaatgtgggcttactaaatactttacggccttttcgttttcaggcctagggagttaggcccattttacatctttcttgtcggtttcatttttaatgttcgtatattcgagctcttttctcgtctgtacaatgaacaaagttttactgagaacaataaagatactcaaatcattcatagggtgatcaattcgtataaacttaaattttgttcgaggattaaagtataatttataatgcctattaaggttctttgataatgctatgagcccaattttacgatcgtcgtattctatgctaccatcccattggacaagtacgatgccatattagactatttagttcaattgtctaatttaattccgaatttaaaaggccttaaataaataaatatagtaaggtttgggcgaaggttacaaatcatttcactctttcagaacacaaaatagcccaaaacatgtttcgacgagcaaacttaaaatttgtttatgaaaaccgttacgcgtataagagtaaaaaattgtcgtaactgggctagaaagagctaacgatttacagatcttaggtgcaaaattacttttcgaattccttaaactacagagataagtcgagggagagttaaaacttagaagcaccaaaaaaaaataaaaaaaaaataaaaaaacttaaaagcatcacgcgctagttgacaaaaaaaaaaaaaaaaaaaacatcacgcgcttactttttcgaactatacaaaaatagctaatttcgaaagggggttaaacctacagatttgaggtgcgtgctgataactcgcatatagtgcgcgtggttattttattttcaaacggatacaaatatcgctagtgtgggctttcttaataccggtctttttattttttgggcttaggcccagtttacacgtgtcttatcattttatttttttatgtttttctatgcattaaaaaattccttatggcaaggacaataacaaaaaaaattcattaaagatcacatagtattgtaaatgtgagattaaacatgaaaattttattttccaaaattactgctttttaatgcataagattatacttttacggtactaatgtacaaatattttccttgaaaaatcatttactaaaaataattaaataaattcgtacgtcttttctttttggtcggaattagtacgtcttttctttcttttttggtggctatttattttgttcatattagatcaaacttaggagaaatataaatatatatagatatcaaataaaaagtaagaaacataaaaatattagaagtcaaaataaagaaaagaaaaaatacaacgcgaaggtttgattaccactcaaaaaacgagcagctgtttatcttccaacaaagcttcttcgtgcatcttcgctcttctcaactcgtcatcctctccctctgattctcttaagtcgccttgaaaaattaagacaaaacaacaacaaaagaacaagagaagctctaaaatccagcagct

SEQ ID NO: 2724 - DNA, 1301 bp, Arabidopsis thaliana
attgctttttatcatttgatctttggcttttgtctctcccatacaattggagttgtttctttgctattcgttttctccctgggaatttggattcctccacataactgcgtttgtgttattttaaaccttcgtttttaaaccacaaaggaaaaacctatctgctttgttcttttgatttagttgcgtgttctagcttgttcgatctagtgttcacggaagatgaatttgattaccaataaggccaatgctggtgatccccctctttggccttttgactgttggtggttgttgcttctagtcattttttttaccagtttttcaagctctattttatggtaaaaaggtgtcctggtaaaaatggatgaatgggtctcattctcagcagacaatgtttgaatgagaaagaaatacattttaaactttttatacactttgcttctagattgattgggactagtcgaatagaaatcttagtagaggtctaaggaaacatgatacacatcttgtttggttgaaatcttaccattgtttttggtttcagttattgatctggtttttggactactttttctgcaactatttgagaatgagaaattacttaccaaaaaaaagaaagtcttcatctacgccaaggatttagaatattcgtacatgaattttgatttccagtacattgcgtcatgaactatatagtctacttgtttttttttgtatctatttgacatgcagcaaagccagcaacacatcttttattgagtctgatgatatttgtgaactaattcgaaaatatttaaaagattcgagtgtatgaaaggtttaactattatcaaaatctctagatatttcaactgatggcaacactcaacaatctcacaatcacgacataaaaatccaataacacttgaaaccaaaagagggttcaaattagggtttcttgttaaatcgaaattggacttttatttatttattaacatctgacttttgagttttgaccaaaaaaaaagatggaaaatatcgctttgaaattgaggacccaaaggaaacgtaaatatgccgaccaatcaaccatataccaaaaattgatatgtggctatgtccccaccaccaccacctatcatatcacaagttctctctacttttctccgaattttaccacccaatcaaaacgcttctctcttcttctacttcttcacttctctctccttcaacaaaattttctacctttgtttcttctctcagatttcataaagaaaagatttaatctttcattggaatctgtgagtaacagaggataagcgaat

SEQ ID NO: 2725 - DNA, 820 bp, Arabidopsis thaliana
tttctacacttttcaattcattatctagctctcgctctcatctatatacacaccgatggaagtactttgaggatcgagttagtgtcgggagaagaacacgtggctaatcactgtgcttctcacgtgtccccagagcaacagaagcaaaggctgattcagagattcttgtgctaaaaaaaagtgactctagtcttcttatcatcatcaactctaagaaagaaaataaagggcccgaaccttataagcccagcccatatgttcaaaatgttgcaagtgttgtatctactatagactacggactaccacctgtaccgctcttccgagttcgcaagtttctttcgtcgaaaatacgtaggagagaccatcagaccaatatgtactaatgtcgatatggttgaagctttttggtattctcatatcaaatggaaaatgaatttgcaattaagacctgatgcaagatttcagacttttcggtattctcatatataatggaagcatatgattcgttgaatccgattctttccacaaaaccaactgttctctaatgcgtttttcccggggataaattcatataacttcaaatcccaaaaagaattaaattaaacacgtcggcagatacgaagaagcaatatcttcttttaatgtgaggaaaacgagtagatacagagattcaatttcgaacacgtattacccataaaaacgacctctctctatcattaagacaaaaaagcttcacactttccttagcccattataaacgcttcatttctatataaacatctcttatcttgttgaaaatctctcgcagcttttgaaaaac

SEQ ID NO: 2726 - DNA, 2000 bp, Arabidopsis thaliana
tataacaacatacgaatatgatctttgattagattactcttttatatattatggttaggcatgtccttgcaagatttttgtatttaacatattgaaaatttatcattgaattacaactctgttatgcatacaatcaaatcaaacgtttaagaagaccatcccttatatatatttatatacaccctatattctcgggatgtaataaagtttccatttcaaataaaaagagcccttaaagggaggtaagtggggggcatgaaaaaagggtttatatatctcaataatcatccaaacaaaccaatccatgtgcttcccttcaaacattcttcttgtcattttcctcccaaccattttctactttggccaactttttttcttttgcttcttaaaaataaaaataaaaatatgcaaatttccactcacacattatacattctctttttacaatccttagattgtcacttttgccttcttcctcttgttctcttaccactttactcctgattctcttcctttcggaatttcatcgaactactcaacaaccctatatacttttattgtttttaaagtattctcatgcagattaaataataagaaataatatacacctttttcctccttatataaataggctcaacacacgtaacatggccccaaaccctagcaagactctctctaagactcatatcattacgtcatgagttcaatagcaagagaccgaaaggaacaaatggtgatccattcttcaatcgtcttgcttcaagaaagattcagacaacttcagagagcaagagagttaagagctgaacgagagctcctaaaccctaaacctaaccaccaagacaacatcttgcaatattacagcgaacccactagtttcggtttctttcagtttctacctataaactctcaaacatcttcgtcacagcagctcctatccctctccttatgctcacactccacctctgaatccattgaaaagccaagcttttgtcatcagtggccaaataaagatgacaagaagatgggtgggattgatcgatacgacgatgttgacacgtctctgcatctctaaaactaaaataattgttcctccatctttttgaagttctaattaaatatgtatgtatatagagtttgttttcgtcggtatgctcttctaaagagtcttctaggtggtggtgatatatgtatggttaaaatggcaatcatatatattaattatttcgaagttaatgattatgatatattttatatcacgatgataaagatcgatctactcattgatttattggttattcttttgttgatggttaattggttactatatcattcctcaagtctttgcttatacgtatccatgtaatgtttagctttttatatatacgtaactacttctacctcaacttcaccaacgaaggcatggtaaataactaaagatgtcggagtggttaagaagacagacttgaaatttgatttcagttgggctccgcttgcgcatgttgaaaactctgcttttgcagctttgcttcttattgtttttgacgatttttcttaaagatagtaaataattgatcatacaagtcgtgccaaaaaatcgtcaatcaaagttcaaaacctacttgcatcgtatttgattcagtactcttatatatgtgtcagtaataattgagatagagaaagatagaactaaaatgtcgacactcaatcatagatagatttttaagagaataaaactcgagtactattcaatactatatcgtgcatgttgttagatctgctattttcgatcgtttggagcttgattgacttaaatgggctcattcgggtctgttatgagaaagcccaaccaagaaagtttatgggtcaaagagaaaagcctctagacgaaagagaggatctcagcttctgttgaaatgaatataacctagaaattgattttgatcggaagaagaagaaagaagatagaatcagagatttgtagattttatcgatcgaag

SEQ ID NO: 2727 - DNA, 998 bp, Arabidopsis thaliana
tttgttttgttatgctgaatttatctttcactgttgtttgttgttgtgatttccactaccacttgcttcctaacgctcttaccatttatatagcaatttttagtatctttcaaaagtatatgaaaaatggtttattgtttatgtaagtttatgtgatgattgcatgcgttgtggtgtcgagaagttcatggatattattgaatcaattgtattttgttctgaattttgtttttatgaatgaaaaattaataaataagattgatatatagtacaaatgttacattcgttaatttatttactgccatcgttaatgaggtttaaaatatactatcacttttggcatatacaattcatacatgtaagttattagattgtaatacggcgacatactaattaccatccatcctacaagccgtggttggtgatacttcaaagctatttctcaatattattcccaaaaagtattaaagtatgtgcgaagctaaaaaaaaatttgtgggagtggaaaagagaaaagggagtgtcttaccactctacaccaacccaccgagagaaagtgtccactcaatgattgactatagatttgtgtgcattgtgacagttggcgcaggctatgaagctctttgaaaaagctacgagaccatggcgtcatctatgacgtagttggcttgcctaacattacagttgcattcttattataaaatcaaaacgtaaatatacaaccaaattttctacaatcatagattcaatttcagcgtctactgccagccagtcttaactcatgcaaatcaacccaataattttttgttattcattcatggaccattagtatattttcaaaggcccaataaaattaaaaccttggtttctgacgggcccaatatttagagattcttatcttcaccgactgaaacttgtttatgcggttcccgatttatcaatgcggcaaatctatctttctttattttaataaacggaaaaacgaaaagtgaagaaaa

SEQ ID NO: 2728 - DNA, 398 bp, Arabidopsis thaliana
catgatgaatataatgttatcattaaatgaaacgacagcgtttggggtttctcactcattacacgacgtcgtttagttgtacttttgtgtggcttttatcaaattataaatcaacggtcaagattgacgcacgctttagtatttttttcattaacaatttaagatcaacggctaatacatcgccaattactagctaataatggcccagtagtgtgaactgtgaagagagtgaactgatttttttttttttaaagttctctctcagatttaacaaaatcgagccgacactttcccaattgaactgaatctactgaaatcgattcacgagagctcagatttggtgttagcatcactcactaagcaagattattgagttgtaattagtatttgagatcaag

SEQ ID NO: 2729 - DNA, 2000 bp, Arabidopsis thaliana
catctcacacctacgtttttatttcttttttcaacgcttactaattacataaatcatttactaaaccaagtgtagttcaaatttagactttataaaactaaaaacaatttaaatttttggttattttaagacaaaataatgtatttggataatctatattttaaacatttgtttttttcttagctaagctttggcatataatttgtttcagaaaaatatactattacatttacttttctgtgtattttaaatattctactatgcgatatgagatcttcgtattcgacttaaaactcaataacgatctcctatacatttattttattcttaaaaccaaaatgaaagaaagattaaatttgcccaaattattattattattattattattatttaatttgcccaaattagtaactagctaaaaaaagaaaaccaatgaggcaacgaaagagtaattcgctctttttccttagaggctgcaattgttgtggactttataacttataaggtatgaaataattgtgcactacacagctgtgattatgcttttattgcctcaaaaaggcaacacaccacaaactcctttatacttagttttgtgcaagctcacttagtaacatatatatgtatattctgttcttttttgtaatggttttaattttacttggcaatgtcattatcagtttttgacttattttggtaaaatgaaagtcgcgagttgtagtacccataacaaccgcaccgtcttttacatgagaaaaatccatgcatcttaatttaatattgcttatcgatgccatgcatctaaatgtcttaaactcatcttaaattcgcgagttgggttcaattttcttctatttgttactctttccctttcccaaaaatcattttaaattaatattcttcaaataaatgtcattttatgacttttaggtttgtgaaagaaaaaaatgactttagactttaataaatttacaattacaaaagattgtttatcagtgccatgcatctatactaatatacctcggaacaaatgaaatagttatgatgtacctttaaaaccttcaatttcactcaacgtctagccctttacagatatgctcacaaattgtcctcaaaattataatcacaagtaccattttcttctattttttgtttttggtagaaaccattttcttatactttgagataggaaaaaacatatattcaatctttttattaatgacttgtttttacttgaagcatcaataaggcttgtggaaatccatctttctttgtgaggattaaaatattatacatctatcaaccactttaagcatctatgacgcatttgtttctttagaggacataattaggtcatttagtggctgatgtgtagaatattcatctaaaatctgtcgtttaacaaaatggcttttattttattttataaaatgattgcagtttacgtctctctttttaatagcaaagcctgcatgttcttcgatacaattatgggtcaataatatacgattatttaaccaaaacgtctgtacagtgtacacagagcgccgaaaagcccatttaaatttatttttaaaggttataaccaaaccaagatccaagaaaatagtgtaagatcagtaatttaaacttaatcaggcattttacatagttagaacattctgagtaaataagtctacactagttaaatgttaatccacaactaacaaaaaataaatccattaataaactatgactaagacggactaaaatcgaataaactagcgataaattaacaccaataattaaagtgattaaggaagaatactagttagcaaaccattcgttccaataattcacaagacaagtgtcttctagctagagtccacaccttccaactaagcttttgccaaaaaaaacttatcttaatttactttctcttatccaaagttctttgtttaccattaaaaaaaaagaaccattctttcaccaagttcttgtaaaacaaaacaaaagaaaac

SEQ ID NO: 2730 - DNA, 1651 bp, Arabidopsis thaliana
aaatatttctatgttcgtctgaaaagaaaaggaaaaaagaagaaatagcagagagctcaggactttttttgggtctaattttttttttttttttaatgttacattaataagttggttttttttttaaattgggtttgtttatgtcaaaagcaaagagacttgtgatatttccaatctttgtctaatgatcctacttctttacttcgttgttttgatctctagtgtttagagtgaaagagagatgtaagtaatttctctagaccaactacattgttgaataataatttcttataatcagccaaacgcttgtttttaaggtctctttacgaatatcttataatgacactgcatacattaagttggtttaagatgaatacaaaactctaagcatgcacattgaaagtactcgtacgttaaaacttaggattaaggatgagtttattatctgcttaggcttaaattgtctttgttctgggttacttattgaacttctaatataaccgcatctttcttgaatgactctgcctctctttcaaaattatttgtttcagcatcactgtaacatttattgtaaaaatagtttttttgggtttgaataaatttaactttcaactcaaaaaaaaagaaaaactcgatattatatatagaaaacggaaatgtgaaacataaggagaagtaaaaagcacggttacgtttgtgtttgtttacaatttacaaacacgtctaacttggaaaaactaaaataaatgtacttttttttttttggtctaaaataaatgtacttttttcttaaacatgaacttattttttgtaacagttgagtggttgaatgaatcattaatttaagttatctttagtttctcaatcgataatatatacctactcaaacctttatacaatactataagatataaaatactcctactccttcccaattctcaaaactgcttaaactttcataatcatctaactcttgtaatttatataatctagtcattagattcatcagtatattctcaatattacaaaggctaaatatcttatgctacattatccaagcaattcgcagaaaacaataaaaataaaattgtcaaacatcataagcctagtagagaagtagaagttgacattccaaattcgtccaatctctacctcaactagatttaaaactttttatcctaaggtaagtaaaatacacaaaagtagagcaaaatacgatccttgaattaattcaggttgtgtaaccgttcaatcttttctaacgctgtgacacatatttgaacccaactaactcaaatttttttattttaaatataatttataaatgtggaaaaaaataataaatttataaataaaaatatatgtcatcatttctatttataaatatcgaaattattacactcaagttctaaaatattttttttttttaaaaactaaagtgaaaaaatagcaaagtacattactcacagtagtgaagaagcagccacctgaaaaaaaaaataacacacacaaaaaaagagagagagagagagagagagagagagagagagagagaccccacaaagagcactaatcttcacaaccctaactccgatttttctcacacctcccaatctctctttctttctctctgatgaaaagctaacggaaa

SEQ ID NO: 2731 - DNA, 1745 bp, Arabidopsis thaliana
tctcttacacgaatctctttttttttttttttcaatttatgttaattatagacttctttttcttgttttttatatgaattcattctcttatatttttttttcaaatttgaacagatatatagataaaacaaaactttaaaaggaaaaaaaaacgaaaaagattttgtaattttgttttgtttttgttccatcaccattattgtcacgtgcgtggcacagaaactagaaatatataaaaatatatatatatttttttccggtggtatagatctgaatcagagaattggtaagtagtaagaaccctagctttagattcgtcagattctgattactcgaatcaaagcagggtttttgacactaaaaatccgatctcgtgaagtgtgttttgcatcgaatcggaaaatatgaaagaagggaaatcatcgaagtcgtcgagtcaacaagagcagcatgaacagatttatcatcaaaacagtcacttgggttctttcaacttcgccaaattgtttgattctgaagcttcctgggacaaggtattacactctccttcgtgctctctaggttctatacaaccgatcccagaatctgttaacttttgagttcgtgttgcttacttttaagattcctcaagccatataatctggtacataatcattttttagtaattgagagctctaaatttagtttatttctcctgtgtacacaattagttgtagcatttgaactctaaagtttaaatttttctcttgtgtacacaattagttgtagcatttgagatctttaaagttgatatctttctcttgtgtgcacaatcacttgtaggaattgagatctttaaatttggttttttaatcttgtgtgcacagttagttgtagcaattgagatgtaaagtttaaatgttttctcttgtgtgctaaatgaattgtagcaattgagctgtaaagttgatttcattctcttttgagttccttacactgctgttttagcccatcttgtatctcgatgactataccaacttgttatcgtttgaaaaggaatgaatacgtttccgtatttgattgctatagctgattgtgctttgtgttggtttatactttggaatcggttcgagtggtttttaagtttgtggttgtttgtttggataggatcaactgggagatgtgttgcattggatcaggcaagtagttggtttactctgcggattgttgtggggtgcgatacctttggtaggaggcatatggcttcttctgtaagttctgtcatttatcttcttactgtgtccactatgactagaaagaactgaaactttgtgcttaaactcgagctatagttagtagaaatccattgtgtctgatgcatgaaatcgaaccatctactatatcgtttggtttacctggcgttgttctatattactgatcagaaaaatccatcactttgagatgataataagctacaccaattattaatgtcgttatcagtttttcgtaacagagaaacaactgtcagtatctgtttttattgcattgattagttaggtatttactttgagcgtattttatctacaactgttttcggtgacattcatagattttgagttatcggttacaatcatactacatagcaggcctttcgtgttgagttggtttgtcttaacaagtagcatcgttgactgtaaaatttggcagatttcttgcaatctcctctggcatagtatatggttactatgcattggttctaaagatcg

SEQ ID NO: 2732 - DNA, 381 bp, Arabidopsis thaliana
taaaaatgcttccttttgcgtcgaaacagagaagagttttgcctaaatcttaaaaatcgcaaatgagtcctgtccatttgttttttccggtttggttcgattccaatttattggatcttgggttttcggaaacaggtcaaaagtcaaaccaattctgaaccgaacgaatgttatcaaactgaaaggatcaaaccaatttattggatcttgggttttaatcagtattatatctttttgaggtctctatatttatttcactgaatttcgatttattttgttcagtccatatgattcggtataagaattaatctatagtttgagttaatattcggttcatttattttgatttggttcggttttatgcttagtgtacataaaacg

SEQ ID NO: 2733 - DNA, 1391 bp, Arabidopsis thaliana
ctgtataaccataaatcagccgtaagcattccataactcagtgataacataaaacaaactcatccacagataccataactcaggcaaaacataaatctaactcagccatagataacataactacgtcataacataaacctatctcagccacacataacataactcagccataagataaatctaactcagccatattttaacagaaactcagtcaaaccataacataacaacagctcagttaaaacataaaccagactcagctatatcaaaacagaaactcagccataacataaacaaactcagccgtcatataacagaaactcagacatcgatgtaaggttaaaccataactcagtcacaacataaaacaaactcagacacagatgaattgataaatcataaatcagtcggcaaacaaacaataactcagccgtcaaatcaaatagatcttagaaatcggccaccatatgtcaatcaacgacgacgttaaaacccagctttaaaaactatcgttacgcatcggaaaacgatttcagtgacgggaatcacttgcgattgaacttagatgtcagagtcttacttaatggaaacatactcaccggaacttagatgtcgaatgtgacttcgcgcttacggaaatgcgactgcggcgtctgaatttcggccggaacagacgagaaaagagcaaaacggcgaaagaaatcgatttcgttccgtcgagagagaaagaggaagaaagcgacagttttttttttttgggagatgatgaacagtaaagccaagaaataagaaacccaaacgttatgcggtttggagatgattaatgacgtggattatggtaatgacatggaatgatgacatgtataatcactgtttttttatttaatttttagttaaaaacgaattaaataataataattaattaaaactagttaggggtgttaattgtaattacacaattactaaaaacatctgagtaataaaaaaaagatgtgttctattttaggaataaacatacaaatgtgttttatcttaggaattatttcttaaaaaatcttgtaatttttagaaataaatatctgatctcttcccaataacaatttttgtcccattagtaccaaaaccatatttcaatttgggatttatttctataatatcaaacccgaattttgtaaaccgaaccgggacaggataatgggacaaatgagcacttgtattatcacgtgcattaatcattcaccagttttatagtagatcacagtggttcatatgtatctagacgcaaactttgaatcattcatcaacgcaatctaagtacaaatatagatctcactgcaatgtttcaagcaccaacctgatcatcatcaaaaccatttcatccgtagtggtca

SEQ ID NO: 2734 - DNA, 2000 bp, Arabidopsis thaliana
ttttgaaattaacatatatttagccatagtggaaagaaaaatttataataaggttggtatatcaaaaatcaaagaacatgtgaaaaggtttaataaaataaaagctatagaaaattgataagttttgtccttatgaaattaatgtcatgatatatatatatatatatatatatattattgtactttttaattaataatccctttttgaaaagaaaagaaaaatatgtataagaattttttgtagtgttcatattcagttttctagaaaagctaggaaagcgaaagtggcctggcatggttttgtaatttccttttttaatatgatcataaaataaaatatgtaaaatgaaaaaaaaaactcattaacaaggtaaggaataatgagttgacaacaaaacaaaggtaagggataaatgatgaactattcggatgaacatattattgcaaaattcagttatatactatatggtccaacgctactagcaaagtagcaatacacatgttggtcataattattgaaattagttacaatttgcgtgaactttcttaattaataaatatttaatttgtaggttatgggaatgaactggaaagtaataaagttgaaccgcatgggtgaaaagatgattgtttttggctaaactaatgtgtttttatattgctaatttgatcggatccccatatattctcataatcactccctcttattacgttgaaacttgaaacaaaatgctaagctgcctaaaactcctttcgctttttagaatctagaggagagaactaacaaaataataacgaacttattttaagatcttaatatgcgaatatgcgattaccaaaactatgcctatatatcaccgtgagtctttctttttttgggattactttgccagtttgcctataaccatgtcattgagtctatgactacaacatggcattgggtttagatgtagtggtcaacatcttatagttattgagatattgagtccattggtaataaaaaaaactcggttaaagaaaagaaaaaccggtttaaaaacggtataaaacatgtggttgaatgattatgattagtgaaaacaaaaatttgactaaaaaaacttactaaaaaaactttaattagtatacacacaccttgcttccacttaactatcatgaagccatcatcactgggtttacatcggctaagtttatgaaagtgaatgtctctataaatgcttactctctttttaccatacatattagcctagagaagtatgtagagttcaagtttccaacatacattaatttgaactcaatacgtacgtgaaagcaagccttcctacatcaataaagaccgacctactagtttcttcataaatcagatagaggccgtgtttgaacgtagatgcgacttggtgtctcaatgagtgtaaaataaaaacctaaaaaaggaaaaaggtaggaccaaacacgccccatcccttaatctcattattatcacctcttccacacgttacctccctgcaaacctcacgctccttccctcataacacgtgactctcacgctcctccacctctcaaaaaaaccaaattttccttgtaatttacttgaaccaaattcatatattcacctaaacataactaattcttgatctaactttcgaaaattttcaaattaaaacatctcattgattccaaaaacatactttattgttttatatggttagtattttaatctttacgtaaataaaagacgttggaattggaaattactactagtagattgctttatcagaattttataatctatacaatgtaaaaagccgcgtcatctgttcaaaaattcagaagatcagagtcacgcctatatttctctctctcccgtcactctcactcttcctcttctgcttcttattattacatcgatcctcgttgtccctcctctgtttcttcaatatctctttctctccaacaaaatcaaaatcaagaaaacaaaaaagaaaaactctcaagaaaca

SEQ ID NO: 2735 - DNA, 2000 bp, Arabidopsis thaliana
gttacaatttgcaacgtttttattaagaaaatggaagcatgcatggttggtcgacctatgtgacagtgtctcttgtactgtaacacaacgtgaatgattttgagttatagatgagatatgtctgccttagcaactgatatcattattgtcttcttatcttcgttattttcttttagtttcaaactattttgtaccatttattttacctattcactctggatataggcatagtggataaataacattattagtattttttaaaataaattctattttggattgggaaaaatattactgacacaatatggctttggccgatagacaggagatatgaacgattttgacaagatttccaaagaccgttgtggtttatgtttctatttatgtttttatactttcactacgaaattttatacaatttcaacggaatttagttttttgggtaaaattatgacaaatatgtgtcggatttagcgaaagcataatttttgttgtctcaatgtgaaaaagatttacagaaaaatttgaaataaaaacttgtaccaaaataatcatataaatccattgtaatttccgatagattgatttgtcactaaaataaaagtaatcatcaagtatgatctcctcattgccgtcagacttgtccaacggtagccttttttgccattgcagagttgctcattatttccgttccgacacttaatcaagtaaattctgattgttatttgttagtttctgcatccagatggtgatattcataacaatcaagtacattattaacttgttttttttgataaaaaaataattgactagagtagtttgaaaatgactaattatttatggtgtgacattggcttattcgacatagtgtggggactggggagggatctctattatgaggattcgaccatttgtcttgctggtgagtgtttccatacgaaaacgattttcgacaagctaatgtagacctaattcagttcatgttacattctttttattttggtatgttaaatcgaatcctaaactaatatatcctttcaaagtagttgaatttggctttaactttccagtttgtctgacaagtatatttcactcaagctaagtcaagtgtaatcatatttttggtgagataatatttcttatagttgagacgaaaacctatatatagttgagacgatgattgttttctaattagttgaaagttgaaaccacttcttttcacaaaaataacccaatgcacttatttgaatctttagaatgatatacatcgaatatctatgattggaaataaaagtcagtgtaagaacttgaaaggtgtttttaacaagaaaaaaaaaaaagaacttgaaagtgaaaaacattaataataagaggaaaaaaggtgaaaacattaaagtgcccatagaaaagttgaaaaacattattaaataccaaagaaaaaagtgaaaaaattataaaattataaactcagaattagggtgtgaattcagattaccccaaatgcacacatctctcgttttactggatattgtcggtcgtgtggaggagatagatagagagtcccgcgtgagttaaaagaatttcgtcctttgggacgtccaaaagccacacgctccgagaaacagtttttttttttttttaccaaaatgattaatgtgtaattgtggaaatttacttttttgggagaatatgactagctaatttatcacacattcaaatttgtcacgtaccgaaaaaataaaattcccatcagaatttttgttattcatttttaatccaatctgaaagcagaaataaaaaggaacaaaatttatcttatgttcattttttttctctttccttcctaatttttcattttttttcttagtctccaaaaaatataaaaataagtaaataaattgaaaactcatttggagtggggaccgcatcaatgataaatacaaggaatgatgaagtgagagttaaagaaaatcaagatattaaaaaaaaaacagagaaaa

SEQ ID NO: 2736 - DNA, 2000 bp, Arabidopsis thaliana
tacatcgttggaaatctcttacatacttacttccattaatctgcaaatcagctaataaatttctatcgtcgaagctttttgtaggtatacgtttttttatttctctcactttaaaaataaaaaccaaaaaaattttttatgcaaaaacaaaatgatctcatatgaggactcttgtatgttgggcctggccctgaagatatctattgtaagaaagatcaattaaaaaagtaaaaattaccataactgtcattctctaatcataatagcttactttgcttcacttgattaggcataatatttgaattctctttgtgtggatcaagccagctttggtttgctctttatccacatgtgccacgtggagcagcgtgtcagtcaactttcaacaactacttgactctcccgacgataattaccggctatctccggttctcgtttccgacgtcggccgtttctttttcatttttgtcgttttttttccaaatttttttatttcgggaaaataacaaaaaaagaaagaaataaaaagaggtgattcaaatccagagagttctcattatgtatattcaaaatctgaatcgagaaggaatctgactcgtgtagatgagaatcggcggcgtcgaggttacgaaatttgcgtcggagatgatgtcgtcgtcgtcttcgtcggcggtggagatgttgaatctcaaagaagcttcgaattggtggtcagacgtaaacgaatctccgatttggcaggatcgtatcttccatgttctcgctgttctctacggaatcgtttccctcgttgctgtggtacgtttcgtttctggatttgattgatgattcttcgatgaaattggtgtaacatcttatgtttgattttggtttagattcaacttgtgagaatacaattgagagttcctgaatatggttggacgacgcaaaaggtctttcactttctcaatttcgttgttaatggaggttagtgttgctgcggattttgatttcgtgtgttcatgttgattgattgattgatttggctcatcttgtatctggtagttcgtgctgtggtgtttgtcttcaggcgaaatgttcagtttatgcaaccagaggtttaggatcattcaccatcattgtaattttaatcttattgacttgtttattgtgtcaaccttctaaatttgcagtgttatctttgtagattctgcaacatatcttgcttgatattccaagtcttgctttcttcaccacctatgctcttctggttcttttctgggctgaaatttattatcaggtagtttctaatgagtatctatgggtttctttttttgtcaatgcttctttggttttgatattttacttaacactcttttgattggacaggcgcgtgcagtatcgactgatggactcaggccaagcttcttcacaattaatgcagttgtatatgtagttcaggtattcttgcaatctttaagaaatttaagtttggtttttgtggggtcatggcatatcttattggatgtattacttccagattgctctatggttggttttgtggtggaagcctgttcgagttatggtaatcctatctaagatgttctttgcaggtaattagcttcgatcctatcgatacactctttctatataatccatagtgcctgtctcacctctcttgcgaattttatatttgcaggtgtttcattgttcgctgcccttggatttttactttatggtggaaggtaaatctgttgccactctaatatgttgacatttgacattaccatagtttctatcactaccactaaaactgtgttgtcatttttgaggaattagatacacaaaattgtgctcatatttcttgcagtcacagtcacttgcattttttcctgctttgattcctagctagactagattctcttggtgctaaagctgagtaccattaaaaatgattatattcttgcatttgtgcttaattatgtctccttttatattgatcttatggcaggcttttccta

SEQ ID NO: 2737 - DNA, 423 bp, Arabidopsis thaliana
ttttatcccgaaacataaatacgggtgtacagagggagagagtgatcccagacctttgattaagtgtacataagaatctggtgatccattaatgttccttcgttttagattatgatttatgaagattgtcataatcttaatgtgtaccccttttattatcaaagatcaaatgagaaagatgatcttcatgtcttcttgccaacataagcatgtttgaagatgagatttaaaaactgttataagtaaaatcaattcctagagatgttcaatccggataaaccaatgcaaaccgaatcgaaccgaaccaaaccaattgattgtgcaattgtgctaactgtttcaatttataaatcctcaagtttctctctctctctcgcagaacagagagtggtgaaatcaagtgaagaacactaaggttcaact

SEQ ID NO: 2738 - DNA, 356 bp, Arabidopsis thaliana
cgtcactgctctgtcacgcgagcattccaacattaatgggaaattagaaaaaataaaataatacgctgtcgtttttggtctattagaaacacggcatcgtttaaactaagtttctgaacgacggcgtttgacccattcacgaatacgaatacgattacgattgtattcactacgtcgtcgtttggtctgttcacgatacatcgtcgttgggcattaacttatttaactctctgtctcttctccggtcaccatttacccaattgtacacgaccactttttagttttgacgattagatgatcaacgttgctggaagtaggaaaattagataagagtactgatcaaatcctaagagaga

SEQ ID NO: 2739 - DNA, 2000 bp, Arabidopsis thaliana
atgtcttttagtatagactgggatttcatgtttaagatcaaatgtgtaacgccaatgatcaaacacttgtatctttgccatttcaaaaaaatatttctaacgtactcaaactaatcacgagaatagaaaaaaaaaaaaagtaattataatttgtgatagagtattgcatgcatatttttgttgtttctatgtaaaaataatctaaaaggactgtgggaaatctacgaggagtgtgtggaacatgaaagcgtcagttctgtacaaatcgaaacacttcaatgacaacgagatcctgccaacaaacaaacaaccgcacgtgtgttgtttgttcatcatatgttcattaccactcttttgtttttattatcacagcacgataatccaattagagtagcgaattattgttgggaaaaaaaagcaaagatatttgataaaaaggtaaaagaatatgtttatgtcgaccaagaaaaacgaatatgtttctttcattatcaaaaattgacataccgtgttttgtagattgcttaccatttgcatggttgttataaaaatgaacaaatatacggtggaaaaaatctgcaaaattttacaaaattagatttataataatttgatttgctagttgttattgtatataacacacattggaaaaacatggagaaaaatgagatgtagatggagtgagggtccatgaagatgagattgtaacttgtaagattgtcagagtcaaatgaaataagttggaccaaccctctttttttcttttgtaattttcctgccaaattacccataaattcaaacttccatattcaatgttttctgtatattttttaatttatttgtcaacactgccaaaaacatatgaaagagtggagaagaattcaatccatacacaattacacaaccttagatttatatatatagtaatgaaacttttttttttttttacaatgcataatgttagaaagaaaaaaacatatgaaattcatgtaaaaagagcaaaatttatattgaggaagtgtgatattctatgtgaatctcttaattaataatatagatgagtatggtcgtctagaaacagcgcaatgcgccatgccatcggcgtcgaccaagtcgcttagcagctccaccattgaataattgccacgaaagaagctcagacacgagtcacatgacccacttctcttgcatggcttaacctttttttaattttttcctaagttaagattgtcacatcaaaaacctaacttataaccattttttcctgatacaaacattatgaaacaaattagttggtaggatttcaatttatttttaaatgccaaaatgaaatttctactttttttatttaataaagaaataatatatttttttctcattcaggatataaatatatgaattatagaaaataattttttattagtgaaactccatatatatcatatgaattgatgattagcgagcgacaaagttaaggtcagagggagtcatactcctaccgacgtacttaatcagatccggtttaagaactcggtttaattcaatggttcaaattaaaagagagaaaaacaaaacaaacaaaagaacgaagagataaaataactctttaactacttcttcttcttcctcttcttcttcgttgatatttttctctcattttattgactttccgaatctccaaaaatctaacccaaaaaataaacaatagttttttttttctccgcaaaggaaaaatcttttcttcaccaaataatttgtctctttcgcaaatctcagctctctctcgaagtgcctttcaacgataaatttgtgggctttattcatttatagtgttgttttgatgatgacagattctattaccagaaattgatcaaagagaaaaacgttgctctctcttgatttcttttctgtttttttttttatataattaatttgttccggtgaatgatcgtcgtcttatggaaggttgtagctaatttctaatctatagagagagagag

SEQ ID NO: 2740 - DNA, 2000 bp, Arabidopsis thaliana
aagtcgtttggtttagattcttcgattattgttgtaagaaaagctcgatgtgcaggcaaaaatatcttggtatggacctagtgagttataggagaaaagctcttatatatcaaccatagagaggatgtgaaggtgaaggacggcttccaaaatttaagaatttgatctttaatcatcatcttcatcatgcttgccctttgttgcccatcttctttgatcgtttgaacaatgcttggaacaagtgtagtggtttatagtttatacgttgtcttgtctttaacaaagagagttcggtggggaaattttccttgtcatctgaacgtggctaagagaagagaagtgtcaatgcattgtacaaggagtggacgagcactgatgaggctaagttccctgaccagctgtaacataacccgagaccgcaacctatcccaaacagctgcacaaaatcctcacctgagaagtgacctgcagcaaatactcctgagctgatcactagtgccttccaccattccattctcgacgctaaggaggtcaggagaaagcgtctgtacactatctcctcaaggatgggagctactacgcagtagagagcaaaacatccgcttctcgccacttccccgctcaccattatcttctccaattctgattcatgtacagcctgagatcaaacaacatgttaaaatgataatcatcttagcagagaatggtgtagtagatcgattggggagaccttagggccaaagagttgatcagctacaagcgacgtgacgaagataaagcccacaagacatcccaaacccaatgctgagccaaccacccagtttcttccttcccttgtttcgttattaccctttagaaagttgattgatttgcactgaggcttcgctgtggtcctcagcagcaagactgtccctgcaagttctaccatttggagaaccacaagtgatagcacctgtatattgtaaccacaccatgaaattcaacactaaaaatcaactttgcagaatcaaaagcatacagatcatcactcatgaaccgtaacgaaattgcatctcacataggaagaaaactaaattgcaaactgcaagtataatcttctgccctttgcttatctctgaagtgtacaattcaactagatatccaacagtctcctcttaatagtaaatgtaaaccttccagacaaaatgaaaggagactcacttgggtctgaggatcaagaacctgccggtggagtatgttggcaacaatggataaacccccaaaactgagaggaatatgcagagagaacatgtaaagagcaaatgtgctccatatgttatcatcctcccatggaatctctgatgccaaaactgagaacccttctccattccccaactgttcaatctataaagcaccggacttggaattagaatctccgtcaaaactagcgaaaaaataaaacttcatccctaatcaatggaaggagacgcacctgagtagtttcttgggaggatttgcttttgagacaagagcatatgagagaaggtcgacaagtactagcagaggagagacgacgaaactccgtatgtcgtcgtcgttcggaacaattagtcaccggcgtgtttccgcaactgaaggaaacccatcggcctagaatcatcgccgtctctgaccagagagtctcctcttcttcatatagccaagccacttgacctttcaagttactaccatggaccaattcaattatgtggtaatccaaaataattgtttttctttttttggcatcaagtgtgattttttttttgtcaatagatatcttcttagctcaaaaaaggaaaacaagtatcaaaaaaattacaactttacgatttgcttagaaaggagaagacatctggagcaacaggatttacaaaagttattatctttatcgatttctcttcttcctagacccaacagacgaagagaatttgttgttggttgtctctggtctcttcgtctaggttttttttgggttattaaag

SEQ ID NO: 2741 - DNA, 2000 bp, Arabidopsis thaliana
gctatctcccacctaagattccgaatgaaaaggatctatagtttgacccaagttctcgaccatttgtttattttatatgtaaaacgctttagactcggttatttttttcttctttacaatctacatttgacattgctaatttaaccaaaccatcgtcttcaaaaccacatcgctaaaaataaatgacctataattctattcaagtttaacaaaaaaaaaaaaaacaattctgttcaagtatcttttttggttaaagttctatttaagtatttattaacaaatttctgcagttgttttgatttaaatgaacatagtaaatctacaaaaatcacgtgagttcacttataattgttttgggctgaaatggaattcggatcccacatgagtaatgagtaacttgaaaattcgatcttaggtgacttttaacagaaaggatagcaaatcctgtgaagtgtgtgaacagtgaaagccaaagaaagagtcacgttataatacatgtgaaaccaattaaaaccaattacgtaccaaccgtcaaatatatcttttgacacatgaaacaattaatcaagaatacaagaggtaattaataaatcaaaaaacaacgtaaaacaaatcattattacggttttgtttagagaaaaatatatgaaattgaatggctaatgcaaccggaagccattaggtgattatttcacatgataattttttaggtgattatttcataaaaacgcagcactaaaaaccaatattcttaacataacataccaaatgaagttaatcataaaaataacgtaagatacaagactcaatctcacaacataaatggaaggcgtgaagggaagagatgcatgcttgacccctcttgtgccattatagattagagatcgatcgatgttgtgttccaaggcaggtgtgttattattacactcactcacataactctgtttgtaatatattaaagaaaatatatattgttgctgatccttcaagggaagaagaacttgaatttaattatagattgccaaagtgtaatgattgttcctacttcctacttgtgattctactacttcctaataatgccttaattaaaaaagtataggatgctaacaactaaaggtatgtgattaagtatcttatggaaccagatctagctactcaaattttctaattcgtaattaggcaaagtataaactcacactacaaaaaaatctaagtctagcatcaattttttaaaaaagttagtgttgcttttaaagtgacactagaattatatagtcattttgaaaagcgatgctaaattcagtgaagctaaaaatatttagtatcattttttaaatgacgttataattcatggttaacatcgttattttttggatcttgaaactaagcacaaaatataaacgaattttatttctgtttgattttgcataaaacattttagtaaaacaatcaattaatattatagatgctcaaatacttcaatatatttttgttattaaaatcatttattggatttagcttaattcggttagtttgattctgttagactaaatttatttagatttatacttggtatataaatttttacacggtttaatttgattggagttcgaattgatgaattttggtttgattcggattgattttttttggtccatccctagtttttatggtcaaaaacaagatcggtttagcaaaatctgaagactatttgggttttcattgaaccaaaagatttcaggaccatggaaacagagaaaaagtaaaaattatgttgggaaaaggtagagaaatcatgagaaatcatattgttcccttatgtaaatgtcttatctttttcacccaccagattattattatcaatcccaagcaacaaccactttatttcacatcaccttataaataccaactttcttcatagtctcaacaaatacactacactactcaacttataacctttctacactttcaagaaaccaaacagaagctgagttagagaa

SEQ ID NO: 2742 - DNA, 2000 bp, Arabidopsis thaliana
cgaagagtaaaacaattgatatcactcacgggtctgtctagttctcgtatttttggcatcactctctgaagccacacaacatgagtcttccttcaacttctccaataatatattggcgttgccgacaccaaatgtcggctctgagtataagtgggagaaggttgggcttgggcttccagatctatttctatattatggggccataaatacatgcaaaatgttatccattagattaattgaactggttgactcaacccaactcaaataaatttgggttcgagatttcttatgggagaatataacccatctatttatttgatgggttgaaacttatatacttaagactcaaaagtttaaactggctatataggttatacgagtgttggaagtaattttgtgtctatcaactcgattatataaatgcggacaaatatacacacgacacaagtatacacacaactaacatgttcaattaaaaaaaaatgcggcaatcattcatcaagtcactagcaaacaacaacacagctagttcacatattcgatttatacaagtcaaactaccaattcttttcagtatcatcgtcaagatctaaagtctaacaacgtaattataaacaagaggaaatacattaacattaagagcttaacagattttgataattaatttaataacaggatgacaaaaaagtaatatcttaaaaaatgtttcatagtccaccattgaattttctaaaataaaatgccagaggtaaagctaaacaggaagataccctttagacacaattaatagacttaagttagccacatttcataaacaagattatcagttaaagagataaggttagatttatctaattggtctaatgatatccctccatatattatgttatttgatctatatcaactcatgattataacaaaacctaattgctttgaactgtataaaaaccaacatttaaaatcttaggattggatcatacaataatttgatctcatgtatatgatattgtaaaatagatgattttggattcattttacattttaaacattcatgactcagcaaagtaatttgctaattaaagtataaaataaaccaatattcgcattttgaacgagtcaaagttcttgcttccgcactaatccagcattagcaaattttcattataatatagatttttttgtatcattaacgatattggttttaattgtactaaaagtaaacgagataaggtttaatttgtccacttgtactaaactaatcattcagatagtactaattatatatttttaaatatattaatttccatttaaaaacataaagtaaatcatacacgaatatttttgtaatcttttgacttattaacagaaaaaaatcagcatcttaattttgcataccaaatattatccatccaattgaattgatataactaatcaagatttttttccctttttccacatatttctaaaacatcttaaaacatttaaagaaacaaaatcaaaatataaatggataaggttgagatatggtgtgatagtgaccaccgaactttcggtacaacgacatacatcggattaaacggagacagtaacccgaaacgtccggcaaaagtccaaacttaaaccaatgaaaactctccacgtcagcaagaccgtgtctataccgtcaaagtcgccgttagcgtgcctaggactattctatatttaggaacatgtgtttccagactcataaatacgtataaatattcgtattcaatacgtaatcgtatttttatacgatattgtcgttataaatgtaaatgagaatttattccatttttctcgttcagtgttgttttgcatttcaccttcttttgtatatctctcttcctatatcattaacctgcgctggttaaagctcttcacctacgcacatcgccggcgatttatgatcatctgagtctttcgggtatattcacaggctagagaaagagatcttaatcggaaaagtttatatggaggtt

SEQ ID NO: 2743 - DNA, 2000 bp, Arabidopsis thaliana
tcttgaattcgcaaaaacatgtcctttttcgtctacaggtttctagggtttgtttctgtactataaactatgtttatggtaacattcttaatcataactacactaccaatgcttttatgttatatgtatgcaaaaaaggctctaacttttgttttctttcactattgtttcttcttttgttctctattgttgtagctcagatatgaactgggcactcaacaatcatcaagaagaagaagaagagccacgaagaattgaaatttctgattccgagtcactagaaaacttgaaaagcagcgatttttatcaactgggtggtggtggtgctctgaattcgtcagaaaagccgagaaagatcgatttttggcgttcggggttgatgggttttgcgaagatgcagcagcagcaacagcttcagcattcagtggcggtgaagatgaacaataataataataacgatctaatgggtaataaaaaagggtcaactttcatacaagaacatcgagcattgttaccaaaagctttgattctgtggatcatcattgttgggtttataagcagtgggatttatcagtggatggatgatgctaataagattagaagggaagaggttttggtcagcatgtgtgatcaaagagctagaatgttgcaggatcaatttagtgttagtgttaatcatgttcatgctttggctattctcgtctccacttttcattaccacaagaacccttctgcaattgatcaggtcagtgtgtgctttattaaaagctcaaagctttggtgaaatttttgattcataaatgcaaagttgactttttttggaaccagaagtttttgaaatttactcttttatgtttggttattgagtaaatgaagggaaatttaggcctttgctttactcattggtttgtggctaattttgcaggagacatttgcggagtacacggcaagaacagcatttgagagaccgttgctaagtggagtggcttatgctgaaaaagttgtgaattttgagagggagatgtttgagcggcagcacaattgggttataaagacaatggatagaggagagccttcaccggttagggatgagtatgctcctgttatattctctcaagatagtgtctcttaccttgagtcactcgatatgatgtcaggcgaggtaatataaacattatcagacacttatggttttgttttttcggttaagtatccgacctgcacctcttctgaattttggctatcttttctgcaggaggatcgtgagaatattttgcgagctagagaaaccggaaaagctgtcttgactagcccttttaggttgttggaaactcaccatctcggagttgtgttgacattccctgtctacaagtcttctcttcctgaaaatccgactgtcgaagagcgtattgcagccactgcagggtaaagttcccatctgattactggagcaaacttttgcttgtgatcatgtaaaaagagattttcgagatttcatgattggtttatgtgtgtgatcatgtaaaggaaagaggttttttgagatttcaagattggtttgtgtgtaaagtaaagattgatgcttgaatttgaaatgcaggtaccttggtggtgcgtttgatgtggagtctctagtcgagaatttacttggtcagcttgctggtaaccaagcaatagttgtgcatgtgtatgatatcaccaatgcatcagatccacttgtcatgtatggtaatcaagatgaagaagccgacagatctctctctcatgagagcaagctcgattttggagaccccttcaggaaacataagatgatatgcaggtaccacacagaaaatcttaaagctaaaatactctctgatatctaaaaactgatatcttgtttgaacaatttcgagtgcaggtaccaccaaaaggcaccaataccgttgaatgtgctcacaactgtgccattgttctttgcgattggtttcttggtgggttatatactgtatggtgcagct

SEQ ID NO: 2744 - DNA, 2000 bp, Arabidopsis thaliana
gtatttaaaaaaaaaagcaaagaatgtgacaaaaatggtaaatatatagagagactttcttggggatgactcaatgccactctttgttcatacataagaaaccccaccgatgacttggatagaaagaaaagacaaatcaaaccctttcattcttactcatgtccttttcatacaccactcattctctctctctctctatctattttctccaagtccacttgcagataggtgcaatggttaaacactaaagtgggattgccattttcaaagacaagtccttttcaaaaatatcatcttcttcattctccttgttgaaatcattaccaatttagaacagtccatggcactttgtagtaaaaaatgtcaaaagtgaaaatcaaaagtagacttgggccagggaccatataccatgtttagtaatgtaatttagatatttaagttataagtagtggagaagtaggccttttgacgcggatacaacgatgaaatgaaaagagtgatgtctcaaagagtcaagtgtcgttcccatgtgctttttgttcgctattgctcttttctatttcattcgctttaggtttttagaaattgcaaagtcacaaagagcttccacactcaaacctcaaataagcaaattctcgaactatgcgtcgtgtatgaatgataattcataaaacttggtttgttattgaaagacttttaaattctataatcctctttggactcttttcttgtttcttctttgcttgtgttttttttttggtatttttgtgtaatttttagcttttggctaatggctactacattttcttcgtcaaagttcgtccaccaacaacagatactagtagagcccgccacaaatcgcttttgctccattgtatatgggcctacttacggacccacaagccgtcctccacaacactaacgttgagataaaaaagacatgcgtatacaaataaaacatgtctattgtttaatttttgcttgctcaagtcatattcaagatgttagcttaacttgtcgaaaggtttttttacaaaagtaactgaaactaaaccaatgaagtcactgaaatttgttaaccaaagtccaatttaacgacccttttagttgataagaaacagctttgaaaaaccttgacctttgcggcttgaaagcagaagataataacctaattctttttacttttcttacatcaatctttttacctttataatactgttagttaaaatgaaaaaagacagaaaagttgcaggcgacatgcaggtgacaagtagcagaagacagttgtcgacgtgtcacattcaccatttcagccaaagccattgatctgattctagacggtggagatgaggtcacactcttcgatacgtaactgccgatacatgacgtcatcgtgtctgtgggtcccataagtgagatatcgttttactctctcttttttttcataacgtcaactcttttttttacccatattaacagagtggtaataattatttaacaaaaaaaaacctatgtattttttattttttggtcaaaaggtttctgaataaatttgtaagattatacgaaactacaaattcatgagatatagaaattattcaattgatattttgataaattacatttctattattaaattcttgaaaataattaaatacaaaactgagttttttagtaaactatgttagttagtttcttcattttttgttgttgttgttggttttatagtttcttcatttcttgcagttaataacgtaattttgtacttttaaactaaagtggtaattgattaaaaatacagtactcgaaaatgataaatcggatgacaaaaaaaaagaaaatgataaatcaaaatgaaaatactcactttcttacttttttcttcctactaaaatctctccggtttcattcatatccctctctctctctgggccttactcaatcaccaccaaataacagacaaaaaaacgccttcatcgccggcgaaagtgagtcggaga

SEQ ID NO: 2745 - DNA, 910 bp, Arabidopsis thaliana
gttatttcgtttagcgtaagtgtaaccaaattttgactcgttatagtcaatcacacaaaagaacggagacgagagcatcaatctttgtagctctattcatgtagcatcaggagacaaagttttgtgagcatattattagccttttgaggtttttattgaaatagatttttgtaagcttatgaagacgatatctgcagggttcaaaatactcaaatccacatggttttggacccatttagatattttcgaaatgaattggcacattatatgcttgcacgttttttgttccgagtatttatgccacatgtgtcatctaactgattgtgtataatcaattaagtataccaaattggataaaatttaccgattgaaaattagttgttttacttgtacatcgtggtctatatatatcattttccaacataaattatacacttgagaataacactttctgttgagttgatttcttatattaatgccaaagctaagactaaataaattctacaaaatatttttaaaaattttaacttttgaaaagctaacttcaaatactaaaatatatactatttgaaattgattaatattatatagaccaagttggattttgatataaaccacatcgcatattcgttttattaacaattcatgtttatcatgacctaattagttctcttaaatagttgttggcaacttttaattagatagccaatcaatttgaataaagaggtcaaactccaaccaatcccacaacaaataattgtctttgatttaacgttttacacttaaaagacaaacactgcacgatatctctctcagatttataagtgaaccctacaaagtacaagtcgtaaactcaaccacaagagaaaccttatcttcttcttcttcttcatcatcaatctctcaagac

SEQ ID NO: 2746 - DNA, 2000 bp, Arabidopsis thaliana
ggtttacaaatcgttttaaagagtaagtaagtagcatagaataatttacaagggattttaaaagctttgaaaagtggttaacatggtttacaaatcgttttaaagcgtaagtaagtagcatagaataatttacaagggattttaaaagctttgaaaagtggttaacatggtttacaaatcgttttaaagcgtaagtggcatagatctatcacgaaagcatatgcaaaagaggtaaacactaaatcagaatcaaaatctattacgaaatagtataacgaattcacataagcaaatctatcacgaaacagtataacgaattcaaaaggattttagaacagtataacgaatgtacaaggattttagaaacaaattcaatcatcaaatctcaaacaaaattcaaattcgaagctgaagcaaatgtcaaactgtcgattgaatcaggattcaaataacgaattcacataatcaacaacaaaaatcgaataaaccaattcgaaaacgaagatttaagctaacattataaaatcaaacctgggaaacgtaagagattcgacggcgacacacagctctacttacgacggcgaagatgggttttcacggcgagtaaactcactatttccgacggcatgggattcaacgacattcacaatttccgatggaagaagaagagagagagtgaagaaatgaattaggtctgtgggtagctcattaagggtaatttggggagaaaagtattagaaagggtagaaatgaaaatggcaaaaaagggtagagttgcaaaagggcattgagaaaagggcattagagtgaattattcaaaaattaatttgtgtgttttgaatttatatttctcggatttatatgaacaattcaactagtttaacttggttcaacttattggattagattaaaaacatgtatgtatttgtttccgtgataatttttaatttaattagttgaactagttcaaatgtctattctttggttttcgtagtaacatttaatataattagttcaactagttcgatttagtaacgctaaaatgtttaaattttttaaattgataatttattatacacgtaaaattatatacgaatatctaaagctataaataaataattttatatcaatgcaataaaatttaatattttctaaaaaacaatgttgttttcatataatacaccccttctaatacaaggaacatttagtatatgatcaccttatatgaagtaaaataggtgaaaactaagcttttaccgatgtaatattatgaaaactttggaaatgcaaaataatagagacaaagtgtgagttcaacttataattaattatttaccgtctagttcaactgtaaattatgaaaactgtgaaaagttcaactatgaacacgatggtacaacagtacaactatgagtattttctgccgcaaaaagacaaaatattttttagtggggttcacatgttgagtaaatataaccactaaattaaatccagcgtttttgtagggtccatatacagaatatttatgtttttcttatttttttattttattttttaaaattaaataaaaagtcattcattaatggtgaaataagaataacacatatagaatagcatacagattaaaaaatggcactccaaattcaaatttctggttcaggtgcattcttgactggaactcaaacataagagtggtactactaattttttattttcgaatagtggcataagaggtgagccttcacattttatgttgattttgaccatttttccgataactttcaaattgcctaagatagtttgtaactacaaaatttaattgtaaacattgcctaacatattcacgtaattacgaaattgcactttagaacttccaaattgtaaaacttcggctcccacaggggaaacaaagcgaccgttttgctcatcattatttatagccgccggcgaattgatcggtaaaaaaaaaaacttccgacgtttctacaaagttgcgaatc

SEQ ID NO: 2747 - DNA, 2000 bp, Arabidopsis thaliana
aacatattacgttaatgattataaattcttatcaaatatgttttggtacaatgtctcggtttaccggtttatctatttctatcttggtttaataaattatatttaaggaacaaaccatgtttctattatcgttaatgaagcataattctaatctaaagaaaagtttgttagatctaaaatggtatcagagcttttcccagcttcattcatcttcttccgcaaattttaatattctatttacgaagtaagttaatggaaacaccctattgactactaattagtttcatgttacacttacagctcatccctcttttagaatttaaataattttctgaaatattaagcacaaccgaccttagctcagttggtagagcggaagactgtagtgtttgcagacaatctttaggtcgctggttcgattccggcaggtcggatttttaatgttttggtggtttttaaggatccttctaaaaacaaagcccaagagttctctttttcttgaaaagcccatagataaaaagaataagataaaaataaaaagcccatagttcgtataaacaacaaaccaattcttacttagtactaattagtaatttcgatctgcaaacgttatttgtcaggttttctttgttgctaatctagcaaaaacactgttctaacgcaatcaagtgtgtgttagtccggtattagccttcgataattatgtcggctttcactaaaagcattcagggcttttataaattttcagtttaaaagagcctaattttggatttactctggcctatggggtgtacggagaaaacggtacggccaatctatttaaaattaattttgttttacttattagtaaaacattttttaaaaataaagttttcgaaatgcatattattatcgctaaaaatgtcttacaattttcatttaggagatgttacgaacacacaagaaaattaagcacacctaaaatgatataattttcttttagtttgataaaaatttatagaaaacaaggaaaggtatatttggttatatctagaaaacacaatgaaaggtatattcggttatatatttgaattgggtagtaaatggattcatcgtaattgccatcttctaattaagtggaaaaactctttagtttccacttggagtggatggagagtgaccccaatctattctcaatagttcattggctcgtcctttttttttgggtcttaatcaaaagttaggtcaatttcttcattatttttatttttgtgttacatcaaaggaggaacatttgcataccagtgatagattatcttacgaaaaattctctagaaaacgtgcttagtcatgtttgcaaaccagtttatttatacatactaacatttcatatacatataaattatacattgttgtttgttgaaacaatccttccaaccaattgcactctccatatatatttttctaactctacattcaaagaagtcacactcgactttgcatctctaaacttcgtgctaataattaagtgcatgcacaaaccttttgcatcactatctataaaatattaaagtttatatcttttcaaaaatgaaacaaaactatagagaaaatgagaaaattaaagcctttaaatgaataaaaattacacacgacgttcctctctgcttttcaaatgctttatgtttctttatgataatggatattcagtttccgtttctgtttctttttgaaaaagtttttcttttttctttttgaagaaagaattctgtttctgtttctttaaccaagttttcgataacgtctttaatttcttcgccagaattttaaagtggtacatattggtgaagccatcttttcttcttctttttcctcatcttttttagtggtattaaccgtcacgcaaacacatatgatttatcatccatatatataaacacttcttcaccaaaacctcatacaacaccacaattaacagatttattgtttttggaaataatcaaaacttaaaaactatcaga

SEQ ID NO: 2748 - DNA, 642 bp, Arabidopsis thaliana
tcgagcttcccaacactatctagtttgttaaaaccattgagtctagtgattctggtcagctgaaatatcccgtgaactggtttcatttcatatatgctttgatgatgattgtgattctggtttttgcttactgtttcggttgttctccatttatgtatgtaactacttgcttcgaacatgattcagtgaaatgaaatttggaagccgttgggtttatgtatatgcatctttgatcttcctgggttatgtatatgtgacaccatttgtctaccaagtaccaacgatggatacgaaaatgaaactttttactattgaaagattttacagaatacgtttattcataatttttctgaagagctcaatgtttgagaaagattccagaaagattttaaataatttttagttgacagaatgattgaaataaattctaaaaagtccatcatctagaaataaatgggtttgggctaaaattgagaaaagtgtagcctttaaaggaagcctcttttgtcggcttttgatctcagctgattcttcaaaaccgagctccgctgaattttctttgctccatttccgtcttcacacagtttagggttcacaacttgattcggatcgaaagcaccgagaagaagaagccaatcaatc

SEQ ID NO: 2749 - DNA, 310 bp, Arabidopsis thaliana
tttcaagattctgcaagtatgtttaagataaacaacaaagctaccaaaagagttgttctttagctgcatggtcttaatttgttttgtcctgtttccatgtaagcaaaaagattcgattttttaatcaagatttatcagtttgatcttaacttacttcatttatataaataaataaaaagtcaagttagttgggattatattaaagaacgtggaactcgtgaaattaaaatattcagatcaagagagtaaccataaattgtgatagcatggttctgcatctcaactttgcttgtctccgatggatcccacc

SEQ ID NO: 2750 - DNA, 2000 bp, Arabidopsis thaliana
actactatctttttgcaggttcatggtgtgaaaacttcgaggagtataagctgatgaaacattgggtacagaaacagaatccttgacagagaagttattaatttctttcttctacgacaacaaaaaaacaaaagtagctgcatgcacaattaccaaagattctagttactttggagtttggtttgtacttatttagtggttggacaaagacaatgcatggcctcttaattaaacctgatggattagattttgattttttagttaatggagcataaaacgttagagtgacataaaggtacgatgtttaatgcagggtaattatatgatttatagctagtacataaattccacccgaaataaaacaaaaatcgattcatgcgttcgacaaaatgataagagtgagacagatggaaatttaatatattaaaataaagtatttcagcaacatgtgatattgtgtgtttcttaattttatattttacgatttctaaggttttcttaaaacccttccaatatttttttgttttttttctttcttaataatgttttaaaattattttgctttattattttatttttctaataatcgaatagaaaaaataaatttaatatggttgcctttaatggactgaatagacattaatcacgtaagaaaaagcattgatcttcaaacaataagcttaaatagtagttattttttgattcgataaggtaatttggttttactttatttgttgtttattaaactcacaaattcattcaaatttggattgcttaagaatgtgtttttcatcttagttcaatttattcaaatttggatcacctatgtagaggatttccatatttctacaaagtacaaatcaaaaggggaacacaacaaatttctatgaattaattatttattaaaaagttatcaacgaaaacgtctcccaagcgtatatacaaaattagcatatgccataggtaaatttaaagcttgaaagtatcattttatttgcaggaagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 2751 - DNA, 2000 bp, Arabidopsis thaliana
atttgcaagcgaacatatacttgttaatgatggcgatgaaaacactatagacgaatttagtacatgactagttgctcgagagctcgtttctacatgttgaccatgacggctaaccttttagcactcgaggattaactgcaacatgccaatatgccatcaccaactacgtaaaccaccagcgccaagaggaataattcgaattatattgttacacgagagttgtaacgggacaagaccttaataggtcaaacccacgggttgaaatggtcaaaagcatactctagagacaaacactatcaaaagacccactttatggacatacagtaagaattggcaaggtcatatgattggttctaaaaaaggtcttgaactcttgatccacatatatcatctggcaccccaaaataagatcgacttattctatgagattgagtcgctcctatctaggataggtaagctcataaatcttttaactatatggcactatgcatcaaacgataaagagctccctcagctctcagttagaaagaattatctcttatcacatttccaccaaatctcgagattggatcttacactacttccggctaacgatctcgaacttagaaaaacaaaacaaaatgtttagatgaactataagtttagataaacccacttaccgaatatcttgtgccaaatataccgcttgctactacaagaaaattgacattgttcttgccgacgaagttctgcaccattccaatgatactattgcaaagagaagatgggctatgactgtaagttgtttcttgtgtaaccaaacaaaccaaaatctgcaacgtaaccagaaatatatttttaggtaaagaaacataggatttaagcaagattttacagtaataaataatcgagaataactagagatctttgaaatcaagtatttctcatcttaaaatccttaactaatttttacaaatctaaaaaattaaagcaatgacattccattgtaaatactctataaactaagatctgtttcctaatttttacttcaaaaatgtatattagattattaagacattagccaaacttcaacggctaacataaatgataaaaacaattttttgctataaaagttgacgaataggaggaacactctcaacaaaaatgagataaattatgacggtgtccgcgtacgatacggaccagattgtgatgattaacaacaccacgaaagacaaaagttcgatattggagctacaagttgcatcaacttatttaaatccatatggtaattaacacttagatataaacaaagaaggtgtggttgtattgtgtggtgggctaggttgattaatttatcttatatgatccctaaacctcagtgcttaagtacccaaattatcgaaccaaccaagtcatcttcgtatttcttaatcttaatttattctaataatcatcatgtatataccaatttgatgtatatattatcgtcgacatggatgccacatcggacattgttgaggatacaccacccctgtagattgttatgatatttcctcattattttaacgtatcgttccactaatctcactctcaaaatccaattacaaacgtgactatttagtctaatctactctagtaaacatataatattaattaaaacccaaaacacatgatggagttaggccttaagctagttattttagatgacatgtaaaccaccatacaaaaattaacacaccttcacgaaaaaaagttaaccacacggcaattataaacgaataaatgacgtggcggagtcaagttacacacgcgttcacacaacattggttgactttataagtcaaacatcataggcgctaaacgtttcattttcttcaaacgttagttaggcacaaactataaaagagatactgtctctcttcgattgtataatatatgatttatatatatgtgtatagtcaaacaccatttctgattctttgttgtctcaaataaacacacacacaaaaaaaaaaaaa

SEQ ID NO: 2752 - DNA, 721 bp, Arabidopsis thaliana
gtgatccatgtaagcgagtctgattgtatcaccatcattcaagatgttcagagcaaatttgagtgatgaagtaatctaggttgattcttattcacgccactgaatcctaagcaagattgtttccagaacaaacagagtttaagcatggtttagtctaaaaccatggattctattttagttactaccttcgttatctaaacgtgcatttgttcatctatttttattccttgtgtttaaagttctttctttgtttagttgcgtttcttctttcgttctcttttggcatgttttaagattaattttaccaacaacaaccagataaaatccaaatgcaataagaaagaaagaaaaatgacaatcgaagactgaaatctcttctttctttttaggtcggcaaaaaagtctcttcaaagtatataaaacaaaaacatgaatcaagattagatttatctttttaacgttaagtgtgtagcacgcggcaagcaatttaaatgcaaaaatagaacatagttggaccagtaacatgtatcaccgtggcaagcttaagagcaaggctaatagcgattctgtggaagtgcaaggtatgcaaaggccgtggggtctattgatttattaatagggccatatttgttgaattatagcacatggcctaccattttgttccccaacaaatcctccattgtttcaaacgagttctgttttttctcctctgtttctaaaa

SEQ ID NO: 2753 - DNA, 2000 bp, Arabidopsis thaliana
gaatagttcaaatacatcccttcttgttctcatcttttaagagatgtggcatgtatcatgtatgtatggggctatgcgatatgcagtattgatgccaatttttgtcaaaagagtttttttttgtgtgttttattaaaaaaaaatattccaaataaaattaaacgccaaaatttgaaaaactagctgtttgttttctgtttatctttgattttattaacttaactattcaaccactaaaattaaaaatgctggattgtttgttgttttaaaccagcttaatgaatataaaagcacgcctattttgtttgattggtgatcgatctaaatatctaatagtctagtcatcccatccaatttggattcgaaatcctatctttggttagaacgatcaaattatgccaatttgtttgttaaacatatatatttattagaagactaccatttcattttaatttagagaagtaaccaatggtttcgcttatgtcaaagtctttgattcaaggatcgataaaatttgaataagaaaatgttgtaacgaacaaatgaacattcaatgatccatcaataaatgttttatgtatatatatatatatatatatattctatatttgaataaaaccaatcaataattctactaatgctccctacagaaaaaccacacgttaaaaacccttaaaatatatcgacacgattgtgagaaaaagactagcaaagagacaatgcataagctaagaaggcctaagggatgatgattaacatgggcctctttttgtacacgttttttctttcctttccttctttgcgttcacgtttcttggtacacgtatctcttacagtctccacgttgaagtgtaagcattacagagctctctcgctagagacaacgatgatcttatacctgttacgttcatgtgccaaaattaggtcttcattttctattggtacatgtcagtttgggccatccggtcactattatacacatatggtctatatttttaaaaaaacttcttacttgccaaataattggtccactaaaaaatagtcggaaattacaataaaccggacccttaaaatcaataggaaaactctggatcttggcttcaactactattgttgtaaactaatgttttttcgcctccaaattccaatctctattttcctagtgaaatacattttattaacaaatttgcgaatatgttaaagattttgaatactagtagccaaaagaaaaaaaaaagaaaaaactgttgttcatggaggcttatttaatttctagaaacgaagtttctgttcgatagaggttcatctcgatcgatcatcaaggaatcgacttggagaaaatagacaagaaaaggtttcagtccactacgaaaagcatacttaagaaaatggaagcgtgggccgtatatgggccttaaaacaattagatacaggccagctacgtctctaagttgagtagtatttgcgttgactgagccatgtcacgtcaggacttcacctgtgggtcgccaacgattggctatatccaccagatcaataatgcaatgcatgaattttacttgaatcgtcgcaatgtacatatcaaactatcaatgatctgattctgaccactcgctcccttatatggtgactaagtcaaggaagattagccacatctatttattgcttttgtccttgctaggcttatacactcttaatctgagaaacttccaacatggccatcaaaacttaatgaggaatcatatcttgtctctggcgttcaaacaaaacaccctaataattttttttttcattctgaagaaaagttttatcattgaagttcaacatccacagacaatctgcattgaatttatcttgacttgtcgcttatgccaagttgggttgtacgaagttgacaaaaaaaataaaaaaatctgtatgtgattttcataatgtgtattataatgattgctttatttagtaaagagtcacaaaactagaaagaaaaaaggtttcattcg

SEQ ID NO: 2754 - DNA, 1779 bp, Arabidopsis thaliana
ggtgtccaaacaaaaatctctgctcataagacaatataagttcatcgacaatactagctactgttttgttgaattcacaatctctgcacctttcttatatagcagccaccttggattaattttgtttttgttttcctttttcctatggtttatgattcagaagtttagattatacgtttatttacaagaatccagagaatgagtacataattgaccaaaaataaaagttcaaattattttgatgtagaattataaattagtatttgtaactatgtttttttttagttttttgaatttttaaagaagaaaaaacacacatgtcaatatttgttcgacaaatattggtatgtgttgtgttcacgtgagttaacaattttgaaaacttatctacatatacatttttgcagccatttatgtatacttatttacattggttgccattggcttttaattattgggtttttttttttggtaataaattgattaacaaacgaaaaacattcgaaatatatttcaatcctatatatcacgcagatttctccaaaatttaaactagattttggcaactatttaaaacaaaaaatgtttgacaaactaaaatacaattgcaatcccttaaaatgagcaaaacgcacctaaatacattttttacaattcactaaatcttatttctccaaaatttgaactagatttcggcaactatttaaaacaaaaatttgtttgacaaactaaaatacaattgcaatcccgtaaaatatttatttaaattagcggtgtactacaggtttttttacggaacgggtttggcaagacgggtttggaagaactttacttaataacaattgtaaactataaaataaaaatgttttatagatagatataatttgcaaacttttatatatattaattttaaaaaataatttgtctccgcagtatactgcgggttaaaatctagttataatatatatccgtaaagaacaataacacagtatgaattttttttgtaagttattcgattaaaaattaaaagaagcaaattaaattaaataatgagctaccaaaacaaataaacaaaaattacttttttgtctataaacatggagttttgccaagaaattgtaaataaagtttctattccttttttgtaaacaaaagttgtgtatctaattttctcttttccataagttgtgaattgtgataataatttacaagttgacaaagaaagaaaagatttaaaacaaaaaaaatgtgattgtacttaagatttcaaaggtagcgttttgttgtttctctcttcctctctctctccactggtaccaatcacgctccattaagaatttaagagagagagagactaaacttgagcccatcacttttgtagtgactagtgagtagagtaggcttttagagagagagagagagagacggctgttgaaagataaccacagaacacaaaaactcattcattaagaatgagaaagaaagtcccaaaaaccttttttgctctgaaaaagcaacgcaaagttttgaaaaatctcacacctttttcacttctctgtttgtagctgttaccacttgtgtttcccctttggcatttttctcggttgtcattaatgagagtaaaatcatcatcaagtgtaaacttctctctctctttctctatctctatctcaaagctctcaactttggagagatcatggtttgtgtttgatttctcaagtttttttttttttaccctcttggaggatctgggaggagaaatttgcttttttttggtaa

SEQ ID NO: 2755 - DNA, 2000 bp, Arabidopsis thaliana
ttctctatatttggaagactaataattttgtgatatcaacttcaattctccattatatatcaaattatcatctgaaaaaataaaatccacaaatacatgaaacgatatatttttccctacacgattatatactaatctatttataaaattaatttttcatgtataaatatcgataatatgtaacatatcataacatttaaattcaaaaaaagaatgtatcataacattaattttcggtgctatgcaccgggtataatactagttacaaataaagtataaaaggaattaaacttttatatagataattaacacaaacaaaatattagagacgatttcaaataaattatgaggatatagatgagaaaaatactatatagaataacaatagtaagaaattaaaaataaataaatcaatttgtacatataaattagaaagaaaaatatagataaataattaaacaatattaatagtatcacataggtcaattaaaattttatatacaatagttaaagagtattatatctcaaaactaagttttgatactgcgtagaacaaatcatgtttcaagcaaaaatgatcaaattcctatgatgctggaaatgcttgacgatccacatgagactggctatgtgcatgtatggagaaaaacgtgttgttcgacaacgcgtgcatgccttcttccacctaagtgacgacgcatcacaaaaagttatctagtagtgttaatagttcatgttccatctgccgaaattacacacaatataacgtattcgattatttgttatccaacaacttaaacgattcgaccaactcactcaaccttttgtcactagttccagtcatatatttcttataaatactcgttcactacatctgtacagatcgaaagaatctcttgatatattacaacacacccataattcataaagactagctcatatacctttgatatatgagatttgatctatatgtcgttctccttaactagatatcgctaattgggcttgcattcaacaagcaacatatatcgcttattacattcgacgatactcagcttctacatcttaagtctctctttttttctgagctcaccatcaagtataagaacacaattctacctcttatttgtctactcccaattttttgtttttggtttttcactattctgacatcttatcgtattatgattaacgttaagaatgtcgtctcgaaaatcacctacctagctattgtttcaagattcgactcccatgcgcgtcccatcaagaacaaaccatccagaagcatcaacctccaactattagagaataatgtcccattcgcccctcgctggtcaaatcgcttccatttgattcacataagtccaacaacaacgatgatctctggtgtactactaccaaaactcaaccttgagacagattctcaaaatactatatgttctattaactattttaacttgaatcaagttgataattgtagagagaaattttttgttcacttcttattaatttgtaaaacatttattttaaaacccattaccgttaagctttgatacaatgatacatgttattttctgattaaaaatggttataaacttgaacggtataagactttagtgtatagagaacaatttagagaatctgtatttatgtaaccgcgacctttcggaaacgtagaaggtggtcgcacaaacaaaccaatcaaacccttaatcgatggcactcttttaatgtctaataaacttcggttcgtcactcgaccggacaattaaatatgtgattaaaagtgtgaatttccggttcggtagagattactggtatttgttaatccgggccggaccgggccgtatctgaattatgaacactttcctaatgtcatagaatcgttcgtgccgtcgtcgctgcgatctgaccaaaatcaaaagtgttacgattcggtatcatcgtctctctcatttgtgattttgtcaaaccctgctctcttttctccaagtgctctc

SEQ ID NO: 2756 - DNA, 1870 bp, Arabidopsis thaliana
caaggaatatctaaaattaatatcttcactttatacaactttcttatgtattcctaagaataaaatgaaacatgcaactttagcagtactgtttatcccagactgggacacgaatatatgtatcaagatttttttgtgtggccatcaaaacatattgggccgtggttctaggcttcaagcactcggttttcagatccgaaccgggttgaatgttgggtcttcagatgacgacccggagaggaatttacttggactcacccacttcatatctatgtactaatgaaaataaaaatatccaacaggccattacggatgatcatcacacaattattgcatgcaccaacccattatcaatatttttgttttttgtttgcaaaacacaattatcaaatcggcaagtagatgttagtcttaatcactggaataatgacgaaactattcgagtgattaactgattatatatatacttttctgtcagtgactatatttagtataaccaaagaaagtatttaaatagtgttgcaatttctttataaccgatctgaagtttgagctgttatgtgattttttatctttttttttgtttttattctttccgctttcgtaaaagctttttataaaccattgatagactgatagtgaaagaaattagtcgacgaaaaaaaaaaaggaaaaaaaatcgacgacaaagttgaccaattagatgccacgtcatcaagactaattgtaatttgtcaagtggtccccgcttcgtagagcccaaagacgaaatcttattcacgtgcttgtaaattaccaatatgcccttcttaagttccggtgaacgattcaaagtcaacgacgacccccatgggtcgatctaaaaaagagttgactggaggataaacaataaaaatatacaacattaggctatatatttgttgaacattaaaaaaagttataaaatttgttgaacaagaaaaggttataaatttagaatctacacacaacaaaacgaggacttgaagacctcgttgtttcctaaagactgaaatctgttgttcctaatgatatgaacatcattaggcgcaaagtatctaatttgaattgtgcgtgcatgttttttctttttaattattgacttattgtgcatgcatgttaatttacgattctaatttctaaagcattagcctctttcgtaacttagtggaactttaagttacaaaaaaaattatgaaaatccattcgattaattaggtgtagttggatttgggtcaccatggaactcatttatattattgacctgtccttttctcacttgatctattgtttatttagagaatatggtaactgttacaagatgtttggtaaattatagcctaaccaagctaacataaacgtaaataatatcgaataactcaattttgaaggtgaaaatggattattgattattatttatatactatggactatggagattggagacagacaatattcacggtaagaataatcgacaatggacaaatttaatatcaaattaaaaataaaaaaatatattaaaatatgctagtgtgctgaaaattttgaagttgaccggtcttcttgatattttttgtaacaaacaaaaaaactagctgcaataggactcaatcaatacgattgaaaaaataataaaaatcccataaaaaaataattgtaatcctagtttgacttctcaattctctgcatctctcaatcacgcatttatatatcatatcattcaagcctttttatcttagtgtctctctataaccagagaaattatttcaagatctacttctcatcatcgttcttttcttatctcttcttgtccaacttcttctgaatcaagacaagagaaaagcaaccaaag

SEQ ID NO: 2757 - DNA, 2000 bp, Arabidopsis thaliana
ttactataccaaacaaacgcaaatgacaaaaactacgcagcattaacaactatattacaattgtcattatttatgtataacattataatacactatcaaggcttctagattgttacatcatctccttaattcttccaagttacatcatcatatatagttgaaattaatttctattattcgtgagaatataagttgattggaagaaggaagattcagtctatatatatatttgaaatactatatgtggaagaacgtagaattccctattgcgaactagaaatgtgttgacgtaccgtgtataaccaaatgtaatatattaatcaaaggacatattaacgtacacattttttactgcatagtcagcaataattgacatttaatcatacatgtattagaaaatggtatgccacgtaagacgcattaccttgcatgaatggcatgtgtagtaagtcgtcatccgcatattgtccaaacaaacaaacaaataaacacatacgggcaagaattaaaaaaaaatcatcttttgttggtcttatatagttgcttatctgaatagtctcacactctctcacttgagagcaagagtgcatgtaattatactatagtattagtacatacgaacaatttggtggtgagtataagtttggatctttggactatatataaagtcattaatttcatactcttacgctattcttttatatcttttaatcaagttgacacatttgtctcattgttttggtgcagagatgatagattggttttctttcttttatatatatgtattgaaacgataacgtgtatgtctccactttctacaaatgaattttaaaaagctcaatgtgtatacataggaattgataaaccagtgattatatagtattttgtaatatactgacacctatacagttttattttagtaatatttgtagccttgtagacaatacataatactcatcacgtcacgtgtagaatattccatggaccgtataaggttcctcctccattgtatcccacaattaattagacacagcttagattagcaaaatggtaatttctttcgtttgagttatgattggcgatttcgtataaaacgaatcgagagaataaaaacgtaaaagaatcggaatatgattcattgcttaccatggttaagtttaatgataagtgcttttattgataacatatatggtcaaataatacaataatttgatcataaagagtaaagacaattgaaaaatgaaatcaccaaaaaagtcagatcacatacagacacattgacgcatcgacgtcaagcatcgtgagcgcacaaagagcttacggctttattattaacacacacactaagcaaaacagtaagtccacgagaaagcatccaaaaagcccaaaggaaccacctttattttttattttattttaggcaaaggaagctcctttattaaattcccaatcttcttccactactttgcacaatctttaatcgatccaaccaataaattttgcattttttttcgttggcgaatgaaggattagagagaaacagaagaaattgttaatttttttcttgttgattttaattaaagagaagagagatctctcttctcgattgctctcaagaacccaagtgacgtctggtttcagctgatttgtttcttctcattctctatcttcttctctgggaaatatcgattttgatctattaagagctggtgagagccaaagtttcctttttgtttgtttgtttgtttgtttgttgtttgtatttttgtatctctgtgatcgcttctacgtgttgggtcatgcagagaaactcattttgttttgatttgcaatgtgtcaattccactttgaaatataagattcatcgcctctctctcctttgttttttttcttcttctgcagctacgagctttgggatgtggtgagatgcttgttctatctcgaacaatccgccggttgttgattttaaacaaactctctatcacaaatctttcccgatc

SEQ ID NO: 2758 - DNA, 2000 bp, Arabidopsis thaliana
gtatgctacgtgatactcttttaacacccaacaagtaacaaatttttgttttcaataaagtaatataataaagtcttgcactgatttgaaaaagttgagttcatttagtatttttgacaggtctcactcactacaatattcatcatcattccctaatttatgacaaacacaattattatccaacctaaaaaaataaaacattatatagttagaattagaaatgataaagttttttttttccttgtagatcttgcagagagccatgtgcatggggaataagcttcacctgggtttttcttatacacatattaaaaaaaaaaaaaatctcatagaaagtaataacaatataatagtaaaaaactaaaaataaaaagataaaaggactttaaatcatcatgattcatgagacagcaacgaaagatacatgtagcattttgctaaaaacagacacatcaaatttataaaaatttgcatattaattgtatccacatatattcatattatatgtattaaaacattcatataatattaatataataattatttcattatttgtttgtatatctttgttgcggactttcgggtcgttagtcgagacttctttatgaaattttgttttgacaactgtatgctttttataataactttgatagtaattgatatatattatactgatattttatgcttttttttgtgtgttatctacgaatcatttgccaatctttttcacaacttttgcactcttatgccattgacagcctagaaccctcgatgtgtgatcactaaaatacaaccaattaaattgtttagttatcattttggtgaactaccgaatatagaatatatataagaaaatcgaactttcgcctataattactttttaacttttcaactttcaagacattaattttcttcaattacgtatttagaaataaaaggttcagaatgtgtagctggcacaaggattctactctttggttaattgaatttagtgattttacttgcaagttacaacaactattacttactgtatttcttattaaacaaataccactaaataaccatgatttgtgtttttttcttcttcttatgaaattagtgaactgcatttttaatactgtacttcatttttcgtttgtgatttaaaaaatggtttggattatgaattttgacttaacataatagtaatgtaagttctgcgtataaaattcaactctgttatgctatttatcctataaacattattttgaaaattactcacactaaaacacaccacttatttacgaaaatttaaccatattttcttgctaataaagtaataatcccctctaatttgaattacataacaaattcacccttataaacaacttgtcttttttttttttgtgcgaataaacaacttgtctaaaaattaaaatctcgtatatatacataacttaccaagatacaaaaaagcaaatttgagatatttttggcaatttaaacgatacatcttttaccaatgaaaaagcaaaattgagatattaattgcttttctatttcaccatttcgtttgtgtgaagcatttgacaaaatccaactcacactacgtagtcaatatatccactacaacctttaattattttccaaataaacgttatctcaatcctatgataaaaattaaataaattaaaaaactccaaaataaaataaaaataaaaataaatatatctaatctgttaccaaactgtcattggcttagtgggacagacatcccatgtgcagtctccttggcttctgcttcatagtttcatcttcttccttctctctcaatggcccatcttcccatttcctaaaagcttcaaactttcttcacatttctctctttatctctctgtttcttcttcaatcctctgtttcttcaagctatgaagaaaagaagaacctttcttctattttcatttacctttcttcttcttctatctctttctaaagctgattctgatggagatctctcagcg

SEQ ID NO: 2759 - DNA, 2000 bp, Arabidopsis thaliana
tttcaattaagcatctttttcttggatttttttttcacaaagggagagctttaactttttgcattaacttatatattttaaattatacatgcatgcataccgacttatataaatcatatggtcaatatgagacttttgatttatattatttgtcaactaagcatcttttcagatgaggttcatgcacctttgttagaattatcggaccagaagatcacatcaacgtttaccaaatcaacaaaaaaatccaatccgtccaaaaaatttggaaactgtttgaaagattcgaaatgttggagcaaggatactcagttccaatctctgagcagaatctgatatgactcatctactcataagactttgcgagatagaccggtacaaaaccgtttccaagggttcataatatatggattaatgtgagttattgtggacgttgtggttgtagaagccgcggtagtcgtggaaacactaattagttatctcctgtaagctatttttattttttttcctcacttcctcttcctcgcagctatgtataattttggttggttatctccaaaactttttatggtcaaacaattttgagaaagtaatttggaaagaaaaaaggtttaagaatatctttttatcgtcaagtcctcctccaaattacttccttaaaactgtttgaccataaaaagtcatagcaaggtattagttattctaatttaaattaaacgcctttttatcaacaacaaaaaaaagaagaagatttgatatgttgaaaagtattagggacgcttattagggcagtattcctagttattgcattttctttcggtcattcgaccttaggatcatacctcaatctgtatgactgtattcgccatgtgaattccaatattacatagtgaccaaatttgatatccaactaaaagtcgatctttgatctaaacgaaatgacaactatttggttagtgattgcaggttggaaagatttaccttctagacctgtcttacgaagctagtattctaaagtaatcttcataaaccgaattcagaaacaaaaaaagaaaaggagtccaaaattgtatgatcatacattaatatcagaatagtctcttttgttaaataaatatctgaagaatatatatctctttgattattttgtggatggcaatgaaactaagaatatatattcattgacttagaagtcgacaaaaaaaaataaaaaaattattgacttaattactagttgaccaatatatatattattaaaagaacatattgtatcgttgaaagcggatcatcgggttttaaaagaaaaacacatcgttgaaacttgaaagtgatgactaataaaaagatctaaacgtgtccggtcacctaccaatgtggttttgcaaattattgtcaagtaccttgactatattaaataaaaaaattcaccgtaacacattgatattcaactgattcctaaaaaaatatacaaactattgggagttgtgagattttttatatcagtgttggtctctttacatttgtgatgtggtgttatagcatatatagtaataaactcaaaaggaaattagatgtgttttgaccatttattaaaatgaaccttttcttgtcaaacatttgaaaaatactagtttttttttttggcaacgttgtaaataatagttaaaaatagattttaagtctcgtttttttatgcatatagtttcattcgctttattagactcaaatatacttttaattaaattttgcagagaattaaaggtaatcatttgccaaggaaaaaccatgcaaatatgcaataagtagaaataatgttaatgagagtaagcgttgacatatattacgtcctggtccgaacattcttaaagttgcgtaacactaataaccttagaagatggttggttgactatcaacatcttattgaccaaatgtttttttttttttaattataaaacagttgctcattgctctagcccagagaaagcagctcaattaagtaa

SEQ ID NO: 2760 - DNA, 2000 bp, Arabidopsis thaliana
atgaagcaaatagctgcaattaattttttctacgttttaagacaagaatatatattaaactacttattttcttctacatcttaattaagtagttagtattcttacaaacacttctgattatcatttttgtgttcaatatataaactcctttctatttaaaaaattccctcaacactataatatcattcagtccctatctaaaagttaggtgtccatagagatatacggatattgaaatttaaatgatatatggcggagatcatgcaaggacaattatcttcaatagaatcattacgacttattaaatgtgtgttcccgacattttattacatgattctactgttttctttctcatcatctcattccattatttgtttttctatttgtgtttctagattacttgacatgtacgttaaatcatttatcttccttttcccttgatatcccactcgaatgacatgttgctgtagtactattactatggttggaaatcttatttctctgaataataaaagtttatattcagataactgctatgatacgtaaactttccaatggttatttaattttgttttgcaattaatatatgcaactataagtaaagcctagtgaattctttggatcggagttatatgctatgtgctaataatacaaggaaccccgcaatattgatataaaatttaccaaactgtatcccacactttaaaagttgtcatcatactttatgtgaatgcaataggatccaaatcgtttggggaagattttacattttaaattcttatattccgcaagtgcccaatggtgccgcacgaattatttagtgtatcaaactattggtaggagcaattagtaaagcatatacagtgcaacaatctatttaaaagtatagaaatatctaactaaaacatattttgaagattccctcgtcctccaatcgtcttccatcatcgaaatatccctttgaagagctaagaaacttggtgggaacaaatgatgctattcgataattttcttcgattctatggtatatttggaaagattggaacataattaatatatatatcccacttgatgcataaagaatgttgtttaagaaacggagttctgaggtaactgactgacaagtgcttcgactcaaccattactacttaccaaatccacggctcttggcataccccatacacgcttagtggatatggttgaatcgctagttcccaccaccagcttctttatcttgacttaaaagagggcacgtcgatgtcttcctcccctacacgacaatgtagaacatgcatgttcaaacaatttgcaaatggaagatatattggaaatttgtgaaaggccatgaggtagatacacaattaaattcatgagttcataggtcagaacaaagctgaagcatgttctacatgcccaatcaagaaaaagtcaaacttttctcaatgccgactttactgttctaaaatgtatgaaaatacacattaatatacaattataaatacatgcaaatatatattgttataaactatataatggttacttgatatggatccttatacttaactaacttaacaccaactccctggatctataatgtatatattgggctaaacaggtcatgtggaagttatttgaaaagtacaccatatcgacctaattagattggaggctttttatttagttttttgtcaacaattagatttgagtaacggatgtaaccatattatttgttcctacctcctaggcattattatagtataaggtttttttttaactaaagatgatttaaaaaaaaaaaagtgggacctaaaccttaaaaattccaataacaaatagtatagaggtcctttttctctttatataaacccccaaaatttcctcttctctgtattctccactcaatacttatttcctctgtcttccttcgcttccctcttctctcaccacaatccgagagagagacagtactgtaatccaagtgagagagagagagaaatgaa

SEQ ID NO: 2761 - DNA, 2000 bp, Arabidopsis thaliana
tttagtcgtatagcaagttagggacaaacaaacaaatgcgatttgtctttccttttcttttttttaatgcgatttggcttgatagtgcgcctctacgcttattatagccgacaaactaaaataaaagaatcgtctatttattctaacctttaatgacattttaccttttttgttttgttttgttttgtctatcttttatgaagaagactctaaaggaacgaaacttcttgacgttcaccgctagcaaattcttgaatgcatgcgattgtctttttcttatggaagtcttagctttttctcttgaatatggattttaatattcttccgtctagtcatcaaatgagattaagcatttatctacaatatatggaacactaatcatataagttgagaatctacaatcaaacatttttaaaattggatatggatgtggtattgtatggtaaaccatcttccaagtaattggacatttggaatactaagatttacttggcatatgaaacaatttaacgtcccttgacatttgtaacaatttcacgtacgaacgattgcaacgactttgttatgtgtcaaacgcttttctaatatggaagttgacacgactttgagaattaatttgtaagaacattaaacaaataatcttccagttttgtagtcttctattgatgtacacttcaaagaatcttctagttcataatcccatgaccggaaacggagtccaattttgccatacaacacggtcgcgatggcaaattggcaacaccgcatggtccgcatgccgatgaaggtgtcggcatcctattgacgatctctatatttaatacactttgatttttttttaaaataagtaaatgaattagttctaaagacatcgggctgtcgtgtgagccaagtaaattaaagtatttcataaattattctattttagttatttacaaacacacgcgtgtgcacatgtatttggcaaattatttgagtcaaacaacatcttcctatcacaattctgaacttctttatactcgtgattaatttcttatatttttgtcttcactgttttagtccacatgttaaattataagaacttcatacacgaaaactaaacaattaaaaaaaaaaaaaaaaactaaacaattagaataatttcaaacgaaataaaaagtcaatacaattagtcttgtaagagcgatgatcaaatagattgaaagactataataatgctctaagtttattttaaaattttcaaccaattttatctaccatttaaaaggttgacaaaaaaaaaatgttgactaaaacaagtcttgatacaattatttgaataggctgaatgatgataccaatcaaacttacatttaataaaatctgaacattttaaaaaataaaaataaatgaaagagaattccatgaatgatgatgagatagagccatagagagactgagagagagagatgtggagaaaaatctaactttggtcgacgaaaggcggctaagttggttattgacatttagctattttttttatgaatccgttcatacatcgatcgatgatagtgactcactctacgtaatcgtttaattagtcaaatctgctacaactaacaaataaaaatctcccctttccttacatattctctccgcaaccctctttgattctattcaacgctttgcctaaagtcaatcttcatcaatttctctccattccttcactcaattccggccaaagttttgatttttccggttcgaatcactctttctggggatttcacagtgtactgtgtgtggtcttccgaagaagaagaagaattcaaaaatacgatcttgttggttttcgtgaattgggtatttcccgctgagccgttgaagttgtgtgtttgttctgagtggattgaaattagggtttagattttagggaagtgaatggattgggttgtgaataataaaggttaagtttttctgtagattggttatgtgtgtagattcatgttctagagagcatacga

SEQ ID NO: 2762 - DNA, 2000 bp, Arabidopsis thaliana
caagctaaaatgtttttttatgcaataaaaaacaaatctcatgttttcttaagctgtatacatttattatgtcttcagagcttatatgcttctttaaagtttttgtttattaaaaaacagattttcttcaaaatatatttggttttagttttatctaagaaatacaagaaaagaaagaaaacagccttcggtttgttcttctcgacagaagatcaagcattctccatggcttcaaccatgcgctcatgcagcctctatttttcccttttacttcttcatcatacgaaacatcttgattgaatttagttctagtaaataatgttaagttttttttttcttttctactaaataaaaactcatgatgaggcataatctatatactttgcaagaaatgctttcatattagtgttttattcatccataaaaaaactatttaagttgaaataataataaatattagtatcatataggagtataacttatatatcagagaaccatttattaaacttgtcttaattatgtccttaagattgtacacatgacatggctctgcaaaacataactcagttcaagtatcccttgggatgacatgcgttttcggggttttgtttctcgatcattaattagtttctagaaagagagacgacgtcaagagtcaaaaccaaatgaaagtaggaaccacacacgcgttgaaatgttcatagttttcttcacctttgatattcgctttttacctgcatatccatgttttatgatagaagacaaaaacccttttgcttttttattgtttataagtcaacaaacgaataacattttgagggatattatttgtttttccttttgtcaagagagcagttagaaactgttcatactctttgtcccttttagttaattttttatcacaacaaaggaagacttgtgaaaccttgactacttacttactaaaccacgaccaagtaaaacattgttttttttttgtaactatataaagctttctttataatagttaggtttaaatctgaagtgtcaagaattttaaaaaacgcgtgcgtgctttgtgaccgaatcatcatttatgtttctctatgatttaatttcaaaatggtgcgggtttatagtctaatagcagtatttgtttatagataaatagcatttatttatttctttttactctaattaaattctttggttctttctttcctttctatttggttgtgacatttacatttcatatcaatacattgtatctcccttgttatttagctttcaactaataagaaaactcttcttaaagaaatctgactagttaacgtgatcaattatacgttctatattgtcgatcggtaagagttccatatattcactcgtttcaaacaaagttatatatcaaaaccggcagtaaaactaaattttaaaactgtcaagatccgaacaatcttaccatttgttgtgtacaataaaaacttatgactgaaaatgcatgaaaataatctattaaaaaccaaataaaaattcaaaatcctagttttcaaactaaattgttaactgttaatagatcaccattaattcgtcacaaagttcaccttaaccttttaatcactacttttaacttttggttctatgttggctctatcaaaataaattttagttttaactttataaaaataactagaaactagtataataaccaaaaatggcggtgaaatagtcaaacaattcatgcaagcttgggacatttggataccaaacccaagatttagtctctttgatttcaaaccattttttcaatacattgtcattttttaatatatctcttaattgattaaaccccaatcaagttaccaactctattgccttgctttttcctcttcatgacgctataatccacgaaccctctggcctatatatactttcgattcttcttctaatccttcatatctcctaccatcacaaagtcatctccttcttctttcttgatctagctagcggaaaatttgaca

SEQ ID NO: 2763 - DNA, 417 bp, Arabidopsis thaliana
gtttttgtatgtaaaatgctaatacgttgcttagcaacggtaacgaattaaatgaaacgtattagcataataaaaatcagagacaaaaatcatattctaatttccaataacccattgttaattatgttacagtcttacaaatatgaatgttcagtgttatcaatcaaacaaaattctaggtgtgaaaaaaaaataaaaaaatctaggtgtggcattgctatgctaaatgtcatataattagctaaaataaataaataataatgattaggtatctaaacgactaatgggcacatgtgatttggccgaaataagattctgttttcgaagtcaacgtctatggagtagttcaagcagattttgcaccacatcatcctctgttacaacccctgaagatccttgaggaagaagaagtcaaat

SEQ ID NO: 2764 - DNA, 2000 bp, Arabidopsis thaliana
cttagattcttagttaaacttgtgttggtttatataaacttagttactttttttttcgtgttaagacatgtcggggtcttattgtcttacaatcattatatatttgtatctatcttgttgtgtggaaatggaacgtatcgacctacattgtttttttgtgttttggtaaacgtatcaagtatcaacatactttaacaaccaaaaaaattgaactctttgtctggctcacatcaatgaagatgattaattttttgttactcgatcttaaatatatgacaaacagaatgtagttatacgtagttgcaagaaaatggaatatactatttggatagtgaagattctagtttctatgatagatataaatgcgcatttcacccgaataattccatgatactctaatagattatatattaaacaaatacacactactgttcaagtttgataatcaatcgcgagacatcgcatataccgatcgttatttgtttaccatcaaagcactattttgtccgaagtaagtaaatatagcaagtggcagtaaaaaaatagtaataaaattgaaggcaagatcaggagagagctggctgaaatgaaggcaagaaactcgtgaaaataataattgatccatctctatccacgaagccctacataatttagtaacgcaccacttgtggttgcatgcacatttatttccataacgacaaaactttgtgtttaattttataaattatttctgttggcacaacacactcattatagccatatgtttgtgtttatattttctattttcatagaaacaattaatttaattttagatgccctagacattttttaaatgtatataataataaaattatagtataaaagtctatatattaccctaaattttacaaaacatatacaatcctaaccaatgggatcctatatcaaattgcattcaggatgaaaaagaagcgacatgaaccacgacaaagagaaaagttagataaatttaaagttgagtgagaacttgaagtctttaattctcattatacaagcaacaattttctttcttcggagagaaagaaatgagagattgcacaacacttcaagttctctcctaagattgttttgtggcagattgacataaccatccgtgacaatatcgcaaaggttgtggaagattgttgtcccaatggttcacccaaacctagttactatagttgggtcttgacttgtattagtttcagttttttttttttttttttttgttggggtccatatctagaagctgtcccaaagtaaataacaatgtttcttttggtaatagtaattcacattttatccttaaaaaatcttcaaaaaatgaatatgaaagttacgacttacgagagaaatgcaattgtaaaataatgaaattcaaatttaaagcttcaatgattttgttaagacagagagacgtagcgcattgattacagacgcgacacatctgacatacaacatttgccactacaatgcacgactgtcttcggattaatacattaatgttacatcgttagtatcaatcttacagattataaatagcttagccgattgtttaagatagtattattctaaattcatatacactcgtgcaagtacaacaacacactaaagttattaaataataaacacatttgatgtagataaactactttttttagtgacgtgactttacaggcccaataatatattctgaaaagcccatagtaatattcacaaaagccccttgataaagttgcaacgcgcgtacttatctgacgtgtcaggtcacgccacgtggattagaaaaaaagtggtaaaagacaaaacccttttgtactcaacggatctgagtgaatcctgaaaacttttttaggatttcaaaattgatttgaaccaaccaatgattcttggatcccatgaataagccttcacgtggcttttgatttcacattccacgaaaatccaattttaactgaatttgagataattttggtttagtg

SEQ ID NO: 2765 - DNA, 1484 bp, Arabidopsis thaliana
tatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaacatggtagcagaagaagcaagaaaagaagcc

SEQ ID NO: 2766 - DNA, 2000 bp, Arabidopsis thaliana
ttcaagctttaaattactttatcctctaaaatattactcaaaattatgaaaactggttattttttatttaattaaaagtctcctaagaatgtagtattttgaatgaagaaaaatttcttatccaaaaaacctaaatttttaaaaaacaccatagtgtttttgaaatccgtaatctaagacacaccatgaattattagaggagtctctagtagggaccgttttatcttaataattactccagaatttgttgatctgtaatccaaaaaagaaacacaatcaagtggtaattaactgtgttcataatgcttttggagggaagccgcgttttatgattgaaagatgaattctaatcaaacatcattactcttagaattctaatgataattctttaggtcccctcaaagattatgaaattaatatttgtttaacttttttagttgtatacttttcttttacctttcatcaattaagtcaactatcttttctctccctccttggacttttcacgtatttatttgtttcttccacctatttttccgtataagttaagtataataactcctattcattaaattattttccatttcttccaaaaccaaaagtttttacctatgatactatcaaattattgatttttttttttttcattttaacattctactactaacgtgaaataaataaattacagagaaatattccccgttcttttgtcatcattatataaactcaatattcaatttcaactagattcactttattatactcttagatttttatactttacataaacctcgtatagtgtggtaaattcccactactaatgctacatgtatgtctatattaagattattaaaaacataaatctttttaaaaagctacatatatgtgtgagagtctccattatcaacggttcattgtctgctactctgattagcattttcttaaaaaaaagtaattagaaaaagaaaacaaacgaattaaaaaaaagaacaaaaaccctaataaatctctaaaaagtccacacacactaacacactctctctccgtctctcactaaaagcttctcacttacatttctgctttcattcattaatctctgtgtttccttcttttgatctttttggcaagatctctatttttcttccaaaaaaggaaaaataaaaagatcataacttcagaatcaaagtttctctttgttcacattgttctatccatctgcacatttgattcatgtagtgactaatctcacagtctcgttctcaaatttactttatctgcttgattcgtttcgtgaatccaagtaagttttacactttttgtttttgctttttggctttattctattcaagtttcaagtttaaaggatcctcttttactaatgtagaagcatttttttttttttgttgttttggtttctgggctttgttatattgcttattccttgcttggatgatttgtgaaagtgggttaattcttctcatctttaaacttttgatgtgtgtttataattttctcaagatttgtttttttttgtctttctctgttccactgattgctcagcaacagttgctactgtagtttctgtatcgtcttcaaacagttgaatttgtttaggtatatttgtctatagagatgttgagtttaccaatctacagtgtgattgaagtttccccaagtttttatctttaagttactttggagtagcctttctttatgtgcttgaatctcttctctgctcatttgattttgagttgtcagacgtataaagtttagtcttttatcactgtgaaagatagcaacactatctcataatttctgagaagagtgtggagattaacttgtgtagtggtttttaatacaattccaattctgtgaagtgattgttgttgttgctcaatatctgttgtttttcagggatgctaatgttatacattggattttgatactgcagatttagtctgaagagaattaagcttggcgcttctttggtgagaagcaag

SEQ ID NO: 2767 - DNA, 1120 bp, Arabidopsis thaliana
tattcaagataaaactcataaaaagtaaaatgttgtaaccctacactattaaattccattgtacaatgagatggcaaaagaaataattctcatggtttcatgatttgtaaacaatgctgctaaaaggttaacaattctatacatatgatttttaaatcatcttacttaaaattaaactagttgaattatatagtttaagcatataaatagaaaagtaaagtatataatcatttaaagaaaatcattttttctctctacaataattcatttgtaagagatttttattcattagcaaaaaaatgtaaggagttatttcaagactttgtgaaccaataaggcttttgtgtccacaaatatgcccaaattagattcttacatttgattggtagtacgtgtcttccaatatctctttcacatttataactttaggaaatgttgaaactcgctgtatttggttggcttattagacgactgtgtgacttaatttagacgactgtgagtctctgacaatcacaaatatcatagaggaagtagtgtagccaaaagccaaaactaaaagtcaatattagggctaattactcaaatactcctcggaaacgtgacagcttatgctgatgccaattctgatgccattcttaaagatcaaattcataagcataattaatcataatgactataaatcttaattaattaatttttaagttttgtctcaaataaacaaactgtcactgttattagttaccgtcgaatcttccatcatcaccgataaatactttgatatatactagtagtgcctaaaacatcttcttttttatggttacagcataaatgagcctgatagatgacagatttaaatattgatattttgagtatagaaatggagtattttaaaaccaaacagagagttaattaagcattaatcttggaagttgtaacacatatcacctaccttcataatctttctcaatcacgagtatatccccacacaaggaaaaataaaagagctagtgacgacttttccactctcttcacaccataaatcgtctctctttctctcttcacaactaaaaacaaagcaaaagaaagaacaacacagagcagagaaaaaaaagaggtagcc

SEQ ID NO: 2768 - DNA, 2000 bp, Arabidopsis thaliana
aattaattaaaattatagatcgaaaacattatggtctcgtaaagtttagaaactatggacccacgaagaagtgtttggcgaataagcgaaggatttaatttagttttgggtatatagaaaacgaagtgtaaagaaaacgtaacgttatggctctttctaaattgggtttgttttaagtactcgtaaccactttcaacacattcactgtatatagtgtgttgtattatattgtttgagtcgtcatatgatgagattgtatatatataaagaaaagtcttggaccttttgatatggtgatccatcacatcaactacgtaatggtaatactaatgctctacgatagatgctatatttacctaagaaaaccgattttttaagaatgcactgaattttgctatcaatcagttaactattgataagtcatatttagatttttattttgtttcatttgtaaacagaaaatcacaagacgttggagacatcttggcttgctcctggcacctataaaaaaatgtatgtttgcaataatattagggacttattaaagtaggcccaatgggcttaagattccaccaaattagcttgacaaacactaagggcctgtctcggatattagttgtttttaattagcaattgaataaactgatgcacgttgactctctttttttcgtcgtcatgtttgatttttttttttttttgtcgtcatgtttgattagttcttaaatcttaacgataagttaaattatcgatttaatatcaacaactgtagcaaattttaatattctacgttaaaaaacttactactattttttttttttttttcagtaaaatgacacaaacatgcaaacctagaaaatagctttgacttggttagtttcttgttaaagaaaaagattacaaacaattaacataatatattatgcactacaacgggaaacaaaattaagaaaaaagactctttatctacaaaaaaaaatcatataaatgtaaaaagggttttatcattgacaatttgacagttatcaatttacatcaaaatatattttaaatgtttttaatattcatgtacttaattagatcgctaataatgataataaattgaatatcctttttgattgtaataaatgagtagatgagtcacaccaactgtagctaccgtgtcaaaaccttatccagtaacacgtgtacagctggacctctcattgtcgcacgtgtcagatcatcaaaccctaaaattaaaatcccaaagaaaaaaaaaactttcctctttcttcgcattcttctcctcctatcggactttgccacaccagatcggaaaatcccaatcctcttttcctttgttttttttgctatcttcaatcaaaaactctccgacagattcaatgaagcagcaaaagagataaaaccctaacaaaagtaaacaatcggagttttaatcttcttcttcttcggagccggagttttgtctgatctgtcggagaggacgtgtcggcatctattaaaatcctagctggacttccacatcactttactcaattagaagctggtctgttttctctgtttttattctaactttttctctcgtttaatttctcatatgcaaacaaacacctttgcatgtaactgattctgttgtacttgaattgaattctttaatcaattatgcaaacagagcttgttttggagatgatgattcacaagtatgagattgtctttctgcttaagaattcgttgagtgttggtttctgaagtttgaattgtgtgtgtgtgtgtgatttaaaatactgatgcatggttcgaagcttagagattttagattgctataaatgaaagcaaaagaacagtgcccttactcttgttctgttttaaagtcattgattgttataattgaaagcaaaagattttagttttgatgttttatgattactatttatcgttaagatttttgatttttgtttatagttttgagtaacacaagtaagtagtaagcttataaaaca

SEQ ID NO: 2769 - DNA, 2000 bp, Arabidopsis thaliana
cgtttctcattcattcttttaattcgttaatcgacattgaggatggctgtgtgtgtattgtgtgcgcttaaatcaagtggatgatcttaaccaaagaaccatattctttttcatgatctcctagatctttgttattacttttaattatctttcaatgtaaacatggaaaaaaaaataaaaaaactggtacattttgtatgcatttttgcggttataaactttggaattgtaaagaatgaactagattttaacccgcggtacaccgcggagacaatttatttttttaaattagtatatataaaattttacaaattatgtctatctataaaatatttttattttatagtttataattgttattaagtaacgtccttctaaacccgttccaccaaactcgtcctgtaaaaataaaccgcggtaccccgctaatttaaatttataattaaaataaatattttacgggattgcaattgtgttttagtttgtcaaacaaaattttgttttaaatagttgtcgaaatgtagttcaaattttggagacataagatttagtgaatagataagaaatatatttagttgcgtttcgctcattttaagggattgcaattgtcttttgggttgtcaaacattttttgttttaaatagttgtcgaaatctatttcaaattttggaaaaatctgcgtgatatatgggattggaatatatttcgaatgtttttttatttgttaatcaatttattgctaaaaaaacaataattaaaagccaatggtagccattgtaaataaattccaactccaggatttatttcacaaaatgactgcaacaatgtatatatagattctatttttatgaatataattccctttatatttggagactatttcctttgaatgatgacttgtctgaatacaaatcttctcgtaagtccttaaaggatatttggtttcccacgaatcaagccaatacaagtttgtgtatgtcatttatgtttaaatgagtttagttggcaaagtaatcaaaatatttcatttcgagaagaacatatagcttacacgcctcataagttagttacctacagaaacttatatggtggggtgatatactttcggattctaggtaagatatagtatatgtgcgttactattgctcatactataaaaatcaccttttggttttgagttatcattttgaaatctacacatgattgcgtgtactcattatttaaagtcggcatagatttctccatatatatgtcatgattccatgaatgttcttttaacatcttaatgcgataacactttacattgaaatattcaagaaaaaaccaagctgttttctaaataaatttagtttgtccacggttaataaaatttaaaattagcgaaatacgtaaataatcaaatgatataaccaaaatgcctattatttttaaaacaacattttattttctctaatctcataaaatactctaataaaatctagttgtaagtgaaaataacactaagcttcaaacacacacgtacatgaatgtttgtttttttctttcaaaaaagctgaacaatgacattttaagtccaaatgaaaacgatggtatcatcttggacttccaattttccattgcccatattttctcttttcttttgtttttatccaattggtatcgaatcattcatataaaattataaatcatgaagtcaaatttttcaatagtaacacttgagtaatagtggtcctaccaactttttaccaagacagatatattttttttaatacactttttaccttttactgtgtttgcctcaaatgagtgtttttaccagtttctgtgtatataaatctgcactccactctcagtttatcttcatccacaagacagttctttaacaaagtcattaaacatttcccttaccttctaaagatcaactctttcaaacacttactctgcatgtaacttcatagattgaacgaagaaccaaaaaaacagagcaaaacaaacaaaag

SEQ ID NO: 2770 - DNA, 2000 bp, Arabidopsis thaliana
attgttttgagcattagggtttagtttttttataaactatatgaaaacaaaatttggagggtatttaagttattcattttcattattttgtgtaattaatctatgaacttcgtgtgtatatatgcaaagttgcatgaagtggaacttggttttagatatttatgaatatctagatatttgttgtatttcagtttgttaggttttgttctctctttctgccaattacacacacttttgttttacaaagaacataaataaaagttacatatatatcctgaaaagtttgcttcactgtatatatatcatcatcctacacgcgcttcaccggcgtttaccctttcaatttctggttaactaagttgaaccggattagtaattcttcggtttagttgttcttctatacgacaatttatcacttgacaaatataaacgatctattacttgcaacattcatatttaatctagtatcttacacgtacatatttgttagaaattcaatgaccaaacattgcaaaactattacattcacttgttgcatgtaagctagaagcctagaactcgctgtcaacgactacaatgtctacattattttcaccgacacaatttacatcttaaccaaaatttggatattggaccaatcgttcgtttatataataaccacacgtatcaatcaacacacagaagacaatgacatgtaacaaacagtgtaaaatattgaaaataacttatcaaaaaactttagttcataacacaaaaactttcggctattttttattgacttctatgtagtctttttgttgcacttactatttttaaaagcaatatgtatgtttccagcagattcttagtttttacaaaattttgcctttaatattttttttgatatacattgccattcttgatttcattttcttctacaatagtatcaaaattttacaaaataaaacttcaaaaaacatacgaaaaagttaacaaatattcaaaaagagaatgattttaaaaaggatataaatatagagagaataaaacgtagaagttaacgatttttttttgtgagtgtcactttagatggaaaatgaaatgattgggtaaaaacgctccacctgtaaaacagagagtggaagaaacgctcctgtgtacgagcgtactctctcttcaaaagaaaacaaatctctcaaaaaaaagaaagaacaattgaaaaaaaaaaagcaaatctcaaactcaaagtacatatacttacttgacacgtgttaatatacagctgtatcccaagtccccaaccgtttttcctggaagattctctgctctccacgctcgatgttaacctcacacaaacgcttatctcccaaaacgccttttccaatcgccaacgtgttttatttttggtttaaaataaatatctgttccaatcatacaaacacgtaaatgttgtcaatttttttatacccaaacgttaacgaggtttgtacgtagcccatttatggacacataattatgaacatataaacaatggttaatcatacgtttaaattaattaaattcaccaatatttttttgactgaatgagtcaaaattgtttaacgagtaacgaccataattatcagtttttattttttattgtttgaactaccatagttatccgtttaacactgagcaaatctctttattaatagagaaaacggttttatttgtttccttctataaaatttgtttttaataatacgttagatatttttatgcagttaaggataatattacactgtaaagtttaactagtttaatatcgtttctgttaaatcgataagaaaaaattaccggttgaaccggtgacccttttgcccactcctttctcgtataaatactctctcttcttgctcttatcctcttcaaccaaaaagcttttcttcccaacacacacaaaaaaaaaaactgtaacgaccaaaaaaaaagaggacgcgttagaagaaaaaaaaagaacaatccgataaaaagatccggcg

SEQ ID NO: 2771 - DNA, 2000 bp, Arabidopsis thaliana
tcatgttggtgagttggtgtgagcctgaggctgctcacgaggaaggagcgggagagccttcaccaaaaatgatcagtttcttttttgcttgaccttcggaattgaaatgacttaaaccccctttgtacaaaagttattttatttatcatttgagtgattaagacaaaattgatatctatggacgtgtttttaacctttcagggtgaaaatcttgactatgcgaagtgcatgtactagagagaatatcttgaggagtttggtcccactgatgaggaccgttttatatttttttataaagcatgattataacaacgagatatttttctccttataagttattctacgatgtatgcttgaaaaatacagcttgaattataaagttaaagtatgtgataatgcacaatatactttgtctttttttttggtatttaagcaaatgtttaataatgaataccaaaattacaagtgtgataaagatgggaagaaatacagctgggtacaatacaaatgactagctatgagaatcatgtttttccatttggaatcaaactttttgcaaattcattttttgaggaatccggcaaatttgaaagtcttccaaacgtttaaaccagctttattcccccacatctagttagtcgtcgaaattcgatgaaagatttgtaaaaaaagattaatcaattgtgagtattttgaattccctgagtaattaattttactacgtacaccatattttcaaatgatgataatggaaggataacaatttatatcttatcaaattatagaagtgaacagtttatgcaaattttcttcacgtgtggattagcggaaaaaaatatgttatacgtatacatacgttctctgtcggcaacggctaaatgtatataattttaatatacataaaacaataatttaaacaaacaaaaacattttataattcggtggaggcttttttttttttttttgtaatttggtggagttgtgctagtagttaaatccaaataaaccgaaacgtaaacaccataaaacacacgaattcgatttccgatatgtatataaaaacatacaaatctttaaaaattaatcccggttttagaatatgtataaaatagggcaaaagtttcatattcttttgtttctcataaatacaaaaacaaatgttaaagagttttttatttaattttttctccagatgcaaccatcacccatattgaatacgtgaagttgttcttgtagacaaaggtaatagtttggcaatgttctagaaatttgattacagtagtgtaaagttttcacgatcctcatgcacattcattattcaacaaaacaagaacaattcacatactatatgagtttatagaaatcttaattttcttaaataatatttacctaaatttttcatatatatgcaataagttaatactaccattttcacccattataccttatataaacatctgtcaaaactcataaagttattaattaacgttatcactgaaagaaaaaagaaactcatcatcgttgaaaccctttcaaaaaaaaaaaaaaaatcatcatcattgttacttattattaatattaactttatgaaactcttaaagctattaattagtaagtattaactttaattaatagcttgttttaacttcttaagttaagtgtctaccgtttgacagatttatagacacattcacatcaaaaatcaatttcagatgcaaatccaaaatacacaattatagttcttttttatcgtcaaacgtgatatttaaataaaatctcaacgttgttttcttttttcccaaaaattattaaagtccatgaaatacgacttttttattcgaaggcaacgtaagggcaatttcggaaaaacaaattaaagtgattttttcctttccttatataaagaaaaaaacagtcaccacaccataatctaaccgtccctgaagccctctttaaaaaaatctccggtaccatctccgccgcaacaaccaccacaaaca

SEQ ID NO: 2772 - DNA, 295 bp, Arabidopsis thaliana
gagatgatgaagatatgatattagtttgataactctctcaaaatctagttaatgtgttaggaatctttactaattatgggtcttattaacttgttacatttgttgtttctcttaagactttttatgttagtacaagtatacaatggttcttctatccggtttggaattacaaattctcttaaccgagtattagatccggtttgatttggtttatagttaattttaaccaatatattacaattttaatagaatccgatagaaatcttcacatcaattattaccaaacacaaaactg

SEQ ID NO: 2773 - DNA, 1478 bp, Arabidopsis thaliana
cttggaaacctctcttttggatagattttgtgatttggcgttgattctttgtggattatctgtttctcttcacatagctggatttgatggagtttataaaccacttcaatgccaagaaaaaggatttgaaacttttcttcattctcatttttaaaattgatttcttaactttgcagcaactagatagtaattgcaagcgatgggtgatatgcaccggaactcttacaaataacgtggatgtctttttcgagtaaggttacgactatgaatattaaaagtgaaacaaatctgaacaagaaaattaggttcgaataatttaattagcttttaatttgtcaatctttctggatctttgcttgttgttacacactggccagtgggccagttgccactgattaaattttataataaccattcaactcaaagtaaactctgcactataactctcatatatcaaatgtcagtcaagttgagactgttaaagcgaagctgcataaaatgtgtttgtccatataaaaattgaacattattatatataaaaatacaaacttatctggtggtataccatctagattagatcctagtattgtccttttttttttacaacagattagtatcttttacatgttcaatcttttgtggaagacaaaattacttaaatcgaaaaatcttgttagttattgtcactatcagtaagtcaataaacaaacattcatcacaaaaacaaaaaaacaaaatcttcactagtcacaacaaaattcgccccaattctttgatccattaaaaaaaactaatattatcatttttaatcattattatttcagaattgtttggcaaaaataattcaacattaaaaaaagaaatttaatatcaaaataaaataaaagaaaagaaaagagaaaacagatccgaattgagttcatcatcttaaaactttgaaatcggttactgtgcctttttttttttttttttttttagtggttacaagttacaaaactcaaaaaaagaccaaagacagcaattaatttttgtttctttctgttctaaggatctttgtctgctactgaaactccttaaagcaaaactgtaacttctcaccaaaaacgaatttttccaacaaaaatttaataatcaaaataaatcttcttcttcttcttcatcgtttatcacgacctctgtctcttcgtctctctcaaaagccattttaaatctctctctttctcactcaatctctctgtagctatcagatcttctcttatgttgatccccaacaaaaaattaaggttcttttttgctttttaaataagtaatatatatatatatatatatatatatatatatatatatataagattgagatattctctgtcttgcttcttctttacccttttcttgtttccaatcaaatcctctaaagtttcgttctttgttctaagttttctgaaggagtgatatttgtttgtggtgtggttagagaa

SEQ ID NO: 2774 - DNA, 303 bp, Arabidopsis thaliana
ctaaaatgatgaaacacacagaagaagcccaaagtgagagtcaaaatctagaaagaagcagaaccgaagattgcttgggagtgaagataagaagtgaaactactaataatatgtatcagtttagggtttttgatgggctaaatatattaatcggcccactaataagaatattgggctaactgatgggcttattagggctttaggaggaacagagttaaacctcacttttttttattaattcgattttgggtggttccggctaataatcttctccgaattcgacggagagatttggtgaagacg

SEQ ID NO: 2775 - DNA, 1282 bp, Arabidopsis thaliana
accaggttttatctacttttgtaactgtgtgttgtctcatcttcgttaaaaatctttccaaaagtaaaaacaacaacaaaagagtcgtgtagaaacatgtttgtatactccatatatcgtacattgtagataagatttacaaaagcttattgacgacaacaataaagattgtaccttttgatccgtggaggttcttcaacaagattctgaaatttctctgccatttctctgtctgtgagaattttgccttgtggtgtaagaaaagcagtccgttgaaacggtggagaccagataccgcttgtctggtaatcaaactgaaactcagacacgtcaatgtacttctgaagaagtttgtctgaaactggttttgtaacattctgagttaaaacagaggaagaagatgaagatgtaggtggagtttcagacattttttaaagaaaagaaaaagtaaagaatctaaattttgataggagggtttcatgaggaaaagggttgatggagacttttatggtaatgacaaaataatggattttttggctaataatggaggatgagtggagaggagcacagaacatttgtctatgttcctttttcactcttttttttgtttcttttcttaatgtacagatgcgtttttggattacatattacataatacacaaatcattgaactcttttcacatggcagcagatatgtgagtttttgctaacctcaaagaatttagacaatacacacaactactatgtgattagcccatatgggcttccattttagtgtgtgttgaaacccattgggtatatacagaatccactaactagaagatagagctagaaatgtttcatttttgttagatcatcattgagagtgactgaaatatcgccgtttaccaatgtaacatgaccaccaccactactttttgaccttttcaagaaaatgaaagcatgtaacatatacatacaaaagtttaacgaaatgtcggatctacccctgatcttagggagtgaatccggggtagtttagtacatgtatacaaaatatttcacccagaatctatcggtgatcatggtccagctagaaagacaccagtcttaccctaacttttttcaaagtctgtgtctttctgtagaaatctgaggaataaatatttgaatctaaagagaataaagaagaaagtaaaaaagcaaaatcgaagttttgttcaattttctgggatcatagagcaattttcgtttctttattcgttgaaagtgtgaagcttttttgattcagtgagaagtgtta

SEQ ID NO: 2776 - DNA, 2000 bp, Arabidopsis thaliana
tatatggacgcttcacgtcctctacggttctcatgtgcttgaccatctttgtgatatattcggtgcccgagcaagctacttggttagccaatggttcttttgagtcaactttttattattgtgactcatactatcttctcctgacttctgctcttaattctctatagaaaagttctctgatagataacaagtaattcaaacaaatagatatagaaccatctcgtaaaaacaaaaacattagtatatgaaaattatgttttcttattattttaaacattgaaaaatacaaaaacatatcaaatgagctatttattagaagaaaaaaaaacaatttgactaaagagttagttcttatggcttatgtaggaggtcataagcacattatgaacgccagaacgtacaggcaatgccgcacgtccatccattcgaaaatatatatgatctactctagcaatatacacacgtagttgaccacattgaatataatttggaattgtaggatagtttaaaaacttttggaacatatgcttcaacctcgttataaaacttcatgttaatctcttgcctaaaaagacatttccaaatcgatcgcttggttccgacttccgtcatccttaaatttaatgatttttgtacctttggcgtttaaatattggactcctaaattttggttctctgagcggcaatgatattggagaattctactagaaccgaaattgttcttaatcacaatctcagttttcttgcaagcatcatttaccacaaaataaatcgcactaactaatatgaaaattattagacgactcatttgtttgaatctaaagtaattgtcagagaaacaagagcatcaacatgtaatagtttttttttctgtgtgtggaaacctttttctttatttagcaaataatgtttgctgaagtgttaactatatttagagacaaacatgcatgaacatattagaaatttggtcaaaagagattttagtgtctaaatttatgtttaaccaataagattccaaccaaatgaaataacctaagttattataattgaccttgaaactcaaacaaaaaccttatcaaaaggttattggcaaaatgttgaagtatatcataaatgtgtagtaaatttgaaaactaaaattggaaaaaaaaaattatgcgataggcatgaataaaaatcagcttcacaaccaataagcaaacatcgagattttgaagaaccagttagggagagcaaatagagcttaggtggaggcaattgatctaggaagtatgtgggcttatactatgacataaaatcaaaggagctatcaaaaaaacccctcctccaattgtcttcatacttaaaaagagactcatacaaaatgagactaacatagtttctaatgagtttgtgtacatttgggtgtgtttagttttgtcgttgttgattctgttagtgtttagcgtatgatccattttagaaaagtttttttaggtaaaactcttaataaattatttaaaaaatatgctaccccgagacaactattgtttcttacaatttaattgtgtttggtgtttggatacatagatataaattaatgatattttttgtaaatatttactaaaataaaagctattatctaaaatgaaattcaaaataaataattaataaataaaataataattagtaacctcaaataattgttttgtcgtattgagtcaatctataacatggaagtcataaaggagcggcgagtgaagaggagaggtcacgtgagaaaaaccgaaacataaagctttcttattcaccacacatgcctcctttaaccctttgccaattggccaataacaatcaatggcaatctcgtaaattttccaattttcaatttccactgtcctcggtctcatcgtcgttgacaaatacgaacaccaatccttgattctctcctataaacacaaaaaccctttgattctaatataaccataacccatctctcaattttcgaaatttactcagaa

SEQ ID NO: 2777 - DNA, 1507 bp, Arabidopsis thaliana
tctgataacagcctcaggatcatttcttcgaataagttctctcagatgtgcaacctcattaacttcttctctatcacggactctgcgagcaaagctaccaacataactcgattgaaacctcgttcgcggtaaagaagctccaccaccacccacagctatagataaaataaaaccaatttacatcaaaaacacttctaaaacaacaagaacaactcataaacggaatcagaatttacctccagtaactcccactctaggaaaagaggagtaagctctaacaagtaagcttcttaaactgctcaattccctttcatgactcgaaacctgtcatcggtgaagagaatcaatacagatgaagttaattactaatcccaaactcaaaatgacactagacaacacatgaaaacattttgataaaagtgaatacttttacccattttgaatcaaaaaaattgaaactttttataccaatttcaaaattaggtgacttgggtagtcaaataaatcaaatgacaatatcacagagacaatctagaatcctaaaagacaacattttgagggcagagaagaatttgagcttctagggtttgaaaaatatcatctttagcttatgaatcacaaagatcttgataaaacccatcagaaattattatctaattagatcaaatccactacagtatcaaaccaaagtcgaaacctttttcgtattaaaaattggataaaggggaaaagagaaaaatgaaacaaaaaccttggtgatgatgcgcctccaagccatcaatcaaatctctccttcacgatatcttaaaaattggtgttaatgtctgataaatcgaagttcctcgatctatatcggaaacaaaagacttcttcgttgtgtttggggaagaaccgttctaatcttattccctaaagtcttaaaaacactaaattacacgtgagagacctgtttggttatcgggtgagagaaaaattgtgcagcaggtggagacacgcacgagatatgtaggtcgcctcttaagtacataaatacccttggacatacccaataattcattttagtaggctttttctggcggcccacattaaaaagaaggacctagaacataaattggcatcgttagaaatgggcttaagtaaaggcccatatgatatatatataaaaaaagagattctagattagtaacgaagtttctggaacattgtcttgtcttgtcgccacgtgctcacataaatgtcaaagaagcttcaatacagtgaaatgatcttgtcttgtctctagaaccttctcttctctccccttataatttcatttctctctcctccacgcctcaatctctcaactcaaaactcaacattttctgaagaaagtcgcaaactttacccaaaacccagtttctaattttagcaacaaaatcaaaaatatctacttttgtttctcgaaagttacgaaattcatacaatctagcttatctctgagcttatggatttgagataaacaacgaaa

SEQ ID NO: 2778 - DNA, 1367 bp, Arabidopsis thaliana
ttgtttcgagtatgagccaaaaatatcgctgagtgaagattagaaaattctagttctgagtttgttgagtatctactacaattgtagaagtgagtgtatatatgtaggtgaggatgagaaggctctaagtgacaaaaggagaggtcttgaaggttgaagatttgatacgaagtttctcgactcgttttgttttctatctatctattttactatttgttaacctttgtgcgttttctcgtgttttctcatcttctcccgaaccatcttctttttttccttcttgccaatcagtgtttatttgtgatgaactaataaaaacaaaataaacgaaaaaaaaagactagatttctacaattagaaaaaccacgattacgaaaaaaccatgattagatgatatattgtttaaaaaaaataaaaaaatcgaagaaagcatatcatattgaaaaagagagagaaaaaaagcaactcaccaagtcaccattatgtgtgctaacttgcagaaacatatgagaaatggaatgcccaagtaaactaaaaatatatatctacgggagaaattagaaaattttgtctagtttgatcatatcagctacacgtatgtcatatacagtatcaaacaggcttattagcttacgtataaactatctatagcatgttgaattgttcaagtcgttttttttttttttttctttatcacagaattgttcaagtcgttttatataataattgttgtacataaattatacaaatagcatgacatgactctatattaattttgattggtataaaattatacaaaatttaagctctaatctattaatccgcaatccgatcaaatgttcaatgatccaaaagactttatgttttgtgtatagatttggttttagaaacattgaatgatttttctctatattttcaaaaggctgctagaataagatcagatgatgtaatagactaaaaaagaaaaaacaagacacacattgaactgatataagatgatgatgatgcaatagtacctacaaaatctagtggacgccgaacagtactttaattcggttttagaacattctgaattgaaggcctattaaaggcccttcttgacacaatctagttacacgacttacgacggtgcagctaaggctatttcggtaatttcagcttctcctttcctcgatctccaagtattcgagaaacccccaccaaggcaaaagctctgtcgtcgtccacaagaacaaccaaatttgtttccgtcttctgctaacatatcctctttttcatctgggaaccctaatttcttgactaacttagggttttatttatccatttgagatactctgtaattgaaaggttgaatttttagaagagac

SEQ ID NO: 2779 - DNA, 1161 bp, Arabidopsis thaliana
tgatgatcaaagtggtgatagattgtcctcttttattatggtattcttttcgaaattggtggaaaacagagacaatttataggtcggtgacttgcaagtcgtcgtttaaaatgttaagaaaaatcttgtaccattgttgtgttatgtttcctctttgagtgtctgtgttttatctaagtcttgagctataagctgtggtcaatgattctcgaaccaatacaaattattgtaataaaataggtcatatacacattggtgtcaaataataaagagttctcaagttgaaattcaatttgagtggtttttgtttttctttataaccaagtgttatgtaggtatcaaaatctagcaaatatatatgcatatagtagtcaaataaattgtccacagaaacaaaactgagaaataataatgttaaaatgttgtttgtcaattaagagctttaagtaattcttctatttattgctaacatttacatgaacacaaatgttttagccttttaggtctaaaataaataatataagatctatctcaaaaacaaacttactagtttcctttagacttgatctattactaaaagtctagtacatgtgtccaacaataatctcaactctacactatatttagtgtcatataaaaaaaatccttagaagttaaaaatagaaatggaaaatttcatgacaatataccataaaaaatcttttacctagatatcttcctacacattgctataattttatttatgaacaaatttccctgtgattttatttgagaaaagctataaattgaattattgaattgaagacataataatattgttttttcctgcaagtgtatattgttctgcgtttaccaagttcatggcggccataaacccgaagatttcgtcaaacatgtttgttctctaatctttccaacgactttcaaaacatatacatatgctaagtcatgcatataataataacaaatgattgaatcctaatattattcttatttttataacactaccaaaaccaataagccctttcgtcgttacccactacccataatttcatttcattacaaaacacaacaacacatcattcatttcattagatcatattgcaacatctctctgaattcttctttacgattttgtaacttctatcaaataccttaata

SEQ ID NO: 2780 - DNA, 908 bp, Arabidopsis thaliana
gcaaaggagaaactattatcactctggattgtgcttgaatatcaggcctttttatactcatatactttgtttcttcagattataatagaggaaagaatctgtttgtttgtttgttggttttttcttttgtctctatcccccaattttgggtttggaggttgtgggtttttgattttttttgtgtgatctgatcatcttgtgtcttgttcgtccttggggttttggatttggatttgggtttctcgtttcttttgtttttacttgtgggcttgtcccgagtccttgctgatgacgttgtgcacaaatcatacttatcatggatagaaaaagttgcaatcctgtttttggaatatgcagttatttatttaacctttttctttggttttgttttgtatatgatgtgaccacagtcaacataataattgtgagttgtacattgtggaatcacgaaagctaaaattattggtggttgtgggtgaaactttgaagaatgtttaacttggactactgagaaatagcatggaaacgaacaaatggtgtatttacacactgaaatatgtgttttgcgatactaatcatcctatggaatacctcatgcttcaaaagcaaactcaaaaaacaaatgctctcttttcgattctcctaaagatttcctctccagaaatagcacttttcagtttccaaattagatgacgagaaaaatcaaaagtataaaattacaaaataaagaccgaaacgaagacttaagctcaagacttgtgaacagaagtcaacacgtgtagtgtggaaaaacaagcacaagacgtgtctttggagtttgtatataaccgttacagtaaaaaacctcttctttaagtaacaacagcaacaacaacacaattcctaaatctctctctctctcaccatca

SEQ ID NO: 2781 - DNA, 2000 bp, Arabidopsis thaliana
gtggtatgtacactgattattcttaattgggcctttgattaatgtgaaaagacaatacaacgagtcaatgacaatggatctaaaaaaaaaaaaaaaaaaaaagatataaaagagattgactgatatcaattaaagagtatttaatacaccatgtggttgctattatttagacttggcaatttttgatacatctaaatcttcaaaagaaggacttatttactctacttgtgatgcattaattatttttagatggaacattgaagtgagaaggcaaaactatggtttgtatttaaagatgacatttactttatatttttacttattttattttaataaatatcataaaaaaaatattttaaaatttttggagcgttacactgatatgataacatgtttcatctaaattgtggtggtgcgtactaaaatttcaggctctacaagatcatatccggatataaaatttcatttaattatattttagaaattaaaataataatttatgtagagctgcaattgttaattatttataaataaacctaaagttgtaattattcttgtaaaaactaaaatattgcaatgagtcaattaaattgttattaccgtttatgaaaaattacaataaaaagataaaactgtagaagatattaatttggattgcaactttctatttaaaaaaaaaccgtaattttttttgccaaaaaaagacacaattgttcacaattgcaaaaagcatttattcgaatttttattattatatagatttattttttgttttagaaaaatgatatggtaaacaatattttttttaaatgaataagcagaataatatggtaccattaaaattataaaatctcgaagttaaaagttttttttttttttagagattgattatgattgaagtcttagtatataaacaagcatacatacaaagttgaaatgttcatctttataactgatggaaaccaatggaaagggatatgtatggactaagaaaagagtgatcttccaagattcgacgaaaatgctggactgatcgatctacgccttggatggattggtcccttggttgatgcttctcctctcgaacattcttgatccggataagcctaataacgctagaaaacatcaaaaccccgcataagtgccttgaacatgtacaaaactcaagaaatgaccaaaaaaacataaaaggcggactacggtacgattggtgaagtttgtccaagtgtgtgaagtctaagtctggtaacggctctatctagtctgcaagaatttattggagtgttatctctcctccatgcctgatggacgccttctctctccttcatgcaactcatctccttttgtaacagctagattttagtcctctatttattttacatcttctcgtacatttcagatctaagagaatatacagattcttttctgtgtttcattactgctctctattatattctctcttccgtttatactattataatctttcgttagtgaatttcggcagttatatagaaaatacggtatcttgatcatggaacctataatataatcttagagcctaaaatattttccatttttatttctgaaaatgggagccaatgttaataataattaaaaaaaaaatcaaaagtatctaaaacctagaaaaatatgataccattcaaattgtaaaatatctaataattaaaagaatttttcttttcagtaatttcatatgggtcaaatcctagtatataaacaaacatacataaaaagataaaaaaaatatttccctttataattgatggaaagcactggaaagggatatgtactatacatggactcagaatagagatcgtccaagattcgacgaagagtaaaagacaaagaagaagagaagtgtatgtttttgccactcgttttgttactttcttttgatattttgttttaggtgttcacataaatttgatagtgtaaagaaaacaaaaccactttctagttcttaaagaaactagaaatcc

SEQ ID NO: 2782 - DNA, 2000 bp, Arabidopsis thaliana
attgacgataatgatgataactacatgggattttatctgcgttacaagaaatcaaggacgcatgcaactttttcatcattctgtcctttcttcaactaccatttgaattttcatttattataaggtatgttctttaaattatataccttcctttgtcccgaaattaattaaaaatgggactggatatgtacttccacttcttaatttcatatgttatttttaaaaatggtcgaaaaatgtataacaatacgcatgcaaaattttctttgcgccaaagtattaaaatggcctgcaactgtacggataaaccaattttcaaatgataatatttgtatataatgtttctgtatacaggggcggacccacgttagtcttgggtggggcatgtgcccgatactcaattctataaatcttatataagtttgcattatgtaattaaaaatgtatttagtttagtggttttttacttaatggtgccccacattaacccaagtttaaaccttgctgatgtctttttattgattttttataactgtacccatataagattatttcctggattagccatctgtatattaataaatcgtttcctgtggttgtgcgatgcataaccgtccaagaaagtcgtatatttttaatacatgtgttaaaataggttttaagtgagaatttttttaacttgtggagtgtggagtgtagagtgtagatgtacattacctatatatttatccaattctgtgtaataaagatgttggggcggcgcctgctgccacatacacattggattagaagggcaaaagaagttctaataaggagcaaactaatagccatgaaaattatgaatttaccatactgaaaacaaaggaattaaggttttgaattcaatacttgttttgttatatatgatgttgatgtgacgtatttgtgcgtttctcatagtgactttgaaaggaaggctaaacgaatttgcagtaaaagtaacagaagaaacacttcaaaattgaattaaaatgaagaaaaaaaagaatgagaaaaagtgagaagtggtggttgtctggtattaagggtactcacttctctccttttcaacacagcccgacacacatgtctctttttttttttttcatacacacatttctatttattagtttcctaaaataaaaattataaaacaaaaagcacacccacccataaactaaagcttttctctctcatcccactacaaatcttatatacaagtttcgcaaatcttgactcttcacgttgtggatctatctagagagataagtaagagagaggaagagtaaggaagaaagtggttgaactgtagcagagtctgaggtttgaatcttgtagttcccattgaagcatgcttcaccgttttttccgaaggaagttactcatccactgagagagaaagagggatttggagatagagaaagaaatttctcagatgggtttgtgagaattcacagcaagagcaagaaactcctatatcttcctttgcttccagagaccagcgtgatcaaaaacaaatatttttacggtatctataagaatcctcccctctttttctttttccttaaagagaatttttttgcatctttcttaggttccaataaatatgcagaagaaagttaaaatttttgtaccgtcgttgaaccttttaaagacctaattaagagacaagatcatactaagctcataaatcactttctatttacacatatataggttattaatcttaaacaagatctatattttatctttgagatttttcaagatttcatcaagtgtcacgttcattcattgattacatttcaaatttcactaagaaagttaaaacacggatctttttgagaatatcaagaaagttctttgaaatataccaaaagaaatcagtactttcaagaatacataactttttaggttgtgttaaataatatttgcttttgtaataaaggaacaaaattaaatagagagatcggagaggatcaaag

SEQ ID NO: 2783 - DNA, 1550 bp, Arabidopsis thaliana
gcgggtgttgcgtgaccatttcctcttcaggaaactcactgattctcagtgccaggttttgttggactgcatgcaaaggcttgaagctaatccaggggatattgttgtgaaacaggtcgaagcatattcctccttgttgcagattctccaacatagattcatcaataaacatatgatatcataatctctctggcttattcttttgcagggtggtgaaggggactgcttctacgttgtgggtagtggagaattcgaggtcttagcaactcaggtttgttctatagtaactcgatttgacttgtgaccagctttgagcattatgatcatgtgcttaaccggggtgaatgttaggatggaaagaacggtgaggtacctaggatcttgcagcgttatacagctgagaaacaatcatcattcggtgaactcgccttaatgtgggttctctgcacttttacttttagaaataatcttcttcaggtgaagacgtactctctgtctaattgagtttcttgtgatatttgatggtgccaggcataacaagccgcttcaggcttctgtacgtgctgtagatcacggaacattgtgggccttaaaaagagaagattttcgaggaattttgatgtctgagttttcaaacttagcatccttgaagcttcttcgttctgtcgatcttctttcccgtcttacaattttgcaactaagccatgttgcagagtctctttccgaagcttgcttttctgatggacaaacaattgttaccaaggtgaagttaattttgctttttgtaaagactaaataactctactccaagagattctttcttacacgtttctgtgcatgtataggaccaaaaacttcagggcctgtatgttatccagaagggacgcgtaaaaatatctttctgtacagaggtgttggagagtcaaaatgtttcaagccttacaactggaatcactaacgagtatgacaatcttgaaatcggaacagaagtctccatagaaaagcatgaaggaagttactttggtgaatgggctcttcttggcgaactcaaagattccttaagtgtggttgcagttggcgaagtggtttgtgtggttttaacaaaagaaaatttcgagtcagcggtcggccctctgaccaatatttcagatgacggtcccaagtatggcattcttcatgcttgtatttgtttatttttgtggttatcgttgactgattccatataatgtttttttttcaggacaagacattcttcattcgagctgtcaaaggaatctgcaaaagttaccgataccacagctcttgctaaagccactcttgcagacctggtaagcaatcttactctacatcaatcttaaaacggtgctcctcaacttacactattttggtttatccaggaatggacaacatgcttgagtacaacagactgtagtgagattgggctcgtgcatttgaaagataaagaaaatttgctcagcttgaaaagattttcaaagcaaaaggtgaaaaagttaggtaaagaggcacaagtattgaaagagcggaatctg

SEQ ID NO: 2784 - DNA, 2000 bp, Arabidopsis thaliana
acccaacttatttaacaaaataagttgggtcaacccataactcatttaatttgatgggttgagttgttaaatgggttaacccatttaagtaataatttaattaattattattataaaaaaataataaataattatcattattaattcattatcatcaaacttaagatatttacagattccacttttcacaggtttacgtttttggtaccgaaaatcacggatttacgtttttggtgggaaaattataggtttttacgttttcggccggaaaatgatgggtttacgtttttgacggaaaaatcatgggtttacgttttggacgaaaaaataacggatttacgtttttggcgggaaaatctcgggtttacgtttttggcgggaaaatcacgggtttacgtttttggcgggaaaatcacgggtttacgtttttggcgggaaaatcacggggttacatttttggtgggaaaatcacggggttacatttttggcgggaaaatcacgggtttacgtttttggtgagaaaattacgggtttacgtttttggcgggaaaattacgggtttacgtttttggcgggaaaattatggatttacgtttttggcaagaaaatcacgggtttacgtttttggcgagaaaatcacgggtttatgttttttggtggaaaaattacgagtttattttttctcaattgcatcgcttgtatatttaagaattttggaaaaatattaattttattaaattggtttagatgtgtttgttaaacttaaattggcattggtttagagattttagttggtttaattcaaatttacaaaatttgatgggttaattgggtaaaccattgaaaccattaaccattacaacccaactcattttactcatcaaaccaattgactcatcaacccatttgacccatcaactcatttgagtaaaaaaatttaagggttcatgggttgagttgagttgagttgacccatgaattttgacccattttgacacccctaaccggtcattatataataatttttattatttaatatggtagtttattttattaaaaaaaaaattatatgaagatcttttacacaaaacttttatgtttttaatagagttatcgactatcacatcatcgatatacgaaaaagttatattgcagtgacttttaaaattttagtattaatctgcatttatttaagatatagattttttttacaaaaaaaaaggttacataaaaggttcttttacacaaaatcctaaatgtaaagtatcctttaattattttgtcatcaattctaaaaaaagatattattgtactaaattttaaaagagaaagacaacacatgtcataaaaatagaatgcaaatatcggtgtctgagaggtcgttttgaaaaaattttacttcattatataagattaaatacgttcataatactattatgggaggaaaaagttagaaacacagtgactttttcattggaatcagaagaaagatccaaagctcttgacatgccctattatctttggatttccttgtgtagagaggcacaacacaagcttcccagttcttgaaatcatttttgacaaactcttaagaaaccttctgaaccacttaaatacaatttcaacagaattataaggtcatattgaccataacaagccaattgctttaaaatgacagcatatgaaaaagaagaaccccatgatttgagagttattggtgattcatgtgttaaaaacttctctcccacgaaaatgatgtgtcaacctcatatttcctgctgatattcatgtgatttctcacgcaacacaacgtattaatcatagccgtgactagttggcatttaagaattatatcctttggaagatcttcgaatctacacgaaatgggattttaataattctacatatggatcacattcacctatatatatatagatatgctatgcattgagataaaacatgagatagggagagagtgtagtagagagaggggttaagaa

SEQ ID NO: 2785 - DNA, 2000 bp, Arabidopsis thaliana
aatcaatagatctcggaaaacacttttcatattatcccatatattatttatacgtaagatccttaaaagattaaattgatatagtacttattaaattaaattctatacctttttgggaaaacattaaattgatatagtacttattaaccagaacttttctattgtagtttgatgaaaacaacctttcagtcaaaaagaattgtactactcatgcaattaaataaaaccagcagatacatttcattacatgctcatggtaattcaaagcaacagaattgttgaattatcgaaaacttgtgaaagttttttttatattttgtaccaacttttaaaaaaaaaaaaaaaaattacgaaatatgtttccatggatattatggaaaaaaaataggaacttcaaatcctttgaggatacaagctttttgtcgatttgagtcggttgaaaaaatttgcgaagatgcggatgaatatggtttacttctccaatgctccatcaaagtaatgaaatagaggagaatattaggagtgtccatgaaagtgacacttaaggttcttggtctaagaagaagatggtgggaggttgtgattaggttatgagcagaacaggtcctaagcgcaagggggtcaaccggtcaagcatgggcttatggtctaatatatgtttatgtatatagaatagtttttgcctcggaggctgctttcacagatccaaagcccggccatcctttggatatcgaacttctgaattcattatttttggaaaagatttataagacatggagattattactggaaagctcaacaggaaatagaggagcttctctcattgctaagagtcttaaaccataattgcgtatattctgttccaaacttatggagtagtaacctgttcttcatagaatttcttctcatgagagagtctctattcttttaaatgtaaggttttgtgtttggccattctttcgtccctactttttttttttttggtagataagtgtaactatctcttaacactaaaatatgtccatgttggctttaacaaggttagtttgtaattgtaatggttcctccttcatctatatattcatgttcagatggaaaaaggaaaccatataacataacccgcatgtagtcgcaacaaaccacaaagtatatacagtaacttttttacaatagggaatctattggcttctataagtgatttaataaatgaaaaagaacctgacaataaacaaggaataagaaagcaacttttgaaagtgctctccaaccatgtcccaatcattaatagtccaagtctttcgggcttatccaacttttattattagttaccaaatattatgaattatgaagtaatggtaaaggaataatgatcatgaatcatattatgattaaagcaaatgctataatgatttaatccaaaagaacagttccagaggcgggatttaaattaatctcctttggagaaaagatctctcccaacgtaccttgaacccagcatctccacctgggagatttaccattaggccaataacacgttagtatcaactatcaattaggttgtttgctttcatgttaaccaaaactcaaatttagtagtcattttagactattagttcctaatgattgtacaaacatttgattttggcttaagcattggaccttgtacgtaaggagagaggcaaccaaaaggcaaagccgacatccaccacatagtcactccaaccccaataacttactcttttaaacaagataaaactacttgataacaaaagtcacaagatgttaacaaaaaagcaaatttagtagccattttagactattagttcctaatgattgtacaaacatttgattttggcttaagctaagcattgaaccttgtacgtatggagagaggcgaccaaaaggcaaagccgacctccaccacgtactttgcctttatataaagatttaacacacttttaaagtcttgacatcattcattcacacaaacacttcaaaca

SEQ ID NO: 2786 - DNA, 568 bp, Arabidopsis thaliana
gaggcacacaaaatgtgattggtacatggccagtggaaaaccggttctatggaaataaatagactaatactgaacaaatttgtgtgaattggaaacatgtaaaattatgtaagaaaaattgagataatgtgatattgattcttgggagctagccggtgaaggaagcataaccggtttggtaattgagttaattttttccggttttgtaaaatcattatttatgtttttttctgtttacaccagattttgtccggttgaaatcggtttagatctcactgataaagtgataagagttaacatttcttaaagataaacaaaatccctcaaaaaaggaaattaaagaaatattcttccaactgttgaaaattcaaaaagattaacaatttacaaatatatcctcggacgccaaagaagtatcaaatccacgaaatatttttttgaatttcgaatttatcagaccgttgtgtttctttctatataaccccgaagatattttacggaggctccacctaaaattctcaatccctaaatttcgaaatctcactctctctcattttcgactttagaa

SEQ ID NO: 2787 - DNA, 1163 bp, Arabidopsis thaliana
ttttcgatttttctaatctcacagctgttctcaattgcttttgaaacaggtttacgaatcgcttctgcgacaagattctgctgccgctagaagatactcaagtcccggagtaaaaaatctaaaaaagtcaagagtgcgaaggcgaaaggcaaaccggttttgtagaaccgggaagttggaacttgaaccatatcggtaatgtattggtttagtggcaataacatcctcgttagctatctggttaactcattttaagttaaaagccagtttcgagttatttcacactcaccagtttggaatcttgatacagacaacgaacgtattgacggaaaacgctaaaagaaagtgactggaaaatagaaggtgtgtgtaacataacatttatttttttctaacgtgtaggaaacggtggctcactatggaacccacagcgtagactttgacttatcaacgcttacatagtcaagtcaataacaaaattcgctatatcaataatacagttttgcaactttctatattcacattttctactttattattttcccataaaacttcctggaagaatttaaatcaaaaaaaaaatgtacaatttagcccatttcacaggtcaggattatcagtttttataatggttttttcttctttagactttaattaaaaacagaactcttattaagaatatacaaataattcaaaaagtatacgctgaatcaatgtttctccaaaaccattgataactaaatatcataatataaaatacaattttgttaggagatcttatgtaagaattcagtaatctatcattaatatcaaactaatcaaataaaatactagcaatagaaaaccccattttttcgatatgaaaccggggcttggatggatcccttgaacaaaccataaatttttcaaactgttaatttaagtttaccaattatatgtataagtgtataacaatattaagaaattaacttgtgaatatattttgtaactttattttttttgggtcaaatatattttgtcacttcaaaaataaagttttagaagaaaaaaaaaaccacgaaacacgtaaagatttctcaatagattagtaccagttgctgaccataaatagacagagtgtagactccgacaacatccacaagaagaaactttctctaattaaa

SEQ ID NO: 2788 - DNA, 2000 bp, Arabidopsis thaliana
ctaagattgtgttacactttcgcagatgtaacgttcctagttcctatttccttttgaattctattattgttacttattgatcatgagattttaatattttattttagtttttgagaggatctagaatttttgaggtataactttttgggtataaccttaagagatgattgattacatccagcttggacaaaagtggctaattgattatatcattccactaaaatgatgatactccggaatgtagactctcaaagcaatcaatgagttgagcttaaggcgcatatcgttccattgattgtaagtcttatttagattcttctaagcttttttttttttttcttttcttttatgttaaattgtgcgaatttcagatcttttgaccttatatattttttagtgtctggaatcaattttgagttcattactatttaataaatgtctttccgtcctaaaagaaggtttgaatccggagcgcaaaggaatcaaccacttgagctacaactaggttaccaacccattttggtaggtttgttgctattaaatacgagagttctcgttctagttccagatacagatatgggcatcatgccatctttaatcatttattttgtgttttgaaatgcattaccgtatacagggccggtcctagcctaaaactggtaaaggctttgctttaggcgccaaaaaatatatgtagtacaaagggcatcaatttctgaaaacattttatagtgtagtggttagctctaaatgtagataattgtttttatggtgcatagtttaaatctcaattttgttattttgtgacttttctaaatgtatgaacttaaaaatgctttagacactcaaatctcttggggcggctcttaccacatgagatggaaatttaagattaagagtgaaaatttgtataaaaatatttaattgtcctaaataagggttcatttatcttgatctcgaacttgtttcgacggatccatgattttacaatctaagatccggtcactatagacatcttattttcatgatcgaataagaactcggataattattcaagctctagtgctagtggattattacgtcaactaatcttgcaatatattattgtttaaatatgggaagaacagaaaaatcaactttttatcaaaaaagagaaggaaaaaaacactaaattgaatttattaaacacgttctccacgtgcgttatagctgttcgtaccaacagcaaaatggaccgtccaccaattagattagaaccattcaatgttatacttttcttttttcacgtgtcacaagaagaacttaaaaatgaatatgaaaacgaaaaataattcctccaatccaaaagaaaaaagattttgaaaattagtacacgatagtgaaatgcactttatcaaaaacacaaacttgttttgttttttcttattatgtttaataattaaaaaataatctttacggttcatataatttgagtttggctacttttcttacttcaatttggctacttgtataaaacagtgagataataatttctttgacgttaaaattacacaatttccaaatgcagaaacttcaacaagagacatgtagggaaagaatggtggcttgtttggcttatttacaatttttaagttttaatccaaagaaaagaagatcccatcactcttttcaacaaaaaaaaagttatcaaattaatcattaaatcagtcacgtaaacgaatgttttcttacaaataattttgggattcgaggaaaattaccaaaaaaaaattaaaatagaataaaataaaataaaatgaaagacttcatgagaaaatagagacgaagttaagttgtgtttggctttgagctttggctacttgggatttaaataccacttttttgcttcttgtacccctgcttcatcatcacgcacacctctcttaacttcttcgatctcttctttttctctacacgattcgattgattcaagtatcaatcaatcgaatccgagataagtc

SEQ ID NO: 2789 - DNA, 2000 bp, Arabidopsis thaliana
tactccaaaacaatatacaagttactccgtaactcaatctcagcaagacgacatttgcgcagcttctcaagactgatgcaaccgtgtggctccactaaagctcttttattgaatctcataaaattctcttgtatatgttcccttgtttttatacctttttggcaaagtagcaattatatttataggtctaacttcttgtacgccccaactttcattccttactgatatttacaatttagcaacaacaaaaaaaataaacacaaacaaatatcgatcaaagcgttctgactagatcatgtggtttagatcaaaattaaagcactatcgtaactaaacatacgtaatttattatagtattacaatgtgttcatctaattgaatagatggcatactaagtaaaaaagatgaatgcaacaatcaatgtatatacataattcaataaatacttaattaaaagatataaatacaaatataacactaggtcaaagttggccaataagaataattcttttgtggcaatcatatagactacggcatggtcttatgctattggtgtgagattggagttgatttgttcgtgcgaagtttgctctgactataatattcaatgttgaccacatattatgtaagcccatacgtcatctaggtctttaaatcaatatcttatatgacacacttttagattccccattcggtcaaatgttttattaatttagaaagtaagtttatattgtttcaggttatgtttttgtttgttaaatattgtgctttttcttcaaccacaagtttatatgattgaaaaataattcatcaacatcatgcatgtaatgacaatattttttttgtttttgtgtttctgataaggcgcaatgacaatattcaaccccataaaaaaatccctcaaccatttttaaaatggcacgaatcgtccaaattgcttataatagaaatattagattagaatccacagtcagatcccacatattattattaaagagattcatcgcatattccattccagttgttttatgatgacttgtgcagagtgtattccgtaaaactatatatgtagcgaatagaaacagagtttgtcctttaattttgaatattcatcctaattaaccatgaacttttatatattacataaaacaatttaaaaacacactcaactgtattggatgacataagcgacttttaattagcaaaaatattatgctattttatttatgtgatttatacagtacgttgtttattaaaataaaatgattgtgcaaaacacatatgtatctatatatatatatatatatatatatataaagacattaaagtcaaatgatagaaaatacattatttacctaaataattggtgtttacatgtttatatatattaaagtgtttctttgattatatgtttgtcatttgctcatttacctaaataattagatattcatcatggtcatttaggtaaattaattttttggtgagtcatttaggtaaattattaaccctttaatgttcaggatgaaaataattatttaaatccaccacatatataataaataattaattttaacttaaaatgttgaccgtaattaacacaagacttggatcataattaatgaattttgtataagacagtcgttttttttttcgtcttttgagacacgcaatcgattttgggttaacacaaaccattaatacaactacatagtgggtcggtcgatgcagtccgtaatgtaacgtttgttaaggaaaattaaagagatgaatacaaagaattgtttttaaggaacaaaaaagtgtgtgtaatgtttatgaccaaaatatcctctaggttagacaaactctctataatattggtcaacaaatacatgcgtgtgcgtctatatataacatagatgcagagaatagacatctttgctggttctttggcttgtacccaaacccatctttgacttcaaaaataaaataaaaataatcataattgacatcatcggata

SEQ ID NO: 2790 - DNA, 2000 bp, Arabidopsis thaliana
ttttttttcagcaagaagaaaaaaaaagaaagaaatatgatcaattaatttacacaaaaaatcagtaatagtttagatatgtaacttaattataattgagctggaatgtgaaaataaatagaaacgctaaagtcgtccattacttctaaagttttcaaactaactagttatgtttataattcaacacacaaaaaactagttatgagaattgtagtttatatctggattccaatattctattggatgtttaatttcttggatccatcttcataatactttttttatcatattgctaaagtaaagaaatgttgaatagtgggagtggagggagatatgaagctttgacttttctcacgtgagtgagaactgggaagtggagaaagctttgtctttaaacgtatatctttgacagtttcgtgacataaaacattgaccgaataggtccatgagatatcgggtcgggtcgggcgtatcactttacgtacggctaatgcacggcgcaatacgtggtccgatgaatgcggcaatatgggtccttaattttttttgctttttttttttctgaaacttgttgaatttgtttctaattaaaaattcactttcttctatgtaagtgggagtctttctctacctcctaaagcgaaatctcttaaaatttagggggtaaatacattggcggcaatcggtaaaacatttttgaatggaaacatatatctataaagtgcatctacttatcatatatacttaatgattaataattgaggttagtattgagtttttagcaaaattaaagatgtgaaagaagtcgcaaatgacaatggcaatgacatgcatgaaaatagtaaaagtgtttaggaccaaaaaagggtaaagaagtaatgatggcgatactgttgagcttagcaaattccgttcgtgattgatgctagctacaacttgttttttaagcaaaccaaatttattctccctttcacttaacccgattagaaatagactcacaccttttttttttagattaaccaataaaactcatatatctggatgctctgtaattttcttatatctcaatatcgcagaccagatttcatatatttttggcggatttaaaaagtttaaatttggagtagatgactgaataacatttgagctaaccacatttgggtattgtttaaaatttgtatgcacagtttcttatatgacatgacttactcatgaacgcatatttctgatagaaatgtactagtttttttctttctcatcaatgtattgctttagaaaatatttacttttttcaaaagaagagagaatctgtacgtagattcatggaatttgcataagacaattcacctttgaactagactacgcgcgcaagttaaaaaaaaagtgaaaaacgagcagagtcaaaagacatattaaaggcttataaatgtttacattttatttggtcagcaaaacaaacatacatttgtataaaataaaatataaagtaagataacctctcttcataagtatgaaacgcctcaaataaggtcaactcgatattctttgtcgaactttttttagcatcaaaatttccaagtcttaccaattttaaaatccaggattcaacgagataatatatttgtaagtatcattatatcatctaagaaaattagattacattaaaaaaatgacaaaacggttacaaacctacctccaccttacgtagaaatagtaatcttattttaaaagttttaactttgacaaaaggaaattaaaatttagccaattatctctcgatctctctctctcactctaactttggagtttccttccctccataaataccgaacctcactccttcttcctccaccatcctcatctctcaatcaacaaacctaactctttctctatacaagagcgcaagctcgaaggcgctcttgttctttcttcattttctccttaacaatcaccctcatagtaactttaaaactctctgtttctagtaattcacacacaaa

SEQ ID NO: 2791 - DNA, 2000 bp, Arabidopsis thaliana
agatactaaccaaatttaggaaaagcaatatccacattttaaaatttaaacataagggacacgtgtggatatcggtgactcaagattttacatgaattattttagtagagtcgtgtgtaccccgtgaaggtgatgaattacaaagatttcagcttttgccgctatcaacatagttataaattgtaatattattttttgctgtgtaaattattttcttagttcttgcttagcatgaataagtatatcatccaatgtatacagaagatgagctttcttacacaatactatatagtaagataaagtttccagaagtgataactaaaacttgtaactcaaccattaatactcaacaaaacgcgaactctaaagtttaaatgaattcttacttagcaatatttttaagctaactatgaatataacatccatacctcaaattaaatcaatcataacatatatgttactaatcacatccatatattgcttaggccttagggtataaggcaaatacttcattcttataaagcaaattactttccagtaaaaatgagacaaataaataaatgtgtatcactattaagtatcatttgtttgtagtaacaccgaataatagcgtttattttcttttaaaaaatatctctctaaatctagaattaataaaatattattttactttcttagttgttttgattaaaaaaaatgaagtgattagatataagtatataacatcacgaatttttttttgcggattgtattttcttgataattttgattcggaagttataattgtggcttaatgagtttaccatttcttttttttttttttttttttttttttttgagtttaccatttcacttcacatatattactgtgttctgtaattttggccaaatcaacactttaatattttgtttgtagaaaaacgtatcttgaaaaaagccaaacacggtccacgttaaaagaaccaatatattaaaggcctttgtttcttctctggtttaacactcacgtgaaaatatgcagtgaaaaagagagtttttctataaagagtgttaaaaaggacaaaaatatactttaataaaataaattttaattaatattcatgtcaaaaacaagagaaatttaatcaatactccaaaaaaacgttaaaaagacacacaagtcgaatggagttagtttttttttgacgtaacatcctatgttgtcgtctctgccacgtcagaaacctgctgtagaaaaagaccagagactgctaaaaaggtaaaaaagtaaaaaaaaaacctgcacaccgcaacggtctaatttgtttttacttagttagcaaatgaccaaaacacccctgtcgttgaacgaaaaagagcgattcttcgtagaaaggttttaagaatttaattagatttattaaccacccttgattactgctatttatttaaattcttaaggtcaaaggttagactaaaaccgcatcctccaaggtcattaaatacaaattttgtttcccttaatgacaaaaaaaaggattgtaaaacgccgcaaccgccgtttcaatatcctataaaagtctctgttctattcagagtcactctcttcacttacatgttttgctctgcttctctctttatcttcttcttcatcttttgtcactcttttcttctgctctaaactttttcttttcgctgcaaaaaaaaattcccaggaatatttcttaaaagaaatttcatccctaaataagaaaaaagcatctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaa

SEQ ID NO: 2792 - DNA, 2000 bp, Arabidopsis thaliana
cctccatcagtaatatttcttctactagatacttattattaaaataatataaagtgatgaaaaagaagagagaaatgaaaatcgtctctgttttcagaaactttgagagatgtttctggtcacgtgtttttccaaaaatagttgattttattttttaaattaaaatttaatactttatctgaatttaattaaaataaataatattttattcataagaaactattttttgaaaatcaaccgatgtagatggccttagttctatatatttatatatattcaaattttatgtttatatcaaatttaagaatcgtttttcactttttctagacaatcgttttttctttggtaaaatgcaaaacataattctttcttttccattataagatgtttaaacatacgtgattttatgtatttaacatgtaccgcatgttaacgtttggagaagaatgacgatgaacaagtaatgattattagttgttacactaatcatttgtagatgaaaatcattatcaaacacaattcaaagaggacatattcgtgtcaactttcttctgctcatctatcaatacatgcttacaacgttagctcgaaacggcgtctgtcatccacatgcggagctatctctgtgtttttcatttatttatcttctacttattaatagatttttgttttgtttctctcagaaaatattactaattgttaaaagatgattattttgaagaactagcaaacggaccgtccatgatattttgtggaccatgttttgagctgaaattacggaaacttggccgtcgatttctgccgttgaacttcttcaccttattaaatttaatgtgcatttattttctcgatatgcaaactaaaaaaatgtgactctaaaaaaaatctatctaaccctaataaatacatttgcagaaacaccgtagaagctccttaaaagttagatacttcatcaccaaacacatgtaaaaattttattttgtcattaagtaattcaatatatgtacttccagcgacattttttctcataaaccagacacgacttcttcatcgatcgtacataggtttgatgattttttaaaataaataataagatggttacgcatcgaaacattagattgagataaacaaacgacaaagctatacgtgtcgtggtacatcgatctcaaagcagaccactatgacccacttggatttcaacttgaattttctttgtctttatgatattttctttgcttttcttttgaatattcaatttcacactcagtaataaaactttctccagcctccatattgaccttaatccattacttctacatactataccaaattcaaaatttagaactacctattttgtagactaaaactttctcaagcttaaattgtttcttgatagactaaatatattatcccaaggtaaagttggtgtttatgtgtgtttgaaggcgcctgaaaaaaatagaaaccacacgactcgtcttgtatgtagctcacatgtgtctttgcctctttgctttttcatgccattaaatattaaatcttcagcggtttttggtccccaacaataaaaatatattttcttactatattctatagttcattaatattacattgaataaacctaatgttttttaatatgaaaaaccagaaaaataaaattgcattcggagttttggtcttgttttgaaaagaaaagaaaaaagtggaagctagttgcattaacattaaacagtggcaaaaacgtaaatcattcactcactaagtttttctataaattgaactactcccctcctctgctttttccaattctaaaccaaacaacagattctcataatcatctcttcttttttcctctttacgaaaagaagaaagatcaaaccttccaagtaatcattttctttctctctctcacacacacacattcactagttttagcttcacaaaatgtgatctaacttcatttacctatatgcaggtttacacaaaaagaaaaaagaacg

SEQ ID NO: 2793 - DNA, 846 bp, Arabidopsis thaliana
ctcttgatcgaagctgcttctgttaagtttctgttttttcagatattttcttgaaaatgagagaatttaattgcacgataatggaagaaagacgatgaaactgcgacttcttttcttcttgttaggaaaaaatctgaacatgtggtgcttattttattttcccgattttctatcttttgtattcaaacgatcaaaagttgacacaacataatcttctcttatcttcttttcgaccaaaacataaaataaaatatttctcttatcttctttagttttctcattgcgccattcttgagtttttgattggatcgcttagatttggttaacctggtttttacgttttcggttataccggtttacctctttttgattaattttctttcacaattacaaaaccaatggtcccatactcccatttgctagtttaccaatttttaaaacggtaagatttagtcgtacaaaagctgttattttcagttttttttaccgccttatcttattgtacttttttttttcatcaatcttattgtacttcttactaatggttatctctctatctttcatctaaaaatatcttaccctttagtgagctcttaaattatgttgttcaattttcttaacaactttaattatgttttaggtattaccgatcacatcattgttcaatagtaaatgttatgttgttccctttcgatccagaacttggtcgtgtacattactaagatacatttgtttttaactataaccagatttgcttatccagatcggaaaatataagtcaactacttgtgttcttgctaccaaaaaaaaagaaaaaaaaaagagctacttgtgttccttctttta

SEQ ID NO: 2794 - DNA, 1906 bp, Arabidopsis thaliana
ggcgggtttggtttgatggttttgtttaatgggtttgggaggaggaagaggagaaataatggagaggtttttggtcagcgatttgatataagacaatgtaaattgaagcatcttggggttatcaaaagtcaacgctaagagagagagagagacaaagggaggaaatgcatgtgaatgaggataagaaagcttgtcaaagcaaagcaagaattgtgtgacttgtggatggttaaaaaaatattcaatgtataaattttctaatattgtattggtaatactgtaatagtataacgcatatataaatatattgacccattaattcgttgtttatttcaaacataaaacacttagttgcacaattgaattggatacagggctaatgaatttaacgtgtgacatgtattaagatttgatttaggaatgtagggaggggccagtggctaagattagagaaggtttacgctgaattagtttgaagtcaacgttgtacttatatactaatcttgttgtttatgtacgtttagttatctcctttattcaggcttatttaagtccaatcatgtcacctaagcaacgtttagtttccttcacttgcttttaaagtcgcagtgttatcttattttagtattagaatatttaaaactttgaaatctctccatattagaagattaatataaagttttgtttttctcctaaaagtggcaagacaataaaataaaatataattgtaggtaaataatttgtatatactaggaaatccaaatttaaccaattgagtcgtgggcattaacatttgtattacataaaattatattttggcaaactaccataggataaaaatcattcacttaacggccaagttactaacacaaggcatctttgataatggaaaacaatctgttggacagttgttattaatgaagaaaatgcgtcattgcatgctcgcatgatgtatattttaatatacactagctatgatagtatataaacagatatacatgtaattaagaatggagataaatgaacgtatattatccaggggcggattcatttggtgaagaatgaatgtattcagtgaattttaattgatattcgaatacaccattgttattgaacacttaattattgccgccgctcttccaatttttcaattctttttttccccaatcagtagagtaactatgggcttttaaaacccatagctccggattcccaatcatatattctatagtctatgtcatctaaaacaatatgaatttagataaacaatttatgaccttcaagccatatatttgggccggatactcaaaacatatgaaattacactcaaacactaattgagctacttaggccaaatatataaaggaaacacttactactaggcataaaaagtttggaagaaataataagagagaaaaaaatgttataatcctgacattgtttttttattgttaactcactcttggaataagttgtccaagtctcatagttgactcagtttggtggtgtcacaaattagttccatcattactaatttgctatcagtttggtgatgtatcaaatactgttgatctagtaatttcacaaaaagcgcatatcttccggctaatgatattagatttactcatatgtgtaatgtgtatgtatggttgaaagttgaagctaaattaggtttaagtcactcatatcatatgtgtgtgttatcttgtatagtgtaatacaaaattcaatacaaaattttccaataagcaaaaatagtcgtcagtgcgagttcaactttaaactgtttcaaactttatattcattacgaatgcaacagtccctctcttgtttctccacgcttcgctttctccttccattttcttccaaactctctccgcttcgtcctctctttcacaccgccgct

SEQ ID NO: 2795 - DNA, 1815 bp, Arabidopsis thaliana
tcgatttaagagaacaattgatttaatttttctcaaaacaaaaactaattaattgaagaaataaaaaatctcaagcaattaaaatttgggtttctttttgttgtttttgttttgagagagatgtttgttgttgatccatcattcgtatgtaacgccactgggtgtaactaattatatttgaatttcgtgtaattaataatcgctagtagattttttcatattcaacaatttgccgatagaaatgttttccattctcctttcttgaacccactttactttttcactatcaacaataagattaagttttgaccgaaaaataaaacaataagtgacaaagacaaacacaaactatagtaatgcacaactttttgttttgttaactactatcactaattcattattgatatggatatcattatgatgtttttagaaagtatatgtgtgattatgttttacttttcccaggatccataacaaaaaaatatctttgagaaaataatttggctatatcatatattggataaaaatattgccatttaaaatggtcttttaactctttttcttaaaatctgtatgtatattatagtttgatatgatcataaaagcattcaataatttttctttcatgcaaaactgatagatcttgctcaatgatcatgtttcaatgtctttaagtgttttaagaaagtgagaattgctttgatttggattgaaaaatattggaccataataaacacacataacattatacaaaattatcctttgcttctatatttaacatacattttgttttccacaatgtgtaaaactctctatagaagaaacaccacacaaaaacaccaaataaggtttagctaggatataattgacatgattgaacaagtgggcttgggatatatatcactacaagaatagaaagataaacaaaaatatcttctgcaattcgtggtttgtgaacacaagagaaaaaaaaaaaaaaacatgtcgaccaataaaaaaaagatacaagagaacgaagcataaaaatatcaaaacaaaaagacaaaaacaggaaaatagaaaaaagaaagaaaaattaaaaaaagctaaaatcaacggtgagaagattctgtatataataagaaaatatcacccaaataaaaaaaaaaggtggagtccacagataccgtccatcaacgtatcactgggctctctttctccgtgccgttcctcctacgtgctcgaataacgatgtgccacgtggtggaatcgaaggataaagtgtcgttttttacttcgattacacgtgagtgtatgtatgtgtgagtgagtgaagaagaacaaagagcgaagaaaccccccagcactcacttcatccataagatcattcaaattctgggatcttctctctttctctcattgtattcagtttcttcgtctcggttcgatcatcaggtatctttttcaattgaattttaccttcaatttcgattgctttcggtgtttttgttatttgattcaaattgcaaattttcttttgatagatattttcgttttgactataaaagacgattcttttcttcttagtgtatattgcacatgttccattcgcagaatgaagtaactgtttctctacaaagtgaaaataaaataaaaataacaagtgtggttctcttgtctaactctgtcagattcttctttttgagacaaatagtataacttgttccttttttttctcatctattgcaaaagcttcattgttttccttattatcttattatataatctctactttacttaacagatccggcaagtttgattcagtgacaagaaagc

SEQ ID NO: 2796 - DNA, 2000 bp, Arabidopsis thaliana
gaaaactgatttctttaatctctctaatgtcatctgcaactatttaacatacacacacacaaaataaaataaaattggaagagctaatgataatgatttgtattagaaagttgtcctttattttccaatgcattgcatcgaacatatgttgatgttcttttaaaatcgtaaaatctagttctgtattcttttattctaggtttatcaaggctttgtcacaagacaatgagaatacaacttttctctaattttcttcatatactaaataaattatcgtagatttgtagaaggttcttaggctagattcaaaaagtcatttaggatctctttctagatcttgcattttttttagtaaatcttatgctggtgatacttttattaaaccttatgattctaatttggaaaacaaaactaactgataacctattttacattaataaaaacgatgcataattgtaataatgttttatttttttatgttaataagctagccaaaacatattattgatccgaagtacgctattttctataagaaaaggagaggcacggaaatgaacacgctgtgtggttaatccaagaaatcatacaaaattaattcataaactataataaaatcattgggatcttattttgcacccaccaagcttgtaggctgaagatgcggatggaacccaacttcaagaaattcttgccttttgttttatggcttttttttgtcttgtcatagttatataaatgtattttgctaaatttaaacggacaatcaaataaataaataatatataatttgtagttaacaactaaattcaatgactaatatcatgtaacaatagacttgtgacagcagttttctttgttgacttcaaagtttaattcgagcgtacgatacatttggtcggtgataaatatcgtgctatgagtttaatttgttgacttgaaagttttataaacattgtgaaccattgtaacatgtgtttcttgattatacatattcctaaaattaatttcatatggtaagagtgtaaaattatccaagtaatggtgtaaattttaaaagtcttttttttttttttttttcatcaattttaaaagtctttctctgacgttaaaaatagtcttgtcttaggtttgaataatatcggcattagccattattggtcgttactatgggatacttaattttgctaaatctttcagaacctgtacgagataagcgaaaaagccatgaaccacggtcacgcgtgtctcgcacttcccaactttcaccatgcatgctctcactaaagcctgtctttttttttctttcttttacatattttaaaatcataataccataatttgcactaattcttatggtaaatccgttttatgagatactcaacttagttgtccattccttaagacacagattaaggaaagtattcaattctttttgaagttatggtaataactcaaattcttctttcctgccttgaatacttggtacaatatcacaaacatatctctaaattaattacatgatctgcagaatcatttacataaacactttcacatttttatccatttaaaaaaaaaaatattatgatcctctttccttttcaattaattatcactaaactaaaaaatattattcccacagtcaaaagaaaccaaactaatttaaaaaaggtggcgcgtgattatcacgctcaaatgaccgatcggttccactgaattttctcagagattctcctctgaaaatgttttttgtttttttcttatgtcaaaaagaaaatttaccagaaatgattaaaatttgaaaagagaattccataaatgagttaattcgccagtcttgaagatcattacagagttttcagaaaccatatgtagtcttagattctcttttgccaaagaagaaaattttactctgccatacaactttttgtctctttctctactaataataataatccgaactttgtttgttcttctacttcaattcataatctttgacggcg

SEQ ID NO: 2797 - DNA, 2000 bp, Arabidopsis thaliana
gctacagacaaatagaaaaaaataatttacttatttacaagttagaaaatatcttttgcgaaattgaaatgttgataaatgtagtgattatattccaataaaaaaactaactgttgcatttgtgttttcatccctaattacaatataacgtttaagaaatgttaagctataagttagtaaaattatattttatcactaattcacaaacacgaactctagtacaatagcactaaattcgatgatgatacgatagcagcacgaatacaaaagcacttaattcaaagttgtattaaccactagattataagtttggtcagtgataaactaatatttacattagatataagcatttgctattcaattattcagcaacatctaaatctaagtattgaaggagcattatatattctatgtcgacgacaacgaaacgagccaacatgacatgaagctaggatactttatatgttatataagttataaaatgagcttctagaaaaagaagtaagtgtatatacgtatctacagaaatatcttgtagataggtgttgatgtagtgcaaaaaagtaagtctaaagactaaaagtgaaaaggacaagaaacaaaattttcaaaatataaaactaagaaagaaaaacgaacggcgagacattgcctagaacgcgacattgtcactgcaagaggctgtggctagtacttggctctaatgcaaaagtggggcgaaacgatagaccgtcgtagtgacttttgtccatgtcaattgcatcatcatagtgtcctttctataaagtcataataataaaagaaaaaaaaaaaaaagatttatgatactacttagagtttgaagatcatagttctttacaactatactttaagtgaacaaatagcgtatatatacgtatatttattcagtgaaaatatgaatatagtgtatccaaattatcatcttttaatatatttttcctcttcgtcaatttttgtatttgtttatttgatatatagtctttctagagtattggtttctagaagaaacttctgggacattgcttgcttccgtgagaaagttatacgtaacacctgtcttgcccaaatctttgtgattctttttcttcttttcatctaggttttacgtttaaacttacgcatgcatgagtgatattgatacataaggctataagcattaatcattattaatatatgggaaattactcgaagtgtcagctttggattatcactttcttcttcttcttctttttgatttgaaatttgatttgaaggtgatttcactgatatgtaacaaatgagtattttaaaatgttaatctttagataaaaattttttttgtcacaaatataatttaatttaagtcacaaaatatcccacataccttatgatgtctattattaccctatatgtatacgtaatattaaacttttatttaccctagtgtaatggtttttgctatcatcatcgatgtgtctccactctctacctaaattcaactcgataactaagttcgtacgtaaactagaatcagttgaacttacatatacagataaagtattatcagatgacactgttctttcttaatattaatgttatgacaactccactcaaccaatatacttgtaacttaatatgaattttatgtatatttttttttttctgtttaacattaaagatgacactattcgtttccgaatttatcctgtcttgtagctgattaatgtttgacacatacttgtataattagaaataatggttccctcagtttggttttcaaactcgagttttagcttaacttgtgtcgatgaaaataaactgtacacgtatgtattaaaatatttatttaaagcaccaactaaaatgttatgctatttgataatatccaaataattaaatcaatatcacgattcacttcctatatatatagggcttgcggaccgaacaacatatcgtgagaactaagaaacacccaagaaaacaaacaaactttttaaaaa

SEQ ID NO: 2798 - DNA, 1369 bp, Arabidopsis thaliana
aaatcctcccctacttatctttaagaggtttatgatctctgtttagattgtatatccactaaagctacttgccagaattttgaaaacactgtagttgcaaggaaagtaaatgcttaagaaaacactggacattgcaactttgtttgccaattatgtagctctgcggatttgtcttcacttaaaccataaatgtgtaaatgctatgttttgtcccattttatcttctcaatttctcaaatattaaacaggaacaagggattgaaattctaaacaaagccatagcagcatgcactgagacaattgagacacacaaaggcaagcttgtcgttaaggagggggctagagctgtgagtatcttaaattagttttttttaagtgatgaaccgtctcgagttgcatgtcacaagaacgagcttttcttttgtgttttgtttaatttggttcacaaccgcctattaatgtttataatctatgtcaaatataggtgagtgaacgtgatgaaaagatgctgacagaacacatggctaagctacgtcttgacaatgaagaaatgagcggcgatgaagatagcggagacgaagaagaggacactggtatgggcgaagtggatctcgatgcaggtgccggaatcatcgagtaagattgccggatttttctttctattaaatctacccaatctcaacagtcccagtattttggtttaagctttgacaaggcagtagaaaaacctccgagaggatttatgtgctttttgatgactctgaggcattttattttacccatagggggtggttacatatcaatcatacattcatggttttataaaagatttgattctttgcatatgttactactgctcaagaatatgttgctccaccacatgactcattattatcttaggaaaactttggctcaatatgatcatacttttgagtttaaacctcaggaaagtaggttgattggatctggcaatgataggtgtgtagatttaattcagatctgatgtctccgaagatgcagatattcatcaattactactgcgatcttctattgagaaaatttaccaaaaatgaaattcttaaaaatcctctgtctgatacataaatggttaacttgcaattgattcataattaaaatgatttattacaagatcaaacatcttgtcttatactactaatcagaaaagaaaaattctttcggacacaaatccttttttaatctgtcggcgcattaaaaattacttaagctctctctgcaaaatcgaaatgtgaaagttgcgacttttggagctcagctcagctcacactttcctcttcctcttacctgaaacgcgtctcgtaacactgatctctaatgatcttcgtctcca

SEQ ID NO: 2799 - DNA, 2000 bp, Arabidopsis thaliana
ttaccaaaaatggagttaacggcgttaacattgctgttaactgcgtgtctgcttactagatatgttagtgggcccagtagagattttaacggttgttatgtgctgacgtggactcatctttcttaacgctgctaattaactccggcacaggtaacagtaaccagtacgacaccgtttttggggttgcattcattggcagcacagagccgcgtcgccaaacgttagcgttttaaaatccacccgctccacatattactcaccacgtgtctttatttaaaacccgcgtttccttcacgcgattctcatttaacggagccgtgactttttcaaaaattgtttaccgttggacaaatgtcttattgtcctcataatgtcagccttatttacggaaataccattggacggtggtcgtgaattttattaacaaagaagggtattttggagaattacatcagggacggcgtattggggcggctaaccccatccgactttatatgcactttatgggaaatttcaattaattaaaatatgtaaaaactataaaaatatgaattaaaaatttgaaaattcaatgatacgccttttatttttgactgtgaaagtcttaaaaaaaattgtttttaaaaaacccaaatgattcaccttttcttaaaatgtaccccgtttgtcttcgaggagagatctctggtccacaacttttttattagacaactcaaaaaaattatattcttttcttttctgttttgtattatgagtttttatttggtatttttgcactttatcccttctcaaagaaagctctacaaagcaaaacccaatttgaattaaacttcatatttaccataaatgattacaccatgaggcgatttttataccattttcaagttttgtgaaaatattagtgagtttgtaagttgtgattttatgggttttttttgttgaaaagaaattgtagtgttggtaagaatagagttgagctgacacagcacctgtgactatttgtcgggacacatgtgtaagaagcaaagcctctcatgctttcttgcttctctttgttttcctctcgtcgtcttttatatatccttcaattatcatttttatgtatatatctttttgctagaaatttaaacatatatatatatattaaactaaagaatctgtatctcctttttacattgaaaagaataaaaaattaattatggtattagcctaacagtaccgattatcaaatataaatgttgttttttttttcgtctgaaaataccaaaagcccgcatttatatttttattttgtcatcagatattatttaaaactcaaacgagctaaaattgcgggaaattacgagataccgtatttacattttacattctaatattctatagaaaggaaaattttgacaggtatttagattactgtttttgcaaaattaaaatctcctaataaaaaccaataatacaaatatcaccaaatatgatagaagacaacacaaatacactaaaaaaggaaacatattaggtaacatgatttattataattttgccatctaaaatatggtttactttaaatatgtagacttctggaccatataaaattaacataattttggaaactatatccaattatatcaatcaaatattaaaaaactatataaattttaattattatatactctaaatatctatacagctggacatataaaaatttaacaaaattttggaaactaatacccaattatatccatcaaatataaaaactaaatcaatttaaagatattaaaaattgttgagaattcgttaaaataatttaaaaaatcgaaatataaacgacccaaaaagacagatggaaaccatattcactctctcttcttcattagcctttcgtctccttcttctcttctctatctctctttagcttctctacgcaagcttattatctctttctcttaaagctttttctatatacaaacagaagcgtttgatactgtaaaaaagatttagaa

SEQ ID NO: 2800 - DNA, 2000 bp, Arabidopsis thaliana
aattgttgctttagttaaattacttagtcgaagtagtttatcaaattcagtctaaaaagtacattatagaccaaaaaaaaaaaaaaaaaatagcccacttttagttgaaatcatactaaatagcaacacttttagaagagataaacacattagtcggaacacctgtaacgaacttagttacaaaagactgtgcacactcaaacaagttagcacctagtcgcaacacttagttgagatacgaacctaaatatctctaatcaatcgtttgtaaaccacattttagtttagccaaaaacagtcgaatactcaaacattatatcactttttagtttcgtcaaatcatattgaatagtcgaaaaataaacgaaatgcgttctcgggtaataagtattctagagcaaaaatgtgattaaaaacaatatgagtaaaatgcattcatgaattatgaagttgcaaatttcaaccagctgatgccgacgtgttggatttcaggaagttgttggatatcaaagacccttggagatcttagggtttaggcttctagaggctttaagcattgtacaatttgtaaacttcaaagcattagtcggggttgttcttagtcgagttgaataattaggcttaattattcttaattgttcttagtgttagttctttttgtcttcacgggcggctgataagaaatagaggacaattaggcttaattattcattcaggtagaaaatgtcggggttgttcattcaggggttgttcattaaacttaattctccttagtcggggttgttcattcaggtagaatatgtcaagtaagttccgagataatacttgttaaagagtttattatcaataaaaataaagtttaagcacttgttgtttgcaagtgaattctctgtgttgtttttgtctctataccttttaaattatatttttattgaatatatagagtaaatgtaaaatggtaagacttttggtatatagttttttaagtgaatttgacgcataaatttcatgaaactcttacataatatatatatcaaaattgtataacaaaatttttgtattttacagacattacttaaaattgcataactacaaacgaaaaacaaccaattttctcagacttttacagtttgtacttcgaatggttaagaaatcagattctattgatgtggttactcgttacccaataaaatagtaattgatcataatttaatgttctattgatgtagaagtcttagaagatacttactaatggacgaaaatatcgagaaagaaaaaaaaaaaggtacaacaacggcatatttccgtgagaataatgcgcgtggaacgattaatgtggctattcattgcttaacggcctttttagtgtcggctctaaggcccatttttgtctttgtgcaaatttaacggtgaatgtgtttgttcaggtgttttacattttttttttttgagtgttggaacgcttttgttagagtttatgtagctcggattaagacaaccctaattggctaattgctaccgcctaccattgtttgactcagttatacgggcttaagatgagctgattccttatcgaacaaaccaaaaccaaataatgtcaaatttaagaagaagaatcttttcaagttacattttctcagaagcttttggttcctttgttactgactatttccttgttgaccaaaccaaaaccaaacaatgtcaaattcaagaacaagaatatctaacggcaacggatccaagacgatgaatttgacattaaaaaaaaaaaagttaaccagaaagattcatgcaacacttgagaggtatgaaggtacgaataagaacacattctccacgttcgcttttggtcagtgcacttcacttggttggtgattaaaaaaaaaatgtataaaatataaaaatgaaacttaatataaagttgaaagcttggtctaaaaatggaccgtatctgaaaatccaatcgacgtcgtattccaagaaaatagaaaagtaggatc

SEQ ID NO: 2801 - DNA, 1188 bp, Arabidopsis thaliana
gagagaatgatttttaggatttgggttttgatttggagatttttcagaggtttcgtcgactttgaagtctgttgatagcacaaaacgtcatcgtatcaccttaacggatgttctgtaacggctgttaattacgctgttagaaggatttttaacggtggtttattaaaccgagtcaacgcaaacttaaaggttaaaatagaagtcaactttttgttgagagataaaacggccatttcacgaattcacggttaatttggccattttttgtaagttcaggtattaaataacatttcccccctaattattaggtgagtaatacggagaaaatggactttaattatattcgtaaattgatgttcacacattaaggctctaactaaatcttccgattattgtcatataaacatgttctaatttgtgataaaactgaacttccactgtctcgcagagaagggaaagaatattttgggagaacaactaaaaccctaatatctatgatgatgtcaacttcaaaacacattgaaacttgagaaaaacaaaaatcaaagaaaataaaaataaagcctgcatgcaagagaatatgccttccctccaaggttaaataaaaacaagcttatgtgagagattaagtatgttcataacttcacaattgtgtccattagtcgctgctcacgttagtcaggagttatttctgttgggtcttatcaaaactgttgtttatgtctattttgattatggacttacctttacatttgcattttatattttcattcttagttataaaaaaattgcttatacttttctgttgtttgacccagcaccaagtataagaacaattaaaaaatttgatacctaagaaactaattctataagattaattgaagaattattttcattcaaaatcttttgacataattgctacgtttaatgtgtaatgccctggtctattcgataagattaagaagataattgcaataatggaacaaaattagctgagaatgcaatccgtttgcatggatccgacccggaatgcaatccgtttttaattatgtaaatgacaattatacccctggcactcgacatgtttgacagtttgagcaaagagaatttttttcttgttgaggatcatcgattatcagtttctggatttcgctactacagatttgtcccgtcttgagttacgaaatc

SEQ ID NO: 2802 - DNA, 2000 bp, Arabidopsis thaliana
aattacatttatattgaaacaaagggaataataagtaacataactttgatacttacaattaatttgcaaatagttttacaaaaaacacgtaatagaacaaagcaagtaaagtaaaatatttttagcaaatatttgaaattgaagatactcgtttctcacaagtcaaatacgaatactaattttacccttacaaaatgggtcaagtagcaaatacttgtcctgtgcccatccctaatttttgcaagcaagatgcactaagtatgagagagttttgtagaacctagtgttttatagcaaatctgtaactaatcctaaaatatggaattacataagtagtaaagtagcaaccaccggtttactttctgaggaattagcaaactattaatggaatgaagaccctttctggggaattagcatacaaaactaatatgagaatttcatgtggtgattattggccaaggcaaaagtcttgactacataaattctaccttttattcagactgaacaacagctcttttaatttttacttcctgcgctagttttttgttcctattaaaagagtcattcaagatttcttaggtaaattcttaaatgaactaaaaataaattttgttaagtaatcagaatcaaaggaaaacgatggtataacagtctggtatcatatcccacttggttgctactcgctagtaaacttcaaccacaaccctctgtccctctatgacgttgatgccacttttaagactaacaacaataatattgtcttttttttcttctttcgaatccacatctcttgaaattttgttaaataatttaaaatatgtaatctatatgtctgtgtgtacatatgcataaatcatactccctctgtttctaaatatttgtagtttaaaatttttgcacacaaattaaaaaaccatacaaatctcatttaatttatctctttcctataaaaacatcattaattacaactaatccaaccaataaaaaatatgatgtaaaatacaattggttaaaactattaaatacatttaatgtttgcatagaaaagtaaaaacaacacttatattgaaaaaaataaaaaacctttaaactacacttaattagaaacagagggagtaatacggatctacgagaaaaatttagtgaagtcgcggtcgaaggaccttaggttggtggctagaccatttcgttcaaatcaatcccactttctttcatcaagataacaaagattcacaaacatccttaccaaatgatacaaccaaatgaccaaccaaatgataaaaactacctaaggtctatcatcaagtttttataagttctatttatcacttaatatcacaatggtgcattcgagaggatacaaccaaatgaccaatacacatgtatttttaactgcttgtaagtatcacatatctcatgattttaaaacaaaaatattgatttacttgtttattattattattattttttctatacttatttggtttgatagtagatgtttttatatatatttaagatatcattttatatatcttgagactgtatttatacctctcttctttattctacaaactacctgtcaaaatagttggttttgaaatgtaacattggtgatgatttttcttttgtctttaaatgtaactttggatgacaaaattcagtaataataatgggcctgaggttatgaatatagaattccactttatcacattggacccaaatttgccatgatataatataaaacgacgtggtatcaagtgttcagtgagtgtgagtcctccgacacgaataatctagaaaattttactaagactagtgtcagtatttttctaccacactcgtcgccttgctttacgctttattctctcttctttagctttttatttcttcagcaaatctgatttcaaaaaaatttcatcgaggaaactgaaaaaaaaaaatgagtgacgggaggaggaagaagagcgtgaacggaggtgcaccggcgcaaacaatcttgg

SEQ ID NO: 2803 - DNA, 775 bp, Arabidopsis thaliana
gctcattttattgtgaatgcagcaatacatggctcaccttctatctcaaggccaactcgatggaagtggctagtggcgccagctctctttgtttcagctttgtgcctaatcttgttatagcaaattcgaatcctggtatcttggaacatttgtatggtgtttgtataagtccggaaccgtaccattggcttacatggattattcagatttgtactctgaaaattaagagcatgtaattcccgcagaggcacaatgtaataaacatatagcatagcaaagcaacaatccggggaaaaactttggttaccaccttgaaagaaatggggaaaactgacagagcaagaagctttccatcatcagcagagacgtttgataaaagaaaggtcaagatttcattccacgaaaaatctgccgaaaataaacatctcattctggatgtggtatatgaaatgggattgtacatggagtttgaaaaacttggcaaagagaatcatggaaggaactaaccatttgagctgcaaggtcatacaacacttccaagaatttatttagacaaacacaaatgcgactggttttttttaatgagtgaggcccattaaagaaatagtatgatattataggcccaaacaatcccaaaacccttggcctttttctgtcgcgctaaaccctacgatctagaaccttccgtcttatgtgtctctgccccaaattaaaaactcagaaaccctagaaaattccgattcatcaactgagagagaagaagaattgagaaatg

SEQ ID NO: 2804 - DNA, 2000 bp, Arabidopsis thaliana
ctaaaagattttttcctaaataccacaaaactaaaactaaatataaaattttcagaattaaatcctaaatcctgaaaaataacctttaaaattaaaccctaatcccaaaatactaaattcaaacccaaaattttaaattttaaacccctaaaaatcatttttagtgtttgtgttattcttactaaccgcaatccgtctcataaccagttaagcatataggatattttacaaattcctatgcaatgtgaaatatagttgactatttgtattctggaatcttttatatcatggttgaatttttaaattaattagtaaaaaataattcttaaaagtgttttttggaaaaatattgattttgctaaagttttttggaacaatcatgaatctgcgctgctgtattaataacttaattagtaattctatacacaaactcaattatagatcttcgattcacaaagaagcacggaaattaagattgtgtatagaactaatcttaatttcataagtaactaatttataattaagttataatttattcacaatctcaattataaatttgactcaattataacttaaatatttcaccatttatttaatcacagttaattattattttttaatttgtccagacagattcaacgggagcctcgtattattgcataaacaagtaggagttatataaacatagtatttttcaacctctactggctttagaatataaatatccaattatcatctatatgataagcgtaaaatctattctacgtcacgaaggattggattttattggagttttcttataataaaactaatgattttggacattgataagcaaattcggatctgtagtgggaccaagttacttgcaataacacgtggggagttgagttcaaatctttatatgttgatcatttgatgtgttggcacgatcagtggttttgttttattttttgaacaagcatcatcagtgtttaaaatagtgaacatgataacttacttatatcattaggggtaaatattagctatcaactatcaagtacgagctaatcataaaatgatatatgaactttagacccataatatgatatcttcaagactacttaaaacctcaattttctgaaatatactatgcaaatacccaaaacacttaaactaacagagcatttacatatcctcttttgcatctgcatttttttttttttttctaattttgagcatcgaaagatcttcgaaaataactttttatgctcctaacgatcgattttgacaattttcttcgtggtctatttaaatactgcacaaactatcacaattttgtctaataaaaaaacttacaatatttatcattgttttcttccagtttatccatatgtcatatgctttatctacatttaatctaattcgtccacgtgatgggctgtggtttttttttttcttacctaaagtcatagactcacaaatctatatttctatcaagatggatacatttatggtacgaatcacatgattttgatctttaattaaagtcttgttagttttccaatgccagatctcatcgcatcggtggctactcaaatccccacctattaataccaatttcaaccaaaacaattcccacatttaattattttcaggacctttaatttactaaaatttattattgctaaacctaccggatcgggtaaacggatatgcgattcgtcagccaaattcatataacaattataaaccatatgctctttttccatgcagatattaattgtatactgcaaaataatgattataaaaaacaaaatcatatagatccactataaagagttcactcgaccacattcacataacaaaacaaaatcatacatactccagaacaaaggaaaatttaaaatatatctccttatatactcctaaagttttctttcctttagcttcttgtttagttttattctttcaacattaacttttttttactctcttgtcaaaagagaaaaagagttcttgta

SEQ ID NO: 2805 - DNA, 2000 bp, Arabidopsis thaliana
aactatatggctctagatatttgactatcccaaatttagagattttactcatgagtgcaaaaacgagacatctactaagattgggcaaatttacttgttacctggcttttacctccttttcggctcgtatccgaattgaaactcaagtacccggtacaaaatatgtcaagataaaacaataaattaatatgtgaataagagtgtgttaaataaagttatggttatgagtgggtcgaataaaattgtggttgtaaaatatcttaaaaaatactataagttatattttctaagctttgtactgtaaatgcctaagcttagtgttagaaccaagttaagtgaataagaaagaatttgaaagagtctatgagtgtgactggtttgtataccatgtaaaagaaaagaaaaaaaagagaagaaacgagaagaaaaaagtagaagaaaattgtataccatgtatttatgagaggaaatttttagttgtttttactgaaagtaaaaaaaattgagaagaatattgttggtgaacaaattattcttgattggaaaaatgacaaagagtaattgagaagatttattttttcccaattttttccctcttctattttttttttttttttttttgaagtagcttataagcccattaaaaatgttagcttgtggcccaacatatttaagggccgtcctgaacataatgcacataatttgattgtagctaagcagtaaaagattttaacaaaattgttttagaataaaattataagtttaaaaggtattgtttgacttgaactgtaccggaatttataccggaaatgtcgtaccgtcctgaacataatgcacataatttgactgtagctaagctgtaaaagattttaacaaaattgttttagaataaaattataagtttaaaaggtatggtttgacttgaactgtaccggaatttataccggaaatatcgtaccgttctgaacataatgcacataatttgactgtagctaagcagtaaaagattttaacaaaattgttttagaataaaattataagtttaaaaggtatggtttgacttgaactgtaccggaatttataccggaaatgtcgtaccgtcctgaacataatgcatataatttgattgtagctaagctgtaaaagattttaacaaaattgttttagaataaaattataagtttaaaaggtatggtttgacttgaactgtaccggaatttataccggaaatgtcgtaccgtcctgaacataatgcacataatttgactgtagctaagctgtaaaagattttaacaaaattgttttagaataaaattataagtttaaaaggtatggtttgacttaaactgtaccggaatttataccggaaatatcgtaccgttctgaacataatgcacataatttgactgtagctaagcagtaaaagattttaacaaaattgttttagaataaaattataagtttaaaaggtatggtttgacttgaactgtaccggaatttataccggaaatgtcgtaccgtcctgaacataatgcacataatttgactgtagctaagctgtaaaagattttaacaaaattgttttagaataaaattataagtttaaaaggtatggtttgacttgaactgtactggaatttataccggaaatatcgtaccgttctgaacataatgcacataatttgactgtagttaagcagtaaaagattttaacaaaattgttttaaaataaaattataagtttaaaaggtatggtttgacttgaactgtaccggaatttataccggaaatgtcgtaccgtcttccacacttcggagaaacgacagataagctctctctgttctcttgccacacttcccaatacatggatccattttgacgtcatctttatcactatctctctattatataaatctcttcgtacccttttaccgattcttcaccgtgatcgcttaatcagacctcaatttcgttgttaaagaacaaagctttaagcagcc

SEQ ID NO: 2806 - DNA, 2000 bp, Arabidopsis thaliana
gttttccttttatgtcaaaaaaactttaatacattttccatcaaacatttaatagatttatccagcttggttttcaaatattcgaatatgtttagtttcattcagtttggttagtataaaatttgtgtgtttcgattaaaaaatgtttggtcgacatgcattaaaaatagttcaaaacatttctaagatatgatctttggaccaatttggtcgatatgcatcatgataagatcgattgtggaagattgggatgatccgatcatatagacatatatgtatatagttttttatttacctgggagatcatatattgatcaacaacttcagtttaaatttgtatttcagaaaaaaaaaaaaaaagacttatttagaacttgtattttgaaaatcatcatgatataactacacaaaataaaaccagaggtggattttctttcggttttaccaagatattttgagttttcggcccataattttcttgagtaagagaggagatcattttaattcaatcatttcccatcatggatattttaatatataattttgtggtaaatttttttttggaagacccctaatacacaaatataactgcatatacgctcgagaaaataaacatactcattcacatcaattataaattatagtaattcaagtgttagtttgagggcatagtgtttagttaactatatgtcatttattaacttggttttcatagatttcaccttcgattcaattagttttgataatttagcatcctatttgtagccaacaataaaacaataaaaaacttattttttcgtttgacatagtgttaatgttgggacgaattatgtacacgatcaaatatcaaccgaaagacattcatcatgatgattaatttttctccttttttaaaattcaatgatttttttttgtgtgtggatatgactgaagaaaatttcttattggtattatcaactttttatacaattttagttcttttcttctttataaatctttattctataaacaaaataataaaaattcaacgttgataaagatttcctaccaagtagtccaatacatatgatagcttcttccgtatatttaggaaaaatattggtaagaagagtaacaaagtattatttgaataagtggtatacttatttgcgattttcaacgattttatttttatgttgcaatactatttggatatagttagatatgatctttagttgatcaagaaaccttgtgattaatgtgtatgtattggggataacaatctgtttatttctctataagatattcaagttgttttgagttttagagttataaatgataaacgcacctctactctgagtactctttcatgttactagcattagaaaactaaaaatgcggagttcactaccatattatgtactcatttctttttttaagatgatgttgcgttatttttagattgaaaaaccttttaaacttttcttttaaattaaaaattcaacaatttgtttattctttcagaaaagataaattgtttatctccctgtttttctaaacaatgtaagagcatcttcaatggtgactaaattgggttctctcagctgtttttctggaaaaagatgattaaaaataaatcaaaatcatgtattattgagaaagttgtctctcttgagagagtttttgaggaggatgagagacgacgacgtggccgttctgatgtttttcaattatacaaattgaaggttagctatattgaggaaaaaaacaaaaaaggtaactgcgaaagcccattaactttaagttgttttgcatcggcccaaatataaatcctaaagaaaaagttacatatgtttaaaaattaaaacgcagcgttttaagagtcagctatttcagaaaaaaataggattagcaaaatcagaactctgcgagcgtctataagaaaaaaccctagaaagaagtcgattatccagaaacagtgtcttcttctctttttgttgttacttcctttggtttcttca

SEQ ID NO: 2807 - DNA, 1302 bp, Arabidopsis thaliana
taacgtaaattatgagatttcaaataaatttttcaaaataggaaaaataatttgaaggatgatgatgatgatgatgctgttggagtttgttcaattaagaactggatcaggagaaacaaaaaaaaatgtcaatgattgttcattatttttcttcaaagttgactgttgccacgtgtctctcaaccggatactagtgggcttctttgggcctgaaatttaaactgtgcccaatagtctttcgtccggacaaattgttacagtagttaaatcaaaggccaccaaaactgttacgtagacatttaaagcgaatctccatcacctaccgactcttccttgatttgattgttccacatgtagtaaaaatagagacttgaaggtaattttgccttgagggaacatgaagagactgaaggttgatatttttattagaaagttaaaaaaattatttcagttaatattatatttataggatatatattaaaagatatatcgcgggcttatatttttatcaaatacatgaattttttgtttttaagatatcaactacaactagatgtatcataatccccttgttagatttattattctttttgtcttaatatcttataatagttaatagtcattaataaagaagtaatagctttcattgaagtgagtctactctaaataggatttccacagtaggaaaactagacatcaggaaatctattcaatcaagacgacttatgtagtagagtaatccccggaggtattgagcaactatagatatatgttattgattatttaatgtatgatacaattcgggatgattttataattaaaagatttgaaatttgaaattatatttattttgttaatattgttagttttggttagcttttaaaattgtgtatttgtatttttattgttaaattttatgatttcacccggtatatatcatcccatattaatattagatttattttttgggctttatttgggttttcgatttaaactgggcccattctgcttcaatgaaaccctaatgggttttgtttgggctttggatttaaaccgggcccattctgcttcaatgaaggtcctttgtccaacaaaactaacatccgacacaactagtattgccaagaggatcgtgccacatggcagttattgaatcaaaggccgccaaaactgtaacgtagacattacttatctccggtaacggacaaccactcgtttcccgaaacagcaactcacagactcacaccactccagtctccggcttaactaccaccagagacgattctctcttccgtcggttct

SEQ ID NO: 2808 - DNA, 793 bp, Arabidopsis thaliana
tttcttgtatctgattatttgttttagctattattatgggtaaattttggtcttaattttggtccattgttgtaatttggaacattctttaataaaataaagatctaataaattttatttacactaattaatatttatggtcattattttatagagaaattcttacaaatagcactaaaacaactttatgacaataatagcacacaatccataaacttccaaaaataacactatttgacttactataaagtttttgttctaaagtattactaatttattttttcaataataccacaatttttatataaaatctattcaaccaaaataaatttgaaataaatttaaaatataaaatttggatattctatttctaatttagggtatatatttcaaccatttaaaagaaattttgattcatttgaatattagtttatggtattatatttggtttctaattttcaatttagggtatatatttttactatttttctaaaaaattgactcaatttaatattaaattagtgtttgctcttaattttattttctattttatattttcattaaatttaattaaagtttatagtgttagtttgtgaaattttaaaaatattgtgttgattttggaagaaaacctttttggtgctatatttgtcaatagctctattttatattagtcataaaaaataaaataaaaatatctcaaatattttgactccaaaaatattaaattaatgacatttctttgttcattcacacctgagagtaaagaagtgagaaggagaagaaagaagca

SEQ ID NO: 2809 - DNA, 837 bp, Arabidopsis thaliana
aaaagacacattctgctataattaagaatacaaaacaatccaagccaaagacaccaatctgattcataatttgtttatgcaggatgagaaacatgaggctgcagtaaatcaaaaccatcgagaataaaagaggattcaccggtcgatttttctcgtaaccctgtcaattgcgaattattgtttatatctatattcctacttccaatgtttctcccataatctttgaggactccatatctttcgattctccagttttaacaaatgaatctgtattaaggttatttgtaatgaaaactccaacgtcatcacgaatcattgtcttagaaaatgaataactaaagcaaaaacatagctggaaaaaagctacctcgaaaaatctgccattagtaatcgcgagctttgattccattaggaaacaccatcagggtttatgaattggggattttaaaaacgaaaaacttgttccaataaagtgagacgcagacatggcgggaaatttgatgcttgcgaaaaagataaaacttataaaatcgcacattgaggcctttatctaaatatgggcctaagcccatttgggtgattaaagataataaaagcgggaaactgagaaagtataaaagataccttataaaaagtacacattaatagagaaatatgggcctaagcccatcagggtgactaaattttaatttaaaatataaatataaatttaaaaacataattgggctttacttcgataaaagtactcaacccatttgtatgtctgcgagaagacatgatgatcggttttgttcatttgcaacttttgactaaaaaaagcagctcatagcagcggtt

SEQ ID NO: 2810 - DNA, 1161 bp, Arabidopsis thaliana
agttagatttcccttggttgtattattatgtttgctctatagaattacttatgaccaaagaacaaagttttggaaattctgagacgatgaactcacacaaatacgttaatcgcgacgcttacatgcatcggtgattgattatctctgtatggagaaaagaactgcatcacgtattagaaaagaaatagatgatagatttttgtttttaggtttgtttctcgaagaagaaaaaaataatagagattttgatttcttaacaagaagaagagtatttataagccaagggtacacatgctacagtatatgctaacatttatgcttaacctaaaataatatatcactatttttttatttatttttcttacaaaaaaatatatttattagaaacatatgaaaaatatctacataaaatagaaatacagtatacaatagcgaaaaaaacacatgttatgcgagattagatatacgagtaaatgtataaaaactctatttattgaattagatattcacatagaaatatgttacttaagtatgtatttgttttgtattttcagtaaaggtcacgtgggatttattttttgcatatttagtccttgggatttagatctcgtaaacggcgtcgtactaagagtatcctccggcggcatcagttttggagtttcttggatcatcacactcacctgcttcgttactcttcccttggattggattggattggattcgctctttcatggttgaagaatgagatctcaccaagctggccgcaaacttccgcttcttcaacttctcggctgcgtcgctgttttctccgttttcgttttcaccatccaatcttccttcttcgcaggtcatctatcgccgtacctttccctttccattatatatacacttcaattgttcgaatagcaatatgattcttcatctctcgcgcagataataatcgtaaactagatcttcagccggaagatatccagatcttgtcagattttcagtccagcgttcaacagtgcgtggtttgtctcctttcccagtttctttgattctggacttgttacttttctatatggattcttcggatttggatcgatgccacagttttggtttattatggcgcactagttttgattttggataaatcagatgtgtttgggagttacaata

SEQ ID NO: 2811 - DNA, 1663 bp, Arabidopsis thaliana
aacaggagcaatgaagactgcaaggtctcctttctatagagaaaagtatggttcaaagtctgtagagaagaatcaactgggacaaaatcttatcacagactataggactggtgtttagtgccttatcacagactatgtgactggtgtttggtggtgaatattatagcgattgtctagtggcaaatattatagcgtatttttagtggcaaatattatagcttcttttctagggtgtttagataagctacattacatgttgtgagctgaaacttgtagtgtgattctttttgctgcttccattgctaattttgtacatattttggtttgagtggctcacttcactctacatgccaattttataagaggcttcgtttaggtataatacagtttggttggttatagcatgaatgataacatgttatgctcaaccggcgaccaaattatcttgcttctttttaaccctcgttgattacacattatcaacatttcggccattataacaatagaccgaaatgacctggtagccattctcgcttggcccactaatttttgcctagaacaaaagattgagcactaaaagatttaggaaattgatcaaagtaaaaaaaaaagtgaaaaacaaaaagaagttgcatcacattctcaaaatcttttggaaatagattttggattttgtttaaaaatttgtaaaagccatcaaaaactgagttttctatttttttaggatccttgattggccttgaatgttttactagtttttgtttttaaaaaactcattttttactcattcaagattttggaaaagttggttctagttttgggaagattttaacaatcttcattgacaatctaaattccattttatttgacttttcacttttcctaaacaaaattcttaacttgacaattgtatattttttatttctttattttgtaaaatccaataactaaaaactataggttttagaagagtttttggtttttgttttttcaaaaactattaatatgtcgaaccagtcaagtttataaaatttggtgtccctaaaatttaggaaaatacgtttgcattatttaaaattcaaaatttgaccttatttatattattttttctcaaaaatcaaaatctaaaatcgaaaaactagaaaccaattccaaagactgacttacaaaacagcatccacccattcatggaaaagaacccaccaccacaactattaaattggaaaaggaaaaaaatatattaaaatggtttttttggaaaatcaaaaactataaaccatgttagaatccagggattatcgattgttgagaaaaacaaaaaaaggtgacatcgctatcttattattatatataagagaggaaaaaaaaaaaaaaatggagttctcgttgtccgactctctctctcttgagaaatccattgtcgtcgtcacccaaaaagtaagctgtttctttgatcttcctgttcacccaaaagcaagcttcttctttcacatcccttcttttgcgtttcgtttccagtcgtaagttaacgtttaattttcttattaaaatctcaaatcatcaccaatttgatcaattagatctgttgattttacctgtctgaacttaatttgggttctaataatcgattttttttttgattctccttgtataggttctatat

SEQ ID NO: 2812 - DNA, 986 bp, Arabidopsis thaliana
ttttcttcgactgcttcgttctgcaaatcccaaaaccacaaactttgaagggactgaagaagacggttcaataaactgtagaaactaaaccggaattgctcggtttgattaaccggaatcatgaaggcgagcacattattataacttataagtatgttagcataagtgtttagatatgaatataatcaccacaattacatttagacatccacactcttcttgtttttatttatctatcaaagttaaggtagaatgattgcttaaatcttaaaaatgagttaaattcttaataatttgttattgaacaaaaaatctttatcattcatagatctctatgaaatgtttttgttgttatatataaagagtatcaatcgtcatctaaatattctcaagttcatgccaaataattttttttttttttttttttttttttgccaaataaatatttgttcccttaaaaggttatttatcctcatgcatgtcaattttattacatcatcagaaacacagatttcagataagctatacattggtttttatgacaacagaaagaaaaaaagacataagttattttggtcttgtctttcaggatatactctactttctaaccatataaatcgatttattgcatcactcgacgtaaatttataccacaacaaaaaaaatgaaaacagaaaaaaaaaaagttgaaatgtttaatatcttaaatcttatgttaaatcagatttattgtcaaaaaaaaaaaagattagattttttttcctctctctctctctcattttcacattcactgttacttcttcatagaacttctcactctctctcacacacaactgtactctctctggagatttgaagaaaaccctaattcccaattttcttttgtcgttttccttctccgacgattgagagttttcctagatctaaagaaaaaagtttcaatcttcactatgcaatactgagaagaaattccacaaggaaaaaaa

SEQ ID NO: 2813 - DNA, 2000 bp, Arabidopsis thaliana
gagacctgttgtcagtgaaatcagcaccatacgtttgcttcaaactctctcttctaatgttttcaaatgaaggcataaagcgcatctcgttattgaacgggaaaactctctgagaacctgggggattcacaaaagacatggaggagaaaactctctgaggattcatgaaagatatatcctctctggtaggcaacgatgtcacaccgttttcgcttaactgggaaactcttacaccttctctgctgtccaaaattcttctttctgaatagacataagcaaaataaattattggttgattcagaaagagtaattaaaccccatagatattcaccggcctctatattgttggaactacctccacatagaatcacaagaataagtattcatggtacaacgtacctagatcagaccggataccaccgtttccagccatactattttccgccagttgttgactagtgcaatttgaattctctttcacatgtagaaacttgcaggacaccccattgaaacaccaccctttagcaaaaaatttgcagggaagagctgcacgtttttgttctggttcattcccaccaccgccagtgaaaaagcttcttggcggtatacccggagcaggaaatctgataaccgaatttgtcagtataaaagcttcaacctcttaacttagtttcagcaaaacttaagcagaaacttttttgccataccttggtaaagtaccattatcttgagcaaaagcttgctcctttatgatttttgattgctcatctaaaggtgttgttacagaatgcctcttcacatctacatgagacaagtttaatcagtacatattagcaaaactgctgttttgaataaacaaaagagattccttacagaaacaagcacaaaactctgagaattgaatttgcttacttggtattaaagccacaatttttacaaaagagcttcagtgaaaatctaattgccaagtctttgaacctctaatcagagctaaatctagtcaatttaacaattctctctttcttctagaacaaaattcatcaattccaaattggaaaaggtgtttccatcaataaaaacacgaacttgacagaattaatcaacaataccatgtaaccaatcacgaatttcaaatactaaccgttgtgggaattggaagcttgaattggtggtttatcaaacaattcagattctcttacaattgtatgtacttgcaccttttgttcgacctcatcatcatcaatgtccatgtcggaatcagacatcttgaagtcttcggcgaggtaaccaacgcagagagtggtaaattgataaaaaaaaatactgcggcgtgatcggggtccgaagctcgctgttgagtcctgatgatctccgagaatacgtttggtatatcgaaaccaccattgttacaaagaccaccgaactattttatatctaatgggcctttcctaaataattaaagctttagtattaaggcccatactaaattccaaattttaccaactatttcctaaattaacacatcgttgcctttttatagtaaccggattaaaccaaaacaaaattaaagagaatcgaatcaaaccgtgaaaatcgtgaagcgtagtggtgctatattgcacgttaactgtctccatcactgccactggtaaaccctaagaatcctccgcaatttcgcaattttgtgaaggagccgccggctaaatttgatggcagaccaaagttcggagatcgtcaatgctctgtcgtcggagatggaagctgtttccgtttcatcaactcaggcatcttcttcgtccgatggattccagtgagttttcttaccaatcatcaatttttttcattttcgcgcttcaattttgatttggattatattatttgattagagtggaagagatgaaaaagctatagcaatttagaagtatggaatttaaaattgaaaagatcttgttatctgcttattggtctggtagatattgaaattttactaattcttcagg

SEQ ID NO: 2814 - DNA, 542 bp, Arabidopsis thaliana
actcgcgattcttggaacagagattgtggcaaaaagagtgaagaagaaacaatagagacatcctaaaccgcaaaaatgatcgaaccaaaacagataagagaactccgttgaatctccacgtgtcagaaaactggacacttacataaactttaattcttttcttcttcaccgacggaaaatgggtctgtatataaacatgtataaatttaattctataagaaaagactccaacgagttcttcggtatggggctaacttattgtgggcctatttataaagaaggcccattatgatttttgaatttccgaatgtacccatgatggtatgacgggcttttttaagtcaaccaggctctgcttttcttcgatgagcgtagtagtcgtcgtcgtcgtctagggtttgtttttcgtttcttctccgattgttcagaggtaacttttctccgataattatacttgctcatgtccatataccttattttatcccttacatgttactaatttcgagttattggatcgttaggaattgcgaattaagataaag

SEQ ID NO: 2815 - DNA, 1723 bp, Arabidopsis thaliana
cggtaagcaccaaatcaagttaaacgaatcgaatatgtaaacgtctatataatcaccacaaaacactattccctaaatcgcaggtgttacaggataatggtgaatgaagtttgtacaattaaggaatagcagagcctgtggtcttctcgtgctctgtcacaagagagagcagagtggtcatctcaaccattaagccaccactggtctttcttttcacatatcaattgcttggcgttcaatcaaatcgatcgtcactatttgttcttctacaatatatatagtttttttttttatttgtacaagtttcacagtcacagaggattgcttgctaaactattcgggttagtcttcagctctttttttgagattcaaacttttatttttcttgaaatttgtaatgatcacaaaagacaaattttccgttttattgtcttctttctcattcgcatactacttttggtcgggttgctatcgtttcttacttcactgaatttctagtttaccgggatctgatcggattacggatttacatattcagaatgaattttcagtacgtcaaaaagaaaatgggttataacgtttttctcagcttatttcatacataaatttcttcagtaccttgaggaaaagaagtagataaatagaggtgttatgtccgaaaatggcggtgttaagcggagatgaaacattatggaagaaatactatgacttcacactaactaaatctcgatataccaagcaatgtctctttggaatgttgaaagtttgaaacttaaggaaggctaagcttgcttaacgtatacgatgcaaattggttaatgaatgcatgtcataatttcatttcacgtctcatttcatgtttgtattttaaaattttaattataacgaagagaagttggtcaatgaaggatgacagagagagcatgtctctgtcacgttttatgttctatcgttcaaaccggaccagttcacacttccattcaataatccgacatcctgaaccaggccaggtaaactcttaaagcacttaaaagagcaagagatatatggcaatccattggagtcaatcgatggaaagatagttaaaagacaaatattcgtaccaatctaaccaattctcttaattataaaaatcaagaatcatctaatgtatacgtaccaactcaaatgttttatttgtctttcttttttattagttgtaaaagtctatttcaagattacaactttacaaaatataatcccttgtacattttaatttttagtatgcactttacgaatataaactataaaagtctctagaagtttaacaaatatatagtcaagtcaatttgaatatttgagaaatcattgtccaaataaacccctttacagtaaaatccaaattttaagatttctgtggattgatgtttactatatcagtagtaactttcttttctagtcattcaacgaaaatctaaacattgattataattagctgtcatataaaaacttaattaattactacctgtcaacagcaaactttctctactcacgcgtgagcctatttaaagccacacagttttcttcttcgttccttaccatccatccaacttgtaactctctttctctatttcttctccattctgtttgctctgcaacatcttttagggtttattattgttggtttcttcattttctttctctaaaatatttgcagaggaagagagagagagagagagagatc

SEQ ID NO: 2816 - DNA, 335 bp, Arabidopsis thaliana
tcttttatttttttgtttgggattttcgctgtttagtcggcagtgtcgatttgttgacaagaagagcaaaaaaaagtaacagctcaaacgctgccgttttcgaatctaaaatttggcccgcgcacactaacaacataattgggccgacttagctatataaatgggcctatatatggtactagagggcttcgtgaacaacagaaggtttttgtggcgccgacaaatgggaagcggaaacgaagaaatgtgatggcattgattgaaggcgagtcgagtcgagtcagactcggtcagagcgagttgagagagcagttaagaaacagtagcaggtagaa

SEQ ID NO: 2817 - DNA, 574 bp, Arabidopsis thaliana
tcccatcttcgtatatttctcaaaatgctttatttgtctcatatgattctattgtttgtgagtagtaataaaatcacatcatcttctagtcttgcaaatcttgttctgctaatagagaaagactcctcgggattgattatataaatgaattttcattggtggaaaaaaaatgaaagatatatataactcattgtgttacattaacaaaataatttgaaatatgattagcaaaaacgctacgtagtatgtcgttttctgttctagtaatccagctaggctgaaccaatggccattcgttgaataaaaaaggaagattggaggagaattaggtaatttaagggtaatagtcagcagaagtcattcccatatgtccacgtcagtaatcctgctcgagaaagctgctataaactcagagccgttggatcaacccgtaagtttgaaaaccccaaccgtcagatcaacactacaagttaatatgagaataatgagaaaaccactttcccaaattgctttttaaaatccctcctcacacagattccttccttcatcacctcacacactctctacgcttgac

SEQ ID NO: 2818 - DNA, 2000 bp, Arabidopsis thaliana
tcttaacattggttatttacaattgacaaatacatatatatattattttatttttgacagaaatatttaacatcacttactataaccaaaaaaaataagtatgcccggataataagcagtggccgatgcagaggtttgacaaggaggtcagttgaccctcataaattttcaaaaattcattatctgtcattagcaataattttaatgaccccaacttaggataaattttgaccccagtacaaaattattgttgcaatatgaaagaaaaaatagtacaaatatttgaaagttgtatttttactaaaagtttagacccataatttaccttaaataaaaaaatattaacctaatattattttaatttttacaaaacacaaaaataaaaatatttttttttaatgtatgattttatattaaaaaaatatattttagaccccataacagaaagttctagctttgccactgttaataagtatgccgtgattttaggaatgattttagattttatgaataaaacaatataacatatgacaatagattttatttcggaacaaatattgaacaacaacaaaatccgttatttttacttcctgaaaaataaaacaagaatcggatttatttattttttcgatgataaagagcaatttatgtgccttgtgtgataaattctaaatattctctaaatattgtatgttcattgttatcttgtacttggtgagcacgtatattctcagtattaagtctaacatacagattcgggacacgaaacacacaaaaaatttagggtttcagcaatggcacatctgataatcagccgagtctttaaactcagtggcggaggcagaatagttaatcatgggggtcaaaaaaaattctaagccaaatgcaaaagaaagatttgagaaaaaaaaatgacaatataatcacaaatgatagttttttaaaaaaacaagataatatgagaaagaatttttttttgataaagtaaacactaaaactaaagttggcgataactttggtgtttacgatctcaccaccaaaatttgcactaccttctacacagaagacgaagtttcaataagaaacttggacttcccttactggcctcctccaattcctcactactagctcctaattaattaaccttgctcttgccgtgtgtttgctttctcatgctattagtgaaatcctatgtttctttttcagtatacgttttttcttcgattccataaaatatggtaacctttaaattttcatacagtcctcctaatgtgtgtggtatactatatggagtgaaaccgatcgagaaacctctctgatgtgaagtatatatcagaacaatacactgaattgcatgactcatgaaaacttagggtctctctcatccaaaggtataaaccaggacaaataccacaagctcaaactcgaatattttggtacggaaggagacaacgatacaggcctacaagagcctaaaaggtgtttctttgtggaattgatgagcataggttgggaattattaaaaaaaaaaaactgagcctcgataattagcatatgaatttgtaaattcgcttgtgtccccaattcactttctttgtttcgtttgcagagaagcaaaagcagagtttgattcggaaaaaaagcagtgttttgtgtaaccaccaatcagtaaaacctagtgtttgtgaagtccttgtttttttacccttttttaatcaccaaaaagaatataaaagtaaacccaaaaggcccaaacaatgtacaaaatcccaaaaaatggaaatatatcacaaaaacaaaaagcgaaaaggagtttccttttttttcgtgggcctctgcgttgaacaaaattggagtaggaaaaggaaacacaaatctgaggagtcctctctataaatactaaacaaatagaagcaaaggtaaaacacaaacacttccattcgtaatttagggttcccacaaattccttgtttctctcgctctcttacacacaggaaaca

SEQ ID NO: 2819 - DNA, 2000 bp, Arabidopsis thaliana
ctctgtagttaatcaataattcactgtgtaattgtcaaactgtaaatagaccatttcaatataactaagaaagaaaactttatattttcattagtttccatgtatctcaactcatttagagaaaataatatttacatatttcttactataaaataccaaaatatatctttatattttaatttaaatatatcattttaatgaattttatcttataaattttaacaaatttttcaattgctgtaaagaaagatgacctttaattaactactcactagatagtagaggcggtaaaaaaaccgtaaacgtatatttaatttgttttagtaaaatttaattataaactgtttactaaaatgcaaagtaatcaataatataaacttttcctattttatgttattgtgtcacaatgtttatagctttaaatacgatttattgtactattatatttttaatatatggtaacttaccatattctctcattatactttattgtaccgctatctattatcgtatactcttatttttaaatccgtaagaaaatttgatcgacttagtatcaatttttttataataaaaaagctaaaatcatgtaacttctaatgttcatcaccaataaggcacatagtcttgctaaatacactattttagatttataccatctacattatatgtttctactgcaattctacggcttcaacaaccccattttcatcacttcttattaaaaccacaataatttacgcacgatttgattaaaaagctttaaaaaaaaaagctatatgacattacatgacctatgtagtactaatctattcgacacaaccaataaataatgcattttaattgccccaatccccaactttcttcttcgtgacaagagtagcccacatgattttatgaaagaaaaaaaagtgtagtctaatacaaatttagttacatacgaaatcagtcgaatttaattattgatatataatcatagaaacaaagcttatattctttaacccaatcacaagcatatgacacaggggacctagacagtaatagagtatccaaatcttaaacaattcaccagtcaatattaataatacaataaaactatataataagatagtaataaataagaaataaaaataaataaataaatgaaaaacctagtttttgacgcaataataatagaagcgaaccaaacttggcctcctcttcgcctataaatacgatatagagattagcgtcaaaagagtatgtaaatcgcaaaaacaaccaaacaaggtcttcttcacacactctcatcgtcgtcacttttttttttatataacatagtctcgttctagaccgtcggattatttctattggtcaaatccaacggtcgtgatccaatttgattagaaagagtctcatcgtctctcaaccaccagattctctcgctcgctcgctccctcgtcgtcgtcctctctacgatatcgaccaacataccagatcttcttcgatcccgcctccgtcgccgttgctttcgttattttactcagccgccgtttccaactgtttttaactttttctcgccggagattgagattgggattgagatttctttagggcatttagacgatccgattaattttagagacgaggttttatcgacccccaccgacaccgttagtggtttgttctctcaatctcgatcctttgattgttataataacctaccctccattgatctatcgtctctgattcattggttttgtttgttaattcgtctgattgctatttaaattttacttcttttaaacaattttaggttgcagcgatttaaagatcgttttttttttcgtaattgaatgtgattcgtatttgtttcaatcaaatttgcattacactgtctattgattgtggtttgtgttgggtttaaattatgtctgcagaagctggtgtcgtgagaggggataagtcttttgatttgtgttattgtgggattatacactgtttatgactatacatacgag

SEQ ID NO: 2820 - DNA, 1464 bp, Arabidopsis thaliana
ttccctttaaaccggagctccgatcagattatttattccggcttgaggaaaccaaacaaaaaacaaagagcaaaagtgaacagatgatgatgatgattaacacagctcttatttggccttttttcgttttttaaagtttttactcctacttaaacaaacatcaaattaagctctttttttcttttcaattagtagctgtaattaacacacattttataatagtgaggaaataacagcttagggatacctcaaaaaaaggtttgaaccacctgtcacatgaaatctactgtcacatatccttgttgtggatattcactgattttttttaaaaaagttttgcctttggtaatgatacaactattcacttgaacaaatgttgatattggcagctgttagtttgcaaaaattaaatatgctaacatgcgcatataagaaatgaattatacgaaattttgattcgactctctgaaaacaaaaatattaggaaaatggtcatgtacctcttgcttaatttaacactagagattttattcaaaagaaaaaaaattaacactagagataatcagaacataatgggccagacatcaggcctttttacgaattacatatgggccacattggatactccgcaatcacataaatgacgtgagaggaagaggttggtggtggtagttttgtgagtcgtcactctttttatacttttaaaacccaaaaaaaaacgtacaagaagcagcgtgaaacattcaaattttgatggttctttgtttcttaattagtactagtattaattaaagtctgcatttatacgaaattgtctgattataggtcctaagagtaagagacaacacaaatcgtcaatttaatctaaaaaaagggccaaacatacgtataactgtttaaaaaaacttttttagttgtttaaaaacttataatcatgaaaagagaatccagcggtcagaatttgttcaggggttgagagtattactacagcttaaacacatctctgccatttattgcaacagcaatcatctcgcttgtaaaccgcatctgattgcgtcctctgaatttatttccccaaataaactctgtatgcttcataaatttgagcattgactttcccattttggatatgatcatattgttgttgtcggatgagaaattcgtacgtagcaataatttaatgttttcccacatgaacgattaataatttcggaatgattaaaaaagatactaatatatatatatatatatatatatatatatatatactttaacaacaacaaaaaaaaacagataatatatactactatatcgaacattacgttatcgaatgcatatcgatccgtgctctttataaagaaacctagagtgtctccgtctctctcactacattctccactgttcacattctctctctctctctggatctctagacaccaatacgcatagtgagcagagatcgtg

SEQ ID NO: 2821 - DNA, 2000 bp, Arabidopsis thaliana
atatgctacaaagtggactattcccgatccaggtagagttagaccaccacactaccagattcgagtttgaaatgtctttcgactaatgttatagaataatcaggtcgtctccatttcttactaccatataaactaattaaagcacgacccaaccgataaattttccaaataaatataattttattctaagaaagaatcgaatttagatatgggagtttcacccttcgccagagttttctctaaacaaaacgttgtacttcttctaacacagactaatcacgcatgtttttacaatattataaaaaaatgaattaatttgggaaaagccctctacagctaaacttacaagtcagtcacccatgaagtgggaaagttttacaacataaattagatttagttctgtatacgtacgtgtcaaataggtgttcgtctttataatttttccgtatagacaacatgcaaagatatattactataactctataagatagcttatttgttaattagccacacgtgtataaacgtacgactacgaacaaaaatgtttacttactttttgcggtattgtccacggcaatgcctaaactaagacaacttcataacctttgacgatgttagatttcgaacactaattgtatattgtttttatcgaaaaatctttactataataagtttttgtatcagtagcaactagcaagtgtcttttgtatgttattgtgtgttcagctaattttaggatcaactgttttaataataaaatattcctttccaaagcattaggatttacaaaatttaccattcaatcaatggtttacactaagtctgaatcacatgctaaatatatatgcataccttcctatatttgtttcatcaaaacatattctaattgaatttaaactttcattttggtgttaaagttctactggtcgtacgcgtgtacattcgcaggtatgtaccctatcatttcacattagttcaaaagtcattttcagttttcaccaaccaattaatcaaggttttccaacactcctcagttttcgtaaaatgatattaattaaacaactataattaaaatccataacaatgatttattttagacaaaaacattaactttttttcttcaccaaaatgatttgatcataagaaatcgtatatatatcgagaaagaaacatttctatcgacattaacaattctgtgaagtatatatatatacgatttctagtttatcctccaaaatgttttaatcatctcaccatcacaagttagtttatgcacgcatgtgatgtataaatattttatacgtgaaaatgaaccatgcatatatattattgttaggtatactgtatacatagaatattgatcatcataagaaaggtacaaatttaatttcttggaaattgttgaaatttccccatcacacataccatattaattaccatgtatttattttttaaaactatacgtattctggataattacttttatatatgtattcaggttgttaattcaagtaaatcaaataacatgtgatgcgtataccttagacgtcgtatatttctgtatagttactttataccaaaagcctatataatttatgaacctaaagcctaaagaatgtttgcaataatctggctaatactcaccatacttaaatatttagatcgtatttcgttcttctgtactctatacacattttgttggaaggaagaatttttattattactaagatcgaaccaaatatttatattttagcatctgatatataatataatcatgaaaatatttgatctaatcatattataaaatattcaattaactgcaatctatgcaattataatgattacttcccacgaacaataatgattgaattaaagaagatgattttaacaataaattcctaacaaaacatatagcgtcattaactatttggtttcactactcacctaagtgggtcaaatgagatactaattttctaactaaaataaaaaatatgtggtga

SEQ ID NO: 2822 - DNA, 2000 bp, Arabidopsis thaliana
ttaggggtatttctgtctattgattatattttctcggtaatattacgcttgatttgaatccttcgactataatagagattttcttaatttcactttcacgttcaaagattttttcgcattgtcttttggaaaaatagcagagttttttaaaaaataaataagaaacgatacattcaaaaaatattatgtgaagttgagtttttttttacatatagaggaaataaaattgatcatagtcatagacatagaaatttgtcagtggaatcttttctattaggtcaaacaagattcaacttttaacattttatctaggacttctgaattctgatatacaatgatcgatgatattataaataagataaaaaggctttatttgtattatttccttgtaaagtaaagtatttcttaatttcatgtttgttgggtcatgcaaaatatgtttccaaggcaaggtagcggattttttgtgaagaatattagctgggtcccacgtgacacaaaagctatgcggaaaagggtgtttccgtaaactcacttgaaaatttctgctaaccagttttgtccggttaagttcatgttatgtatgttacaatttgggaattgggattcagttaaaccggatcagccgaagacattattatattcgttttgtaactttttgtttagagggtgtcgagttaggttatcgagctgagctgtatataaaaacatctcaaacaaaggtgaggaggggatgcatttgcaaaatggaattaaggggtgtttcgtaatcgtgacagttacgtttttggtttctctcctatgaggcttattttgggcctcaacaagaagtaggcgttttaacacgtttcgtcatctagagccagatgagagggcctaaaccctacctgtggctggttatttattgctttaacttacccgacagatgcgactcaatttgaaatatctcttttgggcctactgatcttattgacgagaggattcatcacccttttcttcggccacttggaaagattatatagattgtatgttttctcttttcattttctatcctcgtgaagtttttatttttatttttttattcagattacgaaaatcttgagaaaaagaataagacccggtgagcgaaaggaatgtgtggcgatggcgatgcctacacagccgtgaagccgagtcatcgattataaaatgagatgtgtcgatgataacattgctagtataattcttggtgtggtccattatttgataaatttatggtatgcgtccctcatgggaagtgtgataagattaaacctagtgttcgatataaaatttcaaattttgtgtcttagccattctattgaattttaaactacggtcagattgaagcttacatatatttgatgtaaaacataaaaatatgtggctgttactcgtacacatttatggttatataaatgaatagtctcaatcacagccgtgctctgtagttgtcaggtattcgtgtggtttgaagtataacattgtcaactatttgtataaagtttctctatactattagttccatgatctagttatatatacaagtcatatcagtttacactaaaccactcgacactcattgataatcgcataccgttactacaaaactaaattcaccttcattgcttattaaaatcaaatcatcacaatagctgatagatcgtggccttagcatttcctcggtaagacttatgaaaaaattaagataactattctttgaaaaaggtaaaggaaaagaagttgggaaaactttggcctttgtgtaccaaaagtagaaaaataatttccagcttgtcattttcctacggtcccaattaattatatctctctctataaatatagtaacacacttagccatcgtacacttactagttacttccaacatttggcttcctttgctttcacgaatagaaaccttagcttcttccatttcttctttctctcctcgtttaaattagtttttgacaaggaagaaaaag

SEQ ID NO: 2823 - DNA, 2000 bp, Arabidopsis thaliana
ataccatatcaaatctgagaaagaaacaaaaagatagagatgaaagtgattttcacattaagctgtggattatgtttacaacgaaatacatataaatattatatttattaggctagcaaaaccttaactaaacccaaacatgatgcaattgataatttgtctttctgacccaataaactgggtacataaattttatatgtcagtatgcttcatgttacagtactttaattatttaacactagtaacgcaaaaaagattttttaataaatgatcatttaatcattatcattcttcattaaacattatttattgttttctaataaaatataatgatggtttaattgttagtgtaaatttatatggtaaaactaaaacctgtaggtaagcctcttttcagtcttttgttgaccagaaactttgaacaatagagttctattttaacaaatactaacaaaatacagaagaagggtaaagttttaggttgaaacttaaaagggtgcgatacgtgtgaacgcgttggtcaacaaatactatcacgagctgttctctttcccgcggacagatattgattttttcgtgttctatttttggattttgtggctggtgtaataataatattaaagcatatatactagtataaaactggtaatttttcgtagaggattgttttctcaaagcccaaacagtagttgcaaatttgtaataaccagattttgaagtaaaataaaatggtgaggaaattttagaataatttatttatcaaaaaaaaactttagaatatgttacatatttggtagttatagtattgtatcaaatacacatattaatcgaattgtttgataaaatggaagtaaattatttttgactgaactatgtagcacatatttattttatatgaatctcaaaatcatttatataatttatgaaaaagttagttttttttctattcgatacgttaacaattaattatgaccaataaattgttttaaggcattcagcagtctaaaaataaagactgaaaatggcgtcataataaacgtaaatgcagtaaatattattccctctatttttgaatatttgtagtttaaaatttttgcacacaaattaagaaaacatacaaatctcatttaatttatctctttcttataaaaatattattaattacaattaatccaaccaataaaaaaatatgatataaaatataattggttaaaaactattaaacacatttaattttgcatagaaaagtgaaaacaacacttatagtaaaaaaaataaaaaatctttaaattacacttaattagaaatagaaagaatacaaaacgtacggatgttgttaacctaaacacgattactaccgagactaaagatgtctaagtttaatactaagaaaagtaaaacaatttttcgagcagatatatgaatagtgattttttgggtcaacacataatccacccaacgttgatttttgtttgtcgtttacaatctctaaaacgtttattttctaagaaatatacgtgtgggctcattttaatgcccttcgtgcgtctacccgacgactttgtttactcgaaactatatcacacactacaccacatatttcaacatcacactgtatacacacatttatatatacatgcagaccgattattataataatattttctccggtccctaaaacatatatatcattcattcccacatgagatataatattatgtaaaacatacttttgactatgttgccaataatcaaaaagacatctctctctctctctctcacatcctattttccaagaagctcaccaatgcttttgaattctcccacatgtcttttgacaattttagtataaatactcaaaccccttagtcagtcattctcatgttcatcaacagcatttgatctcaagctcataggaatttgatctccacattatatcttgatcatcaccacaagaaaaacatttcaacttcttttatcagcaatcacaaatcaaagag

SEQ ID NO: 2824 - DNA, 2000 bp, Arabidopsis thaliana
ataaataatgtttatgctgtgcttgacaaaaaaaatgattatgtgtacgtacgtatgctaagagatgatcaaaattataactagagacattattagagcaaagtaccagataagacttttaaagatatttggaatattatatgaaatatgaaagtatcagtttaataaatactaaatgtagaaaaattacaatcgtgacagttagcttaactcaaactttatactaaaaactatctatactattaattgggaatcatcggaaaatttacaaccttttgaaacccgcacgtatgtgcgggtcaggatctagtgattctttaaatttggaaactcgaatatctcaaacgatattaattattcaggatattgatattacatggatggatcatggaaataaagcgacaaattgtttggagcagaatggtactatacatcatcaaatggagagacgtcaaccatgagaactgcaaatctttaagaagtctatcctcactacatgcagaagtggaagcgcttctctgatgatgaggtgtatgattggcgctaacaatcaagacgtagcttttctaatagactattcagatcaggtgaagatggtgtctttcctaaccgaatgaccagccttctcagtgtatttggaggatttgaaaaacgacaatgaagaatttaaaagttttcttttatctttaaattttagtacaaatgttaaagcggataatttggcacgaaaagttctataccaaatcacatcatatcacatatgcaaacaacattcttcgggaatggatctttaatttgagttctaactaatatcggttgacaaaagaaaaaagtttagaaataatattatctcatttaaactagatacataaatgaaacaacaacacacccatacacacaaaaagcgactctattttgttaaatagatgaagagcctcctctagaagatgaagtgatatctctagaaccagcactttcaacctagccacatagtgatggattgattaaggacaacacctcagaaaaagacttgtctatgccatgtatactttcgctaagaagtaagaagggagtgatttggcgccaggtaattgcaatgtttgaagcggtctttttgggggtctagctacttcatccttccaactgtagctatcttgagtctcagggaagatcataaccattgtgagcttgtagaaaaaggcttctacattgtcactgtgggcactcgtgaactgccagccaattttagaggtctatatagaatcttttttatcaagaaaatgtgtataacatataagagcaccctcaatagtgtatcttagcaaaatcttaggattaaaagcaattaaaataaagcaaaccaacaatccaaagctaagaagtgtatttttctttagatgtttttcttaagttaagatgtttttcttaagttaagatgtttatatgtgttatttgatgattggtttaaaaaatgaacaaaaatagaagatattgttttagaaaaaatgaacaaaatagaagatattgttttaaaaatatcaatgaaagtcacagctggcaggaaatctacggtatcgttatctggtggacttttcggcattcaaggaacaatacatcatatcaacaaacaataattatggtttgtttaaggtttaaattaaaattgatgtatgcatttgtctactctaatccttatcattgattcattatatgcttctttttttgttggtaaaaccattatatgcattttgtcaaacctatccttatcttaataacaaacaaaatacattgtatgataagaacttggacaacgtgaaatatgactcattctaaatatattagcagtagatatcaaataagtataaaacccggctcatctattttacgtctaaaccgttacacactctatatataaacgaaggaagatcacacgtgaaaatagtcatcaaccaaagtaagaagcgcacacacacaacatatttctttcactacccaaagag

SEQ ID NO: 2825 - DNA, 1665 bp, Arabidopsis thaliana
ttaaattagttgatccgttttctttttttaaaactgttttttagtggttattatattatgtttgatgtgattaataaagagccaatggaatcattatttggcatttgttatcaactgatttgaataaattatgtaacgagtgaattttatttgataaatctttaaactttagcgcaggattaaaattatatctatatgatcatctataatataatgtccaaatcatttcacattagtcatccggtttataaaatatcggaaaagacattgaattgtttatcccaacttttgtttatgtttcgagtgtattttttttgtcacaaaaatgtttatttaagccaaaacagagtcagtgtaagagtggaagaagccacacaaacaaaagggtaacttaagaactaaagaagacaagattatcaaaaaggagcgtgacaatcactaaaacagaatccagaaaaaactttatctgttttagaatccttattcaactaatcaaacttaagtaaacctgtaataggaacaattaattatctctttttaggaagcttcagattcagaattcctcctctctcttcagcttgtagcttgtgcatttggttcctattattcaagtgtgaactaggacgtctagacgattcaccaacctcaaaatatcttggcattcttgaagtgatatcttcttcatttaagggaaatattagaccatgtggaagaaaggctgtcttctccatgaagcaatatagtattattcaatcgagactgacaaattctgaaatagtgataatggaagcaatcgagaaagacagaagaatagtcaagaaaggcactcccacgcccacatggcatttcttttatcctcctctcttcatatttttgtagagtattaatgatcaattaataagagcaactccgatggtttagaatcaattggtttttaattttcatttttaaccttattttatattaaaatgttgtttttacaaagttaaaaaaaattagaaaaaacttaatttatttctactccaatgattaagaactattgggttcttaaaaaataacttggatacccactcaatacacaacacatgtcctcttcttaatattaagaaaacatcttaattaagatataaatcttagctaagatttgttgtttgtattatatttaatcagtttaatagataagaattagttaagaattatctaagaaccaaggttggagttgctctaagttacagtgttacacactattattcttaatcaatccaaaatctaaatttccataaacatgtattttatttcaaatacctacaaatattgaactaaaactaaaactaaatttatttcatttaacaaagacgaatgcaaaaaaacttagtgcacagtaatcatagtaattaaacaaagacagatgccaacaaaagaaaaactaaaacacagtaaacaaagaccggtgccaaaaaaagaagaaaatgctatcttttaaagaggaaacaactagatttgatttgtttcactttcacataaaaaatgaaagtcaaaaacgtcctacaccattatccaattattcaaattagccgagacacaaaatcttctctataaataataacactcacacacacaccaatcctcttcataaaactcatcattcctcattcatctctaaca

SEQ ID NO: 2826 - DNA, 2000 bp, Arabidopsis thaliana
agctcactattagcattaaatgttaatacacatttcgtttctaaattctaacctttacgtgttgggtgggataaacaaacccgagactccacatttttctactagcattgacaatctgtccttatcacaagcttaaaggagaaaaatttgaacacatttttttagaaaaagaaaaaaacaattattgttgtcattaataaagtcggttaaattatttaacacaaataataaataataaaaataaaggataaaaaaaactatttcgacatataacatgtttcatacgaaaatatataaatgatatgttgtccaaacatatagtactttataggactatcacttttgtaaggattttggagataacgactactaagaacatttttaatggaagattgtattgaaaattttgtgaggttatattggatgaaaaattgacagaacccgttttgtgaagaaatttttgagaaaatggaaaaggtggacatgtgttcacatgcatttgattggatgtttagttttaataaaagaaaaaaaaaaaagcgtatattgttatctttacaaaagaaactcggattttctttctctctatttctcgcacgaagataaaaaccggtgaacttttgatttcctatgagttaacaccgttttatgtgtatatttgtggtatttgaggcttccaaacgctcaatttattaatttgacagacggtgttgattatcgctggaggaagataaacccattcagagaataacgaatctgatttggagagttttcgttgaaggaatgtctaaattaggtatgaatcaagccattctagcatgtatatgataactaaatattgtattttctagttaatatatgtaattttaattttatttaatattcttaagataaatttatcatgttcaacatgtgctactgtatttatctaatcattttaaatttgactaatatttaaaaatgcaatagttttgcttaaacttaaatcaaagtattattcctattttcgaaagtttgtgttgttatttatagtataattacatttatttaatttttataaaaaatatattttgcataatacacggtatagtgatccggtatatgacctgacgggttttaatataatacaagacgggttttattgcggaacgggttacataacatagcgggttaaaatcgatattaataaaaaattaaaatatttttgacaaaaaataataataattaaaatacatcattagccaacgctttgaaaaagttaaaatcttcattttattaatttgtcaaaaccaccaatattattttatgttgaattaaactaatttcattaattaaaatatatgaaacagttttttcgaattttaatgcggattaaaacctaattttttttttgttatttatagtattatatttatttaattttcataagaaatatattttgcatccactgaaaatatttcagtattttaggtcctgtaaatttgcaccactttttaaagccgtccgtaagtgtagccctttgatgatctatttattgatcagtatcactttacataggtttaaaatatgtcgactaaaaaaagggtcgtatccataacaagtaccaagagtggacgacttttcttttctgtccaaaaaaacaacaacaatgataatccaataatgaagtttttgcatatcaatattgtttaataaatttatcgaaatatccaaaagactagtgggtttgccatttatggagtttcaaattatttacaatgcgtccaacatccaaccagaataaggggaccgacgcaattaaactcatatatacttagacttttctactttgttttaattgtgataagttccttttctctttattggattacggataagttatttgacttttctcattccctcctcctcgttttctttaaatagaggccatgcatggtaacattttatgcatcacttgtttctccataataagagagttttaagcatttgaaacaaaaaaa

SEQ ID NO: 2827 - DNA, 2000 bp, Arabidopsis thaliana
ctgatcccacatgacaaaaaatggctgagagaagtttctatttaattccatagagtttgtggtgaaacattcactgtcttgatgtgaaaggggttcgttcctcaggagcccaccaagagaaggagaagagtcttgtgtggtcgtttgctgcatctccattacttcatgttaccaaaagaatacaaaaaaaccccaaacataggttcaggaacagatgatgattatagaaataacaatcttatattatctgacaacaaagtggtaacagtacatcaaaactaggattcttgactgtctctagctatgtgtcagttcctaatatcttccacagagagaaggaaataatgatcatatgccaacataaagaaaatcaaatctttttaaagcacccctaagtgtatcataacatgagaaaaataaacctttaaaggaaagatcactcgattttcacaaagataacaatcacagtgctctgcctctgattaccaagtaacgtttaatgttcaattgccccgagtgaaaccattaccagttatttcaagaagatcataaactctacactcttttttgaagaacccattgtttagatgtcgtaagtagtccagtttcgtctgaaatctctgtctctctaaagtatccaattcaatgaaatcaacaggaatgtggcaatgtgcccataaatcaacattcaaaacatcgaaaacaaagtctcttctttggaaaaaaaaaaaaaaaaaaaaagcctcttctttgtgtctctttcctaaacacaaaacgaacaagcgccacataaacataacaaaagcaaatcaattcatcatctaaaaccgctccaagagaatcactaaattgtgatcaatgacgacggtccacggcgagatcaaggagacggcgccgtgtaaaaatttcacctttgaatttgattgaggagggacatattccacacgtggcacctaaagagtggttaatgataagtatcgacgcaaagtaagtatttaacaatgattaaataaaaatatgaaacaaagaacaatattgggctttcaaattggcgggttgagccaggcccatgcagtagtgcaacgcatgggcgactcgtgaaagcccagatagcaagctatcttaacgggctttctcccttaaaaaatagagttaatatcgtgtgggccgatggcccacatatcagatattaaactgataagaacagatactacacttgatcttagccaaaaggccgagaaaggtatgaatggtttagtccatcaagcttcttttatatacaccaactccaagagtgagcgattaattatttagcgatgtgggacaataccaaaacattttcttagccttcggacaaaagaacaatttggacattattgaattaggttcggttatcttaaccaaatgttttaatcttgatcagcataatccgaattgatccggtctgaaccaattcaatagatctgactaaaaagaataaactgcatacctttctagtttggttaagatgcgaatttcacatcaagagaaagctttaaaaccgtcatcacaaaagggagaaagttactagatgaagctagtaggtggaagtttgagtcatttggccgttactactacgacttgtttaatttttttctctgattcattgaatgctttattaaaaactttatctcataaccagtgtaaaaacaaatattcaaacgttaatcaatccaatttagctttgaaaaatccaccaagaagaagactagtcaatattggttgcgacggtcttgtagaggcgttattatctgttagataatattactataaacagtgagggataaagcagaaatgcttctgtataaatactatcactacttttgatcaaaacaaaaaataccatcactattttacttgtgtgttatttcatcaccttcaccttcaacatcaaacatcacatctctttctcttttatctctttttctcggtcttcaaagagtttcttagttaccaaatca

SEQ ID NO: 2828 - DNA, 2000 bp, Arabidopsis thaliana
gagaatttctgaaatccgacgttttaaacatctgaatcttacatcaatttaatatgcttttgtcttttgatatacaattacttttttttttatataattacttgatttagtttcatttctagattttaactttacgtgtgaacaaaaaagatttgtgagattcgacccttaaatactaatgacgatctcttatttgagagagtggtcttaaggtactttgatcacaaccaccttgtgttaactgtagccaagcaattttccaagttcttaaaaatttaattagtccttagtagctactttgtatagctcctctatgatctactttcagtgcatatagttttgtctttatccagctgtttaaaatctatcgcttgcgatttttgacaaaatctttaaaagataataaacagacgatttttttttgtcaactgaattatattagagaaacttgttgaggaagtatggtgaaatacaaactctcaaacgagggaaaaaccgacggatgacgaaaatgtccgcagaaacaaagccaacgaaaaaagaaatttcttcgaaaactaaagtcctaaagaaatgaactaaaaatataactagaaatacaaagcaagaaatatcaaaccaaaatcgaaagaggacaatcattcaagagaaacaaatagtcttgaaacctaagaaacatcttctaaaaaaaaaaaaaaaaaaaaaaaaaaaaaaatgaaacatcttctcctgaatctcctgcaaaagagatttatcaatggtgcacttagccaacccaaagataccatctactatctcccattatgaagacaattgacctctctaaacctagaaaaggatagactacgtccaaataataaagaagagaaaattactacaattaaagaatatataattacttgatcatccaataatagatcgctatacgtgtgtgatgacgtagataagaaaagatctaaaacacttgtggggtttgtgctatttatggtgtttcaaacttattcacagtaaatccaacgaccacccatacgggacccgacaccgtatacatactttgatacttatctccttaccactttgtttttttctatattgtgatacattacttcccttttaacattttcttttattactaaaattctttcgactgtggattagtttatttgacttttctcattccctcgtcctcattttcattataaatagagagcatgcatggggacatattattcatcacaagttttaagcagtatttgtaagaaaatggcttccaagactttgcttcttttgggtctctttgcatttcttttcatcgtctcagaaatggctgccgcgggtacgtgttatatatatttcagtctacttcatacatccaaggctaattaaacctaaactaacgtaccgatattagatattttcaaactatttcgtcaatagtagttacaaaatatattcacttatacagaagtggaaatatacatatatatctcaaactaaaacaaatacaaatagaaacttgtatatatgtttagcagtgaaagtaattacgtttctttttctaataatatggatgatatattcccataaataattctcaatctcgtaatcttggtcttagcgatcttaattcattttcggttgatctctcaacagttttaaatctagaaagttggtttgaaccatggtcaattattaggacttgctaagtcaaaagactcgtaagaaaagacacttaagtcaaaacatgaatccgtgttactcgtatatatcaaacaatctccattatttatggtttgcacaaattttatatgtatcttatatctaacgttttaacttatttaaaaagaatttacagatctgaaatttaatagaaatttatttttaaatagatattaagtagtgcacaattgcaagagctaaagtatatctttgatatactgtggtgttttggacaggcacggtgaagtcagagagtgaggaaactgtgaaacctgaacaac

SEQ ID NO: 2829 - DNA, 1271 bp, Arabidopsis thaliana
aaaactttattataggatcgtcaacaaacacaaagggtagcttcgcttgtctaataactgatcaagtttcggttctttaacgtgtttcaaaaaacaaaaaaaaaaacacttgtaatgcaagttttttttttttcgtgtagagtttaatgctaaataattctcaagtttgaaatgatatcataccaaataaataggaacagttttaggacctgtttcgtacttcaattttctcatttcatatccattcatatagtttttttttttttatagttaaagagatacgaacctaatcaccatcttcaactctattcgtagttgtagattaaggagctcttccaagagattcattctataacttcttttacatcttggagtactatgtaacaaccctttttacacttccaaagagtccacactacttctatttttaatttattttttcgtcaaacactaaggttttccgttagagatttagagtcatttataaaccacggaaaagcagaatactatgtcaacaataatttaagattttttctcaaatatttacatggaaaagcagaatactatgtcaacaataattaagtttttttctctagcttctatatctgaacctccaaggcatgttacactcctcctaattatgtagaattggttgctgctagttcaaccatatatcttccacaattaattataaatgccgctcctctgattttctcaccaattaaagaagaatcactaaattaacatgttctagtctcaaaaaaaaaaaacatgtaatagtctcaaggatgttctaaatgaaaaggctcaataaaaccaaataatgaatcatcacaaaagctatgtcaacgaagacaaaatgcaagtgtggatatttttcagaaactgcgtaaaacaccgtgaaaatcatcttcttcttttttttttttttggtcaaactctctacagagtttatcaagtgatttttaccggtacctgtttttccttgtttggttcaactcaattattcgccttaaacccactttaagaaaagcccactgaaaagcctactttaaaattcaaccaaaaggcccataagtactacagccgacatcagcagacaacaagccacgtcgatctcgaggaaccgcgtaattaacgtgtcggaatcacacgagccaccgtgtactagatagctccataaaagcagacacatctcatgaagcagaacctaaaacctttaatagcaaacgaaaaataaaaaagaagaaactaacaaaacaaaaaaaaaa

SEQ ID NO: 2830 - DNA, 2000 bp, Arabidopsis thaliana
tattagctaaaatatttaaattataattcagagtcatatcattagtaaaattaatattaataaaataaatggctttttgcaagacagatttggagtgacgggtttttgaatcaacattaataaaaaagtaaaatataattaatccatcgtttcaatacgggttaaatctttaatttattattttttaagaccactaatattaaacatatcaaatcatcctaatttagaaaagattatataaaaccaaaaatgttatgtggtatgtataatgttactatatataaaattaaattataaaatataaatgtattagagaatgatataatttgtaaaacttttatatataaaaaataattcttaaattttaaaaattactactttaaaaaaaattcacaggacgggtaaataaattatagaacaggttttattttggaattgggttatatggtggatgtatttgtatcaatatttataaaattgtaaaatattattaatatgttgttttaatagggattacaacttcagttttttaacaattgtctcatggattcgtggtatagcgttacttaataacaattataaactgtaaaatataaatattttataaaaataaaatttgcaaattttaatatatattacttttaaaaaaagaaatcgtcccacggtataccgcgggttaaaatctagtatatatatatacatacatatacatatttagatatttttgttattattgaaattacactgcaccgtacatttctacgcgaaacatgagtaaaaatgtcatgtttttcttcgttctctaattcttttgtcatttataaaaaattttagactgataaatcttatatttttgagtatttataataaatgactatagatttgaaaagaatgtacaaactaaccttgagtcacagtatcttgtcggaaacatgttggaaaatacgtgtaattacgtaaatgtcctttgtaacatgttatttttccgaaatacatgcgataacataatatcctctttttatcttgttattttctcttattacatagtatttataaaaagcacatggtattttttagaaaaaacattctattcagtttaatatctctttttatcatgatattgtagtaatacacgttttttattaagatcacacgtgatttctttaaaaatatattcttatttttttagtaatacatggtttttattaaaatcacatatatatatttttcttaagattctgttcatgtaaaagaatttcataataactttttttcttaaaaattcataacgttttttgaaatagcatgtttttaaactaaatataacatgtgaaattttaatgttacatgctattttgaaaaattatacggatgtatttcgtttactgttcatcttacaacaaatgaaagatacctttgttatttcctttcttccgacaacgtggtccatagttattttgtaacaaaaaactttctctctactagtttcttaatttatatgttttatttggttatttactaatattaccctatatttttcttcttcatccctaaaaaaatgttcaattttgggattgttttttcttctttcgccttaagtcaacgaaactaaaacttaatttcaatcttggtgtgtttgatttttatctgtttgatcttatcactttcaaaagagaaaacaaaagtttaagaaaatgaaaaacagtagtgggagctatcttcattcttctggcccaaagtgtaccaatctaagatattttacaatcttatctaaactatacacaaattatttaaatcaacggcgctcatactatgtgccatcattgatatcatcactcgaataattcactttataactatctccgtcactatcaaaaagtgttcaaaattaaaaaagaatatctcaatccttatccacttcatcattcctagcttccaagttattattatataactcaatttttctggcttaagagttttgaaaaatatcttcactagag

SEQ ID NO: 2831 - DNA, 2000 bp, Arabidopsis thaliana
gtaaaatactagaattgaacactataaaaaattaataaaaattgaagaaaacaattagtacagccatattttacatatgatatttataatatatattagtaaatttataaaattattaatttatactattgatgggagcatatatttatataagattttcaataaaaatattatcttattagtttatcgatttatatcaatttttatattggtctcaactctgcaccaaaaaaaattattaatttataaaaattattaatttatcgaatattaatttataaagattttactgtatagtattattataaaagcgaaagaaacatatatcatcccaaaaattctggttgtcgttacccggtccttcttcttggcatcctctaggtacttcctctcgtgacctccataaaaaaccatgaggatagatgttaagttttaaattttctctatattgccaatctaacatcaagggacctaacttttatatatgtagttataaaaccccattactaactcaaatcacaaaataacccaaagcgatgaaattggataaacatgggcttttgtaatgatataggccgtaattttttgtatattaaatcataatgggtctttttcatgagcctcttctgtagatgggcttcatttatcagatatttattttaacgcctgtaactatctcataattgcaaaattcgaccacgatttcgagaacaaccccggccacttgtttcttccatctgagacgcttatcttgaaaacgtttagaaattaaccaaacggatgttgattgtttgactgttaaataagagacaaaaaacaaaatataatagtctatgtgactacgatataagctaataacgtgtttatgtttttcacctttatatccatttattaatgcgaccccaaaatcagtgctccgtgtaaatgtatttgtcagtttattcacatgatattaccccttctacaccaatcaataaaatatactaccgctttatctttaagtatcttaaataatgttaattctgttcatttcatatgaataataatgaccaaaaaatatagttatcctaatggtttctactagtatttcaacattatagtctaaataataagggatgaaacatataaacaaaaattcggataaacaaatccatgtctattccgatatatttttataatctggattagtaattcgaaaaatgatgataaaagaatataatagtatgtatttttttaagttttttatatatgctgtcatgaccccttatcttattcaaggagagtggtatgggtaacacaggattcaaaaaccgtggatttttcgatattgataaagagatgatatcaatacattaaagattttctttagtattaaaaaagattaaagatgatcgttaaaagaaggaatcaacggacgtgtcggggtaaaaaatatattcaatcgagactgacaaattcttaattaaatgaaagcaatccagaaaacaaacaaaaaagaagaaaagtcaagaaaggcacccccacgcccacctgggtattctatgacccactctttaatgacctctttatttattttaattaatcacgtacgaacgattcattcatcaattgagttacttaacagtaacacactatcattcttaatcaacccttacatataaaagttacataagttgattaagattacctgatatatttcatacggaaatctaaatttataaacacaaacgaacatgttatttatatagtaagacaataactttatctctaacccaaaagaatgaaagaaactagatctgctttgtgtcattttcacataaatgagaagcaaaatcacgaaaccataagagtgtcgtatgaattttgaaagtcaaaataacgtcacacaccattatccaattattcaaaattagccgacaaaaaaactaaacaaatctcaaaaccttgtctataaatacactcaatcctcttcttcaaactcaacatcgtcatctctaaca

SEQ ID NO: 2832 - DNA, 532 bp, Arabidopsis thaliana
gaaatcgatctatatgagccattttcactctccatttctctcttatcaatgttatgtacaataatgaaacatgtctttgtatgttggatttgatttgtgttgaaacatgtctttgtattttcactctccatactctggtttggtctgtttgtttcaagcttgtgttataacactattgagatacttggtgttaatttgtgtctttttactctattccattatttacgtcggcaagttagagctcacgtcggcaagtgtcgttgtaaagagatcacgagacttgtgggttggatttttggcatggctctagcctaggaggacaatgtcgtcatttaactggctcattgctcaatacatatctcgtcgtgggtccttgttaatctcttctccaccgttgaaccatagtttaaaatatccaccgttaaaagcccctttatatcccaagaaataggtgaacttgttacagaacaagcaaagatcaaagagaaaaatatcccaaaaccaaaaacagaggaagaaagaagaagaaaag

SEQ ID NO: 2833 - DNA, 1237 bp, Arabidopsis thaliana
ataggtcgtctttgtaatctattttgaaatattgatcgtggacccaattttcggggcgatctcaaaactcttatttaaccgtgaacccactttcggggcggtttttaatttttacttctacgtcagggtcgacctcgcgtcgtatgagcgtccgttctcggggaggaaaaggatgtggacggagtttcctggtagattttttttaaatagatagggtaaagatatgtcgatcccgattagattctcatagctttttcttttgttgcagatcgatacaggcctagtccggattttcccgtcgagttcgaaggagttttagaggcgatcttccgagctcgtcgtcgtacctggaaagacgtcacgaggtcgcgcgtcaacaggataatggggaaggtcaggaaatccttcattagcttttaaacatgccacctcccccagctcccatcgaagaggaaagacagcctttagacggagaggcggctgcgtcaaatcctcccgttagtgctggcccttccggtggcgaactggtttgaagtttggatccttattgagcttatgacaggttacctccggggcgattcctgtcatatccttcgtagaccaagcaaaagatgacgacctcgatttcaggaaggcgatcagctcttcctttatctctccttctagctcgcttccgataccgaccgtccgagatggatccgactcgtcgatgttgacctggataattgttataggaaaactgaagtcaagctatagcgttcaggggttaatctggcgagctggaaatatgaagtcagggatgtttagcaaagcacgtgttgtgagctggcgagctggatatgtgaagtcagggatgttaagcaaagcacgtgttgtgagctggcgagctggcaatgcaaatggacgttaacggcgatcgttattaacgtggttaacgtttactttctttacctttttgtataagagcaacatgttatgctcatgctttcattatcgaataatctggttgtaatctctctctagagacttctagatttccctcatcgttttaccggagctctcgtcgagtctcttgtaggtgagaagttgatatcgcgtctctttacgaacgttgtatcaagtgtgttaatcggagtactctattttcatctctctgttctattgatttcaaactctgtttattcatttctggtttacgttaacactggtatcagagccaagcgtttcctcggaatca

SEQ ID NO: 2834 - DNA, 1074 bp, Arabidopsis thaliana
atatatcatcaatgtctccgagttccttgtcaaataaatcagatcttgctatgaaaataatatttttataaattttcataaatgatgacatgaaacaaatcgcatattaactaatatgaaaatacagtattaattttactcacagaatagatctgaagtgtcaaggatatcatatccttgacacaaagtacctatttcaattgttgtgtgcacttacttttacaaatggccaaccattaaatttttaaatgtttacacaatcgtcttttttttaaatgactctatttattggataaatttattttctaatagtatggtattatactatctattttattgattaatcaatgatgaggaatttatattcctaaagctaactaagcatgaattccatgcaccgaatttcctaaaagagaaaattgacatgaaaaaagtgattctcttttactaatatacatttctcaaatgttttcattttcgctataaattttacatataagtatttacatgcaaaagtttctacgtaaaaagcttagaggaattactcatccttccttacaatgatttgttagagttattagataaaaatacacatgacgctcccaaaaatcgattaatggaagttgtgttgtgatatgtgaatagtactatacgagaagttatttaatttgcagattctacaagcagggcttcaagacaacgtacatgctttcgaataacgatattggtcttctgaacgggcttacttttgtcgttggtatatgtggtcgataatagcagcctataacaatcttgaaacatattttttttttgtggacacatcactgaatcgattcccataaggccacaactgactaaaagaaattgtagttgttatcagctagttggtctgattccttcccttccgtaagggaccatatatattccaacattccgaaactctgttgttttagaataatgactcttgccacagattgcttattctttcctctataaaagtggctatgaatttccaaagagactctcactcactctcattaaaacctagagaagcaaaacatccgtataagaaaa

SEQ ID NO: 2835 - DNA, 2000 bp, Arabidopsis thaliana
aaatcataaaaaataatctaagagttaaatttacttgcgtgaaaagcgcttgaactaataacacctcttacggacccgtatgattggacgggatgcttagtccggatgttttcaatgcattgaaattcaacacttagatttttttttgaaaacgaaaataatttatataagaaaaactctagttaaaaaataagtttacataataaaaatatttgtaacaaaaaccataaaaaataatctaaaagttaaatttacttgcgtgaaaagtggttgaactataacacctcttacggacctgtaggatgggacgggatgcttagtccggtttattttcaatgcattgaaattcaacacttaggatttttgaaaaccaaaatattttatataagaaaaactctagttaaaaaaataagtttacataataaaattatttataacaaaaaccataaaaaataatctaagagttaaatctacttgcgtgaaaagcggttgaactaataacacctcttacgaacccgtaggatgggacgggatgctcaatccggttgttttcaatgcattgaaatttaacacttttaaaaccaaaatatatctataataaaacgtttaattaaaataaaaaaaacttttgctatcgtaaaaagagaaaaataaaaattttgaggtaaaactaaataaaaaatcaagaggctgaatccctaaattccaaattgatgaacaaaaataacattcacctaaatccctaaattcccaaattccaaatccctattagtagagaagaggctaaagccctaaattccaaaattccaaaattctaaaattccaaatcctaaattccaaacaagaggctaaattcctaaattccaaattgatgaacaataacattcgtcgaaaagacataccagtgaacgaaacattagatcggagcattcacgtgttatcaaacagacagaagaaagctataccaatttctgatcgagatcggagcattcacgtgttgtcaaacagtcaaaagaactctatacatgaagaacaaagaagatactaagtcccagcaaatcaaaatccaattttaaaatcaatttaaagtaacaaaaatctattaccattcgtccttacttgcttaaacccgagaagaatcactccatacaagtctgtgacacgcaaaaatcagaaaaacagagtcacacaacaatgaaaagagaatcgatgaaccctagaagaccctaatgtatggaattacaaatcatcgatgacagaatgaaacagaaatagatacaattgaaagagagagaacgactataactaagtaacctgatcgtagatagatggctctctcaggttgagattggtgatcctttagtcgatcggaatcatacgtgtgatgaaagaatgaagacgaaaaacaacaagggtaagagattgtagtttgcaaacaatcttaatatgggggagaaactctcgtctccgtatatgtaaataacaggagcgtggataaaaaaaatggaaatcactaacggctacttacgaaaaaatggaaattaagtagttgttaatcttaataaactacttaagaaaaatgggaaaataataattgtaaccgactttaattaatttacaatgacgcttttgcccttccatcgttgacgtcattgttacttcttcttctctcctccatttaaaaaacgcaagcttgaaaatggaaattgttttacgacgccaacgggcataggtgatggcacggacccgttttaatgacaaatgttggactgggctcagtcaaagcccaatataaagttaaaccactctgagaggcgcgagtgggctcagttaatgacaaacgttttttttttctgttttatataatttttaaatgatggtggacgttggggatgatgtcacttgacaagacagatcctgcagaatgattgatatgaaaacaaaaaagctaaaatcgtgaacaatccaccattggagacgtgccatcttcatcctctgag

SEQ ID NO: 2836 - DNA, 1357 bp, Arabidopsis thaliana
gtttttttccaatctctgcaagctccactcacagtaactattgctcttcttctacacccaaaggagccatgcctcaacgggtccctatgttctttgtctctctgttgaaatgctcagaaatcaattaagaaatatgcatttgtctccttcttatgtatatgtgtaaaatataatatatgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactcatttttagggtttattcttcattgcttgagcttccttctcttcttcttcttcaagccgcggctaaagatccctacttctctcgacacttatagagtttcaggtccattctctgattcctgttttttcattttctaatttcctatttacgggtttttactaatcttctattgatcctccagtc

SEQ ID NO: 2837 - DNA, 194 bp, Arabidopsis thaliana
tcccctatatccgttttagtatgtaattaataaactattcaaaatcttaattaaccaattaatgactaatcgcctcttcgcctataaattaaacccctccattacctttcttcttcaatctttccctctcctcctcgaacaaaaacaacaaacgcagagaaactcaaaactcgaaaacgtttcatatagcaacg

SEQ ID NO: 2838 - DNA, 1288 bp, Arabidopsis thaliana
tcctctctctatctctcttgtttgcataaaaaaaaagaaaaaaagaaactggatagtgaatttgctatggcaaagcctagccgagatgtaccaaggatcggtttgaccttgggaactcgttaaattgtgtgtgtctttgttttcaataatcgtgaaatcttcattaagtgtaaaagttatacatgattaagcttaaatactagtaaactaaaccaaaactactaaccaaacttaaccacaactaaaccaagtatatacactctaatactccccctcaagatgaaaggaactttcatcttggacttgaaaacccaatgaatatgtgtcctccacaactttttttcaatgagagaagcatcaatggacatgaatatccatggcttgaaactgaaaataaacgttacgagcttccggtggtcttgttagtgatccaaagataaatgtgcttaagcgaccagaatcatcgacatgcgcttgcccaacaaagctaacatcgccacaactaaaccaagtatatacactctaatatttgttctttcgattcatacaaacgagagtcgtgcgtgagagatatgcaatcgagaccaaagtcttcttccgtgataagattatcagatcgatatttctctacaacaagacttccatctggtgatttcattttattacataccgcggagaagaaagatcttatcttatttaagtgttatactttagttaggtttattactcgagtttgtttgttacttgcataacaaaaaattactcttaagtcagtattttttctttgaaaggttttacctttttaccagtgtgaatgtgctgagttcaacactccttcatgtttaatctgagtatattttatattagtcctgcatattttatcggagaatatcttcatatattattattagagtgtacataaaattcaaggtttactctatattactctatccaataatttacatttgtctgttagattttgttggaaaaaaataactgtgatttacataagttttttttttttttttttttaattgatgaaagaagaaaaagaagaagaaagtcttctctagaaacaaaatccaatttttggtcagaatgaaaaagtcactggcaatgtttattaaaaaaaaaaaaaaaaaaaataaagcccaagcccactacatgttaaagcccaagaagtaacaataaagatcagctctcctctatcagagattagacgaatgagatcggcaacaagagcgtaaaccctagcagcagacacaacacgagttcatcgagaagcaag

SEQ ID NO: 2839 - DNA, 2000 bp, Arabidopsis thaliana
aatttttgaataagtataattacaagaaaacactgcatataacaactacaagaaaacactgcatataccaaaattatcgaaacatgtatattccgacaaactgaaatcaccggaaaacggtggtgtattgaaacaaagagttgttttaactgaagtttgaaagtaaacaaaagattaaaaagtaatttatagtaatgttaatatttactcatgtttctgctttggtgattagtaataaatcttctaaaatctatatgccattttataaatgcgattaaaaatttaccaattaaaccttatttagaaaaatgtagagaaaacttcaaattatctcctcaagtaggattagatcgagctgcaaattggctctttttattcatttaatttcctccattcctaactgtattggtattgtttactttatttctataagcaacaaaaaaaaaagaatcttgtggacaggtgacaatttatgagtcagccagaattgccacgtgtcggaagatcagttgccgtggtaaaaggtgttttttagattctcaaaaaaaaagtagttaaagagaataatatcaaagagtcaactccacagttcacagatccaccgttggatctaacttttggattatcaacggcccagataatagttaaccggaatcactcggttaccgaggtagtcaatagttctgtgttttaaaaagaaatgcgtccatgtgatcacttttattttatttgtagtcagcttttgttttcctactttgtcgtttttctttatcgctgttctcaactaaagacttgtagactatactaataagatatagtcaacgattgtcgctgttattatagcctttaatctctattaatgattgttaattgttccacaatctgtgtagattaattaggtaaaattaaaagtcaagaaaagattgttttcaatttactagttttccagtcaagacgttttctagaaggctatgaggtaagaaaaaaaaaatatatattaggtgcaaagttaatatgggagtcaaatattattttcaaataattattattgtcaatgcactgcaaaattagtaataattctagaaagaaattgaaataataaaaatatgctgcaaacacgagtttggtatgtgtgcaccatataatattgacaagttgtagtgttggttgaagctaaaaataacacaaaaacataaaaagaacatgaataacgcctaaaacttaacacgaataaaataaaaaaacataaaatatattatcaaaagtcaaaatcacaaaagaaattaataccattttacaattagctgaaaatttattctatcaaaatccagtcctattaaagaaaaatatgtgatttgagatgaaattaatattacatattttgatttggttcaagaataaattatggattttggttaaagaccttctaatattccaaagaaacaaaaaaaaatcagcccaattgttcatacaaataaaaacaattcattacctttaattttaaatttattgacttgaacttgaagacataagatacctaataaaagaaaaaatagatatgagactttaaaaaagctttatgattttctttagacaccatcctttaatgttttttatttgactttttgtttctttgaaattcctttaccaccattttccccaaattcaagtttacgcacaatgattcctttattttaaagacacgattataaattcttgctttgcacaaaagaagaccctacatatctcacaactcaaggagaccaaactttgattactttattccatagaaatcttcaactcaatctcagccgttagatctaaagcaccgatttgactaaactccatcttaaacctactcaaccggtcactcggtcacacccataaccccatatatcacgccaacgccattcttttttcttccagtttcgctctctcattcatcaaaaaaaacttgcacatcttctcagatcttcaagtttctcctctggtttctcatc

SEQ ID NO: 2840 - DNA, 2000 bp, Arabidopsis thaliana
ctccagcattttgtacagtcgctgacgtaagcaacgtgatctgtggttgtccttatatggaacgtgcagtacagataagcagaccttgattttcatttacaaaaataatattgcatacaataattaacccaaaaaaggcgaaaaagaaccttcaaatagagtctttaacgtatattttaattaaggctagtagttcaggaactttaaaagagatgagacatgaaaacacaaatagggctgagagtgagacgtgtgtttgcttatctttcgtaactatttaattggttactagttgtaaatttgcattagatgatattggacgtgacttatcttgaattattatatggtaatttggattcaaaatcctcgtccatgcatctacggtgatgtgtccaacgtaaaacaagttatatgcaatgtaacttttggatgcatactagaaacacaaaagaagtcatgcaatgtaacttttgaaatttggttatgtcaaagattgatttccactgattacacttagtacattgtttagatagtcgaaaatttatttgactgcagtatgtgaaaaactcttaactttgacttcacgagatctattaaacaatttgaagcaggcttatttttgttgttgttatgttagtaagtcaaatgctgaaaacataaaccattttgtataataaaaagtttatgaaaaaataaaaaaagtttatgaaactactattaggaggtctcattaccccgagattagtcaaccatttcaagaatctctggtgctagttttgtttgttctgttttttgcaaaactgaaagtcgcaataatttgacgtctatctatgcagtagtaatttagtactatcctagagcaaagcaggatggaatcaatttactaaataagattataggaccattaggcccaaaagtgaaatatggatataattattgggccgatcatggtgctgtcatggaaaattcaagataagcttttttaacaaatgtgccagtgacaatgatgaggatgaagcaacaatataatgcaacactgtttagtcatgggaacccatcaaagtatcgggaatcacatcacacataaaagtcatttatctctataaaacttaaaaaacagaaaaaggaattattagttctactaaaggttctcatatgaaaagtaagtaaatttcatatagagtttaagtggctatatgacaatgtaaattttttaattaggccgctaagacaaaactttaattgttcaagaagtaaaagatgatcatggcataaaaaaaaagttaccaaggaaaatcaattatgatgaaatggataaggggtttatccggaaaaaaatgcagaaaaacaaaagtgggaagataagaacacatgaaagtacgagaatgcttatcccgtgacactgacatctctctttcacggccccaccaattcccattcttcccccgctaaataatacgccagagattcgatatccaaaaacctattaaaataccaacatttttgttaatctaaaacattagttcgaatcgaggaaaaaaaaaaacattaaattgaaataaattttatttaaaaaattccatactttttatgatactattctgttggtttttaaaatttaaaagttacgttccgacaaaaaaaagaaaaaaatatatttaaaagttacatttatagctttattatgtcatatcatctttatccaaatttagaattcagatgatgaataagataatagacaaattggaataatatgtccattaataaatactaaagaagaaatagtctcatgatcgcatccaaaacgtttttccttcccacaggaaaagaagaaaaacagacagcggaggactaaaacaactagccacaacacaacgcttcaaatatatattactctgccactttcttcaatcttccttcaaagattcttattacagcgacacacaactcttttccatttagatttttgattttttttggttctctaaaggaggagagaa

SEQ ID NO: 2841 - DNA, 781 bp, Arabidopsis thaliana
acttgttgtgaggatcaagcacaagtgtaaacgttatgcttcttaggtgtttttagtttccacacttgttccggttagacatcgtaatttttaaaaattttaagatttatgtgattggtaaattcaagatgccgcaatattattgatatcgtagatatctttgtcagccattatttgtttgggtttcgtttggtgcacatgtaaagaataagatacatggatctctgctacccatagatacgtgtacttaaacttttaaatgaaaaagccaaatcttggcccctcgcagtggcatctaagaaaaatccacaactacattttttcttcaaaacttaactaaactcacagcttcaagtctattttaccaagacggtgctgtgatattttaccaatcctcattatcctctcataggcagaaaatccggtttcaagtcttctagaaaatgatagtattaagataaatgcataaaaggattaatcattttctttcgacaagaaaataaattatatgatattcagaaagcaaaatagttatgacgaatattcgataatctgcactagacaaaccttatccaaatcataagtcgccatcggctccattgtacagcaccaatttgcttgatctcttcttctttaattagtcaagtcgcaattagcaactttgacttttcaaacgaatacggccaatattacaaagctaaacaacttatatataccacaacacaagatacatcttctacataatcatctcactcctttactcacacaagaaaacaaaatc

SEQ ID NO: 2842 - DNA, 1120 bp, Arabidopsis thaliana
ttcttcatcatcttttaacttataataagctaagccctctctctttgcaatgtaccatgcaatgtaccattatttactcaaaatcttgttcactcgagattttttttttttcgttttcttctctctggaaggagtgggttcccatgtttcaggggaataagttttgacaaatatataaatacatctcaagtctttttcaagtttagcgaagtttgttgttttgtttgtatcccttaaaggttaatgactcctttcgttagaaaataagagaactagatttggtaatgaatttgtaaatcacagttctcaattcaaatattttgctcatgttctgacagattagtaccctgagcctttccatagatattgttcagtaagttactgttctaaatcatgttgttgaaaagttttgaggaacaaacatctccttggtctagtagaatagtttgagaatccttttcctcgaccaccatgccttccattactatacactgatatgacgacccaccattgtaatcatatgaacatcaaagtgtctctctgtaacacagtgggttcacagacacactcatttggtctacactttttaacgttcaagtgcttggagttgagatacaatgtacattaatgaggacgatactttgtagtatgaaccaaatcatagccttcaccaagtccctctaagaggaagaaaaccttcatatatctccttaagctcacacaagtgttgtgatcaaacactctgccatgttttgccagaggacatggggttcttccataaaccagactcctcttggcccatcaacatatccatggcccatacagagccttatcatgtgaatgataaaataggtttggggttattcttgaaaatatcttaaattcatggaaatatatgagagaaaacaaaaatatgggtagcggaaaataaatagtagcccactccaattctcgtcgcaccaatagagtaattcaactgccccaaattgctctcgactttttattctcggattagcgtttgtgctttcgcatcagagaatctctcagttcttctcaatttaggtcatcagatctcacaatcaatcgactcgaactcaaatctcacttcatcaatcaaatc

SEQ ID NO: 2843 - DNA, 894 bp, Arabidopsis thaliana
aaacaaaacaaacatgaggaccatgcttgaatgtggtacgtatgtattagattccttccttgatgagtgattaaaccggctattgtaccattggtatatgttagtcatataatagtattattctctttatttcatatcatagctttaaaaaaatgttcggctcatgctgtccactccttttgggccgctcgttgctttcatttttttaaattgcttacctctcaacaaattcttttgattggttctctctctgactctaggccgcagaaagtgcagttccgaataattctcactcaactaacttttgataatcacttattctagattattctgatttttgaattccctctactcttgaacacgtttacttactatgaggaaaaatttaaccctaaaaagaaaaccactcattacagctaacatttatgaggggtggactattgcgcaaagcattgatagtgttaattgaaagtcatgcatatagtatgcgttactactaaagtttaacggttcaatttttttgaatttgaactgacagtaaataaaattaatttttaagattaaaagacgttgtttttagcaagttgtttagaaattgtgggacacgtgtggcacgttgctccaggaggggcatatgccaagtctgagatactccaacgcactgactgactgacccctacttaaccggtggtcaaactcttaacctaaccacggttaagatcttaaagccgttgagattttcccacatgtaataatcttgtttatctgtgagatattcgccgcttccccttggccggctataaatcgataacctcaccgataaatcctctattcatcatccacaacaaacctcttcttcagtctgatagagatctcacgtttcaaacaacaaga

SEQ ID NO: 2844 - DNA, 840 bp, Arabidopsis thaliana
aaagtgatccatcgttcataagctctactatagcaattgacgggacaggactcataagtaacaacaaagtacacttcgaaacaaatttcacatgtaatacttgtttttttttcccgtttaaattcacatgtaataatttaattcacgtaaatactaaagtgattcacccatcacgaagtattttttgaattaaatacatcaactaatcgagtttttgatagggacttttgcttttttgaatattgcttatcaaatcaaaattttcaaattcttgtccatatacgcctatcaaatatcttcttttaaagaaagtctcctaaagagttgaaaacttgaaatatatacttttctaaaatataattttatttgggcgttacgttctagaaaatggaacccgtctactaaaatgggccgctcgtgaactcgtggcagtcaaacactggtcggcgcataaaagcatatccaaatacgctgcgtttcatgcttacccgacccgtcttaaatatttaaagaatattccagattagcgcgtgagatgcagttgccatgtctcgcctcaggaatgacgacatttgccaaaataacagagctacaacggtaaataaggaaaatgattaagggcaatttggtcttttaggttaagaaaagtattgaatcagatctgactttttggccaagaaaaactctcagccactagatcattccgacccctcctccacgttcttctctcttttaaataacctcttcacggaacccttctcactcacctatctcactctaaaatctctctctgccaatctcatcttcaacctctctctaactctcgttttcgattctaca

SEQ ID NO: 2845 - DNA, 2000 bp, Arabidopsis thaliana
tgggatctacgctatactccgctgtgtcgaggaagcgagagcacctaggaacacgcttatccggaagcggctgacggatattggtcctctcttgaacaaaataagcaggtgatgatgcaacaatcgaggataaattgcggtatttaacctcatcaaaggcaaaatccttgtgcgtgtcgggaataacatgtcataataatagtattccaaaccgaaaacaggttactcaatgaatatataagaatataggaattggatgaggaacattccggtcttcataattctaaacctgagctattggtgttactagtgaacaaggagtcagcgtaggcgaaccagcaattatttcttcctcaaacaatttttcttgagtctctataacagtggggttgggaatgtttggaatacgagaggtagtctcctttgtatggattatttgtgtttttaaaaccagtgtaagagcttcagaaatgtatgattgattaggacatcaaagaactggatacaacgaatattgtcaaagtattacctaagcaaatatatcatcctcaacggcttcgctctctggatcttttgcattggcggttggaataggagaggaagaaatctctgtagtaattttctatattgtccaacaaacacataagatgaacagcaatgggaaattaatacaacaagacataagagggtcgtcaatactttttaagtaatacctctaaaatactctttgcagacccataaagatcccacacaccatcagaggcttctaaattcacattttgtccaccatctctacgaatgtggtcgtcatcttcatctggccaagagagatctccgttcactgcttctgactggtatagtgtgtattccactgataactgtaaaattcataaaacaaaattactaggtaaactatgcatcaaatgaatgtatccatcactctaaaacttaactataccagtatatataaacagtatttaatgttacttacattagcagcgttttcaacgtcaataacatcttactcccggagaaagatggtgcgaccaagatcaactgcaggcctttggataaaatttctgaaatatgtaggctctttaatcctactacaaagagcatgaacggagttgaggacttggagttgaagtgcaagacgaaacccgtattagcaactgcttcttttttagatagctggctcttgagttctgcaataggatatgtttccccagcggaagggccaaacctttccattgttgattcaaaagctactctcccccatgggtagctcataaagaattccaaatcatgaagcatctcgacaaatgggccacttacccgatgttgttttgtgttgctgcaaacaacaatcccatcaatcaagactattaatgcgagactcagcatcttccatgtcgagaatcactttcgagactcagcattaacatctccccttagcatgtcaataacatccatgactgtcattacacacttctccccaaatagacgattccaaacagacagatatgcaggatcttggtgatcttccttctcaaaattccttggaaacttatcacaattcaggccagttgtgatttggaattcccggagagagaagcggagtggaaaccctcaatatacaatccacaattcatgcttccgttgtgtcaaaaattgtgtagcaagcatcgcgtgaatcaactttgcagaatgagaacaccttgcaacaggcagttcaaacaattttttgaactaggaactaagcagcacatcccaagtcttgaagccctccaatagttccaccagcgtgccaagatattccggcttcgagtatatgttgaggcgagctttatctagaaatctatcgggttcgaggattcatcgaccaggagttataatcgtcgacggggtccgagaattcgtcgaccagtgcgaggattggtcgaggattcgtcgactaggtgttggaatcatcgaccggtacggagaactcgttgaccagg

SEQ ID NO: 2846 - DNA, 636 bp, Arabidopsis thaliana
ttattttaagtattttaattataactcgcatgcttaagaaataaaatataaaccataccataagccctcatagctagtaatatctagattatttgatacatgaaattttgttgcggtgatatattaatttcagtcagtccaactttattataagagagtgttggggtttagtagattttgtatgaaaggcttgtattttattttttatggaacttgatatcccaacaatgtggttgttcttgttcattcgcatgttttttgtgtttctaagttttgagagttgatataagaattactttaatttgtcaagatctcgtcaagtgtttatacttgatgaaaatcttttggggatcaaaacggtttgaagtaaagatcgtactgtcgtactggtgtctgtagattgatattaaactcgaacaacatgattattgtaatataccttaactaccatataatttttttcaattctttctggatacaattgtaagaaaacagaaaaatcggaaaaatgagaaaattcaccaaaactaatggggttgttttgaaattagtttgatacttgaggattgacaaacgaattctacttttccggggaaagaattagagagcgaaacagaacaaaacaaacaaaaagtc

SEQ ID NO: 2847 - DNA, 898 bp, Arabidopsis thaliana
cgcaataagccagtggacttgagtgacatggtcgtcgagcatgtgtagcagaatagtaggaagaggaaaatgcatggcaaggaagagaagaaaaagaaagatttcaacttctgaggtgcgttatggaagagacaaaaaaaaaaagattttagattctggacatgagacatagaaagagattcatgttccagaattattagtcttgagtaagagatcttgagtttttagtcttaatgcttattaaaaaaaaaaaaaaatgttagaccaccaatgatgtaaatttttaaataggtgattgcatcattgtgtaaacctaatatttacattttgaaggatttggtctttctgcagtatgtaagttaattcaatccccttattattctgacttgtaaggggattcaaaccccatcaatggtttctaaacttaagtttcttattttagagagataagttttattataaaaaaatgtgtgggttttttgattaatgaagaaaccatctccaaaatactttatataagaaattttggagagaatttctaaatatttaagaaacccacataattaaataatattatttttgttgttttaatgttaagaaacttatatttagaaaccaccaatgaaattcctctaaacattaacattgcatatagtcataaaaaaaatatctattttctttttggttctctttttaatatagctttcttggtcaacacttattcttaaatatcttagaaattaataaattatttcgtaactcgttgaaagataactggccacactttttgtgtatgactcagacatagtttttgtccactcggtcccatcatgcaagtagataaacactgaatcaccaaatcttgtttgagatttagaaaaaaaggaagctccaagag

SEQ ID NO: 2848 - DNA, 1756 bp, Arabidopsis thaliana
agacggagaggtggatggtcactagtagtggggaatgtggtgtagagttcgtggcgcgtgacgagtggttttagggttgagagagagagagatgtatgaagaaaaaaaaaaaagaagatgactttttaagaacaatggagaaaggtgtttcgttaacggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 2849 - DNA, 2000 bp, Arabidopsis thaliana
atttcttctatgactcatttgctgttgatcaaacagttaagaaaactggtaagctttaccaaaaaagtacaatggtgatatatatttggttagtttgaccagtgagaatgcattttatcacatttatgtaaaccactcaacaaagaacctctagcaagcgtcggacaagaagtttaagattactaaggccagaattaattactaccttgttcacatgttgtatgatcatcgtagcataatgtcttagaacaaacagatcagctacatgttaagctctacgaccaaaatgttgaagggctcgaggctaatgtagtttggtgtctcttatgaaaaagctactccacagaggcttcaaatattatcttttaagcacaagacacatgcgattaaagtagcattgaggacttcgtgattgtgattacttccatgtaacgccctcgatgcaaattaaaaatgttgttttcatcaatagccactcctaactcggaagtgtttagttatgacaatcaaaaacttaagagaattttctgtgtattccaatatgttatgaggtttattcaaagagaaggagacctaagtattttctttccaacaaggcaaaaaacaggtaaacgcttgagacaaatattatcatgtttgtccaaaaatagtgagtatcatgtgaataatttagaagctagatatgttcgtcaataaacaataaaatgcgctaggatacaaaacgaacgcttgggacgtgttttaggtacaaaacttcaaaaaaatctttatcgagacagatttccagataaaatacacataccattttaacaacgtgtgtgtttatacaaaaataacaaaatattaattttacgatttgaagatatatattgtcagaaggggaaaagaaaaaaacaaaacaaaaagatacaaaacagagtaacaaactctataaaatatgataatataatacataattgggaaaatgactaaacattatctctgccttttggaactcatcaataattatatatttttttatttctcataaaagtcaaaactatcaattcttaaattcattctaattcactcaacttttttttataaaaaaatatctatattaagttctcgatattatttacttccattaatttatcaaatgattttggtatagaatcaacttataatcatggatcaagtcgtggaataacatatgctcaagggatggagctaaaagtgcagtctaccaaacctcaagtgtttgtaactttgtataagctaggcctccgattattaactgaatcggtttttctggatcaaaccaaactgagatttggggtttggttaaccgtccggtttataagagtcagccagtcagttagattttgaaataaggtcggataacagtttggtttggtttatcgaaccaaacggttaaccatttgtttaaaattttccaatttaataattttacggatattttacgtaatgatatcaaaaattcttcaaaacactacgtgaaccaaaaaaaaactattcaaatatttttaaagtctcaaatgcttgtataaactattgatagtacattttcaggatatattataagaagaggaatattaaacaaagaaacaaaaatacaaaacagagcaacaagctcgataaaatatgagaataaatagtaccaacttttacacaacaaaaacattaccaattttttaatatgtcagaaaaaataaaaaaagtaccaactttataaaatgaaggaaaaaagagtcaaagcacgtggctaaatgaatcggccggtggccagagtctccaatagatctctttaataactgcgtggtctgaaaaaggaatcttccttccacggccactaaattcactattttcattcacatttattattttcctttataaatacaaattcatttctacacaataatcattcaatacacataatttacttctttctttataactaccatattctcaatcacaacactcgccactgtttcgaatag

SEQ ID NO: 2850 - DNA, 1211 bp, Arabidopsis thaliana
agtgactcatatcattacaccgcacaataagaaatcagagatatagttgtaactttttgttttggtctctatgctctactttgacatctaaagttatgtttttgttcttgctctatatttttactctcatggagcagtttaggaaacaaaccaaatttctcacagaaatgtgaactaatattttgctaatcagttattaattacgtgtgggattgtcaatctaggttttgaaaaagagactttcactggttggaaaaacagaaaagaccaactttgtttatggggtagtgataatcatattgttaacaactttgtatatatatatatatatatcagacgaattaatagaaatttaaactacattatagacatgcgagagtatgtgacaaatttgatgctataacgacgttaaattctctattcaagaaaaacaattcaaaactttaataacataaagaaatgactaggaaggattaatattagtataatagaaggaaagaataatattatgaaattggaaggtaaaagataagaagaaaagcacatgcttttaatgtggatggatttgattttggttggtagcaactaaaggctaaagcaaccttccaatttacatagtcctactatgatcgttgtttattcaagaaaatgtcaaagtttctacattcgtactattatataattgactgaagaaattaaatactaatctggtaaaagaagtagtattgttaacattccgctatcaggcatgttaccaacttttctatgtttttatttttgttggaaaaaaatgaaaaacgcatacttgaggattgtcttgtaatggcattaataaagaaagacttttcgaacactaaagtaagaagataagggtttttgacttttgagaaagacgaccgttcgtatcgtttgcttatgaaactgatgcaatatctttgtgaatgacaagtttgcttagtttttccgaaaagggttcgctgccttcatggttcatgcacatgacttatagtgaaaaaatgagggaaattggaaaatacaggtaaggggtattaaagtaaattgctaaataagtcacatggtcatcttctttataaatatgccacatctcgtagaataatcactaatcaaatttactcatttagccgtcacctctgaatcttcttctccgatcttcaaacattccggccgccaccgagttcttagccgttaca

SEQ ID NO: 2851 - DNA, 2000 bp, Arabidopsis thaliana
taatatacaaaatatagaggatatcagttctttttccttttgatgttagtttcttaattataaactttttgttggttagttttgccaattcccttacttacaactgataaccgtatagctcttttatcagaaaaaactttatatatctaatctcccaaaatatacaaatgtgagaaatatctgaaaataaatcaattctcaccaattatatatatttgattacttaaaaatgttaatatatggcagttgcttgttcagagaataacttaaaaaattgatcacgagatcggcttatgtttaatatttttgaactcttgggataaaagttttgaagatatatatatcgtagaaaagttttgtgttctttaattagttacaaaattttgagttttttttttttctttcataaagtatcagaatatcagggtgatttattgaatagtttattttttctcgttctactcacgttattcttgcaagtattaattttggtttgtttataaaaaaagtatttggaaattttatgtgagcaagtgcgaaataaacgaggattttgggaagtatttttttttttgtaaaatcggttatattgaacgttatactatatatattattatataaatataactgctaaagactaaatttagatactaaaatcagcattgatgaagatccacatgaataagactcgtctcttaactcaacatttaacatatgattttcatattattgatcatttatctttgtgttggtccaaggtgccagactttattatttacattaaatgttgagttgtttactgacatattttttaattaaaacaactttcatattattgcccatttatattttggttggtcctccaaagacttacaggatacatatgtttctccattttcatttttatgatctaaaacgtctttttctaacttagattctaaatggttacagcaaaccggacatacaattttgcttgtcaaatggatcgttgagatagacaacaatccaatgtaaaaccaaaactcttgatttataattggtctgcaatgatttttttttggttcatataccattttataagatagcaaaccattttcatcataaaagatatatttttttatcattgaataccaatcaaacccggtataataaataaaattgtaccaaattaatgcggttaggtaaattcaatttattggaaattaaagaagagaaaaaaaaaataacgaacaaaatttccttgacacaaaaaaaaaaaaagaagaaagaaaaaacccttactctcaattagtcaatccccttccctagtcctcctctcttcaagcttttcacagaaaaccaccacccttctctctctactgcctttttaccacagagaagagagaggatccgtcggtgtgctagtctcactgacactacatccgatcgtcgccggtaagttgatttcgttactctccgatcaatttcttttccggaggaggaacttgttttccgtgcgaaattctgacttgaactttgttgtcaattcatcaaacgctttatcttttctccatcttcaattatcttactgcttcgtcgctgatctctacttgttttcctccgttttgcattttcagtggcgtttcttagtgtttcactagatttagactggttttgcttgtgtgcattttgtcatcagtgtttatgattgttcgctttagctctatgtttctatggatttgataatatatgagttcgctgctctggattcagctggcttgtttgattgttcattttcataattctgtccaaagaatcaaatccacagtagctcggatctgagattgatttgtttctttgcgtctttgtgtagatttgactttaattttgagattgttgtgtgctgatatacagcttaattaatatagcctctgatgtgttattatcgatgtgtcattatcaatctacaggtgacattttataagtgtggagtttacttcagctttattattcaggaattg

SEQ ID NO: 2852 - DNA, 485 bp, Arabidopsis thaliana
gaatttgtagctttcaaaaaatgttttgtacattttgaagttcaaaatcacatttcttcattcgttatctgtttcatgaaacagaaagttctaatcttcatcttctattaatatgttttaattcgcaccattggtgtttcgatatcgatatgtggcttcccgatataactcgtgaagaatttgaactcgtcaactcacgcaaatcatctgagtagatatcagattagaccaaaataagtgagtccaattagttttccccaaaaacattcacagaggtcacgactttaggttaatctgttgcagttgtcacgaacgaattcaaaatccaaaggagcgggaaaaacgaagtgacgtggaagtatcttagcgaaagcatctctctctctctctctcacaatccatcatcttcattaatctgatcaaataatagggttaatcaaaagtccagaaaccaacacagttcaattttacgaaacctctcagaa

SEQ ID NO: 2853 - DNA, 2000 bp, Arabidopsis thaliana
tcaaactattaagtatgtaaactaatgtcttatatattctaattttttaacgtatctttgttttaacgtatcttttaaactacagattcggatgattacgaaaattaataattatgaatattcaaataaaatggacagtaattcttatataaaaaatccttttgtcaataatctaaccaatgattcactccaaactcatctgacatctctataggcccttattatgattggtatgtccattttggaagtcgtcatgacttatgagcataaaatgaatacatgaatacatgttttgcagtttttttttgcttcttaaacagttgatgtctttaatttgtttcttgtaagtttaagatgttatctatttatataccttgtttcgaaatttgattgtcccattatgtttctgacgtggaattaaaacccaatgagaatggggtcctcctgttagattttccaacaacgataagaatatagaggttgatgtgatttaaaaccaatagaggcagcgcaattgagtaatcatcatcttaccatccttcctcgaagtagtcttcattgcaagttggcaaaagcgagagacccacccattcactttttaacttttagtttagctcgacatgagagaaattatattatgaacaactatctttagtttagctcacatgacggggttttttttttgagaaaagaaaattttgaatttttggtttatcatacaggaactatctttctccggcgggaatttggaagtcattatgcccattaaggagtcataatatatatttgtagttattattgtatctggtgtcaaacaaaaattaatgttagttgtacattgtgagatctaaaacctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcactcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttcattcacaccggacattttgaaatctcaacaagaaccaaaccaaacaacaaaaaaacattcttaataattatctttctgttatgtcgatgacggcggattctcaatctgattatgcttttcttgagtccatacgacgacacttactag

SEQ ID NO: 2854 - DNA, 2000 bp, Arabidopsis thaliana
actatatccatctcgcgagacatttagcctcggttttatccctaaaatcaaagtaatatcctcgggggggggggggggggaacaactcccgtagacgatctactttccacctcttcgtctggaagtcaatcaaggtgttaacgtagaccaaagggttcctatccataattaaacctttcggtggtcttggaggagtatctgggatccatggataataggcgactatatgttctaggaggttgcacaaagaaaaagtttgttctagcataatatgagaatagatgatttacgtcttaaaattaaactatcaccgactaataataagcataataagatgtgactaaaacaactaagattaaatgatgatcatcatgacatttgaaaattatataaacccaaatcataaagaaacaagaaacaatatgaaaacaatatattcctaagatacagcaaaagtggatgtatgtgaaacgtccaaagagataatttgaggattagctgcggagttcaaacataaaaacgaaagttcaactactactttcatatttaattaatcaaagtatttaattgcaaaacggaacttaacctgattggatccataagtatattatcattattcttttaccaaagaaataaataaattcgtttttaatcatatttagagctattcatgttcttgtaatcaattaaaagtttcatttgtttacaaacataacatcatatatacactcaaaaacagcaaaattgaaataaccatctgaccagaatgatgtgtttgaaccaaaactactcttggaatcgaatatagattaaaaatatatagtaaactaatttttagagagtttgagtgactattgactaaactatgcttccgtgaaggaggtcccttttgcaagtggacatacgtgagagacccaccattaatttgtctttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacatagaaaaaagttcagatatttgataaatcaatcaacaaaacaaaaaaaactctatagttagtttctctgaaa

SEQ ID NO: 2855 - DNA, 2000 bp, Arabidopsis thaliana
tgactcgtctttgagtaacacttcttcatctagtccaatcgtcgcagggtttcttttaatttatttatttattatcttctcttttggtaagaaagagcttctttaatttggttaaactttttttttttggttaagtacaaaacttctcattccttaataaaattgatatctatattataaaatatcaaattttgtaaaacaaaaataattaagagtagtgtttcacaacaacaacaaattaaaaagactactatataaattaaaaagactacttggctttctagaaattattaaatataaatttttatattaaatctctgatttgctatatcatttattaaaagtgtgaactttattttgtttcattgtaacaagtaacaacatgactttctagaatctagtgagtgagtcgttgattcattctacaaaccagttaatgcaccgcgtaaattcttttcacgtgcatggtgcagtgcatgaagatggatcaaattaaatacgaaaccaaacataattcaatagtatatcatcttttaaaatttgtatgattaataatctctgtcaataaaaggccgcatgcattgacttgactctttcagtcttgtcttgcttactaattaaaccctccataatgcatcaacctaatcataaccgaaaattttctgagttgtatttggttagactttaatgctttactatcattttagttacgtttgtgtttacctcgcaaaaaatcttctagaaggataatataatactacaatacaatgttggcattatccattactgagcggtgtgaaattggttttgattgtttaacatatgagttaaaatttgttcgcaatattggcaaattagcatcggatatgctattgtataagaaaacgcttatttttggagtgcgcgtctacctgtaactgtataaactacgtaacgaacctttgaacgcagagtgaatgtgagtctctgtgacacgacttaaagcttaatcagaagcagattattggaccttatggagactttatcaagattagctaatgaaggttactatatatgaaactttgaagtaattgtttgcagccttttgggatcaataaaccataaaagcattggttttgttttctctatctatatccaattccggaaagtagaaaactggattagtaaaaatcatattcacacattgcgaagaaaaactatgtgcgcgcggatacgttgggaaaatctgcgcatggtttaaagttttgctttcagtcaattataattcgttttttatactccctctgttccaagatacttgatattttgggtttttgcacaagaattaagaaaagtaacttttatatttttaattattcttttagttagtttaataatattaattttacttctctcatttcattattggttacaaacaaaaataataatgatagtttttcaaaacatcaattttggtggaacaaataaaaaaactcaaaatatcaaataacttgaaacagagggagtagttaattaaaaaaagatatttcacactttgacttggcgaagcctcataacaatgaagttatgtatgaactatatatgaagttagaaacaatggaaaacagcttgtaaatattcattgttgtatatatgtttttttgggtcaatttggtgcatgaacaaaaataaaaacgtagatgaaaaccggatattttggtgttaacatttgcatttgaacttcgtgaaagacggataaaagctcatttttgttctttattatatggctgctattagtacacagagttgaactttagaatactaaaaatctcgacatcttttattttatttttgtcaagcatcgacatcttttctgttcaagaaaacgaccgcaatagtcgaataatataactcttggactagttaatatatatttgcgatagattttcgatctcacttatatcttataaccaagagacaaaaacaatattgcagtcaagtacaaaacgaaaacaatcaca

SEQ ID NO: 2856 - DNA, 2000 bp, Arabidopsis thaliana
acttttaccaactctagacaattgctcgggcaattgctccggctcgggcggtttagagatctcctccacaaccaaaacacttcttcagttattttttgcggatgttacataaacaaagacatcctcatcatcacaaacgttcatttcttcctctactccgaacaaccgtggattgtacctcatatgcaattttaccttatttgcatctaatccaagcttcgtcattatcctatcttctaacattgagagagtaatcttctcccctaatgtcttcatcatcacattatacatgcgaccttggaatttaaaatatatgatcacgttctctttcattgtaacctgccaaaacaatacacatactcagtcaatattactagtattatcgattctagtacattttcagtaatactattactaattctgaaatattacatgtgtgagtaatactattacatatatgaaatactacgtgtctaagtaatattggtgctattaaaacatactatctatataaattacggtactactatagttagtgcgaccagtattattttcgcgacaagaacaaatattcgatttgagttcaatttagtatgaatcagcatgtgaaatcaattgcttacccattaacagaccaaatgaagcctaaatctatacttaaacttctaatgtaggtgctaaaacacaataatccaaatctaatttgattgaatttcaaaatcctcaaaatatgtaattcaaagcttttgaagctctctccatacctggacttagtagattgatgcagcttgcaggaggagaaaaacgacaatgcggctcgccggaggaagaagcccgaagaagaacgagctcgagctttttttttttttccgtttttttttttttcaaaatgttttctagaaatattaattattcattcaaaataaaatacaggggtaaattcgtcttaacacaattcattaactcaaaggagataggaagactctaaagtggttttgcagattagttgtcccacaaaagggacacaagagatgatcattctaaataatgactaggattcaacctgtgttttattattttgggtgattgttgtatatttagtaggagaatatattttaatgtcgtcaagcatgtgtactatttaataagtttgtatgtaattttaagatagttaaagtagttaaataaatgtgaaaaagtttaagtattcataagttttaggcattaaaatttttcttatactttgttttttttagattaaaaatattttgaacttttttgatatgatttataaaaatcaataatactcaaaaagtaaatgacagaaagattaatgataaaattttaattaagtaaaatattttaaacaaaatgaataggttttttaaatttttattgtaagtaattctacaaaatgtggttaaattaggtgaaaatagaatcttagaaataatatttgtataaatgatgctcattattcatcatgctaaattggagtctttgttaatcagagaagtcagcttatgcagtatatttagaaaaagccaaaaaggctagaaagagataacataaaacaactttcctttgttgttgttataagtaaaacatttacgaaaaatcccggatattcacctagtaaattaataaagtgtgcataagagagtactaaaatgaataaagtatgaaatttactgctaaaccaaaatcacctttccagcgaattgtggtcgttcgaatggaataatccggttaagctataccagagatggatgttaatacggtttactttcttgagaaaaaaagaatttatgcaaagaaaaataaaacttttttgacaaataagatatgtggataatgtgagagataagaaatatcgaaaactatataataaaactactgttgtggataatgtaagagacgatacaaatagcctcataaggcaaaaaacaatggcatcatcatcatcatcacatttgttttgacgctccaagaaaatttgc

SEQ ID NO: 2857 - DNA, 1143 bp, Arabidopsis thaliana
ccttccaggggaaaataatctgcaagagagaaaagtggaggttggttacagtgtgcaaaaaccagtccaaaacacaatgctcaggagactaagaaagaaaagaaaaacaccaaattaagaagacaactccaaaaggtaaaaagctaaaaactttaccaccattgtcgttctaagattttaatttctgggcatatcctgctaaatcgcgagaaatggtataaatttcagatgaggaacaaacttaatctggaaaaaaaatggcacctttaactgttggtcgccttcaaaattgagaaacattacacaaacaaaaactcattcgagtgtgtcatacagtagcataacaagactttcaagagagaaacaacgcagccaaaaccatacaactatcaacagacaaatcctagcttcatgcaaattctccgaaagagagacaaaaacaaaacctagctccgaatcaacaacaattacaacagcgatatctagtgaaaacagcgcacctttgaaagaattaagaagaggatttctagggttccggtgaatcaaagagaggaatttatttagctcatttctcttctccgtcacagtctctttgggtttcccagacaagcaaaagaatggagggaacgtttccagtgatgggaaaattaaaatatatttcacttttcagtcattttttacagtaacaaaatttaagaactgaaataaaaatggtttattccaaaattattaaaccgaatccttcaaaacttattctatttctagggttatgctccggttgaatggattgaaattcccaacttattcatttcaaatagtaagaaataaaatgaatggttgtaagaaattaaattagaccgtcgtggtaattgtaagaaatttcattgaaccggactataaattagaagccggataattaaaccgtaccagcgcttggagaaacgccagacacacgcgcgaaaagaagcgcgtagaccagaacgtgtaggatttgtcacctcagaaaagaaccacggtggatcccaccacacctcagcctcactcctccttcatctccgacgtcatacccaaaccactcttttctcacaattccgattttctcaaaaaccaaaatcacaatcgaagaaatcttttgaaagcaaa

SEQ ID NO: 2858 - DNA, 985 bp, Arabidopsis thaliana
aatccttaaaagagagctgtaatgaatatgtcttacacaatctccattggtggtgcttcctaatctaccactgaagaacttatcacagtagcaaaccacaattctgcatataaacaaacagaatgtgaacttcgaatcagagccattataatacatagaggtgaaggcagagacctcaaaatctaacgcagaaatcatcaatggaacggaattaaagtaaatacaatagatgattctaaaatccgggggttcaccagggactcaccagagcaactagggttccgcaggattgaaacgaggtatatgaagatgcggcggaattcgaatccaacggctgagagagatttcaattactcgacggagatggccgccgatctgagagagagagagacggaggttgggtgcgtcgcagggaaattgtgccacgtcacccttcctctcttctttttctgttctctgtttttcttgtgctactatttgtttttggtcaaattttacttttttggtcaatttgtttcttttttttttacataacaattttttttttttttttactgaacaaacataacaaaatgttttttttaacaaacataacaatatgtttcctaatgcaatttgattatattttttagtagtacttagtaagtcttggtatgtgtttatggacacatcgttttcgggaaacgaattaaattgtactccgaaaatgataaatgcatggagtaattgtataccaactaacttgtaataatttgaatcaacacatgctcttttgtttacgcagcccatgcatttatcgttttcgaaagtatttaattcattttgttataactacgatgagaagccgagagaaccacagaattataatgaatcggataagaaaaatcaacattctccccctataaatacaaaacaactagctaaagttcgaaggattcatacataaatcttcaacacaactctttaattatctagtttaatacaa

SEQ ID NO: 2859 - DNA, 2000 bp, Arabidopsis thaliana
taatttagaattagtttttgtatagtattttggttatatttgtggacctaattggggcctatattagattatctttaatagggctgacgaaaaaacggacccgataaccaacccaatactcgaaccaaaaaatcgggttagggcgggttaaaattttaggaaatttccttattgggtagagttttagtaaacccgtggatatccgattggaccggaaattacccgttatctaaaaagagtattcaaaaacccaaacattaatttaatatccaaaatattaattatatgatattattttatttgattttaaatatatagtaaactgcgagttgtatatgttttcttgatattatttatattgtttagtgtttaaaattatacacttgtattttgattgttaattttagagtttcacctgtagtataccatcttatattaatatcgatttaaacccgtcaattctaggattttccagcttgtattaaaaattgaatcacatcatacacataaaaaaatctaatatgttattaattattgttgtatataagattataaattcttaaaataatatgcatgaaattgaatataaatatttaaattatgacccagtacttagtaataaatttttttaaatctatttttgacccgttataatatttttttatgtattgaacagtttatattcgtttttaaaagtttaaattatggcatatgcgaaaaaactctaattatttttttataacgatgatattattttttcgcaaaaatagaatcatataaagatgagaggtgaactataataattaataaaaaattaatatgataatttagatattaaatctaatttgttgattttaattggttaattttttggaaattaataatgtatttcattttttaatgaaatttaattaattaaattagtatttgactttttaatttttaaagagatgaattactttactctttaaattttatttctaatggcatacatatgtaattacttacaaaaagtaaggttacatttaaaatgtacttcccaaataatatagtaggatcatggtaaaatgttagttctcgaaagaaaaaatattgttataaatcataaacctaacgagctaactaaaatagcggcatcctaccaatttgagatttttcgtatatatattaaaattatccatttgataaacacttcatgataaagtattagttttgaaaataaaaatattgttcttgttataagaaaaaacacacacataaaagtattattggaggatctcattgttaagttgttaaccctcaacatttcgtctaaaaatcagacttttttctatcaaaaaaatatctatactttgtagtcaaataaaaatcttaatcaaaataatactcgtatactttgactgttgactgatggaaagatattagaatataaacattagagatagaaacaaatctgtaaaaatcttaaaattaggattatttatacggaatattccccaaaagataaaatcattgaatcataaaaagccatttatggtagccctaaatattcaggcgcggctttttttcttatttcgttttcattttaaaaaagtttttagcgccgtttattgccgcgcgtcgttttcgctcctcgtctcgtctccttttattattaccccctctctctctctcccactcttcctctcaaatcacacatcactgctttcttcaacctctctatctctcagaccaattagggtttcgcaatcttccagtagatttcgcttctcaacgtaagtttttctctataatctgtgtcgatttcagtctaactacagtgattgttaaaccctagactcggaaattttcctgggctttgttattatttgcgtcggtttagtcaatgcgatgtagtgaacgcttcgattacatagatttgtgtgaaaattttatagtccaattgcgttatagtgatgattttgttggtaattttgattttgaaactagggattttgaaa

SEQ ID NO: 2860 - DNA, 1388 bp, Arabidopsis thaliana
tttcttttcttcttcttcttcttcttcttctgctactactttgcttctttttaagagtttgttgcaacggttgactttttttcttgcttttactcaaattccagaatctgagagacaacgaaacaaaaagggttatacacatttacatcttcacgtggttagatagatttcaatttggttaggttttgggaaaattttaaatgtgaagttttgccactttgagatttgtgataattgcgtatggattcgtgtttggtacataattgtttggaattaagttccaacaagtaaatacgtcattttcttgaccttatcttcacataacaaattaaaaatttaatactgattttgcatgtcttcctcctactttgatctctatttccacaaaaatcatcaatgctcgttggaatattgtcagaatatactaatgctatataagaaaacaaatacaaaaagaggttttatacttttttggtcaaatgtcatcttcataataaaaaaaaagattacgatcttatcccgttctaacaagtaacacctcggaaaaaaaagaaatcaaaatccttcctagtaaaaaaaaaaaaaaaagttggtttcagacagaaagtgaagaatcaagacaagtgtgatgattttcgtcataggttgaaagaaaacagattaaaaaaaaaagaagaggacttacaggagaaagaagaaggaagatgtaacgatttgttgtagactgggaaatgattcagacttgtgtgtgctatttattccatggattttttgatcgcctactatgaaggcgatgttaaagatgatgttgaccaagttttgatcaaagtcgaatacagagagactaaatatacaacaacaaaaaaaaaaatcaaaagctttaaattcacacacacaaatttcgatagtagctatggatttaagacaagtgtaagaagaaatcacactagttttcaacgtaaggaggatgatgaagatgacattattgtatccacatttgtcacccattttttggaaacagatgataatattattaaatctttggttaattaaatactaagggaaagaaataacacaaaagtggttgtagtatagcggttagtatcccacgttgtggccgtggggacccgggctcgaatcccggcagccacactttttgttacctcttcttttttatttccagcaggggtagtttcgacattacattaatcacgtgatcattagatctggaccgttcattttactccccgccatttctctctataatacttttcccgcctaaactcatcgtcatctacaacccttttaccgcccaattttgcagtcactggttcattcctttctcttcttcctcttccactctctctctcgacccaagttttgaaacc

SEQ ID NO: 2861 - DNA, 604 bp, Arabidopsis thaliana
atttttagtttgctttaataccaagaaggatgtaacatttccttgcatttgaacactatgtactgtcatatcctgcttatgtgggctttgggtagtttatattctttcattttcatgaaatttcttactctagtctgaactttgaatcccagagctagtattttccagtctgcagtatataacttgtcagtatttttgtttacttgtttgatactttcatgtgaagacgcctactgacatctagcttgaccaattgttgtttcagttgctatgccattgcgagtcaggcgagatgcatgctgcaatgatggcagatttacgccatcggattctcccaccaacatttctctcgaaatacccgaaggaagctggattttgtctttggcttctacatcctgaaccctcctcccgaccatcagctaggtatttagctgagtgctactcttttatgattcatgtgggcgagtatttactaggagtctaggagtggtacaaaggagaatctgtagaccttccattagcttaaatagtcgtatttaagatttctttgccggatatcttcaattttatttaatgttttcccgcttaattgtgaagaaaaaaa

SEQ ID NO: 2862 - DNA, 2000 bp, Arabidopsis thaliana
ttaagttaaatttttcgatatagaaatataaattggtatatgtatttgtttttgttaaatttcctatttcttttagaaaaaatatttaaaaaatctcgattttgcaatacaatttaaatatctattttattatataaaaatacaatttaattcgattccatacaattcatatacaatttgattttgcaatacaaatataattttattctatacactccatcttattgtgttagttttccttcttagttaagaaaattttaagttaaattttttagatatagaaatataaattggtgtatgtatttttattggttaaatttcctatttcttttagaaaaaatatttaaaaaatctcgattatgcaatacaatttaaatatctattttattataatacaaatacaattaaatttgattgtatacatttcaaatacaattcgattttgcaatacaaatacaatttaattctatacactccatcttattgttagtttcccttcttagttaagtaaactataacttattttttttagatatagacatataaattagtatatgtaaatatttgtttttgttaaattgcctatttcttttaggaaaaaagtaaaaaaaaatccgacacaatatcaacatatgaacgattgacttgttacgtgtcacgatcagttgagttattaactttaaaaactctactttatataataaaatgcgtctgaaacttcttaatttatccgctttatcattagcacgcttttatatatagaaaactagattttaacccgcggtataccgcggagacaatttattttttaaagttactatatataaaaatttgcaaattatatttatctataaaatatttttattttatagtttacgattgttattaagtaacgtcctgtcaaacccgtcccgccaatccgtcccgtaaaaaaaattcactgattttatttatgatatgtttatgaatcattgtctaaatattttttaattttgtagtaattaaatgctatctaatatctctgcggtttgatgattataatcgaattattatagtcatgtagaaaaacaatatcaaaaatgataattttgtagtaattaaatgatattaaatatttcggaagttttattttagtaactaatcgtgtagttaatgtggaaagattttgggaagattgtcaaatatttaatttaaagattttctttctaattatcaaaaacaattattaaatgcgagtggcagccactgtaaataaactccaactctaggatttatttcacaaagtggctgcaaaaatgtatatatagatcataaaaacagtaatataaaaattttaaaccttaaaaaactagtttttcaaacaaaaacagaaaatgggcaaaaaggccctaatttaagggcttgcaaatggcaataaatgtttatctgggttttgtggtttcttgattcgtcattaccaattttcaccatgaagacttaaaaaaacctgactcagctctgcgtcacctacgagttggaaatctgacttccccaagaatttcttcagattacatcgtaatttacaattctgccctatttatacccatcaatctgattctccttgtttctgtatatttcttcgctctttgtttgaacaatttatctgggtttttgattctcggatctactccaagacggttttcgaaattaacaagcttttcaggtaaattgacttttttttctttgtaaaggtttatcaattttgtcttctaaactcaaacttgtgagtctcttgtttggtttcagaccaaaaccaccattacaaagtagttatgtcggtggttcttgtcagttttcttacaagcttatggttggtttagattagatttgatgaaatgaaaattgagttgaagaatgtttttttttatttgagcaagttaatatgtttactgatgtttttctatagagaagttgctaagagagcttacttatgagtttgatgttgaattgggacacaggaa

SEQ ID NO: 2863 - DNA, 325 bp, Arabidopsis thaliana
atttgaatcataatgtacaaatgatgtctacaaaatgttttttactttttacgatggatatttacaactttgctttgtgtgtggttaatttgttacaagtaaaactttgaggagtaaaagtgtgaatatttatgatttgggtaaagaaggaaagtagcaattggtgggtgtaattatgggaaacaaaatcacgcgtcgaataaagtagaagagaaaaactattgacgggcaaaattgggattggtaggtgacgcgcatgctaagtaattgaaaaaaaaaaaacacaagaggagaagaaacagaacagagaagaaaaagagagaag

SEQ ID NO: 2864 - DNA, 375 bp, Arabidopsis thaliana
tagagagagtgaaggaggagaggtttcacaagtgaacggcgaaattgatttaagattttaattgtttcgtctttaaaattaaaccttatctgtttgagaaaatatatttcatcagatatttttatttcataattcctgtggctagaaatttgtttagaatagaaataaaaatatatacgagccatttggttcgtgtgtaagtgtgtagtacatgcatttgagacaccggtccacttggatatcatttcgtagtaaccatgaatttgcaggggtaattgtgtcaatatctcttggtcatatataggttacaaagatgaacggaagaaagaaaaaaaggtgatcggagattttggcttattctcagatttgggagaa

SEQ ID NO: 2865 - DNA, 1902 bp, Arabidopsis thaliana
taaagcaaacacaaagatctgaaaaaagaaagactgttagaaatctagagaagacgacaatggggtctgtaaagaaacagagagagagaaaggtaacgaacctttagatgagaaaaaatcgaatctttcactcactcacacgggtctgagaagaagatgatgaagttcttgagtttttagagaaatttttgattttcactggtttcagaaagtggaacagagagagatgggcagagagagagagagagaagggcatgaagaaagcgtgatggcaaagccaaaccatgctatttcaggaggtctctcataccgccaaaacggtactatttttccacacactctgctttttggttttggtcaaaaaatttcttacatttcgttaaaaaaacagctcattaatcagtttccatttcaagcattgtttttttctgttctaaattacctttttgaccactctgaaattacagagtcaacacgtcactcaaaactgcaggaagagaagatatttcattacaagacaaacaatgtgtaataaattatgtcttactgcttctaatttttttttctgtgttttccttttgcttttgttttgaaatgtaatctttttagtttaccaatctagatttgttataacaatttaaatgaaaaaaatcgaatcatttactattttataaaagaatctcaaaccctttctttgaatgggattggagattggagtattattgaaatcaactaccttcctcttgctggcatttaattccactattagacctttatattatttttaaactaaagaatattgtgtttgaaagaaaaggcaaccaaaaatgattacttacaaacatatacaaacaaaggtttttagaatataaagtagcaaacaacatcattccaaggagagaaaacagagaagaatacttgtcattaatagagagaggtatgagttcttcacgcaaagtctttttgatattggaacttggtcattaatttacatcaccaacaagttctaaatatgatgaaagaaaatttatgtaccaacttcactttaagtgcccaccttttatctaatcgcagtaatgaacacatcacgtcctatgaggctttgacaaattaggaaaaaggctaaactgtgttagtcagaagataataacttacagaggggaccattattaatctcctaagtttatgtttttgtgacaagttacaaattcctcagaggattattagagaagcaaatatcgaaaactgtataacaaaactaacttcttaagaccgtaccgtcacataacatcaatgagccattaccatagccgaaaccagtcagctacacgagtacaagacttattatggtatgtagtcatctcatgatttaagggtataatgaagtatcaactgttagtcccccaagatcctaattgcatatgatcagaactctggactcgtttcttaagtgaggatttgcaaagctcaatctttgtcattgcgattatgttccggtgacgatgttcaaaatctttccggggatttagttccatcactgtctttcttttctatttgtttttgtctttaacaatgtcaaagtcaaaatctcaccgattctgtaaattccaagttatatgacgtgtcattgtattattggtgcgagcgatagcacaacctttgcgtctgcgtcggtagcgaactcttcggaaatatataatctgtaattaaaatgagactaatcccaatttaaaatcaaaaacctttttatttatttttgttttcctatagagatttcttagaaaagaaataaattacttctcttttatttttcattcggtttagctcgtggaactgaatctggtgtgtttgttgatcagagtaatacggacattgcaatttttctaaatccggcgattaaat

SEQ ID NO: 2866 - DNA, 2000 bp, Arabidopsis thaliana
aaaggatatactattgtagaaacagccaaaaagtccttttcaaccacacttaaaatttccttttttggctatcaagatatacacgatatggtgtttctaccacggaaaatttgcaattaattcgactggaattatcacaaagccaaagatgaaaatgtttgatgatgttgattgattcatcaccattaaaatgataggcaaaaagcaaaaaaaggaacgaaaaataagaagttgaatatataaatggaaaaaagtacgtggaacacaaggcgtcggaggaatgaaatgggaacttgcatggatttgatactgtcaattaaacaaaagataggttccaacctaagcatttgttttcgttttcagattttcacatggggacgaagtttgcttagctacatcttttcccatatgtttttataaacatatttccgataaactatttagatcattatatttttagttaccaaattagttaacccatcaaattttcatattttaatcttccgtaaatgatattaatggtttgtaagttctaactctttgactgaattttgaaatgaccccaaaatgtttgtagatatacaattaacgttctcaaattccgctgatttttccgcatggcacttattatatatactgtatttttgtcggtgaccaacataatgttaagttccgcttggtcagtagatataaaatataatgtcatatgaacctcgtaataacccgtatatcctctcaatgaatttggttaaccaagaaaatataaaactaccaaactacattaatcatttggtgttattttgtacatcttaatttatagacaaaaaataaaataaaagaatgggcattaaagtgttggcaactctacttgtagcaaaagacatgtgatcttgtagttgcaagtacgtactttggtttatatatctctatacttcgtccgtaatccttttgtaaacggactcaatttatgacaaaacgggtatctaaatctattaacggccatatggtattttttggttatttattcatatattagttgtaataaaattggaagtttcagtagagacaaattctgaagaagagtttataacaagtgtagagaaaacagacactacttgtattaatttgtagagttgtgtctaaataaaaacacaaaatagagacaatgtagggtagtgtttatatagtccctaccttatttataagaccctccaaaaattttattgtatgcattcttttacatatttttggcctttcccttatggcttgtctctaaaactgctttgtttcctacatcccacatgatatttgctttcacattacatatataaaaaagaatattttgatggattgatatagtggtataggaaaatttgggagcattgttatatctttagatagtcctgagtttaattcttcattgatgcaaaaaaaaaaaaaaaaaaacttagaccatttggctactctatctaggccataatataacaatttggccttgtaagaaaaaacaataacccttgaaaatagttggacgttgtatttttatgtcttgtgataaaaggaaaatgttcaaattttgaagagatcatataagataatgtacgaataaaaacaagtgtttggacatttatgaaatttaataattatatttgatgtcatatgttacgtacttacgcggctttgatttgatcaccaaggaaacacttcatgtggttctgcatgaattagtcgttgttgtgtatataatacatataacctagtcacaaatcatccaaaaagtcataagtaaacctaataaatctatgttaaaagcatatatgagatttttcttattaaatttaataaacacttccaaaattttctctctcattgtgcccttaaatacccctccatattcctccccaccaccttcacatccacacctttcttcaaacataccaaactctctctccctcttccctcttctctctagccaagttagatttcaataaggtcaaatc

SEQ ID NO: 2867 - DNA, 1569 bp, Arabidopsis thaliana
ttacacaccagaaagatctctcttttccaaaaacccagatgtcgaatccacccagaaagagtccacacacaaacgaaaacgcaacagtttcttctaaacgggtacacacataaggggattcgagagcaagctttgaataactaagattaggtttagataaattgtgtagaggagtgaggtgaggacgaagaagaaagtatatttggggataaatcgatgagagacagaagagaaaagggattttgaattcaaatggtgaagtgttgaggttttgttataaaggagagagcttcctcgttttttcggccgctaacctttgagccttttatattctcgaaatatcatcaagtagggctctttcgtcaatttcactaattctctaattactaatgtctttttcacttttactcccaccaaaactcacttgttcatattttaccccacacatttacaaattattatttagagaaattacatatgtatatcaatcactatataagattttagtatttactaaaaatgccaagaacaaaaaacttcattcattttataagattttagtctttaaatagatgtgaaatacaacaaatctaagtttttttctgtcgtttacggtgaatttaattatttagatttttgattatattattgatataaaaatctactaagcattttatatgtaacgataacgacaaaatagtaaaatacatattagtctaaattttgtgtgtgtatatatattgatattgattgaatcggttttaaaattggttaagctagtttttggatgtagaatggttttggaaagtagttttagaagcaaatgtgtttggatcgtattatgtttcctaaagttcgtatatattaaaaaagttataaaggcttatttactattttttgtgaaatgtctaaaataacaaaaagtttaatgtatttccttttatttattgaatccaaatcttcaaacgttttttttccaatgttctacacatatgataagatgccgttggtaacgaacttttcgctccaaattttcaaaaagttttctaactatattttcacataaacccgcgataaaacattactaaaattaactttgaaatttaagtaaacattctaatttggatctatcaatattttttataaatagctaaaatgaaaataatattaagctttatacacaatattttatgcgattattttgttttagtaaaagatatttaatgaaaaacaaaaatattgttgaacaaggaattgtaatttatatgtttctatgtatatgtgaataagatcaaatgtaaaaagagaagtatatgatttgtgtgatcaaaagacagcttgaaagtttggatagacgaaaacaagggttaaaaagataaaagatctcacaaacgacgctgttttggagcctgttccgtgtttttttgtggccatcatcatcaccttcggacacaacgtgatatctgaatctctccctctctctctctctctctttcgctgtccgattccgacagatagacagagggcgcgaaacagagagaaaataagaagaagaaggacgatccagat

SEQ ID NO: 2868 - DNA, 2000 bp, Arabidopsis thaliana
tctaggtgaattatggattgggattatctatctatcggttagttatccggtttcatctttctttccactaaaatgttcatattgtctgctaattcctctcttggctgatggactagtttttgcacgtttctgaagtgggtccttcctaaaatacaagacaacagattataacttactcatgggcccaatatcaatatcaatatcaaacaagaaagagaatctgttcttaacaggcctcgtggtccgttcgtttagttttcatgtttcaatatttcttagaaaaatacaaaattagagtaagaacaaaaagatactaactagtagcgagcatgagaaaaacgagtaagcagaagttgtccactaataataaaattgtgaggaatcaagaaattctcaatacaaaaaaattttagcaatgaagaaataaaataaaatattattagcaataattggagtcactagaatgtttcatatctctttatatactaacactagtgttagttcattcacgcaaatgttaaaaaccaattctaccattgttaaacttataccaaatatttaaactagttacctgcatcattctaataactaataagtctcatgaattcacaaacatagcaatgttttgaataacccaatatatcatcaaaaagtgtggtgcttccgtgtttgctaagttccaagattcaagagaaaggttgatattgttgtaacgaaaggctgtggagatacaagtataccacctaagttgagataaaaggtgtgaggaccaaaagcagggcatgtgcttcttcacataaattaaaagaaaaaaactcaagttattactaatatgtgattaataaacacaaggacaatgagaccatctgggctggtccaacatatttttggattcctcaagcaaagttgaaaaaaaaaaacttttctgaattttttaatcagaatttcactatcaaaagtcataattgtaaaaaacaaatcctgaaatattctttattccatttccaatatatattgctgtcacaaagaaatctacaaaaatatttgttataacttaaaagaatgcccaacaatttagcctataatcatatatgcttcttggacaaaaaaaaatcttggaacaacaatgctaattaaatttttctttttttttttcttacacagagctaattaactttttcttttttgttgactgtggttaacataattccagggtgatggtatattcaatgtcgcagtatattcaatgttgcatggtgtgtgaatagttgtactataatattccctcttttcatttttatttgatattttaggaaaaatacacatattaaaaaaaatatattaaaattgatattaaatatattatttttttgtgttttacaattttttattattttaaaccaatgattgaactattaaaatttacaatttattaataataactaataaatattgaatagaaaatttacaaaatcaatctttttaaaacaaatatttttccaaaaaaatcaaataaaaaggaacagaaaaaatataatatgacagttcgaaagtataattcaaatctgtaattgttacggttttgttattcttctttcttgtcgttgtttgtgacaaaattgtaatcaaatatattgtatatctcacaatggtgtgactttttaataccatatttttttgtaacgattgtatcactacaatttactacttgtcacaaattcatgacaatagtttttactgttacaaatatgtttctattgagacaaaatattttgtatcaataaaattactttttctgcagtaattaataaatagactgtctgaaattcacaaaattattattcctgcatttaataaaagtaaaaaagggtaacaaaacatcactttcatggtcacaaagatcctaaaagttaatctcaaacctaaccatctcattctcacgagtccaactataaaatcattgaatagcttccaccaaattcactgtgctctcttcttca

SEQ ID NO: 2869 - DNA, 2000 bp, Arabidopsis thaliana
tcagaaacctggttgagaaaaagaattagagtccacctaaacatatacaaaattcagtattatatagtatatttaataaaaatagatatgtgcgtttcagttacaacatatatatgtgttccctaggagtgaaaagatgtcttttgaattgattttcataataattctacgacatagggaattgaaaatttgtagtggcatcaaccgataaactgacttttatataatctaacgtaaattggttaaacacagagagcatctttacactttttttttttttttaaaccaaataaattaacaatgaccagtattgtcggaaaaaataaaactatccattaaaattaagatgcagaaacccccaaaactaaacctagggacagaacatattatatatatgtcaaagggggattattaaaactcaagaacaaatcgatggccaaagtcatgcatgtggcatcattatggacagaagttacacaaaactctcaaacatacatcaatggattgtaaaacgttaatgatgacacgtggaagaagctcgtgaggtgagacccactatagtcattatattttgggatactgattttgcagtgagccttgtgatgcaaaacagaaagcatcacatgatcgttagtatgtacagtcgcagaatgtctaatgaattaaaatgcatttatttattttttaagtgatcatttgaaatttaaacgtgtttgacgtaaaacatcctagttgtgactaaagacaaaaacacaaaacaaaaataaagtgatagttttgcataaataatcgatttcttttgttggaataacacgatagacatacaaaagtggagtcaatgggtcgaaaaatggacgtgaagccataaacgatggccatcaaaacataaaatagttgcgttaaactaaatctaaacgaatgtgatgaagcattattgatgggttacactatacatgaaagatcataaaactaacggtgttggttcgtaaagtgcacgtgaaaatgaatgtatacccttatttatatttcaacgattgaattttcaattactatttaccaaccaatttaactcaccacctattatgaccatgtggcgaggaccagctctataagctaaaagtcagagtcaaccaattaaagtgcctctaatttcaatatctcaaaatccctacgcatagcaatagacataccgtatgtgacatacctattaacgtatatatatatatagctaggctatttacatatcacaagctggaagataaattaatttcatctgatatgttgttttatatcaacaagttttatctaatctattatagagacctagatttttttttttttttaatctattatagagaccaaaaaccgtgatgccatgcttcattttgtttgtaatggtgatatagtaagtaaaaaaaaactccaaatataaagcgaattttgttttgtttttagtgacataatgcgttttgtttttatcatagttatgtttaatttactagcattattaatcggtaacggtcacaaataaagagatggtggtaactaggtaaattatatttggtgaaatactatatgacaaaaaaaaaaggttaatacatagtagtatttgataagagggacattttggtaaatatctcaaaatattggtcagtttattaaataggaactagagagacggttaagaagtcgttctgatttcgtctttcttctctgtaaagtcgtttctctctccaatttttttgttttcctgcgaaaatcaaagagactaacacagagagcttattcaattttctttcgatctgtgaaatctcagattttgatttggaaagttgtggagatttcagctgttcttctttgttgttgggtctatttctgggtttcttcgagctgatttatagagtttggttctccgatgatagagctaatctgcttgagatagctactgtattgagagttcttctgaggatctttatttttctttacatcttgtgaggaaa

SEQ ID NO: 2870 - DNA, 2000 bp, Arabidopsis thaliana
aaagcacgaagtgcattttaatgactttaataaaaaaaaaagtattctaataccttgctcaaaactttaaatattataatattccaatcgtctttactagcatatatccatcattttcatatatttcctttactcacctcattttctacttattaacacaacaataagagacaaagcggcattcctggtgaatatccacgatactacattcatttaaaacaatttcgtcaaagtttacatcaacttcacattaatcccaaaatagtccaaagacccaacaaaaaataaaaactgagttctaagaagacatgggcttgttaatatcattttcatgggaatagatagcgccagtttagtttttttagaagctgttttcatataaaattcagagaagaattgttgaacatagtcaatcttaatgctgaatgcaaatccttgatgcacaacatttctcttaagataggttctttaaggaatgacattctgaaatccaatccaataacattacccctatgtccgcttgtgtccagcatccgtacgtcggtttctacagcagtggttggctggcttatgtctagggtttcaccgttcgtctcctgtatcttgtctagggtttattttgttttggttttggtgaagtggtgttgtagatctgtgaaagtttcgacaccggtccctttggtgatgatcaataatgtgctcaagccatcgataatctaaagttacaataagttcaagctttttttttggaagaaaaaccttgtgttatagctttgagtaaaccggtaaatgtccctcaagtctccttccgagaaccgaattctctaatcatttttcagtgctttttattaagttcaagaacccacatgtcgcgatttgattgtagccaattctgataagaacatgcattctagaattagagcaaatcaacaagtgtaaaattgtaaaatcatctctatatttgcaacagaaattacctaaatgtatctcataacgtttaaaatacaaactttatgataaaatgtacaaatgcgtcaacaaatgtgaaataatcaaataaaaataggtattgggagggtcacggtccacgttcaggttcacgtcttaattttacggcttattatacaaaaccataaccaaaatgttcttatctcactttcctttctattcccggatttgccgctttcttcttcttcatcatctctctctcaaaatcaccccttttaaagttgtttcctttatacgcaaaagtgaacgcagatcttaatgcagctactgtgatttcgattcttagggtaaatatattcttttactcattggattggcactcctcagcatctgggtttttgcaaaggtataatttttattgtctctttcgattggatttgattgatctgccgattctctgtttctcccgagctttgtgggttaagatctcgattatctatctgggaatctttagattttgtgttcatcggagctgttaatcgttggactcgctagtgttcttctcttgtaaaaactttgtggaggagaatctgattgtaggtatagtgtgaagtgagtttgagctgaattctgtagctttacatggaagtttttggttgatgataacgtcttgtactttgataccatatctgaccatagtcgccagattcttaatcggatctagttcgagttataagactcttcaatagtctctccttaggttcttatgtttttattgtgtgttgatctggtttctctgatcaaggattcagcttttagctccctttattggtcatataagaatagatctgtttgattggtttcttaactgagcaattgtgtagcagattaggtgcttatcattatctttgtttttgttctgtgtatttgaatatctcattaggatcttggcatctcctattgatcatgatatcttgttctccgaagtttgtttggttttgtaacagattttatgtttatgcagcattcttattacttccactgattcaaac

SEQ ID NO: 2871 - DNA, 2000 bp, Arabidopsis thaliana
ctattttatttagtgttggtggtaattgatttttaattagtttcatagatttctgcagacaaattctggctttcatgtttttctttttgcttttttttttaataataattcgcattacaaatatatcattaatttttctttctcttttgtcgttacgtgaaaatagatttgctgtgtgttttttttctcccgacaaatatagacttagagcatttccatcgcgagtttctggattctggtctattaaaacagaacaaaaaattcaaaaaatgtggagagaaagtaaaaacgtttctcacttgagaaactcatttttgcttttgttttgttttgattggttcaaataataattaaaaaaataaataataaaataataataaaatttatattattttataaaaatgggtttctcaccgatggagatggtcttactgttttactgaagaagatttaataaagttctcgcttcttttttcctctgagcttaactttttactttttgtgataataaaaagaagaaaacaaagaaaaagttttgttttcctctaaaacaaagaatagttttatctgcaatctttgtaaaagaaactgtactttgttttttttttcaatttctttcctcctaagaaatcacagtactaaacaaaaccaaaagaaaaaaaaaaaaaatttaggcaggtcaatttttaagctggtctgtttttgtgtgagctttaattttctgtctttgaaatatctttatctaccacgacagtttataaaatttgaaagggaaatttatttggtattaggtttctaagaacttcaataaagctatattttcaattacttgttattaaatgcaaaaaaaaatctaaatggatgtttaggtataactgcaacaaaatttatggaaaaaacaagacttgatgaatgtataatctcaagagttattttaagcataaatttaaatctaaattttctatttaaaattatttgatgaatttttctatttttaattatgataaatgcaagattcatagtatctaaatttaatacagtatatgattaggcttttcattaaacaatataaatattttttttatcttgacataatgatgagtaaataatttaccaactaaatacatataatttttgatcaataccattcaaaagaagaaaaaacactttctcttacttatctttgaattaattttgaaatatttcattaagaaaaattaattgtttaaaatattgctttgattaatgtagacactctagaaaactttttaaaggttagggaaaaaatgttaccaaaaaaaagttaggaaaaaaatgtaaaaataaagaaaagaatcttcttcccctaatagaatccaaacaaatgtatcgcttaccatcaagttgcacaaacactcaaaacgctttttgatgatttttcttctataaaatctttctcctcaaccatttcaaagccccctcttctctccttctctcccttttctctctctctcgaagatatcgcctttaattccttcttcttcttctgatttcttcaaagattcatttcttagagatctcagcttctgtaagagtaggctagctaccaaaaaaaaagaaatagaaaaaaacattgatgcttaatcagcagttcttggtgtttgagacacatgtctccaataatactcagtgagatctttctctctgggtttatgttaaattccacaatcaggcgcaggacccatcttgttcaatctttctctgttgtcttcctttactggctttactatgtctcatgatctctgaacttatctccagttttatatctatacgcataattacaacaaaaccctagtttcttttcaaatttctcttcttcgtttttcgtcatctgggtcctgtcctgttctgttgtgtcttgttctgttctgtttttaattcccctaaaaacccattttaaaatattttatctctcttctcttaaaaaaaactcttccctgtttttgtttgtgtgttactaa

SEQ ID NO: 2872 - DNA, 518 bp, Arabidopsis thaliana
agctcaagaagttgcttagaagatcttatttttgtttgtgcttgcttgcttcagctaatattatggcttgtggaaactgtgatctagcgtgtagaagacaaacgattcccaatttacttgtctatgctttgagccaattactacgcttgcgttgaaagttaaccgtatttttttgttcttttcccccagatcatctgaactatagtctgaattgtgaaaatttcatatcgtttaacaatttaggtttacagttatttgtaaaaccaattcccaaaatgattagtaaaaaaaactcaaaatctctagactctaaataggctaaatatcttaatggatataaaagagcttaatgggcttataggcccattagagacggcaccactctaaataaacccctctttcttcaccgtccgttctaacttctagaaaaatcgccagaagtgacgaaattgaaaatctcagatttctcttaatcggcgacggagtaacgaaacaaggagaagaagaagaagaagaaa

SEQ ID NO: 2873 - DNA, 1931 bp, Arabidopsis thaliana
tttcgattccaaaacactaagctagaaactacacaaactttagaactcaggatcagttttctgaatcaataatggcgaaatcaagttctgaacaatacgaattacagatttgttcgcttagtctaacgtaaacacgagatttgacaacaaattctagttcggttcacagagttgagatcgatcatgactaataacatacagatccagaaactataggagatttagaagagaaacggagcaaagtagacgaacctgagacgaatcttcaacgacgatcgaatttctggagattttgattcttctttgttgaatcagtgtttgcagagagagagagagagagactttgtacagctaagaatggtctgtggggttaaaagagtagagagagagatttgaggaaggagatggacggaaataattgacggcgttagatttttgtggaatctaagtttgtgaccggtgttgacgacgtcgacggctgtggtctgtctcgttgacggcaaaatgagacaatagtcgacttacttatctacgctatttgcctatttataattttataattattttttcttttaaacaaataaaaaaatattagtaaactaaaacaaaatttaatacatagtaggtagatatttttttatattgatttgtattacgaaaaatagattaattagtatttaactaaaaataaatgatttgagtaaacattaagaaccttttttatacgattttaggtaaataagattaatttgattaaaaatcgaatgaagacacgtccaaatttatgatatttgtttattagttcatttaatatgtttaatagatattttgtaaatgaagatctttgtttttattaagccatatgaatttaaaatttggataattaaatttaattttaaatagttaaaaatttgatataaaatttaagtcgaattgtaagatgatttatacaattgtggggtattctatattataattgattattatagaagacaacgactaagtgttacttataattttttaatttatttttatcacataattgggtagttttaaaaaaactcaaaacaaatttgataactgaaaatatttaaaaatatcgatgagaagtagttaccaaattttgaaataaacaaatatttttgaaggtagttgtgaacttgtgatctcgcaacaatcattacgagatccagtgtcgacgaacaaagactaactcaatctcttcaccccactgaatctcctcacctataatctccaggatggagaatagattagaaaaatattattcaagattttgtgcactatttaatactttggagattgatgatgtgattttgtattcgtggttcatataattttagtttttactttttcaccgattatgaaaattttaaaccaaaaactcacatatatgcgaatccttatctagttagacatatatattgtctaaagtaatattgtaaaccgcatatgtgttaattgcgatttaatattgttgtaaggaataagccatttgttagattggttattataattagtttccaattggctattaattcaggattttcactattaaataaatcatcttaaaatcttcttattttaatgctgattttcgaacatgttttttttttttctgtcaaataaaaataatttaaaatcaattacatggactcaaccgctcgaatcaaatggaccgagacaaaggcaacaaaagtgactttacggtctaaagaaacctctgaagcagaaagagtgtttcacttaccatctctatctccgtcgctgatgactgtatcttcttcaccactatgatcatcatcaaaactttgtctcatcgcatctttttccccaaattctcacaaaccttctcttctcaattccaccaaaccctcagattctcaatctccgatcgtcggaaattctcagcg

SEQ ID NO: 2874 - DNA, 2000 bp, Arabidopsis thaliana
tctaaagttgaacgaagcaacagtcgacacgtgttaagttaaccctcatgcaattagatcttctctctggcgctacaactgcataatctgagatctaacaatgtataccaataagagaagaccatgtggataataatgacacgtcaacgattgtaatctcatgtctgatgttggtccgtttaccggttagatgagtgagttgtcctgctatgtgccaacgtgtcccaatgtctcgctgacaagcttttgatcgtagtgcttttgagatattttgctcgagaaaaaatctataagaaaatctatttcaaatttgcatccaaatgattgaaagtgcatgaccttaaaatcaaattttactaatgacaaattttcatagtaacgattcagtctacgtacaaccggaatccgttaagtcttacattcctcaggtttatactaacgacactataatacaaagaagtacttcatgatgagtaataataaaaatttagtgatcggtgtttgtttttgcatgtgtcaagcttcttatcttctattaacaggtaaacatgaaccatcatagatcatgcaagtgtgaattcatactctcaaacaattaagcacatgataaatctattcaaaaaataattcaaaataccatagggaaataagaaagcatgcatgtgagaataatttatatatagctggaagcggcgaatataaagagtaaatgtgggcatgttcttgagtcgtggtttcctgatgcggttgatgcattgccattctaacatagcaaaattccaaatgatcagaaaaacagatccacacaccatgtggacgtggttcttccctctccgatagagtttcctttcactaaattgttttcttttctttctttttaaccacatattaaatagaaatttattctttgattgcgctaccaatcaggaaaaataaattttaaatcaaaaattttataacttaaaaatctagaaattttggcaaactaattggcatagagattacaagagcgaaaaatatttgaaagcttaactcggaaaaaaatcaaattcatcgagaaagttggaaaaaacatgttatcaattctctggagatttcatcatggagactaactctatacaatcgatttcgaaaattttacagtttatctttttgagaaaatattcttcatagtccgtattcaaacttccgtctccgagtcaagaggtgagaaacctctcctatgacatttagtttcttaaaataacacatgtacattttcttgatgaacataaagcccttttttcttttctttttaacataaaagatttaaaatatgaatgtctaagtcttataagaagtcatgttttaaagtggatgtgaaaattgagttcatgtgtatactaaaaatatgaagctctactttatgtgtgaatcttttataagtacaagtttcttagtataactacctctagtgaaagaaacaaattataacaaaataaaaaatataatgtttttatttaatttttacttttcaaaacttaatagttaataatagtatataatgtttcatttcattattataataataagttatttgggaagaaatttggacattttatgtactaccatttctgctctttcatatagagaataaaatgataatttattgattattttttatgatatattttttgtaaaatttaaaactaatagatttattttaatacatatcaaaatctccattatttctcatattttcaattagtttataaaaggataatgaatcgattcattgtactatagttacaaacttgacctaaccatggttaactctggtatatatgaatgactcacgttttaacggctctttactcatctagttgtcctctgttttgccctttcactcccctagactcctactttctctgatacaattttttgtttgtttcttgtgtaatttaaagattctctataaccttaatagcattcataaaccggattggatccattgtgagaga

SEQ ID NO: 2875 - DNA, 2000 bp, Arabidopsis thaliana
ggagaaaggttagacaacaattggttagacatcaaaccggcgaccaaaccgaggaaagagacacaaccccagtatatataaaaaaaaagttcttctattactttcttttgttgcagcaaataaataagaatcttcgtgctctgtttcatcctttcaaggatcacagtatctcacgtttccatggttttcctttatgcactatgcttcaatgtatgtaggaacttgtgatttcaaaatccctatttaaagaaaataaaatgaaagccggagaaatatgtctaaacaaatcgtgtgtttttgttcttgtccatagtttaattgagatggagctagtgctttagcttgtccatcgttcatctgttggagctccttttgcattgcgccaacgctagcctccaaagctttgcttctttcattgttgctagccaagtagccatgctggacactaccaaagtggtctgagccaagactttctaccttttgtttttcctagtctagacaaaaactttgcaaataaagtatattagtaggctgaaattttccttgttcatttatttcatcattctacacaaactaaaaaaaaataaaaaaaataaaaataaaataaaaaaattaggaggtttagtaaataaaacggacaatgaaaaaaaacacagaagagaatgatttatatatgttaatagtactaaggaactttggatccaacaggaaaacgtaaactgtggaacaccacgatcaagtactaaggggttaatcctttttgactcctcaagcgcaccatgaacactttgatggaaacaataagcaactcaagagattagaagatgggaaagttttatcactatatcaatgtatatttgttaccaactcacatagttaagcaatccgaagattgtgcgacggaagtgatgggccacacgaaggatcaatgaacactttgcatgagacgatggcacaatctcactgttcggaatatcagcatgatcatctaccatctttaaaatctaggatttgcttaagtgatttttttctttcttaacacttcgccaaatggatctatagatctaaggtttcttcttcttcctccaaggattatatgtgggttttagtacttctcaagttatctcgaatctggttagttttactaacttactattttactagcaaggaaaagtccaataatacgacttgtgtagccaaaaaaaaaaacacgacttgtgtaaatctggaaatgacgataataccctcgtaaaacctaaaactgtgaggagagaagaaggtgccctttttgtcccagcaagaataaatcacgtcggccttctttgcccttctcctttgtccagattttcttcttcaacctctttctctttgcttacccgccaaattccttatctttgaaattgcctcatccctttcgcgtttggtgattctgaagattccgcttcatatccttttgatctgtaagtttcgatttccgatctccttcgtttgtttcctgtcaaatttggttagaaattgttccgagcattgaattttctcgtacatgatctctgtttttaatctgtgtttgtttgatcaagttgtgaaatttcgaattgggttttggtggctcaagggtgttttgttcgttagctaaatccccaacagagagctttcaatttcagagatggtggtagttgtaaaacttaggctaaaacattaatctctgctcttaactagtgttggtttggatttttgttagaaacaatgattggagcataagtttttatagaagaatgcttccaagttagttgcttttgtgctatatcttgagggcttatggttatacaacttatagctcttttatttgttttttgttctcacttttctgtcaaggtcttatgttagtgttcatactttgttttcttctttacaggtctataaaagacactactggttgaattagaatctgtaagagatattagtgtttttgttggccaatattttgttactgtgatgaa

SEQ ID NO: 2876 - DNA, 2000 bp, Arabidopsis thaliana
ccctaagcaactaaatcttttttattcttaacttgtttgaatcatggttaatgccacgttgtatattgacagactaaaagtttaagcagatatagtttggttagcgattgtatcagccgcaaacaagccaaatacacagagcagagcagcaacattgtactactaagtttcaaaaccaacaaagacactaatttatgtgacaagtagagagatacagtgagattgagaacttacagacaagtccagtattatcaatgttgtatcgattagatatctcgaagtcattgagatcactacaattatccactctttgtctgcatatattttaaagaagctcttaggagtggcaaatctatcgaacaaaacataacattgtttcatttgatgaaaacttcagatcaaaatcctaacgttagatagagtttgggagagccagtgatgggaagtgtgtagcaaacggatgcttcacgagacttatccgattgaggagaagagtccaccacttgacaaggaatcaagttgaatccttgagttgctttccttgaaatccgtttggtctcagtttgagattgagaatctgaggaaaattgaaagatgatccattagctatgcgaatgtgtgaaatcgaaaagtggatgcaggaaggagaaggagtaggggagtatcaaccagatctacggagaagcgcttggcgaagaattttccatctaagagcagaggaagaagaagaagtgggatccattgaagaatcgttatagctttctccgccggaatctgaaatttctcttgcagactaaacagcaaaacagggaagatgacgatttcgcttcccggcgaactttagtttggtttttttgcctttttaacacagtactttttgggggtcaaacaaagtacagtgaaaattaaattgtcaactgtaaagtacagtaacatttagattctgatctcactgatgttaattattttaaaattgaggacttgttttgtaatttaatattaaaagtgacacaagatgacaacacaactgctataactcaaaagtcaaatgacaattgtcaagggataaaagctgtatgttagaaataaatcttattcactctttagatttggtgcacaattttttttaaaatctatagattttcttaatcttacttatttatacagttttaattactctaaaaactctattgattttttttttgacatctaaaactctattatttaattttcaaataattgtacttcatagagtgatatgagattatgcaattgatttcttcttaaacaaaatagaaaataacatgtgacagaatattatgtttttagtagacatatatttttatacaaaaaatagtataagtgttatatccctttaaatcttattcttatttttatacaagaaaaaattttcatcatcataattgattataccttttaatcattttttttgccttttatgttttctaatagaaaaaaaaaccaaagttttcctccatggtttaggtaagatcctactgttaaatagaatttcatttggcaaaacaaagtcaatacagattaccattatcatagtcaattacacatcttaattacttgaataattcttgtttagtgtgacactaaaaaaggtggcaaaacaataaacaaatgtacaatatacactcaacaaaaagaaattttggatataaacaaatttaatatttggataaagcgcgggaaaatctcctaaaatagttaaaaaaaaggttaaaccggcccggttcatagtcaaaaagtatgctcctcttgaaacacgcaacgcccacgtcttcctatctccgagactccgacagcaaggttacttaacagttaatcaaactagattcgctttcttccatcactaatcttctgactttttctatttctgccccaaatctttttcaaattcatataaataaccaaacacttgttcttcttcattcccccttcgtcttcctcctcctaaatcaccggcgata

SEQ ID NO: 2877 - DNA, 2000 bp, Arabidopsis thaliana
catatatgcatgtgtttgaagtttgaactgatacatagaccactttaaactttctttcccaagtcaaatttattttgagtttattagcaatcacagtctcccaatttcgtcaaatatgatatgaagttgtattgatcttaaattccgttatcaattatatagtttaaaaacagaagttgttagaaaacaattcataaatttttgatccattcagcataacaaaggaagatatcagaaaagttttcattttcttatattcattcattttcatcttctctttatttgctcatgtaaatttcaaatacttttcttgatagttacaaaaagttttgtagttggaacgaatataaaaacgcaagcaatctaattagcttatgctgccgacgtgtttgtcccaagaaaaagacaaagtcagtcgtttcacgtcacttattttgtcaacaataaatcaataatactgttaaccaatattgttatagttagtcacgtataaacttgcaagagtcaaataacaatcactctttaggagaacagatttggatggaatatatggtcctatcccatactttttctttaatattggaattatgtgtatcgccctaattaacccccgaacccagagacttcaggctagctatgatgaaaatgatattcatggtgtaaataattctttttttttgtttgtgaataaaaagtttagttgaataacgaatcctatcaagatcatgtgttatctgctgagaaaagctcaggaccaccatgccctttttcatcaaccgccttattctttcaacctctacgctacacccacaccaaaaggaaaattctcgaaatatagattttttcatgccacaaacatatatgtatatttaattctccctttgagacgtatgataatgggatgataatcttattggtatatatataatattcacaacagtgtaaaaatcaccagaaaggcaaaaggcaaaattttggaatattatagatttctagcacgaattagtagtttagtacacatcattttctttagtggtgtcagatttggtgtcctaacatcgcatttgttacttctatcaattattatgaaatattttcaatcaaatgaatattaattttctttttttaacactatgaatattaatttttactccaagaaaaatcaagagattttttaatatacaataactaattaattggcaactatatcaatctcatttgcatattgttacaatatacttttaaattatcttgaatttagtaaacacatgtatatataatataatttttgaaaagataaatataaatgtgtctcattatgcacctttaaaaactaacaaagcaccaattataaatgaatttttagttttttccgcagaaagaaatatatatctttactagaaaaatttgaaaaattaggtgggtgtctgtgaaaatatgagtcataaagacaagaaataagaaagacatgagatttgattaaatgaaaaaaaaaaaaaaaaggcatacgattgttatcaaaattacacatcataataaattagttaggttttaataaaaaacggtattgatagggatagttgggtaaaatccaagaaatgtcagcccagagttggtataagtataaaccggaacggttaagagttcgttcttatttcttcttcttcaacgacccctcctcttccactcttacgtcaaaaatacagagccagagaaagagaaagaaagagaccaagaatctatttaattccatctcttattatacaatacgaaactacagagcaccacttctctttcaatttctctcggactaattgaaaaatctcaactttattgttattaggaggctctgaagattgatgagctacttctttttgatgtatctgaatttaacctgatttttggttatgattaatcttatggagttgattggattaaattagctacttttactcctgaggaatctctattcttcctctggtagctgaagagaataaata

SEQ ID NO: 2878 - DNA, 2000 bp, Arabidopsis thaliana
ttaatcagacaacagatacttattagggtttatgaaactgaatcctttagacccaagttctacttcataaactgaatccgaatatctccactctctctgcgacgacaatggaggaaagtggatcaaagagagaatcttcttcttcttgcttttgctcatttctctactttccaaatctaacccttcttcttctccattaacgagcggtaaattcttatttaccacaattacatttcactagtgggctacattagtgagagttaagcccattaataaaagcccacctgaccaataattatacttttggtcaattgcttccaagttcattagtttccgtaagtgttttcatttttcaatgcaacactcttatgtgttgcagccttgcagcaccaagtgataatagagattatggatctttcaggtgacttgaatcatatgataaactctaaagtactttaaaagaaaaacattcgttatctgtctcgaaatatttctatgttcaggtactaatttttcacagcatctggttttacgtgtccagtttcttaaggtacgcgcatggcgtaaactgttgataacatttgctttttattgcttgttggtctactaaagtcaatcactttagtcgctacctagacataaaaagtttagtacttttagtcttttacattgattatcatctccaacaaaaccggatacacatcacatattttatcctttggattaaaccgggatacaaaaaaaaatctaatcggtaaattccattttctcgtgaacaagtatgggagaagagtacataaccaattaaaatatacacttttgttcctttacacagatttttgttttggattctaaagttgcatatattaaatatttggttgctacattctattccaactccagtgggtctttatctatgtgatatagtagcattaaaaattagtaacttgagtttgtcaattaatttggaatctatagagagtatatacaacagtattctgaattctgaatgatagatttttcttaaaaagataggcaatagaaggacaaaatagtcaaaataagctgctgtcattttcaaactagtgattgtttttaagatctgaaggatatacttaagaaaaaaaatctgacacatcaaagtacaaaccccatctttattatttttgcatttcccaaacacagtcaaaccaaaatctttagtttacataataatttatttgatatattattctcttattaattcttgtgcatttgtttgcattttagagattttctaaaaagacactgaactaaaataacctcctaatattttattaaacttcaatgtctcattccggtttgatttctcttccaataaccaaacttggttcattcaatgcaacaatggaaattatgtgaaaaaccccaaaaaaattgaaaaccatttattaaaacagaactagtgttaaaggagagaacaccaaaccatttacattagattacaactagaaactataactggactgaacatcatcattattaaagacacaaactctttatttcattcacattttaacaaaaccctaattatattatattttaaaagttaaattcatcaatattaaagaaaacaaaaacaaaacttaatctcctgaaaactgaaaaccataaaccaaagatttgtttcctcaatttcttcttttatttatataattaaaaatcttcaaaaacacaaaaaaaaaataaaaaaattagacactaactagatcgtccctcgtctgatgaaagaactcaagaaagagagagagagagagagagagagagagagagagagagagagagagagagagagagagagagagagagagagagagttgttagctagctcacacgctttcgcttaaaactcaaaaacctgcactttctcgtctattttctcggcattcgtaaaacagaaaagtgggtctccaagaaaattaccctaaattcacaaagattcatacttttctccacctcca

SEQ ID NO: 2879 - DNA, 1469 bp, Arabidopsis thaliana
tgactctactcagaccaatcgtcaatggctgatttagggatatgtattttattatattgagttctttattctttataatttcaatagctagatatatgttgcacaattattatatatacttcaaaaattgtaatgtatacccaaatttgatgaaaattttactgttttgtaacggttattgctaagtttgaagttaatttttgtaggcaaatgcaatgttttcatatgaatcaaccaagtaactctaccatatcaccaagcaaaatagtatagtttgaagagagagagtaaattaaaaaaaaaaaaaaaccatacataacatattagaaacattaatttcgaataaacagactttaacgatgaaataaaaatttaaattattatccaccggtagatgtagaatgtttattggtatagaaagttgttctatttggtcaaagtttttgttgaccttgcaattacaaattacaaggctgtcaatcgaatgaaaaacatggcaatggaaaagatttgctaataatgccaagacaaacaaacgtttatttggaaggttaaaagccttttagagaagaaaaaaaaagagcagagagtcaactaattaagccatgcatgtgaatcaacaccaatccatagcatattctagtgatcagtgacattaatattgtagattactatattaacccgaattcaaagggcattaaataggtactttaatgaattgaattaagaagagtaatataatcaacggcttagattcgttgcgtgaaaaaaccataaccgaaaacagcggaatccacgaaataagtaagccaaacgcaatctagaccgtacgatgtgaatactttaatgacgccagaatactatggacagtgtagatcaggcgaatgggcgtaatacacgtggcgtaaaatcacgaggatagatatggtgcaacgtagttcaggccggtgtggtacgagagagtctgatgatccgacaaggaatacttctagtccacacaatgtcagcctttctttattttctcggtcgcttcgagattctcaattctgctctgtagaaaagatcctgatggttcacttttaatatccaacggttgatataacacaagcgcatgctcctcttatgagaacggccgtgggatataatttaatctcgccgttaaaaaatgtgacgaccgtgagttaacggtttatctgttaccaacctcatacctgtccctaacggcagaggataacgccgtgagtatggatggatgggagagaaaagaagagagagagtgtgagtgaggaaatgaaaggagtcttttttatttgttatctctcatctctctctctctttctctctgagctttgctttttatcaaacaagcatcatcatcacatccacttccttcttcttcctttctctgtctgtctcttaacccaaatgtggactctttgagccgttattagatctctgccgcttcaata

SEQ ID NO: 2880 - DNA, 1852 bp, Arabidopsis thaliana
tcgaaatcctaagagttgctcattcttggcttgtatgattctgatcacccggttctcttaaagttctgaactttattgtcatctcacgtatgttatggtccggattttgttcgacttttctctaaagaagtcaagctagggacgatgaagaaaccgagaaagtaagtacacgagaaagagacggtctggctcttgacttaggaacttaggaattttggtatcaattcgatatcctctttctaaatctgaaccgaaccaaaattacaaccataccgactaccgagctaattaaactttagttttaaatgcgggcccctttgtatcatatagcccattaaccgatcgaaccgaaccaaaaaatcgaattcgcacgactaaatacagatttgacccgtgcttggttatgcccgctacataccggtcaaataaaaactcatttgggctccaatatttaaatttagaagcccaactcgtaattgaaaagtccaacttgtgaatattattagtttttttttttttttttcatcaaatattaatagtttatagagacatatttcattggttgtaatttacttatcttttggcctatttttagtgaaaaaaatgattagttgattttttaaacgtctgaaacttgtattagtgattaattgaaaataaaagaaaagaaatgtaaattctattactctattggttatctaaatgtaaatgagtcattctccggaattttgttttatgttttttttctctcgactcttgttggatcatttagttctcactgcaagtcttaatcttgtggatagaagaatcttacaaaattcttgtgaaatttagattccaaagaatatactacgaaaaaagatttagtcttcttcctattttttgtttggtcaggattacttaaagtcgtagctccatgtgagtttataaatatcatcttattctttctctttctcaacatatgtcggtacgtctttttcttttcacgtatgtcggtacgtcaaaatgttatagtgctactcttagattgttacattcatatcaacatcagaatacccaacaatactacatacatatatccaactagtcaaatactctataaaaaactaactaaacaattcaacagacaggataaaaagaaatttggtagtctattgagcattttggcttacaagtaaaagatcttgaaacatatcaacgtaaactaataatgcatatttttaccaaaacaaaaaactaataatggatatatactataacattttggcttttggccagttaacaaaaagaaaaagaaaaaaaaagtttagaaatattaaaattatgacgttaggacaaaagaagaaaatatcaaatttatagaaaacaaccactacataaatagtaggtcggccatgggtcggacaaaatagattacttaacaattaacgagcagcaaattagctttgggtatagtaacaaccaatcaatgttccctcagcttcttcttcgtgggctccatttaggccacgtggcattatcacagccttgtattgaattcaacggagatccttcaaccaatcacgagatttcgttagcgctggtagggccctctctcgctaaacacatggggtagtatctaaagtggacctgtcacactgcatcgccatgtcatcatttcgggcatcttcaacttaatacgaacttacgaagctttccccggtggataattaaccgttttattaattagccataatcacggcctcaaagcctatataagttgtttctcaccaacaatcaaatcacttatcaacaactcaaaactgatcatcacaaagaaaagagttttctctgataatctttctcggacaag

SEQ ID NO: 2881 - DNA, 1996 bp, Arabidopsis thaliana
atgtatatgaactggacatttctcaacaaataaaatatacaggaaccgatgctaacacacatacatcatgtaatggttgcattagttttgttctttaatggtaaatcacagaaatacatcaatacagtaagtttatatacataattgaagtattcttcaatggcatcttacttcatgcatccaaaaagtaatttcaaccttacataattcagatgtcgttttctctggctttcaaagattcactcgattctagcaaaggaacatacgtaacatagtgtgacacactagtctatatatacatttttgcaatatttttaacaaataaatcatagagttgagacttatttacaactcaatgctattgacattttattattatcaattaattaatattcctaattattaggatttccttatctaatatatctccatcaattctaattatttaaaaaaagagaaattttaggacattattaatattatactttattaaaccttaccaataaaaaatatatactttattaaaggtaaatattttagttatttaaagtttattaaatattttcacggaaaaaacgtttagaatatttataatatggaaaatctataaaattaaataaacatttgaaagaaaactttttaattgatttaaattataaatcttttaataaagtattattaaaacaaaaaataaaaaataatgtttaattacaccgaactggattagatggtataatgggtttagaatattataatatatgaactttagaacaattaaataaccatttgaaagaaaactttttaattgatttttgaattataaatcttttaataaaagtattattaaaacaaaaaataaaaaataatatttaatttcaccgaactggattagatggtataatgggtttagaatattgtaatatatgaactttagaacaattaaataaccatttgaaagaaaactttttaattgatttttgaattataaatcttttaataaaagtattattaaaacaaaaaataaaaaataatgtttaatttcaccgaatggtatagatggtaggacgggtttagaatattataatatatgaactttagaacaattaaataaccatttgaaagaaaacttttatattgatttgaattatatatcttttcgattaaagtattattaaacaaaaatgacaaaataatatttaattttattgatcgggtttagatggttaggacgggtttgagtcgatagaaatacaagacgatatatcatgggtgaaatccataagatatgtttgatattcactgaacgagattagattgtaggacgggtttgagtcgatagtaatacgagacggtataccacgggcgaaatcatatatataacaatcaaaatacaattatattatcttaaacactatacaaaacaaacaatattaacaaaataaatataatttaaatttaaattatttagttataatctaaattttaacttaatggacggtatgttattgttcctatatctttaaatagtaaaaatcaaacaagtaattatacagtaaataatatataaaaataagagttgtacatttagaaaatataaaacattaaatcatatatattttaatctactaaacaaattaaatttataccgcgggataaaaactagtattatatgttagcgaatcctactaaactatgacaacaaatatacatgcgagtcgtatacagaattgattctcacatttaagctgtcaacaaaacattcaacaagtcttaagcaagccattaaagaagggacctgaacaatttaatatatatggttaactatttaagtatcatgtccccacttgtccattacgtgattactacaaaagttcacataaaagttcctttttatatatataggaaagggaagaagatctcaataacacaaaaccttttaaactagtaaaatacacagattttaggatgagccaatgtgttccaaactgtcacatcg

SEQ ID NO: 2882 - DNA, 695 bp, Arabidopsis thaliana
gagaacaatgaaaagaatcgtctcagtgtgtaactcggaatctgcaaactttgtattgcgaacacatgctttgaataaatccatgtaactatgtaaactctcaatgatcactaatcttttctactagcttaactttttcgtttttgggtaattatatatgaatacacgcaaacaaaagaagtacagaataagatttatgagtctggctgatacacccaaacacatctgtcaaggatcttaaagaatcatatcttctaaatattaattttcatcacattgtgtttttatggcagaagaaagtatgaaacatttaatggttatgagtagaaaatctaaaatttaattaccatacagtcgtgactcttgagaaaatcggaaattttaattaccatatataatcacctcgtttaaactaaattgaaaattttggtattggccgctaaaaacgaggaggaaaaggcataaaacgccgtcgtttgggcattttgactggtcgaataaaaactcttttgactaaaacgtcgacctaaaaaaagaagagagagactagacctctctacaacgcactgtcacagaactcttctttgttgtgcgagagagaaatagaaaaagtgaagagacaagcaccgtgcttttgatcggagatcggaggaatttaggttcgattctccgtaattgtgatattgggagagact

SEQ ID NO: 2883 - DNA, 2000 bp, Arabidopsis thaliana
gtcagtagcagaattgaagaaacagggtttacctgatagaatgaatctacttggaaattgaggaagtttcgcggcggtcgaggatgaggtattatcacttgacctgggttttttttaatagtaatatataaaaatatcacactaacaactttttggtggacgaaaactttttcgaattaaaacgtttcagatctaaacaagttgtcgatataacgtcaccaaaaaaaaaaaaaaaaaagttgtcgatataacgtagatgacgtttttgctatacataaattgttacacttttagctatgtgctgcatttcattatcaccattcaccaacctaagttactttttgtgaagttggatttgaattcatgtcgcacaaatcttaaatattacatacaaattacaaatttaactgaagttaaactacattgcataatatataataactattatatgtatccactggatactccctaacgtatatatacaaaataactttatgggattttagaaaattaatctctcaagatagcataatgacagattgtgataaatttgtcagaaaaatgaaacaaagaggacaaagaagtcggaaagacataaaaaacaaaaagggagtaacaaattagaaaagtttgttctgggtttacgtaatacattttttcgaattatttattcttgttttattatatgtttgttagtgagggaaaaaatgtgaggagaggattgaaacacgactgtagaaagaagacagacaattgaagacagatcttatctctatccctcccacgactactttctttggaaacacaaagctatatatgtgttctcttttataaaaaataaattatcatttcacataaaatagtcagagacaaacaattttcgaaattttatgaacaatacgtagccatttatgagatgtgtcatgcacgtgatgaaaaaactaaataaggaaaggctgtacatagaaatcttcttggttaagagacaaaagatcttttctaggctttggtccatgtatctgcctttcttttcttcttctttttcatatatatgttttttatataatccaataatatctgcaattttatcaaagataaaataggctaccttactatttctggaattatacaatattttctcatgtagaaatatggttttgtgttaatttcacactaaggctgataaatataatgttctaccgtacctgatgaaattgtagggtcacaaagtcaagctgtaacagaaataagtaaatgttattgtaagaaactaaaaactatatatgtatgtcagttaatttgtaatacaaatgtcaatatgtcaaaactaacataattaagattgagataattggatgatttgttgggtggtgaatggagagcacgtgcttgagaagttagtagtaagctatagaaaatgaaggataatgcgataacatgtgccttatcccgacaaaacacatctcacatgtaaatatagatatgtccatacatattatcatagaaagagtaccaaaagtgtgaaatctatacaccctaaaataccactagataacactctttattatttatatagtgatatcaaccacctttcatatgtttctctgttttgcaagtaaactttttacatttatatcaaggatattaaattagttttcatattgttagctttgctgaaacccaaattaatgagtccaatttttaattattctctttacatcaaaattcatatctacaattatattcagaaattactagaaaggcatatcttatacatacttgatgtattatagataaattttctctttcttttgaaacatatatatacagatataaatagaggcagatacatgtaacctagccaaaggagcattggtatctcaaacaatatttgccctttctctatctctctctcatcactatttgccatctctttctctctccctctctttcaaatgtcaataaaccaatactcaagcgatttccactaccattctctc

SEQ ID NO: 2884 - DNA, 2000 bp, Arabidopsis thaliana
attggaaatgttttgttgctttcaaggttacatcagaagaaagaggcttattgacttggttatcacaatcacctaaaattactctactggtttgaattatccatccacttgtgttgattgatttgaatcttcctcattggttgtgttatccctctgtgcttcattaaagacttgagtactatatgattccactatattcacctattcaataagcccctttatgatgtaacccaaatttttctttttgtctcaatatcgtttctactatatgacttgagtactacttgtaaatttttcttttttggtaggccctggtaaagaatgtcactcacaatttattcataaactaaaagaaaaaatatcatatgtgaatgcttctcggtctcgtggacccacgcgtatcatttacaaagagcaaagtaacaatatctggaacataagtagaagaatgaaatcttggcgacaaactaaacgcataattagctaacccatatgctagatagttaattagcttctcgatatacgtgaaaaaaatgaactatccagtctctcgaaagaaagtcatgacacaagcataccagaaaaacattgaattatactcgcttattcctgtcttaattgttattttatcatattctttcaacagatataagacgaaattctaaaaaccaattgttaaattgaccaacacaaaagagctttagtaatagtagagacaaagtgaatatattagttttttgcatgaaaaaaaaaagaaaaagaaaaagaaagttaaaaaaataaacattggggaaagaaaaatattcgtttaggttgaggcatggcgatatgaagacgatttgaccgggaggcttgtgattggtggatttttttcctactgtccgatttctttcttcctgtaggtatgtctatttcgttcgtgttggtccaccggattcccagaaacaagagtagctatcaaactgtcatgatgatgctaaatgtggggaaatatttccaatttagtggagcaaaagtcaatattaaaatgctaacaagagaaacagtgagaagcaagattttgattcacatgaggctaccaagagaccatggtacaaatagtcatagtcttggctgaaaaagtatctatatatacatttttaataaagtttttggttgaaaaatctctcaaatatttactattttcaatattaatcctaacaaaatctatttgacaaaatattgtctttaaaaaaatttacaaatcgactttatcaactaacaatttataattaattatttgtcttaatcttgcacatattaattacgtattatttgagaaaatctaaacaattagaaaagatctatactaaccatatatatgttgttctttgatcacaatattcatttacttgattctaaagcaaattagttattgacttttccgattttgttgctaaattctcgattttatgatacaaatttatctaatcacaactaattaatactaaatattattgttttaatattaaccattcattttatttgtatgtaattaaaagctaatcaaaggcatattctctcttttattcaattatatcctatacgattttcatatatttcttaaacaaaatagcatattcgaatcattaaattattttcccaaaataagattatgttaatcatgcattaattttcggaattgagaaaattgcttgctcacaaagctatttttttattcgaaatcaaaactaaccctaattgtgtatgagctctatctatatcctcactagcaaacaaatatcacaccttcattgtgtcttatgataacctttataacctctcattagcaaagccaacaaaaactcaattgggtgatacattgctaagagagaaaccaaacctcaattaaagtcataaggtataataatgtagatgaagacaaatatagattaggatatggtgttgctggtaaaggtgtgaagcgtctttgcctccttggtaccttgagaaatgtaatg

SEQ ID NO: 2885 - DNA, 825 bp, Arabidopsis thaliana
aatctttataccacagacataaaattcacagttagatctacccgattctttttgaccacgttctcctctcggcgtatatgtaagtaggttttgtacatctagttttcttatatgttatacacagcaatgtgactctaaatttacagtacctctcttctcacgtagaatatatcttcgttattttgaatcactttatatttgtgtgttcctttcctcacaaatagaaacttgaagcaacatattccaaactcaatagtccaatctaataacacaatactgttggttctttaacctatgatgtgtacgttttcccaacattaccatactaatataacaaagcatttcaataagaacacaaattcaaacctattttcgcctataaactatgtactaaaatcataaccaaactatatctccaatagaaacaatgtgtccataaataataaatgctcatatatcgtgggttgttgatgacatagtctttgtccacaagttccttatttagttgatataagcattttcaaaacaaagaaacaaaattcaacttagtgtaacaatgtcaaaaccaaactcttatcttcaataatgagacaaaagaaaccgaagttaagtctataatcaatttctacatagacaatgtggccaaaaataataaatgaacatatatcatgggttgttgagacacccaatttaataaaataaaaacattgaatgtcttattttcttcttctttaaaaaccctttgtacatttactcttcaattcatcctcatttactctctatagtttctctctctttctctaaactttcacctaagatcgatca

SEQ ID NO: 2886 - DNA, 2000 bp, Arabidopsis thaliana
accgatggaaattggtatttgcttaggaaaaatgtttatcagattcgaaccatcttttgggccacatgaatttcaagaaacattttggggtaaagcccaacttttttttctttttcaaacgtatttaaattctttagagcctacacaagattccccaaccagatgacaaaaacatgcaaacgaaaatgctaaacattttgtctgtttatttttgacaaaatgggaagaagttttctcatttaaaagttaaaatgcttttaaaatcgtactctaaaaattggtccaaaataaaataaagatcgtaccctaattttgaggtttagttatgatttctcaccacaatcgcttgtccaaatttatacatgtgaaataatcttatttaccaattatgatttaattaatttaattgttactgaaaaatacattatacaatcactatatgaaactctaaccacaaattaatagcagtgcaggacactaaaattataagtaactagaaaacatttggtacgagtgaaaataactctatgtaatgttcggtccatttgcatgctatagtaggtttatattaataatgtggtttgtgcataataatggattaccaaatggacacttaaacgtaagaagcatcgagtttaggatagtggaccattctcttaaattcttttcacacttgagttcctactttttacgacacgagccgtgagatgtttgcctttgtttttctataatcgaattttatcttgtagattacaaaattatcgagagacttgcttgtgtcttagtttctgattaagtggttataaaaagagactaagaatacttagataaaaagagagagatagatttaagtatgatttctcgaattaacaattttccggtcccttaaatgtaattaggtgctttggtaacgcgtctaggatactagagctttcgtatcacacaataatcaagacaattagtgtgattatttattcaactataaataatacgaggtttaatgcaataattcgagatattttgccacgtaagaaggtggtatctggatacatagctaaatgaaatttgctaatattttatcgtcactttttagtattgcctttctttgtattttccctcgtcaatgtttgctttctctgcttttctgcggatgccattgtatttaatttgtaatttagtatacgtcgctactagctttttcacctgtgaagccaacacaaacatattatctttggggagaatcccaaaaaaaggaaagttgaaaaagagtaatcttttaattttgatttcttaagactcttaaatacttggaactgattgctaactgacaaccaaattatggattttaagatctattatcgatcaaagactcatagttatacgtactaatcaacctacctaacctacctacctcaaataccattgtaagctaaaaaggatgaatcatcgagttaggctctcatttgtcattaagcttcttctttgtttcactagtcattaagcgttgcacattatacgcaactttcattaaatgcagacttcgataaatccggtactaaagactatagagtgtgacaaaaaaaaaaaagagtacaagagtgaaatctcataaaataatacaaagacaaacaaaaattcccaaaacaaacaatttggaaagaaaggtcactgaataatgaaaaaggaaaatgccatctgcacatcatgcaaccattaaaagaaattttttataccaaacttagtttaatgatagaataaatttgtaacgatactataacaaagactcatgggtgtgaaccaaagacaaccacgttctctcaaatactcacacacacactcctatatataagtatctaatctaatcaagaacttaatttctctcacccgaagttaataattcagtcagaaacacacacacacacacacacacacacactcaaaactgaattgacttgtcagaaatggaatctctgttgtgtcggaggaggataaagagagtc

SEQ ID NO: 2887 - DNA, 1296 bp, Arabidopsis thaliana
cggagcatgtatatatttatgactccaatctttattgttttgatgataaacttcagaatttttgggagctctgttctgatcctcaatgttttgatcataaactcccaaaaggtgttttctattctgaatggttttattggattataaagaaacgcaaacctaatcaagaagaccaagttcataattcattgtcataataacttcacaagaaaaaaggaaaacatgagagcattgctgggtgcaagtttgatagataataaaagaaaaagcgatgagaatctgcaacaagggtttttgatgattcctcttctgaagacccaagcttatgaaatcttgttcatagaccactgggggttgcatgtgtttctgtgctgcgcttggattctcctgaagatgggtcagcaccgaatctgtgaggatgatctgtttcttgcatccccttttcctaaaccctaaatcctaaactcccaatcttcaatgagttttgatcataaactcctaaagtttggtgagctctctaatgaagtctcagttagctgagattacagtgacaaagatgtgtaaaatacaatggagctcaaatcattcaaagagattaaaaaagactaaatggatcaatgagtaacaagaacatgcataaaaatagttcattttttgaaaaaactttgcttcaatgggtgtcattatcaaatttgaatccaagtcagattttgagtagcttttacgctaatcttcttcacacaaaaaaaccatcaacacaaaaagatttataatttaaaattttatcggcccaaaatacacacatcaatcttcctctcggcccacgcttttagaatttttgtagatttaaaaattcagttggaatctaacggctgagatcacgtttaatccaacaaaccaagctatatatttactaaaacacccgagagatctgcttcttttgtttactctactctccacgagaagcacacttgttttttgtttatatcaccgcaccaaccgctaatatctttacacgtgtcaaatcttttgcttaaggctaattatgcacagccttctttctcccgttttatccaatactataacgacatgtcattctcaatgacaaatgtatctgacgtgtcggttacctattggattacgtggctgcagatttacacgacgtagcctaaaataaaatccatgagagcaaagctcacttgctagctcctctcctcgcggtatatataagctccaggtcttgtacatcttcatcatctgatctcggggaagctccgatctgagttttttttagca

SEQ ID NO: 2888 - DNA, 2000 bp, Arabidopsis thaliana
acaatatactgattttggatttttggttatctagttatgtatgattgatcattttatttgaatcactatgaatagggaatgactaagtcattgtaaaatgcgtacaagcaataaatagaaaatcgtttgtgcttgtaattctactatttgacagatagattttcttattttgcataatagcaggatgaggagacaaattccatgttgagtaatttatttatatatattgtagatggtaacatatacaagaggatgattttcatcaccaacatcttgcatcttcgagttgcatgattatttcctcgttcttatgggtgttggcaagtaggtctgatgtatatatatcaagtaaaaatatgttattttcagtgagagaatttgaatttgacttatagttttgacttagagtaatattcaaaattagaatgaaatgaagttttttctttccttttcttaactggactgaaaatttatgatgtatatatgatgatcattttcttttacttttgtcaaataaattgtgaaataacaaaacataaattaaattatcaataactaattgacagaatcgcaaaatcagtttatcgttctaattcatggattaccaaccacaacctaaagatacgtatatgattttggtcctttttggattataaatcaactttgttaattttgggaaggaagaagattaacctgatcatttttctgtcaaattatcttgatcattatgaggttgcttcttcgataataccggttggccttggccagctaatataattacaataagttatctttggattcttccataatagggaaaaaatattcctcatagtttaacaaatcaataaaaacctttaaatcaaatgtttggtaagaaaagtatacattatatataatttaactaaagttagaaaatattcccaaactcattaagaagtgaaactaaaataaaataagtttaaaatgatagtactttctctttatgtacgaaaaacaacacaatatacgattaattacttccaagttgtaatagttgaggttataatacctttcttttttcggaaaagggttaaagttgaggttataataattcgtgccacaaaaaatcttgtatcaagtaacaagaaaataaatcaatctttatctctctcgtatcttgtgaaattaattgataattgataacaaaaaatcagaaagaaatacttcggtcggtggctactactacctacttttcttttagtgatcttagcccaataacccccatgcgagcttgttatttctttcactaattgaaaagttcttttttttgtcaagtattaatttacaaactatatatctatcgaaattcggatttatctagacttattatgaacaaaatacttactttcaatggtaacgttttaattttttaaaaaaattcagatttatgcttacaaaacgttcatatataccgtcttcttcttactgttcaatgtcttgattgattttttggtgaaagtaaactatggaattacatgtctttttaaaaacttatggagttatacacacgcatgcattttcattaatacaacactaatttcgttataataaaatgcaacagactaggctatattgtgtttggtttggtgtctacgcaaggcatgtgtactcgtcgcatacaaaacgtaaaaatagacagcaaaaaagaagctagctagatacgataatctcaaggctcaaaagcccaaaaattaaattgggccttaaagttccgaacatcatagaacaggccattatacaagatatccctaaaataccctttgccttgtaggatgagtaaattaataaaggaattgactattaaacccttgggtcagagtatatattcacaccaaccccaatgcggagacctcgaagtgaactccattgacgacgagtgaacgaaaggagggaagaaaaaagttaggttcgaaacgaaagtaaactagttaggtgaaaagcgaaacaacacccacagagca

SEQ ID NO: 2889 - DNA, 1082 bp, Arabidopsis thaliana
tggaaggcctttcccacctctcttcaacttcaaacaagaagtagctggagcatcacctgaactagtcaacaagttgatccagaccatatcaaaacacaattaggtctaagtttcttgattcaatctggaacataaagaatctgcacaaagacaataactctttaaatgtaatgtaccattacacgagccacaaggtcatagttgaaggaaaaagtggaggacacacttcgaagtttttcctcctcgaacaagtttgatggtcaaagccagctgcaagcaaaccaacttccccaaatctgcaaaaacaaaaactctcaagttgtatctgcttatttctcttctcttttcaagtttggtgaaaacaatctcatcttttcttgtttcttttacgcatatgtaaatgagtttagtcagaagttttatatagtatttgagcagaaggtgaagaatctagtcaaagtgatcaccaaagtgtttcataagagtttgtgcagttaagggtctttggtttttctttttttcatacagtacttttgaatttttgtcttctattattaccaaattttatgaaatggtttgtttatgactcattttcttacaaaggcaaaatcttaaatacttttttcctgtatttctgcgtaaagattctctcattattcattcattgtccttggtccttaccatattcatcaaaggtagctgagagaagtcagagaatgatgattcttaacatgttgttttaattaaatgtaatagcatgagagggcaacaatccgttgtagtctagctggtcaggatactcggctctcacccaagagacccgggttcgagtcccggcaacggagttttttttataattgttaaccgtaagtcaggggtactttcgtcattaccttatttgaagaaaccctagtgtctttcatataattatcacacactacgcagccgacgcaattcgtgtgccactctatttgctcatctccttcgatttcgaacccctaatcttgagatggtaaagtttcatccttttgatctatggttatcttcgttcctcgttttggggatttaacttactatttacg

SEQ ID NO: 2890 - DNA, 1587 bp, Arabidopsis thaliana
tttttttttcaattttcattctaatttgggtttagtaaattaagttgtgttcacataatgtcaagcacacaacattaattactaattttacgaactaaatgtagttgattctaaataactttaacttttaactgagtttcacgtatcaatgaaatcagaatcaaatttgtattaatcgattttatattatgttggttatatttctttatatgcagaaaatttatcaaaataatgacaaggctcgaccaaaaaaattaaaaattaaaaatattgacaaggcattctcatgcatgtatgtgtatcgttgaattgtcaatattccgccaaccttggttaattttaaatatgatgtatatatattatagaaattaaatatataaaatttgtgcgtctctttgtccattatcgacaccaaatcaatctcttattgtttcttcctcttttctcttagcaaacttatattcgtttttgtttatgtatgttaggaagttaacgtcaaagtaaacctagataaatgttattaccacggtcacccatacaatataatctgacccataaaaaaagttatcatcgaaactcaaaacatgtttgtacctaaataataatatgccaaaatttgtgtcaaaaaacgttgttatgtcacgttttcttctcaacaaaaaagtgaaaacgttatgaatgcatgtgagtttataaatctgtcaataaacgtttcgtacgagaaaaatatatttcctaacgataaatgtatacataaatgatcatatatatatgttaggtatcactagtgggaaaaataattaaacagaagaaaataaacgagcgttgaaatcactcaaagttgccatcaaattggctttgcgtgacaaattaggcgcttattgactttcttaaggtacattactctactttgttaactctatgatacattttcgtcgtttttttatatatcgatcgagtatgaagttttctctaaataattccttacttacatagtcatattacatatactttatatgttgtcagcactttccaattcaaaaattcatttccccataatgacaatgaatacaaaagttataatttatacaaaatataaaaatgcaaagaaaatgtcagtagttgccaaataaaacatcaaagttatttaataagtcataaatagattgattcacaacaagtaataaatacaaaactgaaaataaatttatttctttataaaactagtcatttaattttgtaaagacaacattttataaaagagaaaattgtaattggtcaacaaatgaacgaagatagtaatcaatgtccgtccggttttgaagaatcgtttacttttcaaatctgaaaaacgcctaaaagagagagagaaacaaagtaaatataggggcatcatcgtaataaaagaagaagaacgaggctaaaacagtaacgcaccttcgtctacttaaatacaagcgaaaacccaaatcggttttcactccccgtcctacaggtcgactcagtctccggctagttcgactcggtaaaatcacgattactttctccttccatttatcacgatcgtggatccagaaactctgaaag

SEQ ID NO: 2891 - DNA, 2000 bp, Arabidopsis thaliana
tcttaagtgggttttaaaattttaatattcatttttgttggtgtcgctttatctaaaacgtctcttacaatttcttgcaaaggcacgtcaaaatgcaaagaagccaacaatagctatatgcacgtgatgcgtcaattgtgatccataaatttttggggtcacgaacttacgatacggcggccgacatatatatcactttgtagtggttctatttaaaattcaactcattaccaaaaaaaaaactcaactcttatcttaaaagtatatctcactttatataaagtaaaaaattactatatctccaattgcaactcttattttagtcagacaattgaagaaaaaactcactttttttttttccttgtatatattacttgtttcactttgtattttacatgactcgaagtgttattgaacttcagtattagtctattagaaatgttttcagaaaataaggcacatcgaaatttgatggagaaggcaacaataattatatgcatgtgatgagtaaatgcgatccataaagttctggggttactaaagttactatacggcccataccatatcttgctatatagatttgtaattgatgtattcagaactcaactcttttcttatatctcattttaatttcagtcgactataaattaactaaaatatcactttattaccctttttctacatgatattgtgttacttattacttattagcaaaaataaatattgtgttacttcatatatgacataagtcagaactgttggaggatgaaggccactaccaccgattcacgtggtcgtgagtattgatcgcattattttttctttttcttttgactaagaagatcgcattctttgtcacatgtcaatgttaaactaggtaactacatacgtcatgtaggaagtaggataaattgataacaatattaatttttaactttttccgtccaagaaaaaattaagtatggataatgccataaggaacaacatttttttggtatgctttatacatcaagtaacttcgaccggtcctggcaataaattatagaatttaagtttggatttggaagcaaataatgaagctttttgagctcggccttttctatttttgtttgctatttgttgttggtatgataattagacagaattaaaatgactcgctactttcactaaagagagacttaaattttatggaagatctccttagctgccacagttactcaaggcatagcttttcctcactcaaacctcttcatggattttgatgattatcgaaattaaaatggtattactctcattcatcttctcctacaaatgtgaacctcattcaacattttatgtttcaagccatgatctacttcttattggaagaaaaaaaaactccttgacgcgagcacgactcttttcttacccacaactttgaaagttttccctcctaaaaacgaattacacccactaatatatattctgaatagtacccattcctttttgtatcaagaaatcatttgtacaaaacatagatggagacttgaagtggatgtttttgttaactatataaaaccaagacgtacaacgacaccatagagcgggcctaacataacaggtttttgacaggcctagattccacaaacccaaacaacgcaaagaaaaatattatggtccaaaactaaaacgtcaccgtttttgttgctttcaagtaaaaacaaaaatgaaaactttaattaaaaccctagagaataaaaggtcttccttcttcaccaccttcctccgcagttgcacacaaattcacaaccgcaaaaaatcctctcccggcttaaaaacggtaaatattcatctttttttctctttggatccttaatttttgtgggttatatgaatcggcaactataaatgataaaaatacgatcttttgttgaagttgtgttgggagatttgttctgtgttgattgaatctgttcttatatatgtgacttttgcagagtgataaagaggtgtaacaaaac

SEQ ID NO: 2892 - DNA, 1731 bp, Arabidopsis thaliana
tgatgttttcttcgtccttatccgtagtcgagttctatctcctcaagagattcccaataccatacggtaagatctctaacacacaacatgagatacatttagaagtcgtagcagaataaaaaggaaactgatgattgacctttgtttcattgacagcaatgtacttgatttcggtatcgattcttgccggtttttggggacaatcctttataagaaagctcgtggcgatcctgagaagagcttccataatcgttttcgttctctcaggagtcatttgtgcaagtgctctcacaatgggagtgattgggatagagaagagcataaagatgatacataaccatgaattcatgggattcttaggattctgcagcagtcaatgaatcaaccatctatctgaacaaaaatttcaagtgttttgttttcatttactggacaatttcggttgtccaacaccattattgtgagaagttataaaattagattgttttacttgcagtccaagtcatttgtgctctgttcttggtcaatacatagttgaccatcttcagaaatagagtttgtctaaattgttgtcattgtgttttgcttgtattcaaacgttgtattattatttgcgagacgatagataaaataaaaatggaagtctttttctattcacatcttcaatgtaactacaacaagaaaacagaacatgttttggtaatctttctaattggaggaaggagggcaattgatttggacttggctaagattgttgaacaacaaaggcaactttgagacagttgactaaagaaaaagacatcttcagacaaatctaaccacaacatcgtcttcccacttgagtgattaaattttataagcatttaagtattgtggttccaaaagttttgtcaaccaatgataagagagattgcaatggaatgattcgcggatcatcttggtccatataccattttagccgtgagtttttttcttggaatttatgtatagttttgtgatatattgttcgtggttaaacgtcaaattcgaaacaaacaaaaaatgatgcatgtgagatatggaagtccaagccaaacaacatttggtcctattaagactgtactaactatcattttttatttattagaggccatcaaatctttgtgtaatgggtttttaactaaaacatttctttcatgggccaagacatttaatttcggctaaaaggcccattaaactcctccaaaactagggctcaggcgaattcatctgccttaaatagattcgtaattctagaaaacagattttttagggtttcaagtgaaaagagtaatagcgcggcggagccatggttctcaagtaatcaatctcttctctatatctctcttctccatgcttctctgttcataggtttacattgttgctaatgatccatgtgaatattgctactgttgaaaatgccaatttgctaaaatgagcttcttttggttcaaatctgtttatttcccgatcagaaatgtctgcaaattgtgattttctggtacgagatatggcttgtgttcggcaataactagatcttattgtttcccttcactttgcaacatttttgtttgtaattctgtacattgaattaattgtgtttggtctctgtttcaaatcattgtgactcttgtgaatcgtattgtttctctcattgggcagatatctaattagccatttactagttctgcttttaggacattgtaaaatgag

SEQ ID NO: 2893 - DNA, 1123 bp, Arabidopsis thaliana
ttcaatccaatctaatgcaaatcacttcataaaacctgcagaaaatcaaaacaaaattccaaaacccaaatgcttcaaaactaaatcaaattgatgacaaattcttgtctaacaacgctggtcaacacctaaaatctcaccgtaaattccggaaacaatattaaaactttcacttccaagttaattccacacgaatcgattttaatcactcttgacatagagatacatatacatctagttctggattgtggattgcacgcatgcattcgaatcaaaacttgcttataatcaaatagttacaaactccaattccaaacaagatacgcacaaacaccatgcgagattgaagaagaagaaaaacgaaaagtcaaactattcacaaagaaaaagtaaaactcgatcggggaagatgacaaatttcgcgaaaggatcaaagaaacttacatcaacaaaacaacaaatcagagagattttgattttagctctcgcttcgaattcgaactgttgcttacacgcattcacttaaaacggaatttttttaattaaaagatctcaaaagggagagcaaaaacggattacgaactaataacgttttttgggcaaagcgtattttatcttgaagcagtaaacgccgtttaagttacagtcacgatgactcggtggctgattaaaaccaatactggtaaaccggcttttaactattcccgggtcatttattggggaagctaaatgacacgtgtcagtaaattgttggatttgtttgtcgacataacgtgacagcacgattgaacggagtggtttgctaacgtcattagaacaactcccgcgcgaattggataaaaacgcgttttattggtaagacaagattgtcaccgtccgtatgtaggagacgtgtaaagagaagcagagtgtcgaactaattgggtcatcgaaaagcccattgggcctaaaatagataacaatgagtgtcaattgtaacattcaaaatgtatggggctttatgtacatcttaaggcgtcatatttttttggttttgattattcacacttcagttttctttattttggagttagacacggatctgtgagatctagaagaagaagaagaagaagaagctaagaca

SEQ ID NO: 2894 - DNA, 1372 bp, Arabidopsis thaliana
tgtttttttgggaaagttatttaccgaattctttttgaattcttagagatttaatgaataatcggtgtgcttgtaatgatccaccgttgaatatattgtattaccttaaaaaaaagccatcagatgtatttactatatatatatagtacctttgagaatcaaaataccatgtgaagcattatcattattttgttgcctctgacaagagttttgtagtccactggtcctccacttggaataccgctcacttggttcttaattcaattgactactgaggtttgtagatggtcgttgggactcatactgtcaaaagaacagcaaaaattttgtcacttctccaactcattgggcctttaggctttgtcatagcccaataattctatcttaatcggacaaaccgtgtggtccacttcccttcgtacatattttttacaagttttgtggtcttactttttactttttagcattacatgggataaaaagtgaaagcttgcccagcagctatgcatccatcaaccatcaaaatctgactcacagtactgttttggatgtctgaacttacataaaagattcgatcatcacaagatgattattgtgagttttaatttttttactgttaaagctggcggagatgtttttatatctgttagcattatctcggaaatttgtatatatatatacgacagtctagtggcgggtcagataaaggtggaatgtgtagtctagactttagaatatataaaattactttatgaagtatatttacatacaagacggtaaaatcgagaaatttatatagctagtttgggaagtgtgggtacttagttatccaaatattcactaatttgagtagagatcaaaatggtgatcgggtagattgcaatcttgaaaggatttttagatatatttttacagtttaaagtatttaaacgagtacattctatatttaaaaacaagtgtttaaagtatgaatccgattggagaatctaaattttcttttgtcaaaaacgatggtcaactttgtctgaacaattttcatgagattagttatacaaaatttgtgtaataaaaacggattaacaacaatatatataattagtgttttactcacaacttttgtatatacgataattttcgaaaattctcagtagacatatcttatccaaatcataaatgagccattggttgatctgtataacgaagacacgatttgcagcttaggaccattcaaaaaaaaaaaaaaaaaaaacttaggactttcaaacgaatacagcccaacgacccaaagttaagatcttatatatacacctaaaggatatagaaaatcatctcactctactactcaatctcagtaaacataaagaacacaacc

SEQ ID NO: 2895 - DNA, 2000 bp, Arabidopsis thaliana
gcgacgacttctccgtaacgcggtgtcgagatctaagcttcgtacgtaaactaagctcttggaatttaaatgatatatgtaaacacgaaagatatttctaagttagtttttacaatctaaatttcaaaccgaaatctaaactaatcttcgaaacgtatacaaaaaaactgagtatgtttatcatttaaaacctataagtaactgatatacttcttacataagcttctgtacatctcagttctataatcgattagacaatttgttaggcaaaaattgttagtaccatgtcctaaaagaaaagtcgacgatcgtttcgttatcactaaccacttaggcatgttacatgttcataactaaatagtacaacgattaaataaatatagatatattacacgggatatgagttataagatagttggttcgtgggacctacattaaaagatggtttataataatgatttggactgttaaattctatatttttagcccgtagaaatcattctattcgataaaaacgtaacagagtgatataaagaattaaagatcgatcgaggttgaggttcgaaataacgtggtcaagatatgggaagaatatataattatagaagaatttagaagaatattgataaatgttaatattgaaatttaggaagtttaacattatctttaaatatattatttatatttatgtttatcttaatctctatacaaaagaatgtaagttataatattatctttatgagaatctattacattttttcttataaacactttgtgttctttacttttattaaacttatcggttatcattaatcaacttattatggtatggtaaattagtgcagtaatgcaagacttaccttcaaatcaaaagacaatagttcgagtttttctttcaattttgtttgatatcatactggttttaaataccaaaactactaagattttcacatatgaaaagtttaatctaaaattttagtatgaaatcctccaattatattttagaaatgacaaaaaatattttctcctaagaaaatgttctatttcatgatataaacttcatggtaattatagacttttacattaactataagaaaatacacaacatatgtgtcaatgttttgaatcttaggtacacatatcccaaaactcaactatataaatcaaacataaaatacatcaatgatctaaatatctcctgccacatgaattttttaaaactcttttaacaagaattgactagaaagaaaactctttaaaaaatatgttgactagaaagaaactcgttaacaaaatacataaatggtgtgaaaactaaaatggatccgttaattcagggtacgagaatttaaagagaaacagtgttgaaattacttttaactagataaaaagcaaaatgaagtatcttggatccttcgactacatatctctctcatatgggcggctcgaataaatatcagaaaaataccctcactactcttcaaatttacacaatatgccatcaccgtagaaaacaaataaggaaaaaaaaaagctatcgtagaaggtaaggacttgaagacatcagagaccaaggaccaaaaaaaaaagaaaaagctttgattaccagaagaagaagaaggacaaagtttgagactttggaagatttgaagaaggaagctctaagctggtgaggagagaaaatcaaatccttttctcttagtttccttgattggatcgggaaaatctacaagttgaaagattcgttttttgaaatcatttcgaatctgaacattcgatttcgagtcatgttttgcttgatttgtcttaagctttcgttgaatcgaagaagcgtttatgcttgaaagctcagattttgtgtttactgattagctaagagttagatatgatgagtagctacgttggttcgttcctcccctagagatctccaactgaatcatcttcttcttcaatctacaaaaggaggactttgaaaaagggtcagactcagatcgagagat

SEQ ID NO: 2896 - DNA, 1313 bp, Arabidopsis thaliana
ggcttgaaatgattcttcacacacgaaatctgtgaaatttttagatagaaacccagaaagcgaagctcagtaatgaatctgaagaaagaaatgtaggacgatttcgagagatagtttgcaaaatcgagacacgaacctggagaggtgaagccgctgattctcaaaaccctaacttacgccgcaacaagttttatagtggaaactgaaaccctaagatacttagttgggtctataatgggcctttttaccacaatcatcatctaacccagtaagctttggattgaataaatgggccttttaccataatcgtccatcggacgcataagccataagtgacgaaaaatttcattagaaaaaaatgaaaatgagcataagatcactgattcttttggttgcacaaaaagatacttaaaagataatatgggcttgcaacattgtaaataggcctttgaccaaaatcatcatgtaaaacccaaatagaaagtgagcgtaaatttaagttactagtttatttttaacgtaatggtattggcgtaagaaacatacaaacgtgtcttttgtcttaccatacaaacgtgtcttttggcgtaagaaacatatttgcttcttctcttgtgtctatgacctttctttggttttgccattccaaagtaaattattacagaataaaatttagtcagctttggtttgacttgaaagcatacaatctttgaccaaaccaaagcaaatcgaacaatggctaaccaaaaaacaaaccaattggtcacgaaactaaacaataatcatttacttacgcttgacaataagagaacaacaagcctgctctacatgtctaatattttacgataattgtgaagaagaaagctttagctgaactggcttctaccatttttcaaaggttcttctatatcttgggtcggttgtatctaatacagtttttatactacataatagagtttgagagggcacatatgtgactcataaccatgtcatgtcacggggtcgtttaattgcagttgaatctcaactgtacacgtgtgtatgatgactcctccaatcacgtgcgagatcccaaatccattgagagaacgccacgtggataattagcagagacgtctcttctaaaggctggtccaagtatctctgtggaggaatgtcttactaccacaacagtcgtagtagctagcctcaatctttcttaattaccgattttaccctcgccgtctcttcaaatttcccatttccttaccactctctctctctctcaaaaaaaaaaaaaaaaaaatacaaagtctctctccgccgccggaaaa

SEQ ID NO: 2897 - DNA, 2000 bp, Arabidopsis thaliana
ttgcttccctgattcatttttttttttttggtatttatttgtctctcccccactttatttataagatttaacatcatatcttttccttaatattcatggcaatgatatatcattgtcattttaaaagtaagagtatatactatatagtgtgaacatcattctaccaaaaatgcatatgagaaacaatctttatttcaaatgatcaataaacataacaagtatttttgaatacggaaaactaatctctctattatacaaaaaataacattaaccaacatcaaacttagacatggttttaataaatcactgctttttggggatatataaaataaaaatacacagcattgattgaaaggaacacatgaatgaatgaaataagattttggaaatgatcgatatgtacgaaggtaaaaaaaacagtatacatttgtcgagtctgtgaccgtacacaaaatgtcaggctccataaccttatgcccgatagaaatgtatcattacactctctgattcacatatctgtctccatctcgagattcgtgtttcagatctaatacattaatgtctacgtacttttgttcgtacgtacgaattcgatacgaaacttctttcatgattcgtatcccaattcccaaccttacttacttttctccaaattattagtcattaacaactaaatcaccttataatcaaaactcatatggaaacaatgatgtggacctaatttcggttggaagatattttgtttatctggcttagattttgtcctttgatttagggaatcaaaagaaagtcataaacattaattttgcctgtaaaatcacacatttcagatttgttctcgtatgacctacaaataaagtatatgattacacaatcaatctttagattcaagaactttgtccctacttcattatattcagctaacatttctttttaattctctgtcgtgcgaaaggttgttgacaatataaatgatatatgtacttgtacgcgtaatgctgctaatacattttaatttgggcttcttctgggccttaatatttgggctttaaataagttatctctcccacttacgcatgtaaacacagctctgataattacgctgaggtggcattttttaattggctaatgcattaagagatgcgtggcgagaaatttcccctcctataaaaattgttgaagagtccggtcaactccgaaagtcttcaaatctctccgtcacgaatcgttctctcgtcgtcatcaaaatctgttagccgaatcaggtgagccctttgttatttttgttgtttatgatctggatctctgttgattgaggaaattggtagatctatggatttgttagatgagcgtgtgcgtagatctgaaaatgagatctcgatgttgaatctgaatcgcggctggtatacgattcccgatctggatacgattcaacatgcatagcatctgagaattttacatagaattttgcatgttcaatttttgtctcgctgatttgagaattttaggattgcttcatctaatttagttttgttgactcgatgctgaaattagttttctgcgtttgagagtttcgaatcttccatctcctgaaaatgcagctcaaactcatatagtatatgtcaaattgaaacaagttttttcaattacgtttctaagaactcttgctaaccagaacaggattgtaccaagtaatttacatgattaaacctgaatttgtactgatttgagcttacggataaatggaaacaatgtgatagtagtatataaatttgggtatacgtagttgccttgtgggaagcaaatcttttaccagaggtttctagtatcatatagaatgtatgaccatggaaaactaaacatgagcttaatggtgtttagatgtctcctattatttcatttgcttaataattctctgtttttttttatatatgatcgctcttttgcttccgatttcctaaaggccaaccattattctcagatagagaaaagaagaaaga

SEQ ID NO: 2898 - DNA, 2000 bp, Arabidopsis thaliana
cttgagagccggctgagatctatcgtcgactatcacttctctgattcaattttattttgttttgtataaaatggacaacaatcagacttgttatgtatataataaaaacacccaaaatttgttgttagtctcttcctctttcaatttacttgtccaaaattgaaataaatattatccgacaatccatatttataaatagtgttgatcctagtatttggttctttgctagtctttgtctctggaagtttgttacttgtcgggttatgtctcccttcccttgtttgggctttagcctatgttgatatactcctatgtatgaagactcatgacattggttagctaggcagtaagatgaaggaaaatttagtcctattacaacttgcctgcagccattagaggaagaaaagatatcttgtctgctaaagagagccgagaaaactgcagaaataacaatggtaagaaatgggatcatgaagaatatttgagaaacaggggaaatatttgacttacttgagaatactactgtatagaagaagctcttgaaatacaggaaacttaaccttaaaacacataaacattttcatccttataggtttcttgcttcataagaaacagagaaaaaatatatgagtacctgtaaatcttcccaggttgtgaagggtttgagtccaagttgatcaaccaaggaaaatatgtttccattcggataccaaaacccttgttgcacagatcacatgtattagttgggtaacgtaaaactaaaaggtaattaaatgggttaccttggaacccaacatcaacaggaccatgaccatcgtcaagaactgtgacatcaaatggagttggagatgagaatatcaaagtgaaagtaaccttggttacaaagatgatgagcggcaccaaaagcagcccagctagaacccacgacaaccaccttcttcttcattttttttttggtttaaaacaaccttcttcttcttatctgaggtggctcctccatcgccttgggctatgatacatagtcttctccggcgcacgggaccttgtactattatcagattcaggctcccacaccacaacatctttactgcctcacaatctttcttcttttgtttccttgtgtttaacttgtgagtaagtgatgtgtgggtgccatggccacaaagacatcataaaccaaattttgtctgtatttttttggttacaaagatgatgagccgcaccaagagcagcccagctagaacccacgacaacaaccttcttcttcttatttgaggtggctcctccatcctccatccccttgggacctagtactattatcggattcaggctcccacaccacaacatctttactaccttacaatctttcttcttctgttttgtttccttgtgtttaacttgtgagtaagtgatgtgtgggtaatgccatagccacaaagacatcataaaccaaattttgtctgtatttttttttacctaaaatatattagcattcattctacaattatgcagttgtttctaatacagtatgcttatttttcagtattactcatagattaaaattaacatttacctcacaaacaattatagaaatagaaagacatggaaaaaaaaaaatagaaagacatggaccacaaaataaataatatgtcgaaaacaaaatatccatttgacatacttatcaaatatcaatttattatcaaagattcaaaagtaattgatgtaagtacaaaaaaattgccgaattcttttgcttccacgcttcgaattgtgtattggacccaaatttatgtgtgtgacacaagataatcgttagtataggtctatctaccgtccgccgtttcaatctgacggctatcgtacaagccgtacaatatagactcaatctaacggtggaaatagaaagatcataaatccctcaaatctcacagttacctcaagtttttttttttttttttgttggtggagacgaacaacaacaacaccaacagaagacagaa

SEQ ID NO: 2899 - DNA, 465 bp, Arabidopsis thaliana
taatcgtatcaatataaagttcgtgtacggatcaatattaataattgaagagaatgaaattataaaagatactgctttttatgtttcaagtaaaaatgttaatattagaaagtcaagaaagaggaaacacaatgcaatttgataaggtgttttatcgtctccgggattgaattgcgtaggtcaaaaaaagacatttgccatttgatatcgacatataatcactcattcacggatacgtatctcttgtgaatggtcgtcggtcaattacaactttactgctcggctttaactgacaagtggcgcctcctggtttcattcagaccctaccggtaggatgtaatttggaccataagtaagaaatatttgtgaaatatttactacacgaatatctttacgtatttaagttggcttttgaagctttgataattcactcatttgaaagaaaatatcacttgagaaaaaatt

SEQ ID NO: 2900 - DNA, 2000 bp, Arabidopsis thaliana
tcaatggtgtcagggaaagtggtgataacttctttaatttcgcaagcatgttgtactcggatgggcatagtctcatctttttgtaaggatgatatgagatttgcattaagaaacaatatacactagctaataatattctgcaatacaattttctacgacatatttttatgtaattttattgtttctaaactcaaatctcatagcatcttacaaaacgatgtcatgcatgttaagaaaaaagaaaaaaaagaacttgagcattaatgtggttgcgatatgtcaactattttaagtttttaactaattgtacacttcaaagaataaataggagatatttttttcattcgagtttaatcaaattatgctgtgtagcaaactagcaatcttagatgtaaagattcaattggggtaaactcagtgttttgttctttaatagaaatatatctagaatgaagattttttggtaggaaataattgaataattgttagaggaacaaactgaattagatatagattttgtagaataaattataaaacgttgtaaagttagttttaatttgttttgtctagttattacgttttcaaaacactaaaccgtaaaagctgaatgaatcgcaatcacgtttttcaaaaatgaaaacatgaatgagatatatactctctctatttcttattattttattatttagaaaaaaattgttttaagaaaattaattttttaaattttgtatgcaatattaattggttattaatgatgaatatcaaccttcaaaataaataatttaatattattggtttagaattaataaaaaatataaattacaaaaaataatatattaataatcagtttttgatatatatttttttagtatgtatgttttctctaaaaaaacataaatattaaaaaatagagaaaatactatttatcccgaaaactaattcaaaactagagatgacttattattttaaaatgagggaaaatatcaagatgacgaggacctagactgcgataagtcaaataacattaaatgtttgagcaaattgcaacatcattttagcaaatttcaacgttacagcagtggcatggttcaagcatctaagtatatagtaatacattttgctgacataattcacgaaatttataaaactcaaccttttttttttgaattctatacttaataaagatataactattacatcatttatgaaattcataaagagacgtttatttgagaatgtgatcaagcatgtagaaaactctctttctctttttttttttctttttctgaactgaatatacaatttattcaaccccaaaaaccaacgtttttacatcaagtgcatattttttttttaaaaagataataatacaaagatttagcttcttgtacagtacttcagtatttatctaacatttttatctcataactcgtatcgatgatggcctgtttcgaatttgtttagcgatgtgtttgtcagtttaataagtacaagaaactcatctaagaatctttatgtatacatgacatgacatactatatatgatgcattatggcctatgagctagtaattcacatatatacatatacaagtcggaagcttaccattattatcttctggtcgacgcattcaacatttttatcattcacgcgacaacttatgtggtcaattcttttctatataaataaatacacgatatggatgcaattaacttagatacatttacacttccatgtttatatttacttttcttgtaaaacgattaaagctggtatatgatatcaaaaataaaacaaaaaaaatgaaagtgatatatagataagactttaaagatacttacaaatgagttataaagtcttttggttctatatattcaactcacttgcaactatgagagagtaaaccgacacaataacaacaacaacaacaacaaaaaaaaaaaaaaaaaaggccaacgttcagtgatctaggctatgaagattacaaaaccacatgtggcc

SEQ ID NO: 2901 - DNA, 339 bp, Arabidopsis thaliana
gaatgtgtgtgtttggttagcgaataaagctttttgaagaaaagcattgtgtaatttagcttctttcgtcttgttattcagtttggggatttgtataattaatgtgtttgtaaactatgtttcaaagttatataaataagagaagatgttacaaaaaaaaaaaaaagactaataagaagaatttggtattgttcatttcatgattaaaatggttcatgggctatcatgggcctaaaaggccttttccataggtttaaaccctaatcctttcttctccttcatttttctacttcgatcagacgccaaacatcagaagccctagagcttgagccgtcgaaa

SEQ ID NO: 2902 - DNA, 1408 bp, Arabidopsis thaliana
aatgccgttctccactttaagacgcttgattacactagatgattgaggaaacggccgcacaagaggggaaacagatagcaatgtgaaatagagagaagcagggaaggaaaaatcccgacgctggcaagcgtgggctacaccggcgtcggagaaggtggtcaagataggtttctcgattattggaccagagagctatcacagagcgtctattgcttttgactttagtttttaaattcaataaaagtgtgaaatgggttgatttattattgaatattgatgttgtatcttcatacttacttttagttttagttgatgtatcaatagcttatattgtttgataataacacttaggattgtcatttggttcttaaaaccatgggcctgccaggtccaattaagtatggacaagcccaaaatgaaaggatttaatttggcccaaaaaccatttgggtccaacaacaattaaaggctagggtttcagtatatggggaaaattttggaaactccaaaaccaaaatcgtcgctctctgcctctctcgcatctccaaatcgaaatcgctctctgcctctcttcgtctccgtctccatctttgtctccggtgagtattgataaatccgatctctgacaacattagatttcgattgtaagttctttaggtctgtagattttgagtaatgggtttgacaacattagatttatattgcccactcccacttgtttgtgttgattagattgtccctagaagtcactgtttttgctctacttatcgctctttcaattactgtaatgttgaatttgggtttcatctactaactaagatgaaatcaatttgagaagactagtggataatagtgaacacgtttacatgacttttgacttgatagtttgctattcttgttgtatctgtgtgaattgttataggttgcttgattttgatgttcatgtgtcaaatttgataatgtagcttttgtatctgattaattaagattctaatgcagttgagtttttggtcttaagattaggcattgtatattataccaacttgtgaagaggttctgttgttttctgaatttctcttattttgtgtttcattcaccaaaagtgtgtcgtgagttaatattcttttaggctgaatataaatgtatgtataaaatttggcttatattgtttgataagaacactagacctctttcaagttgagcgttatgttgatgtatattacttgactcattttcaattctcttgacaatatttgacattgcatttacatgtggttcctgtgtttgtttagtgttcaacctgaatgttgaagtttaagacataaatcatctatacttggttgtttcttgattttgaatccttaataagacatggaatttctcttctcatcaggtaagtaactgaaag

SEQ ID NO: 2903 - DNA, 787 bp, Arabidopsis thaliana
gtgactgacacttttttgatctcgtattcttattcttatcaaggtgcattttgttttgttcgcggacgacatattcagcgtatgggtaaacaaagcaaaggaggtgctacaaaaagcctaaagtccaatcaatggccgaagatacacaaaaatattccccaatccttcgcacaaacaaatcatttgctatttgtgttgcgttatgaatgccttgtgattattcgttacatttagatttggtaataaagaaaattcttgcatctaaaagaaaaggtttatcacttgactcccttattatgtcttcccatatgactagttatctccaagaccctgccaagtgaaaccgaaaaacctaaataggattctctcgaaaggtaagaagtgtgtaaaataagctgcttgcatttcttcttggtcttcctgagttcggagctgaggccatcactatgtttggaaagagcaaatgtaaacgcgagaaacacaaacagaagaaaacgttttatcatagaaacagaaaaaacaaaaggttaatcacttgaccactgaagattgcccgtgctcagcaaccatctctgagtgaggaacgaaaagtcactgccagtgtttattttaaaacaagagaaaataaagcctaagcccactatgtaaaagcccatcgtaatttaaggcccaataagtaacaataaagatcatctcctctatcgatgagaagcgagtaaaccctagcagcggacacacacttaagtccatcgacatctggagagtgagaagagaggaatagccaaag

SEQ ID NO: 2904 - DNA, 1419 bp, Arabidopsis thaliana
agcttttagtttctcagggctcttaggaagagttgatctctttgatgagttctctgtttgttgatgaggacatgtgcagtgtccgttgaggtaagattcaatcttgttgataagttccggactttttgttagagacaagtttagatgtggtccctgaaaaaacataactaacagatccaacgttgaagaagaagatgacgaagaaacaaacgttttctattttgtgaatgaatcttaaattagatctaaaaccaaatatatttagagaattttttctaaaccctaaaaccctaattcttcttcagaagagacttaaaactatctgaaaaaattactaaagaaagaacaaaacagaacgaaaaagagagcacgagacagcagaggaaacgcgagacaacagagagggaagagcaaagtagatgtagctacaagagaagagttgttgtgaggattttgaggctaagtaattccagagagttgatcgggcgggaacaactgaaaaagaggtgatcgggcgggaacaactgattgtaatttgggcttctctgcttggcgatttcagcatctccccatcggctccatttagttgggctttgttacgccgtaacaaatatttgggctttgttaaggcccaatacgtatttccagataaagacgcaactagatgagtgggagggaatcgatgccgtgccgactcgccgactattatttgccgatttaaaatataaaaaaagaagaatattggttcgaattaaaacttgttcgattttgtagctcttcctctcgtaatttcctcttcttcttctttcagacagaagcttgcctttgtccgaatttagggtttccatttttctttccgttcttccttcaatcaaatactcgaaaccctaatctcttcttgatcaggtgatactttctctctttctgctgaatgattgtttcctgttgatttgcttgttcgaaaaagtttttatttagagatttgtaggtcattttattttctgatctgaatgcagctctttttggttcaaaatatatactctgggttttgtttcttcgcaaaatgataatgtttgattgttttttctttcagaagaaattgactccaaaactagatatgttatttattctgtagaaaatggtatcgaattttagatacagatactatattttttgttttgatttttgattttggaatcttgtgatatgtttacgcaatggagacttttgcagaaaatggtttctttattatttgttatatgaatctttgattatctgaataagacattgctaggataaccagtgtcacttttttttacgttatgtaacttgaaatcatttttggactcgtaattctaacattctgtttttgttctcaggccttgtcgatttactgtcccttgtatcaacttaaggttc

SEQ ID NO: 2905 - DNA, 2000 bp, Arabidopsis thaliana
tttgttgtagtagtagtgataagctgatagtgtagctctaactagggcatggattgttcctttgtgttgtagacatgttcgtgattataggttattgcagcgtgcacaataagttttgtaggctttcaagtggttggaatggcatcagccattgttagatgcaacactctagatttcagttttgtcatttgctgtattttattaggctagcgtttggagttttcatggtgtcagctattggtagatttgacacactagatttcagtttctttgacggtggtgtttattaggtttctacttagctgagaatagcagatgagaatgttgatttcgatcttatacttggacaagtctggagttgaaagtaacttcactagatttgggtagataatgttttagaaatcatgactgcttacctctatctctatagattttggtcgattaatactatactgcctttgagtactactattgctcatagtttcccaaatcctttgtttagtttcctaaagtgtggcttcatattcttctcttttaagtacaagtactttatgctggtgttggctttttagcaagcttgtgatcttcatctcatcctctggtttcatacatgatgattaaacaaaagaagagactagcgattaaacaatagaagagactagagtagtagcttaatttgttgtttgccttagttgagcaatctcgtgtcatcaaattgcatcacatagagagggatcttgtggtaattacttctctctgtgtagttgtgtttcccgagagtacaattctgtaacactgtctggaaccattaggctaggtctaagaagagacattatcacgacactcttcacatgctttttttttttatctctggagacccaagaagagtctagtgtaaagccatgtgaagaccatttgtcatctatccatttcctctgtacatcaatcagatgttttcagtttaagaaggaaaaaaaaaaaaactcggtagtcgtatgtaaatgtaagtcggtgtcggtcggtggagttgaagccaaataatcaataatgtttaggacgaaagtgaaaaggtcaataacggtcaattaaaagtaaagtttatttttctggtaatgtgaccggttattcccggtaaacacacgagccaccgacacatacttccatgggtcacgaccacgattgcagtccgtacacgatccatgtttttatttatttaaacgcaccataacttcccgcattcggatctcccatagcaaagacagagagagaagtaaagtagctttattatggattacagataaaagacaggtaatctcaatgacgcaaagataaagacaggcaatttcacttcagtgatgcaaatctgacagtagacttcactcttgtgtatattaaagtaaccgtcttgaagaggaaggaagataaccaagtgaatttcgtgatggtttcattgtaaaacaccactttttcaaattctctccttctcttggtgctctgtttctgttggagatttcagtcattggtaatctcttcttctcttctctagtcctcatggttgtttcatgctctgtttcttttctttgaaactgatagatagatcgttggatactttagaaaatgcattttattggttttatcaaatcaagttaatttactcgttcttgtaaaatccctatgtgaatgcacccatttttctattttagcaactatggacaagtagctggggcctcaactgctactgtaggatcagacaaaaacatagcaagtgccaattatgtcattttcctcctccattatttgctgtcgttttcaggaacaggaatatatcttagctgtgttttatcctttcgctcatcttgcaaaatggaaatctaaaaatctttacttcttgaagattgattatcacagaattttggtttctttcttgtctttgtagggttacacaaatcttcttggattgttttctcacgttgctttggctgtattgagagagtttcacg

SEQ ID NO: 2906 - DNA, 392 bp, Arabidopsis thaliana
aaaggcttcttttttgtatttattgtttgctaagtttgagttgaggatattataggaaaatcagaacttggattcatctgactgtatgttctgatccattgtgtctaagaaaaaaaacttttgagccgtttcttattaaactagtcatgtcataaaaaactgtattatttcaggtttgagtgtatcggtgatcatcgtcgctggcttctagaaccatttttttattctgaaaacatgggccccactctgacaggtaaattcgtaattaataaaaaataaaatacatatccacgtttttggtgttacaaataatttagaaagaaggtggattggttatggaagaatgtgcaaggagagtaatttgagatatacaacttgggcagaagaatcag

SEQ ID NO: 2907 - DNA, 1345 bp, Arabidopsis thaliana
tttcttttctcaccggcgattctctctctctgatcggaccgatgaagaagaaaccaaaacaagtactcacgtggtctcacgtgccttttgtcaattaaacacgttgtttgctaaaatggtccctgaattaaatttgtttctctactctacccccgttaaactatttttcacacaaatcatccaaggcgtctttagatgttaatgatcaaagaaattaggaaaatcaaatcaattacaaatattttagttaatcattcactctcacaagatcacaagtgacaataatggaatgtgtcggtgatctctaattaagcatatgggcaagtgcaataaatgattacatatcccatattaaaagactattattaaaatatagtaagaatatcattacaaatacaaattcgattgctatctaatgacgaaaatgaccctagatcgtaaatgaaaggtttgagaagttgagagccacacatggtacctaacacgtataccacaatcgcaaacgtaaacgcactgtagccaaccgtcccttgttttacttacctaattttgtttttaacttcattgactttattaaaaatcgtcaataatcattttctattcttgtttttttttcgtacaatcgttacttcatacttcatattcacatttttagtcttttataattataaaattccattttctaaatcaaatctagactaattttagactataacatgttagtaattagctgacatgcgaagttaatgtttgacaaaacgcgcgatcatcaacacgcgagtcaagtcgtgtacctacccgctattgtaaaagagtgaaaacgagaagggtattttcgtaagtgcaagcagtatataatgaattcccgtagactcttccctctccaggagtctttagtgttcgttctcttcttcttctatttttgctgtgtgacgaacgagaagactcttttttgaattttgattcttcttcttctccgtttctttcgctacttcctcagcttcgtcaccgtcgaaaattcttcacgttttcctcggaattttccaattgtcttctccaattctcttgcgatcgttgaagatctgaaaaattcgaaggtatgtttcctgaatctctcgtcttcctttatactccattatctcgaattttacattgatcataatgcttcactgagtttcatttaccctttcgtactctctctctttgatccgatggtcataatcacagaatcgagatttcggatctggatctaagcttttatgcgtttgatttcctagatctactgattcatttctgcgtatttgagtgtttatgatttcattcttcttaaacgcagcgtttgatc

SEQ ID NO: 2908 - DNA, 2000 bp, Arabidopsis thaliana
aaaaaaaaaaagttaagctctatataattagatatctattggaaaaagaattttccataagacacatctgtttttgcttaaattagcgatcatatatttatttttataaaggaagcatagatagtcgctataggttataccccgatcgactatatacactcaccatctacacaattaggctattgaatacatgtttttacgtacatttaagaatgggccttattagcgattatgtgtacattatgaaagtatatatttcttctgtataccagaaaatgaatatacaataataactttaaacttgaacctcttattgtacaactgtccaaagccaccgtattaatgggcgtggatgagtaggtgtagcttttaatatggcaaccaacattatgatatcgttcacatataatcctcaattctgtatttctagttcgcgttgtaagtttctaacacctagaacgcagtcaggactgtagtttatctttttatatatctaatcaggtcgtctctcgattcgaaagtcggactagctattgcattgcatgcacccatatatatatgcatcatgtcaattttgcgacatcagataatattgctaattttgcataagaacgtgtaaggatttagtagcaactagcaatgaagagtgggtgaaagttttgaatttcaacatttgatatcggtcatttgtgtaaaaacaatatataatagttttcagagaaaattacggcgatacatatgtagctgaattcttgtactatatataaagttgaatttgtaaaagtgctatgcgttcttatttgttatcaagttgatacgttctcatattccataagtgttctttaactcttctattcatttcgaacaaaacgagatttagtaatcaaacgtttacgtatacacttttcatcaaattaaaatgaacaaatagtagttagcttagcttgtccagaaaaaaaaaagaaaaaggaacaaatactagtaggcttttgagctggctgcttttattgaagggccttgccaattaacttcagagacgaagtagattgatgatagatattaacttctatctccatctaaccaaatgccaataaatcatatcagtcctcttctctgacaaatttcgttagtttattactactagctactttattttattgttatgtatatacggttaaaacagtagatatcatggcgtgcataactgcaaatgttaagaatatttgttagcattgtaatggatttccggtaaaataattacttaaatatatacggagtggacaagaaatataagccgacaagtagtgtgactgactatattttttccataaaaacatttaagtttctcttctaaccataatgtgatccgcttcaattttgggttggtggagccgtatacacgcactgattaattcagtttcttttttcaaccatagcgtgtgtgtgaaacaaaaaaaaagtatatgcatgctcatcctgcaatctctataacaataaaattaaccatatttgcggatcaaaagtttcgtgtgtcaaaagttgtacgcatatgtctcgtgcaataacgttgatgagggaaacaaaaaataaaatttgaatgccgttgtcgtattaaggaaaaaaaagtcaatgtgtttcaaccaccctgcatgaaaaatatcataaagtgccgcatagacgaaagtaacaacgagaagatggaccatgacgacattaaataaatgatacacaatacaaaataataggaaccgccgaatccaattattgttggtaaaaaaaaaaaaaactaaacgttaattaattcggaagtaattattacgatcaatcttcagaaaaatctttgataagaccattatataaacgagaagaagtctcactataatcatatcatcaccttccccactaatactctatagtttgtttttgttcttcttataatctttatattttcagcaaacgaaagggaagtgtgtcagaaatctcagagggtgagaatccca

SEQ ID NO: 2909 - DNA, 2000 bp, Arabidopsis thaliana
catcataggaatttgatcatttttgcttgaaacatgatttgttctacgcagtatcaaaacttagttttgagatataatactctttaactattgtatataaaattttaattgacctatgtgatactattaatattgtttaattatttatctatatttttctttctaatttatatgtacaaattgatttatttatttttaatttcttactattgttattctatatagtatttttctcatctatatcctcataatttatttgaaatcgtctctaatattttgtttgtgttaattatctatataaaagtttaattccttttatactttatttgtaactagtattatacccggtgcatagcaccgaaaattaatgttatgatacattctttttttgaatttaaatgttatgatatgttacatattatcgatatttatacatgaaaaattaattttataaatagattagtatataatcgtgtagggaaaaatatatcgtttcatgtatttgtggattttattttttcagatgataatttgatatataatggagaattgaagttgatatcacaaaattattagtcttccaaatatagagaattagcttccaacttcaatgctttctagaatacatacaaaagctataaaataaaaaattacatatggtattcaaagactcaatacaaacatagattatagtcatagacaaaaaaaagttaccagagtgaagttgactcaatacatagatgatatcatttatgtcttaatgttgtacacttctacttcgtcttcaacctcctactactttgccattggtgtttttcttgctcaagtcttctactttgtttgtgttttatcctctatcgatcaagtttgcttgtttatttttagtggttgatctatgaagcaaaaagatattaaacatacataataaaagataattcaaaaacagaaagcattaatatactcatctaaacgcaatcaataaaataaaagaaatataacatacgctggccatattgccttatatgaactgattagagattgaagactcttgttacaaagaaggtctcgctcctaaatgattttactctcaaccttcttttaaaaaccaatatcaacaatagaaagatgataccgagatttgtatatataggtttgagatcgtatctgtctttgtttcccaatagttagtttgaatgttttaattgaaaaaaaagagttacatagtttgaatagaagaaaaagaaattgtgggagtatggagaatatgtgggttgatttttattttcttttgagagtgatcgtgggaaaattgacgataatgttttaattttgtacactgttttcacatttaattttattttgagttttgtcgaaaaattcatttttgttttacattgtggattttgtttttgataaatttgccacatgtcaaaacatgatttgccaagtgacttgtgttttataagataaaggatatataatgtattaatgtcacaaaaaaagaattacattgcataattaagagtatgcatcgattacatatttacatcatatcttttcatatttatcctttttcttaatattcagattacgttcaatcttttctaatattacttttttttttaaacaacgagattgacaccaatgggaaagtctgctatagattacggaagcacgatgtgacctaacttgtttgtattaaattcggcatcggaacatggatcttaaggaatatcctttcccaccaccgcaaatgtccgtttgttaaatctgagatttttcaatcccattatataataactcaacaaaatctctctgtccaatttccaaagtcaactcctttttggtttttgttttactttctgttttcctcttctctactctggaacaacaactacacacacacacaaaaaaaaacaattttctgtctatatatatattaaggatccaaattagggagagaccaaagaggaaattaataacaatcaatccaacaacga

SEQ ID NO: 2910 - DNA, 1615 bp, Arabidopsis thaliana
atagaagcagaatctctctacaaagagttttttttcgttctactattatctacatatacaaaagtgttacacgttctaaggaaaagggagagctacttaaaaattaacgctaaatagcagcttcattaagaaattttaaattccatatccacaaatattacacccataaaaggtccataggtcacagggagaacacgttttccatattatattcactaattttgaaaagaagtaaaaatggcatttgacaaaaatgctgtacggaaaagctgagcggtgcaaaagctatggatttgatgaagactagtcaaagcttatcatgcaacaaagttgcaactatacgatattatttctcgagccctctttggtagtagtaatctaaatgattgataatacgataacacggagtaaatcatcacgtctaaaaagaggtggatgaatcaatctggaaggagattatgctattagggactccaaaatgaggttatatatacccttgtcatagactcacaaagagtgtttggattagacctgagatatggatccaagtatactcactattttcatgaatgttttactaaagtttacctgtcccaagtttgtagaccgattttttgggtgaagacgtgtttagttgtgaaacagtggtctggctaattgcaaagtgatttaggtgtacttgagaccaatacttttgatttggtagtagagtaatgtatggagtccgtcaaatcttgccaaatatcgcattgttgccatggtggaagatggtagccgtgtgtcttcctatgtgtgttgcatttattacttgcacatgtctccttggacccttgtgtggaggaaaaatagtaagttaccgttcatacaactgaaattttaggaaactttgacattatgatctttaagaaaatatatatatatatatatatatatatatatccatccacaaatagtcttacaatctactatgtatttaacttttcagaatttaatgaagacacaagacatgtatgtgtgtttgatatatcaatttactccataagactttgaaacatataatacagttgaaaattgcaatacagctaaaacaaatcataaagagtcaggtaatacattattgtattagtgttaagtaaaaatagtgtgttgtgctggcaagtaagagaacacgaacaaaatcttaagaactttcgttgcttttctaaggcaaaacaaaacagactttttctcttcttcttctttttggggctacgacaatctgaatttgatcccaaatcaaaactttcttcttcttcgtcttcctctaatcaaaactgtctcctaccaaaggtctttcctttctccagccagatatgtgaggaaaccaagcttctcgtacaacttcatcacctacttccttttgacgttttcaaatcttggtatgtttaaaactcttatcgattcagccctctctgttttggtttctgtttgtagattgatttcttaattagctctaaaagattaagatcacaggggtccattgtcaaaattctcttttgattttgtttttgtaatcaagaatagtttctttttttgattcatgaagaaatgtctaattttttcgttgcagagagag

SEQ ID NO: 2911 - DNA, 978 bp, Arabidopsis thaliana
ggttattctcgagtgtatcttcagaaacagagcattaaacgcatagatgagtgtcgtttgatagttatggagacgaaggaaagtttttgttgcgtttgggacggagctggtctacagtatttatacgatttaggtgtaaacaagtgccaagtgggggttgtgggataactaataacacggaagaatagctgaaataatagatttaactaaaactgtataattttaaagctctatttatagcaaaaagttttactttaccataatcttcagttaaaggaactctctataattttgatgtttttctaacatatgaatgttttcatagttgattttggttataacagaaacctaacaaaaaccttgacttttattgtttcttaaacaagagtcaagacctaggttctttatatgttgcattgcgcatatttcgttaattcatcatcatttctttcttttgtgaagagtgtgtgacagactttatctccttcaactaatcattttgttaatacacaaagtgacatgatttatagatttaacaatttatttatttcttctatgtcaaattgtcaagtcttcaacagatgatgaaatcatggagagtggtggataggaggactcacgtcacgtgagatcaggaactgcaacctaaaatatttaaccaaatgaaattgtctagtgggttagatgtggcccaataaaaatataagcccattataacgaaacgacagatttgaacataactagcagccgttggattaaaagagaacctagagagaatatgaaccgttggatagatgccctacgatttatgatagagaggaatccgatgcgtccaagtacaaaagccacggccaattagagagattttcagagtcagtctttttatattcatctctcagcatcattctttgattgtgtgaatctctcatcgttctctcaaatttcgtgtttttgtaaccggacggagaacctttcacg

SEQ ID NO: 2912 - DNA, 2000 bp, Arabidopsis thaliana
aattgacaaggcttgactcggagataagaacacaataatctgcccatccacagaagacagtaaaagcttttcagaaagtctatagaaaagatgtcaaaatatgtggatgttgtaaaagatgatatttgatcatttggtaaaagatgaaaacagagaaaacaatacaacgtacagaggcgttggtgcgaaacatcactaatcagaagttatgttgttcttgttcttgtaacgattgtaaaactctggttttacacaaatctataagatttacagctaagttgtgagttattaaattataacttttgactaatattttgatatataaccactgatccactatcacttagtcttcaatttttaatcgcagaaacataaaaacgtctagtaagtcacgaaaccttgattagacaaatcaccaactctttgacggcgaagtatatgtgtgtgattgtgagtaagatctttatcctctctagtcttgctgatcaaattgaataaaatcttgggataaatggggatttggaataatgactcctcctcccctgagtttccatcactttgaactatgtgataatctgtaatatacatattttttcttttctaaaagatgattctattattatgtgcttgacgtaaaaattcaatctaagatatggaaaagttggaggcttactataaaggacgatctggaaggagccaagaagactctctgaaagtgaatctattgaaagagagccgacaagaatttgtggtgagtaagaaaatgaaaaacaaaaggatagtgttacttgctgcatttaattattaggaaccaaaatgtacgcactatcgcaacaaaataaaatgaaaagccgaaaaggacattttcattaaacaaagataagattcaggacagttgggaatattgttgtacacgattttccaacaaaattcctaagttttgttttatggtcaattaagtagaattgtaggttataaaattttagaaatgaaattaagaaatggtaatagtgtgatatatagccattattctttttattggtttcaatcatctttcactaaaaatgttacgtgaaacataaatttatttgacagcattaaacagattattattttgtgacaatagtttctagaacaaaactatatatactacagtagtattaatttataagaaaggggttaaaagggaagaagaaaagtcgtgagagagaacgcgtccgcattggaggacgcagccgataaaatgttacagtcaccgagcatttcacattatttcctcattcgcatcaacgaagtcaaaaccatttataaacccaaaatcttcttcgatctctccataattctcgtttgcgtcattcattcatcacatatcaaccaccacagagacagaggaatagtctcaaaactttctcagaaatggcaggcagtaatattctccataagattaaggtactactctttttatgctttattcttcttatttgacggtactactttgagatgagatctccttgatctgatctcttttgagctcacttttctctgctttggacctggaatcagtttctctgttgttagctctttctttgattagtaaaaagtttgaaactttttttgagaaataaacaaagttttaagtgagtgagttagtcagataaacgaatgcagtctcaaggttgatcctttagctttatcaaataaaaaaggttgatcctttagaattttatggtttttggctgatccattagcttaacttttgaggtgggttttctctgaagaatctgtgcatagatctctgttatgcttatggtttgttcatgggggtgataaagaacttagatttagatgactccatgaaggcttttaactgatttggtttgaagaatccagtgtttcttgatcttgtgtggattcagtattaactctactgttttgctgtggattagttgaaggctgggttctgtggatctgctcctgacatgggaagaggcaaaagcaag

SEQ ID NO: 2913 - DNA, 238 bp, Arabidopsis thaliana
ttttgtttttctctcttctgcaaatttcttctgctctttccgatttctcggataagattgggttctcagtaaatagtagtagtggcaacaccgtaaataatctgatgaatacgaccgaaaaataaacacaacacgggttaaggatccgggtttttttcggagctccggattcaacccgaaatactgttttttttttctcaataggagagaaaggtcttcttcggaagcaagctaagtc

SEQ ID NO: 2914 - DNA, 2000 bp, Arabidopsis thaliana
gtaccactacctaaataaactatgtacgaggacgatacatccagtacaagagaaatatatatgcaacctcatcatataaaatcatagtcacgagattttatgacagatcttagtcgtacataaatggctgacagatttgcatgatatattgcaatgatatatttttttttaacccaaaacattttaccagcttatatcaacaatagacatatatataatctgaaataaggaatctaataaaatagctcttaatattgaatttaaagaagaaaaaaagtgaaacaaagcattcgagatttgatgtcgaagtccacatcgggaagcgaaggtcatcaaacggccacttggactccgatgagaaaatttcaagtgggctgcttgttggcttttagtataatattgaccacaaattatttatatgctttttagttataatatgcagatattgtatctatataatactccatgaatagtatacatatgagtgtgtttctttttgttaaatatccaaggaagagtgcataatcattttggaaccatttatgtttaaataataaaatttatgatatatatactgtatcaaaataactatgtgttattagagaaaatgaagatatagtcattaagttaggtaatttaatatgtacaatattttaagaatatcatgtcattttataaatttatattatttcaaaccaaactaaattgctttagcttctgtcgaaactgcctactatttaaatttgtttttctaaaaacttctttgatcgaattagctttcccgaagttctagtacaattctaaaaattgtgtactagaatctacaaatagcatattaaactttaaatttcctttgaactagcttgtacataaactaccatttcttttcttgtttatttgtgacttaagtgttaaaatttttcttcacaccatctagcaaaacacctaacattgttccctttccaataatcgaatcgcctatcctacaatcatcgataatttagtataggatctagaagacttactatgactaattttgacaatggtgaaataatcaaactttttttattaaactaatgtgttgtattggatcagaaaacatgatttacataatgtttgtaacattgatatcaccccctacatgtatattaaaagccttatcgactccaaatttttaccgaaaaaattgaaaaattgttcaaaaacacagttttaggatctcattatacagatcaaatcacacgaattcatatcataataatttttttggaagtccggttattttactaatttgatccaacatatctatgatgaatcttagttaagatgtggtgatcactcaaacagtaaatttgtaaattttgttcattaaaatcagtttcttgtggacaaaaccatcctatttttggcaaatcaaagaaaatataattaatctcaaagaaaaaagctacaagaaaaaaaaaatggcctcaaaataaaaatagaaaatatctgacaagactgcccgaaatcacaagtaactgtaacaaaactgacaacgggcaaaaaaaaaaaaaaaaaaaaaaaaaactgcccgtcgggcaaatcctccaatagagagtcgtctctctttatctccgtctctctcttttttttttaatcaactttataaaaaaaacaaaaaaaaaatttaaaaattaatatcttctcaacaaatgactctatcaatgtgtacataaatgtgaatcttcttccctcttcttcttctccattgttaaaagctctcacacaaccaccgttctccgtcacggtggcgctttattctctcatcggagcgcctcaccggtggcagacggtgtcgttgttcctctcctaaaacctccatcaatcaccatctctttacacagagctctaaccaaaatcttcgagagatggggcagagtatgagctgtggaagtcgaccggagcacggaatattcgcctctgtacagtgcggcgatatcatcactatccgtcgtgtg

SEQ ID NO: 2915 - DNA, 1555 bp, Arabidopsis thaliana
gatttacggcggaggatggtggttagtcaaaaagtcaacgtttgttttttcagttttagttggttttggggttttggtgataattaagaagagttttttgagtgattatgaagtcattgtttgaaaccaaacctgatttatgacttttcaccttcaaaagactatgctattttagatataaaaaacatatattatggaactaattatttattccaaatttacattttatcaaccagtttaattgtcaaatcatacataatttattgttttggaaaccagagttgtcattaatttgttaaggtatatatgtaggatatggttaatgctttgtctctgtttcagatacaaaatagaggttccattataataaatgtgtaatcaaaaaagcataaaatctcacttatgaccaaaaaaaaagaaagcacaaaagctcacaaatttagagtatgaataaaaaaaattagtaaggtgaaaaaatggaacaggggagattcaaaggggtgacctgagaacacaaaactcaatggtttcaatggaaatttgaagaaaccataggatatgtgttcacatgccactcctttgaaatttcacctcctgttgttcttctcttcttctccatactttgctttcactgcttcttatatatactatactacacaagtttctacatatataaatacagtttactcttcttggtcttacttagatttttgttcacttctgttctgtcataataatgtggtcatcttgttgacaaaaaattagtaagtgtgatggaaatgaccacatccttttcttcacatacgacaacgttcaatggaatgtatcaaacaaagttgggctcagaatatatatctaataatgggctattaatgagcccatatgagctctcttctcataggcccatccaaaactcatctaaactctgctaccaatcttcaaatagtttaattattctgccgacaaaatcataaatggtcaaagagttggatagtcggacgaacgtggcatgaggacccatttttccgtgccactcatcaaaacctcaaccaatactaaaacttttaagtgtagtaaaatacaccaaatattacttccctataaagtataaactctacatttatgatgaagaatccaagattatactagcatttacataggtaaacaaatacccaaaactaaaagtacccatccaccaataaaagtaactctatgatcaagaatcaaagataataagaaagaatttatcaagaccggttatgagggtcgacttttgcgaaatggtcaaatgtaatcaagcatcttttttacgtaggaagagaataaaattcactcactaaagtcgaaaagtagatctaaggcgtaagaatcgtgactataaatatcccattaactagtggataaagaaaaagaagaccaaaaactagtggacaaagaaaaagaacaaaaacctaatttcaagaaattcaataaatatcatcctccggataagttgttattgtacgtttaccaaattcaagaacaagaaaaaacttttcctttgaaacaaagaaac

SEQ ID NO: 2916 - DNA, 2000 bp, Arabidopsis thaliana
tggccggaaaaatcgtcggagctccggtggtgagtttagatatgtatgtaaaccgaccgtgggagatagagagagagactgagagagactgagagagaataatgattgcgtaaagccgtaaaatctgtaatggtttttttcttgacgtattaaggtgggttttatcagtctttctattacacggtactgtacttactctcttaaaaatctattttgtcggtttttttccacgaaaattattttcttctttaaactgatacacatgtatcaatatccaaatgaaacacatttttatacaaattgaaacatgcaataaactacggaatatctaaaaaacaataaaattaacggccctaaaattaattttaactaaattctttaataaaataaaataaaatcataagtctataaagtattagttattttatggtagtttaatggttaataattgttttttcatatagaacataggaatgtggttaaatttcagaattttaatacacttttaacttaattatttgtttatatgaggcactttaagttttagaaaactataaacacatatgcaaaacatcaaaccaaattatgtttttgcatgtcttttgttgcatgctctatatatcctaactatttttgcttagtagtccactaaattgtttcgtttcaatcacaaccactcaagaaaataattacaatagattactaaaacaagttaacaacagtgttatttatttactctttttgtcgtaatgctttaaattacatgtctctttcttttcatcggacaactgttagtgtgtttttttgtacatcaggacaactgttagtttactcatgttttctacattgtacattttggcagtcaattttacggcacggtttccattaaagatatggacgtcatcttatggtaagctgcatcttttgaggaataatacatgtagacgtccctatttataatttttgtgttacgtaacttcccttttgttattaattaagtgtgtttatttggtcaattcactcaatcaaatcaaacccaacgccaaactgcaactatttatgtgattgacgcttcagagttgaaactgccacttttgtcagatttattatctcacttcccaacttttcttttccgtaactagtgaatttattcatgggaaactaatttaatgcatggtatatgatgcgtacaacaagcaatacttatatgaaaaaagatttagaaacaaattgtattggcttaactaaatcaattaatcatgtagcaattaggtgatttggagtctattctctgtttagaaaagtagtaactgttgtctttatgagagtttctgttttacttagcgggtaaatctactctaagctaggtgttttcatccacttaacatgtattttataatctcatggttttcacaagtcttaaattgtacttattagtttggtctaaatattactccctttgtttcattatattggatgttttagggattttattttgtttcagattataagatgttttacaagtttaaatttaaatttaatttgactatttgtgactatttatattttgcagttttcattatcattttttttaacaaaatctaaatactattttttatatacaaaatgacctaatatgtatccatttaccttaaacctcttatattttaaaacagagtgagtacattcagtaagagaatggataaaaacgaatttggaatacacaaactataaaagtttcttgagtactgtttctattattgggccataaacagtgagacaaacaggcccatagaagtaggtgaaaaaggcttattaagatcaacggttctctcgttacgaatgcaaagaatcttctggatcctttttctctcagctactctctccatttatctaataaaccctaacccctcctcccacactattcgtttacactaaccacttccttatccacaccaatccagaacgttcctcaaaaagctccctccttttctctcaaa

SEQ ID NO: 2917 - DNA, 1058 bp, Arabidopsis thaliana
tcaaatcttcatgaaactgtattggatttgatataataaaggtttgttgcaaatgaattaataatgatgaatatttttaaatttcaggctttgttacttttcacatataattcactaccaaagagtagtatttttcttcttcttttttgtgcacacaagaaaaagtaatttaaggtttaataatcttttatttttttagggatgattctattcttttgttgtcaaccgactttaattacggtttagaagagttatttatgaagaatgttgtttacatgaccatctgttcatgataaatactccgattttacgtttgtattgcgtaaaattaaaaataaagaaaaagtaaagaaatcttttgtatcattttgaaaatctgtcaaatacgataaaaacaccgatcattcaattggagaagacacaaactttaccaaataaaaaaggaaagcaacattttaattgttggcatcaaatatatacttcatcaaaaatgaaattctacttctttatatgagataagacttctattatgttgtgtcattgtgaacatggcttcaactcgtgagccatgagtaaattaataaatcttaatattataacttaagaaagattccctacatttatggcgtcgtcctctttcaatcttggtttgaattttctgatgtttaaagttttcttttaacagggctttcaattcttcagttggtgtctgggatttttcttttgtttgccagcttttacttcattttcgtggacatttgtatttatctttggttccacaaccagtttaattaataaatttcaaatgacacaaccaaaaaaattcctacatttctattacagattaacaggtgtcctataacctttttattttccttttcatgtgttgtttctagaaaacaaaatccagattattataattcttgatatcacaaaaatgtagaggaaagggaccatttctaaggaaaagtaattttaaaatccctttatctatgtgttgtgtcgtgtgtcggtgaagagtaagaagtcgagagacaaagttaaaagtagagaagaaa

SEQ ID NO: 2918 - DNA, 1772 bp, Arabidopsis thaliana
tttcaccttcttgtctaatcaaacacttacgatgatcataaaaacatcatctatagttttagaagacaaaagagtgactactaagaaagaaaaaaaaaagttccaaaatattgaagatattatggatattgttttgatattttccataccttgtagaagcttcaaaaccaaaacgaatctttattttgatcaagatccgaaaaaaaatccaaaggttcaaaatctgcctctttggtcacaagaaaacagagaacatataatacatttacacgtgactttttttttttgtgtgtcatcagatccaaagttgatatgcctcagcttatcttctttactcgatcaaataaacttctcttctcttcaatttttttttaaaaaatcttacactagtttattttattttccaaatttggcggagacataagaaaaaggaatcagaccaaacttttctttatttagctgctgatagatcgtttcatcattcctttactcgattatacaattatcaaatatatattgattagtcaacacaaaagtgaattattgaattttatgttgttggacaaagtaattttaacattctagttacaagtaaacttgcaagatggatctatatatagatggaaagatttgtgatgtgaaaaacatctactcgtatcgtatgttataacaactcatacggttgaaaatcgtgtacagtaaaacctctataaattaaaaatgttgggactgctaaattttattagtttagaaagatattaatttatgtattatacttttagtatattgaaccataatttgtacgtatttgactcttatgcatttacgacaacaattttttaaaccctatatatgttaacaagtaaataagtcattatcattaggggtttaaatatctgaacttgaagaatttgtaaaacggttctccgcgtcatcagtatgtataatatggctggccactccttagaccgaagagctcgttgtataatatgttttattttagattttctcaaatctcgcggagacatggaaaatgaaatttattaaatggatggagcaatttggtaatttaatcagtatgtctgtatgtgttttgtaatgttatagtttaagatatgtatcacaatcatctatatgtgacgtatacgacaagaatttaactgtacgtacgatacccttataattattattcacttagatttttgtttgtactttagaagaatctgaagaagggtcccggcgtcaccatgcatgtatggtcactccttaaaccagagattcgtaaataattatattgtagtttccattgttattgtcgatttatttatggtccccaatgttctcttggagtcgagggaccatacatttagcttcaaaaatcttacgattaggaaacgtgtgacaataacatttgttttgttagctacaattcctaatttcctatgatttgtacaataatttaaagattaacacagcttgtgggatgcacatggaatttgtctaatagaatttagttccatcatatttgcatacaaacaattgtcacctattaatactttcattattactttcgatgaaacattgttattgggtatataaattaaggcccggccctaaagcccatttattagccacgtgcagtaacttattatttttttcacttatcaatagtaaaaaaaaaagatcaaaatgatcactcttttgagtgtgagtgaacacacttcgtcgtctctctttcactacttttgagaagctctcttcttcgagcttcc

SEQ ID NO: 2919 - DNA, 400 bp, Arabidopsis thaliana
tgacgatagctaatgcagcagtctgataatcccgccgctagacggagagtgagttgcgtcttatctactagtatacacttcttgaagaaagctaaaaacgtcgtcgtatcgttgtcttattgcttgattggataaagcttcaattttttcctccaatttttgtcgaaaatgtaacattttttttgctttccactgtgagattgtcacacacgattctctaaagaaatgagacgaattttgaaaacgatttataaaaatagtatttttgtttccttgagcttatctcctcttttctctttggtttgagatatgaattacagacaatcaagtagtcagtcacaacagtgtgtataaatatgtcttttaagtgaaatcggtttcgagagacagtgagacgaaa

SEQ ID NO: 2920 - DNA, 780 bp, Arabidopsis thaliana
gaaaacgacaatatttgagatatatagagagagttctcttatcaacaaataattatttgagtgaggagatatctctaacaaaagattttataaaccgaatagatctcggaatttcatggtttgctttgttaaaatatgggcttttgtgaaattccgaaatattggccccattaattaatcagtatatattttgttcacttggatccaataaggtgcaagacatgaagagagaaaggtaacataggtgaacgattttgttccctaaataaaggttcaattcaacaatgtgattctcacgtcttatacacaaatgctccaccataaatttcatttcattatatacctattttgacaccgaaaagagtttggaataaatatacctattttcttcttaggtctgaaatgtccagtaaaatacatttgaattacaactgatttaatcatttaatgaaacagaccattagttatacatatacacgtcaacggcattgaaattgtattagtattcgcctttcttcatatatgattagaatgaatgaactgtcgaatccatatcaatgaatatttagttttgttataatcctaataaagatatgatctggattatattaatgacacatatctttgaattgtcagggccgtccagcttatattgattttcgacattctgtccttaacaacttcttcgcaaaacattccattttatgtattaatggttttattttaaattggcttccatatatatacatgaacatgccacataaaatattcattctcaaa

SEQ ID NO: 2921 - DNA, 2000 bp, Arabidopsis thaliana
aaaaaattaaagagttttgcgataagtaagatatttgtttcttgttggtttaagagtcggtttgggtccatgatataacactaattaaccaatagttgtggccttgtgggaggtaaatgatccaacaaactttgctttactaactcacatcttttttcttttgaataactaagaggttttggcctaggccaatacatcctctcgggatgggactaaagcattttatagaattttctttcaaatgttattggaaccagcaacctctaggcttagctaaaatattttaccagttttgagctattgacacttgataactcacagtttttagatgtagtttctctaaatcatgcatataaaataaacatcatagagatcactagtagatgatttcatcaactagttctatattcgatacgattttacacgaaactcgtattttcgaaatgttgtacattgtatgatataaactttagaaagggaagatacaaaattaagttgctgactatatgctaaacctatagacacgtgaacaatgagatgacggcaaacatgtggatttaagtttgcttcggtttgtttcagtttgttctagtttgctacaacaaaactccaaaatattgttgatttggtggctacaaaaaaattataatataaaaatagaagatatgtgtttgattaaatatactaacatagttttgatcgtattaggtagagccatatttagataagtttgtggactgcgatgaagttatgaagccacacaatatgtatttttttttccctcatgcttgattcgttattttctctgtgatttgatatgtatgcaaatttatttattaatggttcctttttggattccagctaacaaaagaaaaggtttgaaaatgtccaactacaaatttaatatggaaacgtacaccaattcattgcgagattggtgcattactcgcttgctttttgtttcataccagacaattcaaaacatgtgattgatttctcaactttcattctctaatcatttagaggatacctaccaaaaattaatatcctccaaaattatttggccattgacattacaaataaagaaatgtctttggatgaaatatttcaaaattatttttattcattaaaacaataatgatttaaatactaagcacacatatagtgtgacaaaaatatgtgatttaaggatctcaggatacaaacatctctaaactagttttacaagcattcgaaaacacagctctaacaaaccaaatcactatgatattctcgaattacttactttctaacaagaaaagattgttggagatttttatttgcgttaaacgattaagttcttaatcgatgtaatcggtgtactagacgacttaaagaataggttagctatgatgttgagtcaatcaaccacatcccctccacaaatccaggagagttaaaatttaatcttttaccattcattttttccttctacaggttcgaaatcgaagtccggtccaatcttgaaaacatcaattatccaacatttttgtgctggaccgaagccaatggcaggccagatattataaccgaaggcctgaaagtaagttacaacgagatagtaagaagatgcttaagtaaatgggcctttgtggcccaatctataaaacctaaccctagcatcgtgtccccatataaaactcacctccatcgctttctacaagtttcttctccagatttagggtttctcagtgtttcggctcggcccagaacaagatcgcaagacttcaagatggtaaatcctttcacatctccttcattcttaatccttatacttttctattatcaattagtatgtaaatgttacggaagttcgagactttgaatcattttgatgatcttctctgcttcaaccttaatcatctacactgaattttatcttaatgttacgaaagtttaagactttgaatcatttttgatgatatcttctttgtatgaaacagccgtcgcacaagtcgttc

SEQ ID NO: 2922 - DNA, 1612 bp, Arabidopsis thaliana
tatttagaataatcctccaaaacgagaagaagcagagaaactaacaactctgttttcttgaaaggattataattttggttggaggaaaaattagaagagattggattggtcattgttattggttgagtgtgacttcactctctgacaatatctcacgggtaacatgttcatagttactgtcaagaaacagacaattatttgaactactttaataacgttcccaatgaaaacactatatttttttttttttttcctcgattatctatccttatcctataaaagtattttagttccttctttcttttgttatgtataatggaaatttactttattcaagaaaaaatttactctttttagtttctttgcttttttggtagcaacattttccccaatggagaacaaggatctctgtctcaaccatttttttagatacattttactctattttatttgatatacaatagattttagtttaattttttgttgtttcaagaaacacattataaagagagaatttttttttttcgatgggtgaaaattttgttttatcaaaaaaaattgttgatttgtaattgtaatataaaatttgctacatatgtataattattttaatctatatatacatttttgcagccactttgtgaaataaatcctcaagttgggacttatttacagtggctgccactgacatttaataattatttttgataattagaaagtaaatcttcgaattaaatatttgacatttaactatcttcccgaaatctctccatattaactacacaattagttactaaaataaaacttccaaaatatttaatatcatttaaacactacaaaattatcatttttgatattgcttttttcatgactataacaattcgattataagcatcaaaccgcagaaatatttgatagcagttaattactacaaaattacaaaatatttatacaatgatttataaatatatcataaataaaatcaacattaataaaataaataggtttcttttacgggacgggtttggcaggacgttacttaataacaattgtaaactttaaaataaaaatattttatatatagatacaatttgcaaatttttatatatattaaaaaattaattatccccgcggtgtaccgcggattaaaatctagtgtgacataaaatagaactgaagcaaacctaaagagtaacttccttttgtagaaatataattatttcaacaaaagattgtatagtaagatattttaaaacggaaatttgcagaagcccatttactagtgttagtttcaaagaaggcccattaaaaaaggcccaaatattgccggcttcgaaactcgacttttttatagcacacaaggtttcaactgaaaacattcctcttcgccttcctaaggaaaaaacactagtcgctcgctgctcttcaattttcttctcgaatctaatcgattgatttctccttcgattcttcaggtaacttttgattatcctcctctaatcaattgtgtatatcccaagctttctctataaattagggtttctgaatcaacgatttttcttttatccgtaggagaatcactgaagcttttgcctcccaagtagaaagagat

SEQ ID NO: 2923 - DNA, 2000 bp, Arabidopsis thaliana
tctctccactaaacctaatatattttaaaattttgataagtctatatacttttttggcggggacaaccggatagttcttctttgagacttctggcttttttttctcttgatgataataagaaactgtatgaatatttgaaaatgccttatgacgttttcttaccaaaaaaaaaaggcaaaggaactacaaaagatagcttaaacaaatttagacaattcatgtggccttaccttaagtattttagtgatgatacgattttaaaattattagtgccattctatcatgttctatactatataaaatattcattcaatattgatttcatagttaaagtttacaccaaaaaattgacatcacatcctatcagctacggaaatggttaccaacacaaaatagtatatctatgtcctatatatatataggaatttaagacaaagcaatattagtctacttttggaggagatgaaaagttacaagaagtctccctataaaacactattaatgaaccaaaaacaatctactaatcaaacttatagtctactagaggtactttgttaccgtttggttagggatgagtttcaacgtttgtggtggttacaatgaaggtaaaagtaataggcccaagacattgagtgataaagtgactaactctttctctttcttcatgatgataaatcgatttgattaattccaaaaaggaagtaggaaagaaaaagtttcgaaattcatcgcaataccaactagacccagatccaaagttgcagacttttcaaagtaatttacccacacacactctaaaaaggatgggttagagaagactaattatttttcttaatagccaattaaaatagtatttctttattgtgtgtttgcgttagaaaaagatatgagagctgagagagagagagaggaagcagaggatagacagagagaaaagggaaaattaccagacaagagttcttctttcttctctctgcctgcttctttttcctctcttttctctctctctctctttctttgtgaaaatctagaagaagagaaagctacaaaaatctcaacatcgaggtatgttattcgtgtttgcttacctaggagatgatttaagttctgtttcttgatttttcactttctggttttctggggtgtttcaaaagatctgtctttttttgttctctttgatgtctctagtcttgttgggatgtgaaacacatgattttcgaggagtagagagagacagagagaaattaagggaaagagctcacttgtgtgacttgttctgtgagaaaattctctaagcaaaattctcaattttttcagcttctttctaatttatgcatattaaaattcagagcttttacacttgaaagttgtcatctttgtctcagtctctctctctctctctcgtttgcatagaagaaacaatttttgtgttgatttagtcagttcacctaatctgaagagaagttaaaaagtttggctaagatttgtcaaaaagttaaaacttccttttcatggaagctcaacaacttaatctctttggcagtttccttatcttagtttctttggatctgcctttgattttctttcatttgtcttttaactgcagtttccaatttggttcatgcaggtaagagttttggctacagagcaaccatgctaacttgcgccttctcccaaaatcttatccactaatctcggtaagcaatacttctgttctgatgatcaatacacaactgtactagtcttgaagtttctccatgcatagatcttagaactaccataaaggttaatcctttgagcctgaaacaaaggtttgagttctgtttgattgtgacaggtaaggaaagtgatgttggcaaaatggtgaagaaaggaagttggttttctgctatcaaaagggtttttactccacattccaaagagaagctagccaatgtaagctggttactccttactggattttcttagcttgcaaaaatgttttattacagagtttttg

SEQ ID NO: 2924 - DNA, 695 bp, Arabidopsis thaliana
atccaatcctattgtgaatgtgatgttgttaattctcaagaacacatctttctatcatcatttgtataataaaagctttgaaaaacttatttcttgtgatcttttagttgctttgtacatcttcaaattttggttttgagagatcttcgaattactcggttcaagatgtccttaccaaagtgaaaaccaaagttttgattttggtttggatttaattttggttagatttccttaccaatgtttgattgtaaaagatctaccaatcggtttacaattttggttcaagttcggtttaaatcaccttatcattgtctatttcacaacattccaaagtcgctggttccatcagaagttataatatcaaggcaaacaatatggctaacaaataaaccaataataaatccccacgtgtcagtatttgattgattacaaataaaccgaacttgatctattgatatttcccatcacataagaaaaaaaaagagccaaaaaaaaaaacttttaggcttagctttaaagggcacacacacacagtcgcgagtttctctctggtgcgctctttgtggcggctcgtcttcttcttcttcttccacgggactctctctgaatcggtgattttcgatcttcctagggtttcgatctgaaaccttgcgatctacttgaaagagagattcagaaatttccaagtaataata

SEQ ID NO: 2925 - DNA, 2000 bp, Arabidopsis thaliana
atttaccgtttgaattcggtcagaattcgatccggactttgtaacgtttaatatgactgagcaatactaattaagctgactgacggaacaataccaattaacccaatttatgatagttatgttcaattttttttttttgtttatcgttttaaacattattattgtaggtaaactacttcataataggattagatcaaatatttctaatgatgatataatagataaaaaaactaaaaaatatatatttttaataaactctattatttttcagctcaatttagttttacttaaattaaaattatttttgattcaggtcctataaactgaaacctaaataatttgatccgtaattcatcaaatgaaatctttgtacaaatttatcttttaattcttaacaaaattgtttatctcctaaatttttcatacttttttccaaagcttatgaatgctccacaacaaaatacaacttggtgaacattttgccaacaaataaaaattttcaaatgcaataacacattatgtgttatactatgctttaacgactaattttttgcgacactaaaatgaaaacagtagtttgatacatttgtaaactgatgcatttttaaaaagattgaataaattttacattctctcttaaaaaaaccatacttacaacaaaatctaaaatcgaaagagctacaatccaaatctttggtattaatatttcggtttggttcgatttgattatacagtttcagtttggtccggttctttatttttcacattaatattgagagagtcaaaaaaagctccacaagcgaatcatagttgagagagccgacaaaagctccacataaacttgccaacttccttttctcataatctttgtagagttctttcaatacatttttgagttctttagctttcgacttagaagtagaaagatccacatactcataagcttataagttttttcaagaatctgcaacttcatctaggatccaagattgcacccatagccaaaatgatattgtaatcctttttgagctagaaagaagcttagaaagtgatgtggacaacatgaagacgcaattagatgtttatttggatgagccaaggttacatagaaaggcttttcgaaatttggatgttttgagctattggaaagaaaaccaacacagatttggtaacttagcatctatggtgcatgacatacttagcattcctatcacgacagtagcatttgagtctgcttttagcatcagagcacgggtctcgagtccatacatgaactggttgcttccgaagaactttcagactctgctttgtactcataattggttgcgaggatttgcggaatatgaaggtaaaaatattgtgtagttatgttttaaaacgaggtttcttgcagtgatcatgttttaaaacgaattcatactttgaattgtaggtaccctaaaagacattgatgatttgcaaccaatatgcaaggatgattgcaattagtacccgagcagaatcttcaagatcagaaaattcaagtgcaccatgaaacaaatgtagaagaagcaacatgttttggaactaagaagaataagaaacttattgtgtttgaaaacttgaacatgtttgagtttgatttatagatattagtgtctttcgattggtaagaatttgaaatttgatggtaagtgttgattttagtttgttttataaaaggttagacacattcttgatttagtagttgttttgtgttccgagtcacttaaattgcttttttaatttatatctaaatgggtatatgagtttaaatgggcaattttataaatcttaaaattaaataattttaaatggggtagattttaaatgggctaaatgaggtgggcatgcccatagttgaccagctctagtggtagaaacggcacgatgtttgaatattaaacgacacgatcgttgaccaaagaaagcagggtcgttcttaaacgcaatcagagagagaagcgagacgagagacgata

SEQ ID NO: 2926 - DNA, 2000 bp, Arabidopsis thaliana
aaagtggttgtccccgtcggaacaagaaatctaaagggtttctaatttcgtgccctttgtggactctcaagtaacgaaagtcaagaatgttgacccatctggtctgtgtttagttatgaaatcatattcaaataccaattagacttaatttatttagacaagttaagaaaaaaagcaggacaactaaccgtcgtgaatagtagtattaattaattcgaaattaaactacagatataaataaagagtgaagccgtacgtataatacgcccaagtgcatgcaatgaaaagaaacaacgaaaaagaaaagtgatacacgtaggatttgcgtacgaattttatcattacaaaactaaagagagtttatagctactagtttcgactgaaataccacaaactgttagatagatttaggtgcaatcgtttttgctcctgtgggcgtttcgctctgtttctttgtattttcctattaaagtgcccaaaacaagaattgatacgtcctctaatttggtaaaccaatggatctctgtgctatggctatagctaatgcatgtgatcgttagaccgacaaacgatatttataactcaattcttcataggcccatagtcatatccttagccacagtattcgaactacagaaatttctctaccccatctctattgaaataacacatatatacagataacacgtttataactgcataagtgtatttcaaatgcagatactcttttaagaggacaaatatataaagaatatatattggagtgggcaccgagcggttaaaatctaaaatataagtttctgaatatgcctgctatgtatttcggtgaaattttaccttttcttgattcctaatcttacgaataggaaccgaatatatatcattttccgagatcatgtagagatatgatttttgatcaaattccttaatatattaatacgttgatgtgtatcctaagaatgtcgaataatcctcaaatctcaaggttaagtgattagaaaatattaaaaacattccacgccgtaacacttggtaaattcaataaatatacaaatcatattaagacgaccaatccaacagttttttttttttttttttttttttttttgttgttgttgtaaaactaccattccaacaaattcattttaacataagcctgcctaacctttgagctttgatctactcccttttttttggtgtctaacctttgatacagccgtaacattaattagctgactatttaagctaaatcaatacactgtctatttttagtttaaaacgacacttaaataacactaatttaaaagcaaataaccattcttaacatagcttggatgattaaaaaaacaatctgattcttaaataaaaaggatcttatttcgtgtgattaccaaaaaacaaagtcttctttcttgtgccatcaaaagctacgctcgtatctcatgctacttaattaaaaatatagaccaattatgaaaagattaaacgcattattataaaatcagatagtgcggttcataatctttcaacatggatgaaattaattttactttttccgctaaggttcgagtttaacacatgtctgtctactccaacgaactttttttttttttttttttttctgtatatatggttttaaccgattgactccttataacatttttttttccgatgttctaaatttccattattgtactctatacatttcatttacattgagacatcagacacgtagaaaaaacatgcttaaaaacctaaataactaattttccaaggatccaatggagagtgaaaataaaaagagagaaagagaggcataatgtggccaaaaaggtacagagggagccaccaatgatagatgaagttttttcctatttcttttgtcttctcttccttcttcttataaattcctctactcctccttcaccatttcctcctcctcaccttctctctctcaacatctctctctttctctgtcttctctctgtctcaacgagaat

SEQ ID NO: 2927 - DNA, 927 bp, Arabidopsis thaliana
tcctgatttcaatacttggtttttgtgatgatggaatttgatcttatctatctatctatcacctgggaaaaaaaatgtgattttgatgtttcagagtttgtggttgtaacattaagagacatatattgtatgatggatttaggtatacaacagttggagttgcttggaatttgagtttcctttgtcatatgtgttggcctgcaaatttgtgttgtttgttgaaaggtttatgtgtgaagtagtgctagtagaatctaagtttgtttctgactaagagacatgaagtcatgggttgttatgctcattcatatcctgattgagatacaatttaaagaaacttagttccaaagattctgaacattcaccggtacagtgtgtctgcaaatggtattctgtctcacttcaatgtctaaacacgttgtctcaaaatgtatcgtttgttagatactcctttcaagacatatgatttagcctcgcatgtgttcgttgatccaagttttaccggtttgataagtctccagtcttagcaataaatccagaccggattcatgaccaatcgcagatttaccggtccgggtcaagttttaaaacattagtagaaatgtgtttcaccgaacaggaagacttatctgatagcatctcgttgcagtggataaatggcaaaatagtaatatacgtagattctgcttttatctgaaccacatagtgcagatggatatcgaacagaagaacatgatatcgagaagacacgtggcccaatgaaaaagccacgcaggctctgtatagccaattgcaatctggttttagattctcatctcacaaatcttacttatacgatcagtctcccacattcacacttccaccaaacacctctcgtccacatctttctcctttggtggcaaacacaacgacagatagagagaaacg

SEQ ID NO: 2928 - DNA, 699 bp, Arabidopsis thaliana
ccaagtccacgtcaacaccagtataatgttagagtttgcaaagatttgacattacttaagggctttattgaattagagatttagtttatttgtaaatgactttagatttggttcgactttatttagggtctaaagtttattgtataactgtttaatatttgtcaggacttaatgaagatgtaatgtttagactttggtgtattttgtacgacatgcatgatataataaaggaattatcataattaaattgaacttataaaaatatgacttgccttacttctcttttgaaatagaaattctaatgtaggtaaaatgtttgtgtttacataattacattacatcaacaaacgtaaaaaaatgtttgtgtcattaaatgtttatccacgtactcttcacaacgatcataagtcataattcagaaaattcctttaataaatgtgaactgaataagcttttgtatagtcatcaaataaaaagtcaactgtacaattaaaagtccgcaaacatctcgatcgtctaagagacgacttttctcgtaactttatgaagaatatacaatagtagtggcttgatcgcgtccacacatttacattgcgacttttcttgcatgccgtctcacgcactatatttaggcaaaacacaattgtcttcatttcaagactagttcttgttttctccatattcctcaacaacatcaaa

SEQ ID NO: 2929 - DNA, 1328 bp, Arabidopsis thaliana
tcgtcgaacattctccttctcgggatgttaatatgggccaggtcatcttttttaagcccacataatttatttttagctatgactgaacaaaacatgctgaatatgggacgggcttaatgggcctgaagactttaagcagattaacgaaacaagtgtgttgtgtataatatgagaaccatgtcgttctgatcggttaaaaactacagctgaccaaataacatctataggcttctgcggatatgactctacggcgtctacgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccaaatacacctaacttgtttagtacacaacagcaacatcaaactctaataaacccaagttggtgtatactata

SEQ ID NO: 2930 - DNA, 399 bp, Arabidopsis thaliana
tgatttgataatatatatatatatatatatatatatatcaaccaaattgtatcaaatttcaaataagaataaaatcatctaatctattcatattttcttactgaaaagtatgtaaataataaaacatgatcatcactaaaaccaaaactttacaagagaaggtggaaacatcatcaacgttttggtctgagactctgagtgataccaatggtatcataccataccaaacgaattatcatctctcattcaaatgggcctcatatttagacatgataaggcccattaataacaaattacaagcccaatttgttttactctctttcgttttcttcaatcgtatccataaaccctagtctcgtcgtcttcgtcgatcatcgccgggaaaccacaccagtctca

SEQ ID NO: 2931 - DNA, 1661 bp, Arabidopsis thaliana
ctagaaagcttaagaattgaatatccccaaagcttttttcatgtttttgcttgtttgtttgatgttgtttgctggcgactttgtgtgtagtattaccacactgcatgtactttatcagttgaataaacttgaatattgtatttaataagctatctacattagattttggggaagtttgattaaaatttattccgattgaagattttagttggcgatattgtaagattacaaacatattaaggttgaaatgtgatgggttcgaatgatagaaacagttttgtttgaccgacacgagaaagtaatgagaacacactgatttaaattgatgactagaaactaccaagatatttattggtcagatttcgtaggactaatcaaatcaaaaactacttcttttgagacaaagtgcatgtatcttagaaaattttcaatgattccgatctttaattagcaatgtaaacacatttttactatggaatatgttacgtggacggaactgaattgagtttccgaatggaaaaatatggaccacgtgaacagatacatatatggttgagttgagcaaagttcaaaatggtccgtacacactgactaattgtcagtattctaacaacgttaatttcgtggtgcacgaaaacaaaatgacgatgtggttgcacaaggtccacgttcttgtatattgttttttaatgtgctaattgtgcgctaaaataaatttaattgtataaaattagtatagtttatatttttttaatatgtatatgttcattcaaaacatttggataatatatgtttactatgtgatagactgatggtggaacattttatccatcttatatgcatatgaataaaaattattcaaaatgtttgttgttgttcagattattaattattaaagaattagaaaattttggaattacaggtatatatgtatgtgttgtatattgtatatttaaattattatgtatatttatatttaaatttttctattttcataaatcgttagtatataattgtgtcacatctaatattattagaagacaagttggacttttcataataaaataaaacatatcttttatcaaattaaccttttcctttaggtgcccaaatccgtagcaccatcaaatacctaagatatactttttatttccaaaaatcctttcgtttgatctaatattaataatataaacgatcaaacaaaacgatttttagaaatcaaacgttcaagtttgatcgttggtcgtcgctaatttaagtttgatcgactgctcatgttccgtgacaatgttaaaactgaatacatgaaacatgttttttttttgtgcatttgattttaataattttttaaaaactgataacacccgaaaaaaacagcaagaaactaaacaaggaagaaaagaacggtcggtgaggaactctcgtgaaagtcttcaaaagacttttaacggaaaaacaaaaaacaaaaaacaaaaactcttgtgaacgtaagtgcatggaccgaattgcacccgatcacgtcggttccacaatcctctcctatattaaggccttcactgctccttatcatctcaaacttctcatttattaataagtgtcattcaaaagaataaaatcaaatacttacttttgaatccgtttttttcattgtttgatcgatt

SEQ ID NO: 2932 - DNA, 242 bp, Arabidopsis thaliana
cctttgaaactctgcaatacaaaattaggggtttagagttgtttaaaaatgttttccccatttcacgtacattttatatactgtacttctgagataagcaggccttagacggctcaattaaatgggccacaaaaagcccatttaaagaacgtcacgtgacgcgatataagcatgatccgaggaacacacttaaaacaatcaggttccacatttggctttgcacaccttccttgatcctatca

SEQ ID NO: 2933 - DNA, 2000 bp, Arabidopsis thaliana
cttagatctgtttttaatttaacttggatttatactttgtactttgtttttgagttcttttagtaatgagtttgagaagtttagatttagtatcaatgtttttctttatttttgagtttttttttcattttcgatatgtttttattcccgagagatattgtttgctcgccggcttaattttgggaaggattgttttccttgccgacatatgtgttaaaaataaaataaatacaaaaataccctttaaaaaaaattccagcaattttataaaagtctatcgtttaattacggcagatttattcttattccgcagacttttttaactgcgacagattttctatggcagactcttttggttgacagactttttagaagatagtgatgacagatttataaattatagctgatttaatttgattgacagatttttattttattcaaccacaaacttttatataattttatagacttatttttttgtcgttgtattttcacggtaagtgatggcagatttatgattttgttaaacaaatctgtcacattgtaacagatttgttgtcaaaaaattaattactagaatgacgtctaacgataaccaattttttttaatgttatgacagacttgttttaagttataacagatttatgtaatcttacacaatatctgtcgtttgttggcagatttattttctaaaatatgatgttttgtgttatgacagagttgttttatgttgtgacagataaatttatattaccataaatctatcgtttgatggcaggtttaataaataagaaaataaattgctgaaatgaccttaaaaatattttatgttacgacagatttgtaattaggaattcttatggtgactgatttttagttttcttgttccataattttttgtagtagaataatactaactgttgtgacagtttttttttcattttagcttgttatgactgatttactaaaattagttacaatatttaactcataaaaaatattaatatcgagatacaactagggttttggttacaaaaacttagtctccttacaaaaaatatgtggcctcctttctttcttttgtttatctttttttttcctttggaaatctcttttcagtttttggagtagtggaagcaatatattgtttcatctcttttcctcgtatgtgtgtgggttaaaaaaatatgaaacctataaactcagaattttgagcgatatttttttaaatttttccttacttatttgtttttattttatttttaatttcattttacattatttttttaatatcagatgttaaaaatttcaaaaaaaatacagaccaaggttttttggtcattatacaccaaaattgtgtcaatctaattctctaatcaaatagagagtcattctagttattattggctatatttgtgtcaatctaggtaattttgacaaaaaaaaaaaagaaaaaaaaaaaaagagaactccaaatccagattgtgaagcatatttcaatttcgcacttattcgatcataaaagaatttacataattcgttcataaaatgtatgggctaaatttaggcccagtatgagaaaaaatccaaaaggcagtagtaacgttcacattatgccgccacaaaaaacgcaactgatgacgtaagcacaccgagtgttccgacgattctccaacgtggctttctcttaaacatccacgtgtctattccattctccaaccactgaacacggatcaagaaactaaaatgatattttgactccaaccaaaataaatatctaattttgtgagaaaagaatcttcttttgcaaatgcttcgctcctcaattcgacttctctatataagaagaaccagtcctctgcttcgaagtttatcatcatcatcatcatcatcatcatcaaaacgattcgattctgcgaaaccacttttcaattctcatcggattatttctcttccaatttctacaacgggagctaaactatctagatcggagcattca

SEQ ID NO: 2934 - DNA, 2000 bp, Arabidopsis thaliana
ggtttgtgttaatgtcatcgatgtgttaccatccgcattatattaattatttatcccaacataaagtcagaatctgtaatttctttgttataaaatacagtaaatggttccgtttaagctgttagatgatttttgagtaaaaactaatgtaaaaaaaacaaaaaaaaaacaatgtagttcataatacatgcatgttttaaagaagtttcttgtttactatcaacttgaatagtatttcacgaagtcaaaattgttcattccgacttttctatgtggagaaaaaaaattctatcattgtgcacaatttaacagaatgtaatttcttgtaaaagaagaggaaacaattcgctgttagtaaatgtgaagtatagaagtctaaaatgagatacctcaactagcttgaattaagaaaaaaaacaaaaactctatcgacatgaaaaaggtcgcaaatatttatcatttatcaatgccaaaggagtatttggttcacaaaatactgaatcatttatatagatatataattagctctaaattctactataacttgcaaaataagtatactgactcaattatatagcgtttaaaaatagacgatttgtatgatgaggtccatatatatggagatgtgcatgcaactatcgacattttcacacgttgatatcgtctttctccaatggagacttgaatttgtgtaaactatgaatactcgtctctctaagaccttttttcttcaaccatgccaactatttaggtaagattttactgtctttgattgatattaaatacttagccgtggcgttatcaatgaatgataataaaaatgcggataaaagccaaaggtgttggaaataaatccaagaatgaagacgtagatgtcgatgggtattttaagaacttgaatttgtcacgactcacacgttaaaatatattatccgaattgtttagtctaaagacacacatatattgaaaaagaaaaggtaaatgaagctcattggtgcctaaatgtgaaatgaagccgaaatgtgttaggtgaacacatttaaatatacaaaaagaaatataatagaaacaaaactaattaacaaagtcgcaatttgtattgtataaaatatctttccgtctcccgtcatatttgaaaaaaaaaaaattacaaatctgttaattttaaaactttctagaaaaacacaagtatataattttctcttttcgtgcgtgtttgttttaaaataacattgttttgattggcgactcaacatattttagcatttacatatttctgcatatattaaatgatttataaactcaactatagattaaaatataatttgacatctaataattttaacaataatataaaatatgagatttataaattacgaatataaatattcaagggagagaaaaagtagaacataattcaaaagataagactttttagacttttttaacaatatttttgatggataaaaattattcaaaagagaagaaagtaagaagaaaagatgtttctgagaatttctagaaacagcatccgtttttataatttaattttcttacaaaggtaggaccaacatttgtgatctataaatcttcctactacgttatatagagacccttcgacataacacttaactcgtttatatatttgttttacttgttttgcacatacacacaaaaataaaaaagactttatatttatttactttttaatcacacggattagctccggcgaagtatggtcgtcgtcttcatcttcttcctccatcatcagatttttccttaaatggaagaaaccaaacgaaactccgatcttctccgttctcgtgttttcctctctggcttttattgctgggattgggaatttctcaccgctctcttgctttttagttgctgattctttttccttcgactttctatttccaatctttcttcttctctttgtgtattagattatttttagttttatttttctgtggtaaaataaaaaaagttcgccggag

SEQ ID NO: 2935 - DNA, 1335 bp, Arabidopsis thaliana
cgtcatttgaatgccacacacaaagataaatctctctgtacaagataaaaacagatacttttagcgaatacttataacaacactgtgttttgtccaattcaggggaggttctacgatcaacccaatgcaacaattctatatgcttccgtttcataaaaattctgaatatcaatctaaacctatacaattacatccttactaatctagataaagtgtatacaataaaatgagagcaataaggttcattaatctttatacttagctcctccacaggacgatatactttgagactgacacaaaacaaaataaggaagaaagcttacgtttttgaaggaaaatcacaggagggacgcggaagcaagattggtctgagaggaaaattgaggaagaggggttaatcgagatgaaaatggagtttgaagtaatagagagaacgttgcgcagatcgaggaagaacagaggataggatcaacacaaggatcttgtgaaaatgaaaatggctgaggaaatgaaggactatttgttaaataagatataatattatttctgaaatatttccatctgactcctttaatttatacaagcctccttttttgtacatctattttcagaagatccaaataattgtttcttctatttgtgtatttttgatatttaaacgtaaatctttggattttgatcaataatagacaattagccaagttcagttttcattaattagatttataattttaattatttttagcattcgtctaaaattaaataatgcggcaaaagaggagaaattaatttttgttgttattaattcaaagcgttacaaataaaaaaggaaattccacgctggcaataaaataagcgaaaattccacgtgacatctacctgtcggatcaaaaagagtggaattgacatttgtttctctcacactctctctcgaattctctggtagcttctagttctatgcaaaaaaacgacgatagttctctatctttccagatgaatctccttccatatacaaaagcagtcatgcctcctcgctctctcgcaattcacaaagtatccaaacatctaaagttatcaattttacaacattaccgctataatctgcttgattctctgcaaaaagagaagactttttaccgagaagaagtcctctggctcattgaagaaactcaacgaaacaaacccagttctcatatatcgttttaaggtaaatgatcgcgacaatcttgttctcatttgtgtgtttttgtgtttgtgattagggtttacaaaagatactgagattagtttttttttttttttttttttttcagggattacaaaagctaatcgaag

SEQ ID NO: 2936 - DNA, 813 bp, Arabidopsis thaliana
aacaatgacaataatctcatcagtaaccatctgtttgcttgtctaggtctggccaccagaatactttgggtcattgagatgacgattatatacacatacacattcaggtaatcaggttgtctgcctactgtatacgtcaagagatcactccaacgattttgttgcactgtaactcatgcgagtaatgtatcattcatgtgggataagcattttcgtctactctcctttttggcagtaatagaagaaaagccatggtcctgatattgtttctgaaacccgaacttcaatatcaaatgttaagattcatattgttggtatcgaaaaagctggtgcgttatgggatgataattgtgtccttgatacaaagttttatagatgttttgattcatttgggggactcaagccaattgttcaatgttcaccaaaaaaataaatttagacgaaatcattaatgggcctcgatattatagcccaagaaaaaacaaaaaaacggcaaggcgttcactcgccgacctgatgcattgcacgtcgtctcagccctcaacaccagaaacttcttgaaagcacctgagaagtctggtaacgtcgttaaaagaaagaaacgaagatccctgatttttcaaggataccatcgatcaaaataattttcaagaaactcgcagaatgttctatcttactttccatactctctccctataaatatgcgaaggctcgtagctgtacgaaccaacaaggagcaaagagttcatagcaaagcaaagcttcaaaacagagcaaacgcaaagagtagcaatcacaagaggaagtgaaacg

SEQ ID NO: 2937 - DNA, 663 bp, Arabidopsis thaliana
ggaagaggaaatggatcttaaagctgaggttgacgaagatgggagcttcaaggtgtgactagtgatcgatctcggagataatttagggaggaagttagatttgagagaaatgaagcgagaaagaggattagggtttaaaagattcttcgaattgaagaagagtgacgatgaaattgctgacttcatttcactttagtccgatgatcatataggtaggtagatgatattgatacttcacctcacaaaagccatgactcatgaatcctctgcgtttgcgtttcaaccgtattgacgcggttcaatcaattttatacactaaattcgaatgaaatcgtaccaaaccggataaatttaacatccttactaaatccaaaacagaatacatatgggcctgaaaacgaattggtcttgggcctgaccgaatcaatcgcttttctctacattcgtctagaaatatccatctacacttctccaacgatcaagacgtttctcgaacgttagagaagcgcttttaagttctataacaccgaaacaatcgctctctctacattgctctagaactatccaactcaacttctatttaatactttcttacatcaaaatcaaaatcaatcaaaccaaagaaaaagccaagaagcaagaaagttaacacaacagctaaga

SEQ ID NO: 2938 - DNA, 400 bp, Arabidopsis thaliana
agaagacaaatgagagttggtttatatttaaccataatttcattcagttcacactgaaccggcgaaatttctttgccagacctattcggaattgaaacaagtggagtctcgaaacgaaaagaactttctggaattcgtttgctcacaaagctaaaaacggttgatttcatcgaaatacggcgtcgttttcaaagaacaatccagaaatcactggttttcctttatttcaaaagaagagactagaactttatttctcctctataaaatcactttgttttttcctctcttcttcataaatcaacaaaacaatcacaaatctctcgaaacgctctcgaagttccaaattttctcttagcattctctttcgtttctcgtttgcgttgaatcaaagttcgttgcg

SEQ ID NO: 2939 - DNA, 756 bp, Arabidopsis thaliana
tctaatgttaacgttgagatggcaatgatttgtatacttgattctcagaaactcatcaacattgtcgtcaaggacaagtttttttggtgatacgaggagtgtttatagtagtagattctgtccaatggtgtggctggatatgttggactatgaaattttaggatatcttgtattcagtttttagttatttccttgctgagattgtgtcttgtagaaaaccgtttcaactttgtttggtttatggcggctataaagtttaattttaatgcatgacaaaaacaaatcaccaaaaataaaataaattactttcacgacacttttgaaagcactgccctaggcgtgggccatgtgacagaatgaaagaactcagaccaaacttttctgtccaaggacaggaatggggcccacccaattagctcccctatccattattcaccgtaagatgctaaccagatctaacggctaaaatccacccacgttccaatctcaattgcctttggatccttgtatttcctcaaggctcacctttctccacgattcactctcgatatccgttcgattcttcagagatctgacggcggtagccagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaa

SEQ ID NO: 2940 - DNA, 1520 bp, Arabidopsis thaliana
tctttattttattggtcttatattaacttttattttttttggaaaactatattttttaaggatctgagctgatgaattaatcaaatagtaaacaaaaattaatttattaatgttgtgttaataaatcatttatttttgtgtattcctcttcttcttccttatttttaaaaaattaaaaaatgttcttcttataatatagtgtttaatagaaagtgagctcacacaacaaaattagaaaactgtgaatgaatgtaagagagtgagtggaataaaaaaaatataaaaatgaaatctaagagtgagtgaacaaatgttggtattgtagacaatggtgactaaaattaaaaagaaacaaaatgatataaacattaatctaaaaaaaactaaaataaatatacaaattctgcatttctaactatactttcatgtattatgtatacttatttgattcatacatgatataaccggttatttagtttattttctatcaaatccatcaattagagcatgaaatctatgtactccttgataatgattttgatcaaaagtgtaatttccacaaaccaattgcgcctgcaaaagttttcaaaggatcatcaaacataatgatgaatatctcatcaccacgattttataataatgcatcttttcccaccattttttttccctcactttcttttataatcttgttcgacaacaatcatggtctaaggaaaaagttgaaaatatatattatcttagttattagaaaagaaagataatcaaatggtcaatatgcaaatggcatatgaccataaacgagtttgctagtataaagaatgatggccaacctgttaaagagagactaaaattaggtctaaaatctaggagcaatgtaaccaatacatagtatatgaaatataaaagttaatttagattttttgattagcccaaattaaagaaaaatggtatttaaaacagagactcttcatcctaaaggctaaagcaatacaatttttggttaagaaaagaaaaaaaccacaagcggaaaagaaaacaaaaaagaactatattatgatgcaacagcaacacaaagcaaaaccttgcacacacacatacaactgtaaacaagtttcttgggactctctattttctcttgctgcttgaaccaaacacaacaacgatatcccaacgagagcacaacaggtttgattatgtcggaagacaagttttgagagaaaacaaacaatattttataacaaaggagaagacttttggttagaaaaaattggtatggccattacaagacatatgggtcccaattctcatcactctctccaccaccaaaatcctcctctctctctctctcttttactctgttttcatcatctctttctctcgtctctctcaaaccctaaatacactctttctcttcttgttgtctccattctctctgtgtcatcaagcttcttttttgtgtgggttatttgaaagacactttctctgctggtatcattggagtctagggttttgttattgac

SEQ ID NO: 2941 - DNA, 2000 bp, Arabidopsis thaliana
aagaaacatgagacatgtcacaatcactttaaaagttttcctatcaaaactcgagtagaagcacatgaaatttctggatattaaaaataaataaatcaaaatagccttatattattgctgtcaggaaataattctatttagactacctgaatttccagttgaacggcgtttttccaaattgcaagcatcatatattatgctcatcgtatcattagtgcataaataaactatggaccaatttcatggtgaaaaaggggcttcggatgaaatttttgatcaaattatatttgtttattgataaaacaaacgttttttttaaaggatgacagttgtgcgtttgagatgaaaaccaaacactgctcccactcaaaatttgtaaaaatggaatttataaatatttggtgctacaaatgtcgtttggtagcctttggaaacattaaaggtaaactagagatatgggagtatggaacttaatctctttatgtggttgtatttcatataatttcacgtggcccaacttgtttctgtcaatccattgatcaaagttggtagacaagagtgaacccacacacactcacacacatacacacggtcgatctttttttctattctcgtgtccctacgtcctctaaaccccatcattatacttcttgtgttttattggtatgctgagctagagatagttaacaactacccaacaatgcgggtctggcttagtttgaacctattcgaaactagttatactccgcttgaagtcattggttcgagactaactttggagatgagtatcataaacagctctaacttaagattacaatacatcctcttgttagtctaagttgagaggtgttgccattgactatatatttctttgggaatttggtttaccaggatgttgcaaagaagatttaaatagttataaattagtacaaattcaatccatatgatatgatattcaaaaaacaaaaaaaaaaaaaaactgatctaaaagtcgaaccaaattctaatttgattagagcatgtatataattgaatccctaagtaaaattcaacccaatacttgagaaggtagttatattcttataaattatggatatgatttgattaaaactcaaacctgaacccaaaacatactagaatatacgtttttactttgtaactatttgtcacattccaaaactaaactcggtactatatttgattctgatccatacaaattttgtatatctggtttatattctccatgtgagattaaagcggtgaccaatcaaaatcattgctggaatatcttactattaagctaaatgttgttagttatatacaagccaatccaaaaaaactgatgcaaagagagataaacgaacatatcccaaaatggtaggatttgatttaatattcccatcctcttattagaaatgcaaacaaatagactatagttttatttatttattttcactataaaataactaaataacatgaacttattgaagaaaaagtatactatagttgtgattctgtgatatactagttagaacaagaatctttacaaaaaaaaaacacatgggatgttaggagaaggagattcggattccaatgatccaacggtcagagaaaaatcagaagaaaatttcacaaccgtaggatctgttcccttaaccaccttgtaatgccggtctttattaattttgagaaaaaaataaaaacagcaccaaacttatgtctctcatgtgaccgaccaccgcatcctcagttgacctgtctctgcccccactttgtctccccacacaaactgaataacaagaagaagaagactttagatatcaaatgactccacgtgtcgatattggattggttttcattggttgtatcgtgtggaccaacgaagcaacatataaaaagcacgacgcggtgccattactacaataagagaagtgtaggagaagaaagttctcatttcataattgtatcaaattgtgagaggaaaaaaagaagttcaagaa

SEQ ID NO: 2942 - DNA, 2000 bp, Arabidopsis thaliana
ggcttaagttcaatattgttttttaggcaaaacttaatgttcaatatatattcatggaattaactccataataaacagtaactgaattctcttgtactttcttaaatggttttcagtaaaaaggtttagtttaaccaacaaataactttagcaatcatctatataagcataaagcatcacatagatctagtagttatgtttctataatacattttcactaagactaaaacatgcatgaacacacaaacaggaaaaaactattctcaagaagtttgtttcccaccatgttaagtgattctagaaatctgtaaatggttaacctttagtattcattcgtgcaatatttaacagacaaatggtattcattcgtgcatctctcagtttgtgagaaaatacattgcatgagttcgttattaactggaaataatacataaaactctgacaatcagaacctctaaattatttacttataagaagagaggcaacgtatcttgcatcgcttttacttatctaatcttttggtgatggaaggggcaagaacatagaaggaatctttatcttaaaagaagagaaaacaaataatatccaaaattggtaaatccattgaataaagcctaacgttaacatcaaatcgcatgcggattagaagctaaatgcacatagttaagcgtaatctatggggagaaattaattaccactttttggttcattcttttaagttttatgattcaatgaatacatagcacgtggaacctctctcccccacaacccattttgaagggaaatgaataattaaaagagacatacacataagaaagcacatggctttaccattcctctatcaattaccaacacatttgacccttatccacatgggtcttcgtctcctattataaaatcaaaatctacacacaaaatgttataacattttccaactcacaatatacaaaatgccacgcataaatatgtcttcgcaagacaaatatgtaacgtttaatattcgatattatctgagatttaaccataaaactaatatttctttattaatcaaattacatctacgagcaaaaatgataaaattcaacttatgcacattcaatagttcgtaacacataagagtacttggaaactctaaataatcttcattttggaatcaggattcaataaaatagtactttatttgacataagtgtccttttaaccattttttacaccatacgttttttcttctgaatcgaaatttttacatcatactttcaaaacatctattaatcttttaagttaaaaattaataaatcaatagaagtaaactaaaaataataatcaactttcacatcaaattttaagacaacacattatatttaaatatatattaagaatatctattatgcaacaaatggattaacaatcattagcacttgatattttctttataacctgcactatacactttcaaaaagagaagaagaaacctttaagaaacagtaaataaatgttattataatacacctctttagtctttactttatttatattttctctgtttgcttttattccgggtcggccgatagaattctcatcatttcattcatttttatattctttcgttataattattatacatcctttgaaagaaaaagaagaggcaatagagatggacggctaagatgttaacgtaaacaaagttggcggagggaaaagaggagcgtggaataattaaacaaaagagtcgtgtccacatgggcggcctcaagcttcgtgtcccacttttgtccccttgcctctttcttgcctttcatgcttccgacaacacttctctctcttcctttaaccctaacttcgatgctcctttatatatatctctctccccttttctccaaaactcatcaaccagctcaccaagaacaagaacaagaagaagaagaacaagacaagaagaacaaagtacccaagaaaacacacaagaaggaaacacaaagattgatattgatccaaaagca

SEQ ID NO: 2943 - DNA, 2000 bp, Arabidopsis thaliana
aaaaaaaagctaggcgtcgaaatccataacttcaaaaggccttcttacattcatccaatctccaaacttctgtcttcacgcatttattgctcagggacatcatgtcgctactcactgccacttatttgaattgacatccattcattccatacatatatattaccttcacttaaagttgtaagtatatagaattttaagcattcctgccaaataagttttggatcgaacctaaactaacaaagaggttactgttttgtaactttcttttttgatgtggggtcattcaaagggtttacatgcattttacaatggtctgtgatgaatatggaggttcagtctttggtagataaaacttgttatgtggccttaaaccaaatagattgtagtttgtacaatgacatatttatggttatattcggttttccaatatgtttaggaatatatatcaccgtttttttttgggtagacattttaacgattatagaggaaaattttgaatgatggctgtactgggaaaagagtgtaagttgtgatcatcatatgtaattttattttgtgtgacattataacacttcttccaaaagacaaaagtttaggttaattaatataagaaaccaataaagaatcatgaacaaagagagaacttctatcatttttgatatgaaatcgtccgttaaaatattgttctttgtgatcgcatatgctgtatgtacttagatttgatcaattaatcaacatttacaacaaaataagatcaattgtttataatgatgatctaagcgaatttagatttgtttgttattatagaactcattactaaacatttaagttccattctcgtttaaaacatgaacgctagtttatgaaactcagaaccaaccatgtaaaactccacaaaatttctagtaaaatgcttttgttcaaaataatgaaaatcataaaattttttgatgaattatgaatcctaaaatctatctgaattaaatatagttaactacaaaagaaattgccaaacatatatgtacgcactttgatcaaataactagctagtcagcttagtttgtttttttcaatacatcccctataaatctatgttatccctaatcaagtattacaataaatgatacagtaataataaccttaatgaaaaaaacttatcaaattatcagagataaggaaaaagaaaacactaataaagttgtttttttgtgtgtcaaagttaaaattttagaggacaataataacattaagaaattaaatcgtggccagtttgctagtgaatatgtcggcttcatgagcataactaaataggtataaaaaaataaaaatatcggaaaaagaaaagagaaggaaaaaaaaaggagaggaagaagaaaaagctgttcctgtgctttagcagaccttttggtagttgtcctggtcgctgatcatccctttccgacaactctgttgctctttctctcacgtttgagtcttaatcttcgattgtccttggtcatccttaagttttgtttttctctttcgattcattttccagatttctttttatagaaacccgtctctttgatttgattccccccaagaaaggaaagcaaaacaaagaagagcagctgaatcaagtaactttgtgggtgtttttgaattatctgactcgagataaagagcttcgttaaaaacggaatcttttttaaggtcgtatgctttgtttgtctctccggagattccgcgtgtgaaaagtcgtggtttttgatctctttgagatacttaaaatttccgagaaattggcggctctgtcggagataaaaagctgagatcttggagttccccatttctgattaacgattctctctgctgttacttgagctaggaagctattaacaacttgagtgaaagtttagggcttttgatgaagctctcacgcaaagagcttagctttgtataagctcagattcagattatttattgggtttattcttcagagaaagtaaagttgagtgatc

SEQ ID NO: 2944 - DNA, 1399 bp, Arabidopsis thaliana
tgcatgtatcagtaattcagtatagtgtatgtctgacttctatcattcttagctgatgcatgcatgcttcgttgtttatcagttgatcacttattcaataataacgtgaaacataaataatcgcatctaaatttcgtggtaacgattacttaattctttcattaattattttcagtttgcatgatttgttttccagtatttaaaaagcttaaaattcaagttttgatatgcaacattgcaactcaattcgaataaatcgtcacttgtggttttaggcattggagtcagtggcggacccataattttttatcggggtcaaaatataattgaaaaatacaattaaaatcttgaaaacaataatgtaaaaacaaaaatacaatgcaagattgatacaagataaaggtgaaattaacttacttgaagctgattggagacagtagagctcaagaacatgagaaccaaacgtaaacttcgtcaactgataactgcatccgacaaagacaaaacaaacatgtataaggagaaaaccaaaagcagacacttgatctaagtttaaaaaccaaataaaacaaacatttgtttgtgtaacaaaattactcatcgttgatgaagaaagactccaagcagactatctcttcttcttcttcttcaacaattgcttctctacctttatcactttcactgcccatctttgactacagtatacagtcagaatcagatatttcagatcccaagcttcgaagtgtgttccaacaaatcaaattcggaaataacaacacatcagctaagggaatcgacgaagaaaggtattgattaacaaataccacctctttgttactttgttagagaggtgcgcttgttgatcaactgcggcggttccgtcaacttcgaaaagtaattagatttttagagcagaccatttcggttttctgatttgaaccggtttgagagagaaaaataaataaaaagaaatttgcacctataagttataaccaaacaaaattacaagtcaaatattttattttcgtcaaaaagattttattgatagaatgtgggatcgatttctaatgactgttatttttgtttctaggttctgataaaaatattttttagttaaaatcagtattgctttctgactttctcagacatcacaatctcataatacatcgtgagagatagattcaaacatccctaattccaaacttgtacggtatgtgttaaattaaaaacttaaaacgactgatccctaatatcaaaatgccgacataaaatataaatggaagcgttgaattagggaaaaaaaacagaatcaaaattaattgagatctgattacaaaaaaaaaaaaagagaatctttatttgtatttgcagaagaagaagagaaaaagtttgaaagaaa

SEQ ID NO: 2945 - DNA, 1193 bp, Arabidopsis thaliana
atgaatctgctgcagccttggaggtcgtctctcctttgtgtattactactactattgatgattatgtaagattctgacatagatgcaaagatttggtcttttactttggtttgatttttttaacttttctcaatgtaaagtttttaactggaataaggtttctctgaccagtttagggcttttagaggatctgttgtacatcttttgtgacattctcattctctttacatatttcttatctagactttttaaaaattcctcgtgtgtataattatttgatgtgctacttgtctgattccacgagttcgagttttgtcgtgtgattgaattcgaattgtcacttaccaacgtcgttaatacactaacactatgattggtctgatcgctggatcggtgaaccaattggaaaatccagttcaagttgttttagcaaaaaccaatctcttctctgaaccggaaaactgtaaaccggtcagtacttgatccataagaaaccctccgagtgatttgaagggtttgagctgtgttgaaaatggttcgtcggctctctctaaacccctctttttgtcgactgcttcttcacgccgtcgaggaattcttctccaccaacgaatccggcgacgtcttatcaccaccttgtcgaatctttagttgatgttgtttaaaggtgagtccaaattccacgcgccgccttgactttcatgaatgtgtgttttgatacatttcctacatattccgatgttttctagctagatctccaacgattttctgattgaatttagggttggttacatgatgatctttgactctaactcgcaggttttagctaataagggcatgaaacggatctgctcggtttcaagtgttcaactttgtaagttaaactaaattacataactttattcttggcctcttgcaatgtttttgcttcttcaagtcttttgattttgtattagctcagtgactttgataaagtgatgatttttgatcatgaacagactaatgaattcttcataaccttatggattttgtgaattgaaacagatattactctcaattgcctatagatagattttaagtttggaatcctttatctaataactctctttttagtttccagaagtttcagagctttagcatcgccacgttccttgaactatcccctgcagtgtatcaagcgttcatcagttcgg

SEQ ID NO: 2946 - DNA, 2000 bp, Arabidopsis thaliana
catattttgtcacatcttcgatagaaatacatatttttaataaaaacaatatcctaattcctaattaagaaattccggagatccaaggtgactgagaattcgcaatagagtaccatgaatcataaggtctaaaacttgcaatatgcatcggccagaaaagatgacacaattactctagcgtttgtaatgatatcaaaatactaaagaaagatgggataattatgcattttacgcgctagaaatatgtgtagtataattattttttggatttactgttgtaaaattcgtcagaaatgcaagtcactaaacaacagcaacaccacagttgtattgttatatatcagtataaatttatattcatatgatataaatttagcttctagaaaagtagctagtcactaatcaataaaaatgcataaaacttacactatcaaatgatttcaatttgcataactacaactcatggatttcatggtaaagaaacttagaagctactacaatagaccgtggactatttctaaacaaatgcaataatgaaactgtttaaaagctattaccaaattttacccgcaaataacattatatttgtttctggagccaaaattaaaagtccatttcctatcttgatttatgcttgtacccatactatatcttcaatgtttcgataattagtaattactccaatataaatatatatttttttaaagtttttgtttttactattactttttttatgtttaaactttttaactcactaatcttttttcttacaaaacctaatctacttttactctctaaatcggtggactatatatatatatatatatatatattctcttcttctatgacaaatatttgtctcatttatatttactttgactaatagcataattacacataatataatagcacaaaagataacaattcacttgtgaataaaaaaaggaacgaccgcatcgcatgcattagttaataccgttgctggaattgcggttcacagggctctataagtcccgtatccataggatccgacacgaaaatatattattttcctatatataaaatagaaaataaagttgagagataacagaagaattaaagttgagaaaattcgaaataaaatgataaaaaaaacattaaattactacaacaactcgtgggtgaaaaatgactttaaaacatattttaaaacttaacaatatcctattttaaaatttcaacaaaaaaaataatatagatatgaaaatccgagcattacagacaattagcttaggaaagagaaacatagtcctaatcaccaaatgttaaacacagtgtaagagattttgtcttctttcttttgtctaagattttaaaacaaaataaaaataacaagagagagagagagagaaagattagtttaagaattaaactgctaattaaatacgaaacagtaatcttctcttcaaatgcttataaaaaggcccttcacaatctctcattcaattcacacttcacatttggatatctctctaagtctctctatactttcatttctcgtttcataatattaggtaagtctaattaaatatctcatctccttaatttttttattcgctcactaatctctctacacctttcagctaaacacaaaacaaccaaaagctcaggttcttgtgttttggtcctctgtttatttcttgctcaaaaaacaaccaagagctcacttgctcttaatcacaaactgagacttttctcagtcttcctctgctttaactagtttacttgggacagattctgtataacataaacttaaatcaggacatgtaactgaaacatgtcaagtttctaaatttaacttgagttctaaaaccgttaacacaaacacaaagctgtatgctttcctctctgtttctatgctctgttttccattttttgctctctgtcctctcttgcttagtaaggtctgtttttttttttgcaggaaacttgttagtgtttaaggaaacaaaaggaagaag

SEQ ID NO: 2947 - DNA, 1431 bp, Arabidopsis thaliana
ttggataaaattgttgaccgtctcttcgcctcctcccgaagaaatcggatataagaaagaaggaatgatctggagaaaaacgaatcagaaaaaggtgttttcccgagaaaatttgagaatgtctttcagagagagatcttcaggaggaagaagattaacacgtcgagcggcaccgagagaaacgcggcaaagtgtctttacctttatactgtacttctttttttaataaggaaaattctcaaataaagtttttttttataaaaatggaaaattatcgtattggtggaaaaagctgtagaaataaaaaattaaattggagcttttattatccttgttatacgggtcggtgacacgtcgggaaagacaggcgaatagttttgtttgagctggccaacgagtttatttttgttttcgtttaaagagagaattaaaaaaacaaatctttctcgtcctggcaaaaaagaaagaaagatttacttgccaacctcaacaattaaaaaaaaatgttatattgcttctttgtatattttttaattgagaaaacactttgacaaaaagaaaacaattaaaaaaggaatatatatatacatttgttagtttaacaaatttgagattaaaaagaaaaaacaactttgctagtgggaattaatatggaaagaaaagattagcttaagagacatttagtaaagatgtaaaaaaaaatacatgttaagagcttcaactagtcatacatgacattgtaaataaaacaaaatatacccacaaagttctatagttctaaaaaaaacttttaacttcaaaaataaaacaataatctaactttctaagtatagtttctgaaggttaaataaaatttgacgtccattttcttttcattgctgaaattcattttgaaataaaggagaaccacatatgtttttgtcccttcttcttcccttcactcgtttttgctcttgtaatcttgcttgcactttttctatggcttgttcaatcgtatccactcacattgtgttttccttttacaacatgccgcacaacagcccaagcttacggtaattttcttaaaatgatggcaaacaaccactttatgatcatataaatgaatatagatgtgtatatgtacttcatatttgaaatcgattgaatgatttggttttgaccacatatggaacggtccatgcaaatccatgtggctgataaaactacgacaagtaaaaaaaaagacgcttcatgtaagttccaacataatctccaccactatcttggagcttcactctcacacacacatcatcccatcatttttcagtatatatagaaatattaacatacaatatatacttgcataaactaacttggttctcttagatatttctttagagttaaataatcatattcaatttttttaaaaaggatgttagaagggaaagcagt

SEQ ID NO: 2948 - DNA, 1239 bp, Arabidopsis thaliana
cttgtttaaattatgaaactgaacctgaagaatgagaaattagatacagatagaaaccactcacaaaaccaaagaacacaagcagaaaaccaaaaacatgaagatgttaagagatctgtggttcagtactcaatgagccagtaaaagatcacaatgagtccatcacagccaacaatgccctagtatctaaatgtcatagaaattaacctaaaagccaagaagatcctgagacaagccacaacaacttagggaatagctatcaagtgttacaagaacaactctgcatcaatgaacctgttgtgtaactcaacaacttaggaatagctattgatctgcaaaactatcacaattttcacaacaatcagagctaaatgaaattcagattagttatcataaatctacttacagaattttccaggaatatactaattcagaatcaacaaaccacagatcgagtaccactttcctggttcaccaaaatcaaaatcaaaacttttctggttcatcgcttgaagaagaagaagaagagaaaagaaagaaaatagaaaaagaaaaacaacactgaaaaggaaaatttcctaattttagctattcaattgaagaaaatcacgaaaagttgctttttcgtataaaaggctagaactttagaaaagtacgatcccattaatcaaacgcaacataaagcaacttagatttaagtaaggaaataattgaagaactttcatggtaagagattcaagtaaacagatatacccaaaaagagtagtagaacaaatcttcagggagaaacgatggagaagacgataagaaaggtgtacgattcttcacataattgaaagtttttgtcttttgttactttttcctttgaggcaacgaagcaatctagctggataattatattattctctcttttatttaatttatgtttaattaaaacttaaaagtcagatgcagactgctgaggacgaaaactcaatagagtaaaccggttttaaccatctttaaatcataaacaaaattagtttatcattgagtatttatgtaataatatattttaagtactcgattatcgtctaattaatgatcaatttatccagtttccagttttgcattcgaattgagttcctcctcggagcagcgtcaaagtcaacggccgtctgattcttgtttatctcctaaacccaaaaacaacgatttcactgtcaccgttgtcaagctcgaatcacactagccgagacg

SEQ ID NO: 2949 - DNA, 2000 bp, Arabidopsis thaliana
aaatctttggtctcactttggtctctttacttaaatatgcttgtgattctgcatatgccttgtgcttcactctctatctctctcactctcttttatcaacataaataatggagaactgtatttgttactgtagattttctttctctgttaaaaacgagttcatcattttctatatgctttgttaaatatgtcattttagttgggtttttgaaaatggttgaaatagatttttgagttgatcgataaataaataaatgaaaacgtctggacactcttgagcgatctatcagtatctcgtgatcttcttcaatactaataaaaaaagggaaaagaaagagaagagagtcgtgctcataaattaacggtgcagagcgattgaacaaaaacaaaaatatcttccagaaaaagccatttttgattgcgtataatgaatacacgaaattaaaatcattacttgccatatatagtacactatttctcagcttcactcactctcgagactcgtgtatgttgatttacggtttgttcaagcaaaggtgatcatcaattcccaattttttttacgtcactattttcgattcactccaatggcttgcgtgttgctgatttcttgattttgtggttcttgagttagtctccatctgataagtaagtaaattatgtgattgtgatctgggttttgctaaagttttgatttttattattgttgtttagagaatgatgaatctaggatctctttcgttgagtacgagcaagtcgagtaagccaatggttagcatcagcttttggataccgtatttcactcactggggagagagcctgctggtctgtggctcggctcctggacttggttccgggaatgtgaaaaaaggtttgctgctaaagccatcccagcaagatgatcagctcatctggagtggctctgtctcggttccacctgggtttagctctgactattgttactatgtggtggatgactcgaagagtgtgttaaggtcggagtttgggatgaaacgaaaacttgtggtgcctgagacattgaccggtggagagtctgttcatcttcgtgatctctggcaggtttgagttctttgtccttttcgagtgtattatacaaattttgtaatctgattttgtagtgttgtgattgatgttctgttcctttaattttagagtggggatcaagctcttccatttagaagtgcatttaaagatgtcatcttccaccacagtttcgatgtgaaagtagaaaaacctctaggggtctttatgaataagtcagatcaagatggtattcatttttttatctaatcctatcacaccattgtctctgagattctctagtttgtgattgatctctttgctaactgttgtggccttatgactttaccatgtaaacagattcagttgttgtccaattcaaaatctgttgtccagacattggagagggaacatctgtaagcctttctctatgatctttggttttctttcttttcatgtttgagcctgatgtggtgttgtggccatcattcttacccttgattatgacatgtacaggtgtatgttctaggcaccccagaaaagttggggaattggaaagttgaaaatggacttagactcaactatgtcgatgattccatatgggaagcagattgcttgatccctaaagcagactttcctatcaaatatcctttctttttactttcttccagactaattagttgaacatagttgacacttcacttctcatatgctttctgcatgttgggttcttaacgattctttcacatatagatactgtaaagttcagaaggaagatagcatagggtttgaatctggtggtaatcgggagctgtctcttcactccatcggtagtaaacaggaatacattgtcatgtcagatggcttgtttcgagtaagtaacagagacaagctatgaactagctctaatgtgacagaatcaatgttgtcttactattatttaattttacttgtaggca

SEQ ID NO: 2950 - DNA, 702 bp, Arabidopsis thaliana
ggccagattcagattctagcgcgcttgtaaggttaaccccagacccaaccctaacggctacctgtcgatttacacacaaacacacacgagtccgcacgtgacaagtcatgggttgggtaagttaactataatgaacgacaaataaataattaaacttactaaagcaaattatagtttgacaaaaatagtcttaattttcagattattagttggatatgcatagtttattcaacttttctcttaatatttttattacatgattttttttatttttggagatttatcagttttttttgttttaataatagtttttagataatttggaaaagcaatgatctctgcatcatcaatcataaaaattaaaaaaataaggcctcgtcgctatatcttctctctagggttcgctgttgctttttcatcttcttcttctccttctctgtttctctgctttcgtcacgaaagggcgatatgtattgtttctcagtaggaagctcgttactctgattcgattcgattctcaatcctttcatcaaaccgttttgggacttcggattttcatattaaggtagcgtatccgcttagggatccaattttctccgagaattgtctccttctacaatctgattctcctcgatttttccagttttcaaagcagtcaattagggtttgtagactaattcggatttggagacggtagcggtt

SEQ ID NO: 2951 - DNA, 2000 bp, Arabidopsis thaliana
tgatacgtattaaaaatgcatttggccgctcaacatgctataaatatatatatatatatatatatatatatatcgtcacatatatttcaaaataacctgatacttttacatatttgttaattcctgaccacacattttaagtttttaacgtcgtaaaaataaacgaagttgatgacgttcatttctaatttagcaatttatagtgcgactgtttaataaaatacaagattcccaaaaatacaaaaggtattttgatcaatagtacttcctaaaataaaatcatgtttcaaagctttataataataataaaaatgatctctcagttacaattgtcttgtctcacttgattattttctgtaaataagtttggatgtgaagttattcagtacaattaacctaaatatttaatgtgattgactaaaactagctaaatagggttcacgggaaattgaagcttttgactatgggaaaatatatcaaaaaagattgaaaagtcttttgtttttgctttgtcaaagtgctttatcttcttcatgtcacaccttttcctagtatttatgaagatgtgacatcttctctcaataattcaatcgcgacttcctaagtaacataaatgcacatgtgcgctaatatcggatgttgctgacttccttgaatcaaaaatttgtgttgctcatgaattttttcttttttaaaactgatttaatcaatatacatgaaatagttcgattcagttgttgctttataagtacggactaggcagagaaaacaaagaaacacatctcttgatttcgatcaacaatggctgcttttacacacttgaatatctatctgcttttgttgataatcagtgcaatgtgatttggttaatttgaagcaaaataattaaaaagaaaacgagtttgccaaacatttaattctgaagagaaaaagtattaggctattagcccacaattaaccaaagtattagcccacaaataacaggcctgcacttgacggcccatttaaccttttttttttcctgacaggctaagaaaatatctttcagaaaattataaaaagtaaaaagcatatggcataatatatttttttttttcaagtgggaatttacctataaaataatattccccacttagatattccaacaatctatgaggtttggcttttttgtacaattaatttgcttgtccccatttaaaaagtgtctctttataattatatatcgccaaagatttacgcatggattcgtttttcgataataatatatcatctatttctttaaaactcgattaatgcactattagcggtaacgcaaattactggcaaaattcaagttattataatgtttctctcaaatatttttgtttggctgaatgagaaagatgtattagacattgtcttctttagacattatatatatttactagtactaattatagtaaatatacacacgtatacaatcggagtagatgcgcatgttaattaccaaaaaaaatacgatttaagtgtgccatcatctccgttaatctagggttagctggataattatcatttacgttttgatgatgacaaaaaaggataaagaacaaaaaggtacatactaatatatacatatatgtaaggttaaagtttgtttgatgagtgcttaaattcgatattctatttaaaattatatctctattcgctaaggattcaaattcaaataagagaaaaaaaataaaaagtaaattatgcccaccccaaactttgctatatatacaagaaatatcaccttctctttaaaaccaattaaagagacgcatttaaaagcaaatgaccaacaagcgacttcaccatccatctcttacaaccctccaagaacactggctgttttccttcactttctagacaaaacaaaaaccatcttctagagaaaataaaccaacatgggagagacagaaaccatggcaacaaactaactaaaccatagtatatattatctatactaatattatcggccc

SEQ ID NO: 2952 - DNA, 39 bp, Arabidopsis thaliana
tttcagattctgatttcctcagagctctctctgtttgaa

SEQ ID NO: 2953 - DNA, 2000 bp, Arabidopsis thaliana
cctatgaaacaaaatcagggtcttaactagttttttgttttggttttggttttaatcttttctagttgctttgccttatttataagcgcagatgaggaagagaaaggcgaaggcacatcagctgcatgggacgttgctgaagctgtggcgctctcattgtgtgatatcttcaatctctgttaatagctttgtaatggtggtaacaatccaaaaatacccaattacaatcttataagtaccaatcatcatccatcctatggtttttcttttttaaacaaaatccgatataaaattaataaaaatctattgtattaacactaaaggtctatttacgaaaatttatagttacaatgatatgaaatgatagaaaaaatgaaagattataaaattgtattgaccgaaaaaagaagtttaatatatatatatatatatagggatactcattagaaaatctatatgcttagtgaaaaatgactccttcccataatattaaaaacagataaacgaaattgttaactaaatttattcaacaataataaacttttaacaatgacaggtcacactttaaatggaaatatgcattgatagactttctcggttgaagttgtaactctagatttatttttgtagaatttaaagatgtattttgttccttttgttgtgagctatgaaattaataccttataattgtaggttttaggaagcggttgatgtatagcatgtgcagagtaagctcgaaatggctgagacgaaaaaaagtgtcgccacaatgatttactttttactactatacttttgatcattgggacctaatggatgaatgttgtgtgttgtggacgagtttatgacacataacaatattgtagacaaattgtctaatttgagtagagatactaaaatttatctccatataattgtatactgtatatgtataacaaataattcaattcattggcctaagatgttttattgtatctttgtagaattttacactttagagaaaaatcattgcaataactcgatgaaaaaaaatgtttatcttatcctagttacaactaactatctatctatctctttgtggtaggagatttgcatctgatcgaacgattcatatggtgccacgtaactatggtcccacttctattacgagatctactaagacatcagcacgtgtcggtgtcgtttgatccacgaggtcggtgacgcttagagctagttgaccggtacagtcggttattaccggttatactatatgtatgttttttggtcaaagatttggagctattttatagttaataaatcaagagttttttttttccacaactaggtcttaatttgtgattgtttttttcttccatttttccaaaattctcttatcaatttcaggttagtatttttgttactgtccctagcttttgactattgtactactgtataccctttttttttggcttgagaaattagattttgttatgtttgcgtaaaatatttgtgaactcaaaaataaaatctctttttttttcattgccgatattttttcttccatgaatgctgctgtaaagtattaatttccctctctactgagtttcttccaaatttctgatttttgggatttgtgcaactcccaagtcgatttcagtttctgggttttgatttgagttcgccgattggatttgaagttttagtctttgttggtaagttctatcctttttgagatgttgaatttgctcttctgataattagggcttctgattattagcctaccaatctttgatttggttttcatttccttcagctaaatatttgtaattcttggatcctgaatgattaaccatcttagtttgattggtgaaagtataccatagctgcttaggatccgtttggctttgttatttgctcagattctgaaaggaagggtttaaagtttcaagcttttcattccgctgaatcagtccttgtatttggacggcttgatctgttatctgctctcgtgggtgggg

SEQ ID NO: 2954 - DNA, 2000 bp, Arabidopsis thaliana
gatgtggccgaggttgaggtgaggaccacgtatccaaaatatttacagtccttttttttgtttttgttaaagatatttttgcattcgtacaaaagtatttgcataaaaggcacctaaccatttgttttaccgtatataaaatttttttaactgtctttgcatgccggtttttatcatgaagttcgaaattttttatatacggtaaaacaaatggttaggtgcatttgttacctctttcttttattatttatcatccactaaaaatcatcgtgtaacgtagaccacgcataaattctaaattattcttgaccctgaattattagtacaccaattaaaatatttgaatatcaaactgaaccaattctcaacagttttagtgtacagttctcaaaaaaacaagttttttggttcaaaaatagtatttacaaaatattaaaaaaagaaataaaagaaatggaaaatttaaattttgaaaaacatatagtagaatgctatatttatttccagcttcaagtttataaaatataaaagaaaaagaaaaatatatttgtcagtttagtaattctagaaaatgtaaagatttagtttttaatgagcataagaaagatctagtatgcataatgttaaaagtcatacatgaattgtatatctagaacatttcaacaagtatttagtaaattaagaaaaaaagaatctagcaaactaatatttaaaaatgcatattatataattaggtatattacgtaggaaataaccatcgttcgacttcgttcattggcgtggtttgacaactagagacgcaactagcaaggttaaaactgtaattccatatctgacgaatatgatttgttgatagaagggtgagatcgtaatttcagatttataatataaaaaaaaacaattttctaattgggtcgactattgagcacaaatgctataaactcgtcgccgttgcttcaagctcctaaaacgtgtccaagtatcttttgcatcttcaaagcaaaagaaaaacatcaattttttccaaatttttatcattttctcaatcgtcagtactcagtatttagagtcaaaaatctcgtcgaagaatttcttttggaggaagcgttatttttgctaaaggtactaattcaacttatttttcgttttaaagtttttgttgtgttgttactgtttatctttgaagtgaacttggaatgtttctggttttgagtcaaatctttggtatcaagttatcttctattttctcagagatttttgttctgtccaatggaatattctagtaattattacagattttacgaaggaattcttcaaatcgtgatatgcgtcttcatcgttctatatctttcttcatcgtcccccgatggttcttttatattcttagcattcttcgagattcgaatcttaagttgatcctgttctgttttataatctgtatttaatataattttgaatatttcaaaggatgagttttattttcttgcatgatttcaacaaatattatcaagatgaacttggatcaggtcatgagtaaactgtttaaggatttgatgaattttcaagctctgttattttttttgtttaaagaatattccttaaatataccaatttagtggtcataactcataactcatataaaggtaaagaatatctagagtaaaaataaataaattaaggtaataaaatctgagttatttaactaatcaaaacacttcaaatagtttctcttgagagttcataaaagagacacaagtacaaaatcacgatctgtcactcattccgacacgtttctagagattcctcactagatgtaacctttatgtaacgccaagagttaaaaaagtaaaattctatatgaaatattcgaatatactcttttttgatactttttttttatctaatatttatttctccaatctttaggtcaaacaaaacattggatttcgagaactgaagaacaagttttgatgggttctctaatgcaatctgaaccagag

SEQ ID NO: 2955 - DNA, 2000 bp, Arabidopsis thaliana
gatccggtttaagagaatacgcgatcgtgatgggctcaccactattgggccttgtatctttaggtttttatactttcgtaggtccttttggtttgcacaataacacaacttctttttttttagactacaatcgtacaataatgatttcgtttattatattgtgactaaaactgtattttaattttctttgtaacttgtaggcttgttaatatgattgtaagttgtctcgtttaattatataggattacattttaattgcttccgcactaagtgatgagtaagctaacactcatcctaggtctggcaatgcaatcttgataaattaagcattcgtttttggtaataatatatgtggattatcctgaaaatggatttgtcgtatcaacaacaaacatgttcatgtacaattatatggccttttagtttattatatttaacgaatgttaatgtgcatgactaggtaagcaataactaaagtcgggcaattatatatgttttcttcaacagttggacaatttacaaacatatagactcggattattcaaattaacaaaatggtttacgtgtcggcgtaagttgataataatatttaagagaacaacccaaaattaagttacttgttaaattgaaaatatatatccgaaatttatggatttggaactaattttagatctttaatatttgtttgttagactccaaaagttgctcgtggtggcattatgatatttgatcacttgaaattgaactgaaaccaaatactcccatcgtggtgaaattatgtgatttttttttcttcttggtattagaatcaaatagaaatttatatttttcaaagctaagataaacatgccttgaggtattcttgatgcttaaagagcatggatcagattcatcggataaaaaaaagttgtagtggtctttctgaaatggaatttaagtttagactatttgatctctcattgaaactgataacaaatccttctatttgttttttgtttgttaacaaaatacatataataaacacttctaaaccaatagtagtattgttttatcaatttctactgaaaatagacgaataagaatgttaatttatcccacacagacagagacaaaggtagggtgtcacgtgcgtcgatcacgtgtgatagtggttggatggtagaatcttcttcgttatatggtatggtatggtggtgatcccgttttttgctttataagtgaaaggcaaaatgcatcacgattcactagacattttaatatgaaaactactattttaaagacagatcacaaaaatattgtataaaaaagaaatgaatcaatagtcgaaaaaatataaaatactatttttttgttagagaaaaaacatataaatacaaaaacgatttgatgtttaagtttgtgttgctaatctattaaatttaataattataaaatttcacgtttacaaattataatttttatttatactttagtttaaatttaaattatatcattttgagatttgaatgccattattaaatcatgttactatattatactcacagtttaaatcgtttcaaaatagtatataaaacttttatgcgttagacgataattgacgaaatgcttaacacctatcactttatattttttttacacattagattcaagattagtgtgcattttcacagtaagtgaataaacaaaaacaataaaacattgttattgtcgacttcgcatgcacatgattcctcaccccaaatgtgaccgtctccacaagattccactgagaatcaccacgtcatcaatttatatgggccccatctgacgtccaagttggactactgggtcccaacagctgcctcctctctcttctcttctcagccatggaagccataaagaatagctctttctccttcttgtctctcattcccaagagccagtggttgtgttgttgtagttccgttccgtggctgtctttgtttatcatcgtttaatctcaacctcttaaatcggcagcc

SEQ ID NO: 2956 - DNA, 847 bp, Arabidopsis thaliana
ttcatgaaggaaatctattttaaatcttttactgattttcttcaatgtatcatttgcaacgaacccttagctaaaataaaaaaatatactcctttcgtcttacaaagataaatttttagaaaaaacattttttttacaaagatagaagttttatatctccaatgtaaattttaaaactttttacttgttttatccttattaaataattatgtatatatttattattattttcaaagtgtattaagaagttaaaattgttattatatattattttttaaagaatgtaaaattctaaaaaatccatcttcgtggacggagagagtattaatttgtgctacttttctcttgaaatgttaatcgttattacagcctttttgaaaaaagttgagtaggtattgtaatagtatactttccacgtatgattgagaaaactcaaggtgaggcagagaggagccggtggggatctctcatactctctctttgtttacagagatccaattatcatatcgagccatgaactgattctgattcgatttggcaataattaacatttatcgtctttaaacgattaaataatataaattacattttaaatgaaaaggaccatgcatccaccaaggtgatactgactgcctaattataaatgtcatatcaaaatttattactatatggtttaacaaaaattcttatctgaattttttttctttttcttatctgaatgctttcattctaattaaagattttaatatatgaatattcgcacgtggatatttgtataagatatgcattaatctccgaggctatgtatagttcagaatttgaagtgaagtttaggagaggaagagag

SEQ ID NO: 2957 - DNA, 2000 bp, Arabidopsis thaliana
aaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatgagaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatactatgtttctatcggcatct

SEQ ID NO: 2958 - DNA, 2000 bp, Arabidopsis thaliana
tagtcgactgaaattaaaatgagatataagaaaagagttgagttctgaatacatcaattacaaatctatatagcaagatatggtatgggccgtatagtaactttagtaaccccagaactttatggatcgcatttactcatcacatgcatataattattgttgccttctccatcaaatttcgatgtgccttattttctgaaaacatttctaatagactaatactgaagttcaataacacttcgagtcatgtaaaatacaaagtgaaacaagtaatatatacaaggaaaaaaaaaaagtgagttttttcttcaattgtctgactaaaataagagttgcaattggagatatagtaattttttactttatataaagtgagatatacttttaagataagagttgagttttttttttggtaatgagttgaattttaaatagaaccactacaaagtgatatatatgtcggccgccgtatcgtaagttcgtgaccccaaaaatttatggatcacaattgacgcatcacgtgcatatagctattgttggcttctttgcattttgacgtgcctttgcaagaaattgtaagagacgttttagataaagcgacaccaacaaaaatgaatattaaaattttaaaacccacttaagaaagcaatgctaatggcattaagatcgttttcaaattttataacgggatgtgaaactctgaataaatttgacgattgaaagatagcatattgagataagtttgaactcttaaatttgacggttgaaagaggattgaagtaagtgtgagttgtccaaaaaaaacggtaagtgtgaaactctttaaatttaaatattgaaaaagagcagtgagatatcagataagtgcatgtgaaaccaaatcccagctcccaaactaatgtattatagaccttttttctttcctttgaccaatatatatatgtgtgtgtatttatcttaattaagtagtttaacttgaaacaaaaatgtaatcataagattcattagtcgccaaatgaacaatttttttacatgttattttgttaacatcacctctattattctatgcttaatttttaacttaatctgtacatctttttgtcaataattaatgagatacatacattagggtttatcaaaaaaatatgagatacactagtcgcctaatttggttacatagcatatctttggacgtggatcagactaattagaagtgtacctattgttgcaattggaacgatttcagggtcaaatccactatccatctctttatgaatttcattaattagtcgcacaatccaatttctatcttttgttagttgccgggtgaatataaaatactttgatatattgacgtaaaggcaaaagatactttgcatgatagtacaaatatgtatccattacaaatatgatatatctatacgtatatttttttttttcaaacacataaagcgaataaaaatgaacattttgttaatttgtgactgatggtgatgctaaaatgtttcattcatattggaatggagatgtaaaataagtatacgttgaaatgccataattccttggaaatgaatcgatgataaagatcaacctgttttcattataacaacaatacaaaaggttaaaccatgttcacaccaaaagtccattctgatgatcatttacgaaaaatcctagatattcgtttgttattttgttcttttcattcccatgttactttttgggtcaagaagaagaaatgaatataattgccatagtacattcttaatacttaatagcagacaattctggttatttccaactaataatctagacctcagttggaaaaacaaataatcaaccaaagcgtcaaagtcaaagcatatcaattattctattattataaaccctaagaaaaaccaaacgtacaccaaagagtacgtactagtccactataaaaactcaaaaccaactctttacctctccacaaatattatctaaaccaaaacatttcaaaagaa

SEQ ID NO: 2959 - DNA, 1875 bp, Arabidopsis thaliana
ttcttacactttaataatcttaccccatcacttatatctggatggttttgtgtctttaggtctacctttaacactccacctgcaatgcaacacttcgacccaaattggcattcacaaccatatccccagtgggaaaacaaggaacctgcaccccctagagtcgttcagcatcatgatttctcttcacagccaaatcacttcccgcaccaaaatactcaagcagtatccgaggttcataaaccactgcatcaagatattccacctgctaattttgagaagcatcagaaatctgagactgccagcgtggaggtactccttttgtaggatctgctaatggtagatggatcttgaactacgaactaagagtttatttagacggtttaggtctcacaaatcttgtatatacatgtgcttgatcttatatctgtagactagaagtgatggtcagaagatttctagtcattcaaatgcattccatgaagatcaaaatacagtgagctcagagtgtgactggagtgaacacacttgtcccaatgggaataaatattacttccattgcatcacttgcgaaagcacggtaaaagtttccctctttcaatgtgtactcctctgaagcaatatctacttttactgaatttatggatgaacacacagtgggagaaaccggacgaatactccatgtatgaaagatggttgaaagagcaaacaaggctacaggatgaaaaaattaaatctcccccgttaaacaatgagagccaagaagcaatcgaaaacagcgagcaagttgagtctgatgtattacaacagaatggtgaactccaacaaccatccttatccacagcggttagagaaaatttcaataatgacacacttggagttccatttttgtagatagtctcttacaagaagagtaaattccaaacttttctgtgatgtgtgtttcaggatcaggagaacaatgtagtagtatatccagtaacaacactagctgttgaaacaacatgttcataaaaggtttcttcaggtaatgaagtgttgattctgtttattagaattcagtgattcagcagatgctaatttggtttctgagctcttaaaaattgtcttaatctgcagtaaaaaaatctactgaggaagctttgtgtgatgagcaatggagagatgaaagctgtaaaacggagaaagaagcagattttacgttttggttagaaacttttagaattggaaaggaaaaaataatcgaaaaattattttgataaacggtaaataaacctattttcacctgatccaaaccaaacacttcacggtatcaaaattaatctctactataatcccatttcaaattcaattttgttatttacataaatccaaaattttcgggaaaattaatttccatcaataatgtttagtgaaaagtaattactgaaaattatactccatttaaaaaaaaaaactcgagtgcctctctgtgagtgagagagttacatcgtcagtcatcttcttccatttaaagacgaaatagattcgcagaacaaagaaatcaaatcactcacttgcaaggaagaagaagaagaagaccaaagaggttagtctttgcttgattttagtttccagaattcgattttgagtctttgtgcttgaacaactctggattgatctatgttgtgtttttcttttcgaatctcgtcaaatcttactttgttcgtcccatgtctagatcagtgaaagatatatctctcgatctcgaattccatatagatttgatattctgcagaagctaaatgcttttgttttgccgaatctgatgcttttgtgtttgattcgtaattgattttgattggtcttcttaactgttcattgtcttcagagtaagta

SEQ ID NO: 2960 - DNA, 1773 bp, Arabidopsis thaliana
tggattgattaccacttaccaactctcatattcatatatacacgtatacaacaatcatctattgtttatttgtatattggggcttttatacccaagaaggcaggggactgcctattcttcctctgtcattacatgtatgggatcaataaaagcttgtgttgtgttttatgttccttgtcattttttctgagaaatgtgtattggtcatctataacaatcactgatcatgaaccagtactgtaatagagatatatctctagtttactggttgtacacatctttgctagtatatatttggccaagtgcatatacgcttattcactcactagaaagatttccccatgtgtaacttatggtaatttttcatgtaaatagagtttcaagagctatatgtcgtctccttccaatcactaaagttagtgacaaacttagtaagtaggtttagtttcttatgaagtcaatttgtccaagcttgaatattagatctttgcgcattccgattaaccttcattttttatgtttttcgggtcgagataggcgtaaccatcaaaggttcattctggtttgaggtactcccataaacatttcgatgaaactccaatcctgcctccggttggagtctagtccacttgaccaccttcgcttcctagagatctccaaccctctatagaaggattacttacgcttcttgaaccaccattccaagcaacaacaaaccaatggaagcaacgacgcaactcactctaccaagatcatttccaacatcggcttgtacatagtatagcaccaaaacaaacacattagtcttactacttccaccaaaagtagagagaaatagagccacaaaaaaagagttaatctagtaaaatacaacagaaaatctagtaaatacgacataatctagtcgatctttcgtaaaatagcatagaaaatcaattaaaatcttataataaatgtgattagtacggacaacttcctaggatagtgatgattattctgtactaatacaaatttcatagttattaataaaagaagagttgaaaaaaaaaaaaaaaaacgaaagaagtcagtgacattcgttacatctccattggcttacatattcacacagacaaaaaaaaaaaaactccttccattttacctttttcctctcccaacaaaaaccctaaaagatcatctctctctgcagattcagtttctcgccatcgacgacgacgacaacaaaatcacatatcttctctatcgatctccaatcatcatcttcttcctaactacaggtccagcttcttctcttcgatttccctacgctttcgtctctctctcaattcgtgatttgtattcgtttaaatcgtcctcgtgatttcgtgaaatttcgccgaattctggaatcttctccgatatttcttcaatttgcttccatctgtagaagaatcagaagctttggtctatgtcggtcaatttaagaatctgttcccaatttttcttcataattcactttcatcgttttacgaattggaacctttcgaatgtttcatcgttttgttagtcactggaattggcttagcaaaaaagctgagtctctatagaagactgaatttgcttatttttctggaaaaaagtatcaattcaccattttatttacctaattcatagttttggtagctaagatatgtgttgtgttgtagttttaaaggttctaaagaagtctcatgttagcttttggagtatcaaattaactatttgctcgtttcttggtattttttaggtgtattg

SEQ ID NO: 2961 - DNA, 630 bp, Arabidopsis thaliana
ggttggatcaaatgataagggtgaagatctcaatgtttttgatgataataaaatcagtgagtgatggtggggacagagtaagtgagattaataaatggcggttatatttgtatttcttacatcattgactttatttacaacgatgactttgtccttgcctatgttacattgtatcatcatctatttttgattcgaagagccaataagaaaccgaaaaacgtacacggactcttacttagctaaacaactcgagtaactaatggttatcccttaatacatgtcatatctagactctagtcatcgtttcggatccaaattcctcaatcagtcatgtgattttgtagagagacataaaacaatacacaaaaataaaattttgtccattaggtgttgaagataaaaaaaaaaaaaaaaaaaaaggtgtgcaagtgttatcaaggtcaaagaaaaaaagttcgaacacgagacttcatgcttgaagagagaaacagtaaccactagaccactaaaagaaatttataaagctacaagttttattaatatataaaggaaaataaaatctctaaaaccctacaacattcatttggaggaggagacctgaatctttgcaatctcgcaacagaaacggcg

SEQ ID NO: 2962 - DNA, 2000 bp, Arabidopsis thaliana
atatgaagagttttatgatgatgcgaaagcgagctagccgaaaaatagaactaacgtttcgtttatagtctgtagttagttaagtttgacgtaaacattgatcttgaaggcatggttcagaccactttttaaaatacctttaaagttactagtatagcggaaaaaaaaaatttgattaacatctggttcaaattataaaattaaacattttttatacagaaaaattggaaatagttttagataaaaaacaataccaattagcacatgaaaaatagcggctactgaataaaataagtaaaaacataagctcactcaagatcaaatccgatttgagttaaagtattgcgatagtcaagattagatttgatctgtgtatcgtggaatcatcctaaatgttataatttaagattacgaatcaaacaaacacatcttgaaaacaaccacatggctgttaaaaacaattagtattactattaactaacttcttacatcttgaaaaaacaaagagttccttcacatgaggccatgagcatgtgacatgcttgagttgactttgaaatttgaatggatagggccacgtcaacgcattcaaggatccttaattagcgcttaagtaaaacctctttatttgtcgtgactcgcgaaccccttttttattaacgttttagtcaacacaacatttcattaatgataattctactactattagtttgcaatgttaactaaactctttttacgtgagaaaacttaagattatcatttccagaccaccgcaagttccttgaaaagattgttatatatataacagctgcatatcttaatacggatttatgggctttaatttgaaatcaattgtatcaaataggtttgaaaaaaaaaatcgtatcacatacctttattttttgagtgtagtataagcaagcaatattgatgaatgcgtgagtctgcaaaatttaaccccaaaaaaaaagtaagcaacaatatatattcagcaatcatgttagaaagtattttaatcatgttgaactgaacgatctccgcgctaattagtattcctaagagacaccaatcagaaactattggatagttcgacggtttagaatttgtccagttgagaatggttttcaaactattttataaaatttttttagcgaatttctaaagttaagttgaccagcacatcttgtggttaaatgtttcactcgtcgttgaaaaagtcttttcaacaaaatcttactttctggatataattaatatcatatgtacaaaaattgattaatgggtcttaaactatttcatgtatttactatttagatagagacgtttaaaaaaaaactattttcgtgtctttactatttagatagagattacacgacatggaaataatagtacatggtcaagtttatatacggacgactctcatgaaatcctacaacaagaaaacaaagcaacatatagtataatgtgaaatatacactgttaagcaacatattacgtattatagttatttttatgttaatgacgtacaatgtacaaattctagtattcttcacctgaattatttgatgctaaactacgtacgtcgtggttattttcattgttctttaattagccatctcgaaatataattatttcaatgttacaagattttagtcgctctaataggatgtttatgaatttaaaccgacccaatccgacttgttttttcttctaaaaaatattatcttgaaaatgattttattaaattcgttttcgtcttagtctaattcagctataaagtataaacgttatgaccaagtccataatcaaatcatcatagtatttctccttaatcacaactacaagaaaaggaaatgggtcatgactttcttataaaacattaactaagatttgaccaaacataattttgtattatcaatattacaccataaatacggccacatatcctcctagtttcttcacacaactctcccctcaaaacattccatcaaaggaaaaaa

SEQ ID NO: 2963 - DNA, 2000 bp, Arabidopsis thaliana
gctttcattatattatactactatttaatttccgtaccacagtgtcttactctgactctgattttatttctttttaattaaataatcacataaataattcactatcacgactttcgtttttccatttaaattaaactaaaccggttagattcgtttttcttcaccaggttaatgtgaaccccaatttttctattttgttaatgatgttttataattgtgattaatacaattagaaaatatctaataattaaagttgagaccataattaaaggaaagggaactattgtgtgaacatatatatattcttacacactcgcagagcaacccttcttcacttgggctcattggaatgtgatatcccaaaaagaaaaggcaaaacaaactactactaaaaaagttgagatagtaaaaatacaattgtactttatcatataataattcaatgtacaacaaaactcaactaccaaagtttgcttattactctcaaagaaaaaaacactgattaaaaatagcaaaagagatttgtttatctatatgaaaaataaacttatatagaaattcttatatgattagttgcaattgtaggtgtaacatttaatcgttgatttgtttttttttttggggtgcatttctcttgtagttgtaacaatatttcacacttaagactttcagacaatagtttaaaaacaaccgaacagaagttgcaggtacctataacttgtgtatgaatccatccacagttttgtaaacgttgactgtttgacattttgaatgtaattttatttaattagatcctacacaacaataatcacatctataatttgccaatacattttaataaaaccacttaacaaaatggttttaacttttaatccagtaattttctgtagttggtgtcatgatttataactactgtacacatttccaagatctaacgaacaatcataatcgataataattgtacctaccaaatttggtctaaaaaaatagaagaagtgattatatatatattcttttttgtttttgatgctaaatattttttttttaatgtgattatcgtttatcattgcacctcacggtaattattattgtttttccctgattttataaaaaagatatatagagagattattgagaccaatgaagagcagaaactgttgggagtcaaaaaaaacttatctccaatttctaacagtgttctatgtcggattccatcaatctctctctcttccatcatctgtcactttctttgttttctacgcaacaagaaaccgaagaaaaaaaaataacaatttactaaagtattaattcctttttttgtgtgacaaaataaaaacccactaaaaagcaaacgattccaagaacatggaaacaaatgtgtaaaaaggaaataaaaacatcaagcgtgggctgaaaatcactacacgaaaatccaaattttggtaattctattaaattttttaagttggtaataaagagaataaatacacaaattgactggccagtacacaagttgactgattaatcgcaaattatacataattaataattaaaaaacggtaaaaaacgttaataaataaggaaataaatcaaaacaaatgaagagtgggattagtaaagtattaaagaaagcatatagagcggaagaaaactgaagatggaagattataaaaataagtgttgtgaagaagaagctattcgatttttatagtcttgagttttattttattttaataagaaaacaaaataagatttttaaaaaatagtatattatttatttattaattttcttcagggctgttgtggtttttgaggttctctataaagcaaagtaagaaaacatctacacaaatgtcccaacaatctgatcagaaaaaagtagacgaagaagaagaaattaagtcacttgaacaatggcgttggtccgaaatgcaaggccttgagcttctccctcataacaccaacaacaactcacgaagctccagagaaactcaccggaa

SEQ ID NO: 2964 - DNA, 2000 bp, Arabidopsis thaliana
tatttagtgcattcccttttgattttggttaaattcataccaaaactaaaagagattgaatataatgggtgtatatttttcctgaaatcataagaatttgactaaaatttttagtaaattcacaagtaaaaaaagaagaagtagaaattcttctattgatacgtttattttgtgttctggagaaaaatatttctcattttttttttttccacttttccatcaaagttatgctgaaaactttttcattttttttaatcctggttggtattaagaaaaattgagacatatatttcaattgttttcctctaacatgtttaccattcaccaattggtattatttgttttattgtcttcatttataactatttttcttttgtcaactcttgataaacaatttttctctttcttaacagaagttattttagaatatattttacaaattggatcctagtttacgcaactttgtccatgagaattgagatgtgcgtagatgtatcgattatccaacttcttatcttttttttatttttttgggttgcttggctttgttgattggtgtctggcgacttggttgtgtggtggtccaccaactcacggacatcctcgttatcttcaatcagatcattgaatatatatttgttctattttaagatcattgagaatattttattccgagatccagattttaatcagatcatttcaagatttcacgtaatataaatcacaaataagtggaaaaaaactctataaaattatagtcacaagtggtagctagtaatgaaactttcatattggttgaaatacgtatcaattatattaattaagtcttttgacaaccatacgatatagctggtgcaagtgtgcaagattattctagattctggtcctaaataaaaaaatatttatctatttataaagatatgaaagtttaatagtacaaccatatatcattgagaaaatatgataatgtctaaattttcatactaaaatagtatacatcatggcctaatcttaaatcttaaatatgaaactaatttcattgtatatacattatttcatgttcttgttatgaaattaatcatctgaacattgacgtaaatttaataatatttaaaatgggaaacccccccagtaaaaaaaaaaaagatgattgaataatatagaaaatattgtttgtactaaaaatccaacaaaggtcgttaaaatttgtgtaattttcgtgttgcagttggaatatggagcagacgagtcgtacaaattagtggttccatctccagagaagccgtcttatgcacaacttgaggttagttggtaccattgaacacctaaccccagcttttgtcactttctctaactacttatatccataaagatttaaatgtaaattcagctttataaccataaaagaacctaactttgaagattttgttttctttaatagttgagttcgacatgcaatcaaattttcaccgtaaaatacatgtttcagaaaagaaaagaaaaaaaatgaaacacttctgttgtgttttgttttatgatctagtacttttgcagcttccttttaaatgtaatttttttttcacccactatagagacccatgtaacataggtagggacatgaaatggtgtactccacgtgagctgtattaaacatgatgggataattagtgtggtcatattttgttttttcctctataagaatacaaatgcttaagcacaagtcgttagctatttattatgtcaatatagagaaaggtacaaaattattgtgaaagataagtgtgattcccactagtgttggactgttgtgtttaatcaaatattatatgaaaagaaaaataatacaatctccattgatatttatgttaccacgcgtgcaggccaagagtgtttatggtgcattgcacggtctacaggtttgtgtttgctatttttccaatttggttatcattatagttaattaaagatttgagttactgaagaaaatgaaattattgtaa

SEQ ID NO: 2965 - DNA, 1119 bp, Arabidopsis thaliana
gaaaaaaccggatatccgcggatattcgagatccgtttatttttgggaacaaattcaatttcctatttcaccaaccagattgaattcaccaccaaaagagatcgacgtgtgcccgacatcagactttgcaaggcacataccaccaagatctcgtctttaacggtgtccaatctgctcctcctcattcatctccgccatcgacactttgaatcccatgtatcatcattcccgtaagtaaacttccgtccataaatttacgacggtggaaccgagatgaatatggtggggagacggtgatgaagattacatggagatgagatggagatagtgaaggaaatggtgatgaaggaaacattcacggcggcagaaaaaatatgttatgaaaccctaatagttaagtcccaaacaaactcaaattccatcattttgtcgtagtgggctaatattggactattgggcttaacattgataatgtgtatttgattaagcccaggatacaaatataacttaagcccataatacaaatatgtagacatattgaacggatgcggatattcggctctgatttttttcataatctggatccgtatccggatccgccggactcgtatccagatccgccggactcgtatccagatccgccggactcgtatccggatccgtcgcacctaattattcggttttccggatcggatcacggatccggattcgaatacccgcggataacggattttagtcccaggcctacatagcatctacggtaattattaactattaagtaaccatgggtaaattcgaatttccttgccgacaaaaagaaggaactttccattccttttgtgaaagtccgtgagaacatgaacccaagttaatacaccttcacatgattagccccacttctcctaaatgtctcgtaaactccaactattcggctaagattcactaacgtgtcatctctctattcgctattcccagatctccatgacccacttcactccctgcgcgtccggtacaatcgccacttccataacaccaagagtcaatacaaaaaaaaagccgactccattattatccctctctctacaaaaaaaacagtagagagagatatagagagcatca

SEQ ID NO: 2966 - DNA, 2000 bp, Arabidopsis thaliana
atggaaacattttgacgtgtgagattttaacctctcctattttcaaagattgggcaatatggggttagaagcttgcaagggggggttcacgtgtagcgtaaatgtacaatgatgtcacttcctacactttatcacgtccttgaatttataggaataaagcaaatgttctaatcaataataccaatcttgcatgtttatttaattattatatagaagtttgattttataacgaattgtgtaatatagtacttttgtgatgccgccgttcctgaatatgttgactttgcaattgcaagccagacctagaactgaagaaaaaaatgtacgaattagtcatttatttattcgaagcataattcatttggaaaatcaggaagaccattatagtacggagccaaaatatttgaacatcacctaacatgttttgtaagcttctttgatatttattcttgttaataaaattttactttcttacggacaatagatgcaaccaatttgcattaccttctaaaaatatctactgtagttgtagcggtgcacatcaattattataatttttgaaaaaatggtgtacccaaaaaaacataaatattgttatagcaatgaatacaaatcaaagaaatatatgtatttaaaaacttaaaaatagaagagttgtacgaattcactaccgaaatagacaagatttattttggccaataccaaaattaatggtatataggacatgagtgagtcggcttaaagagaagaaaataaaaagaaataagaaataggaggagatgtaacagaatggaaaacgaaaggtgtggaaattgatttgagaagatgtcgcctaataatattaaccgacaattagtggcctcttctctgacttttgacttatacactgttttttcacatttgttggtgctctctcactcccacccaatcacggcccttcttttctaatcttactactctataaaattaaatattttttaaaaacttatagtgatcatagtgtggaacatttgcttcaatagttgacctagtaatttaatagtatctatatgatgtatacaatgttctttttgttgccaatatcgatagaaaaaaagttttaacttattcgaaaaaagaagacaaaaattattatagagtaggttcttgtggatttgaatcgatttgtgatttgtgaatactacttaaatagaattatgtaagattctacaattagtgttttatgtggttagagatgataaaaattacagttagatgattaaataatatttccgttgatacggatttggattctctaccataaatacttccaattgtttatgttgatgagaagtgtgatcagttaataaagaattaagacgttaattaagaaattgatatgtgcaaaaattgatagggcatcattaggcaatttaaaaagaataatagagaatggcatttaatcctatcaatcatatttagtttgcctatttagttttgaacctttcgattttaaatttaactttattgtcactataccagaaaagaattgtagtcatttctccaaatgaaaaagatttgaacttgggaacaaaaaaaatttgaaatcccaagaaaccttttaaagtagtaacaaaggagtagaatgttccagttcagtaaaatttcactttttctataaaggtgacagtaataaaataagatactcttttttattttaaaaaaaaaccttcgaatttttccagaaaagaatctgacaaaaataaaatgaacagagaaaagaaagcaaccaatcttatgcaatagaatccaaaaattcacttgtctctattttttaaaaatgggtcctttttatgaaggttttgccaaagtgtcattagtgcccagaattaaacgcaatccacttcaatccaaaatcccatactaaattaaaaccaacacacaggaagaaagaagaaacctctcatcttcccctctcttctgttgaagaaagcttaaacctttctgggtttcttttaact

SEQ ID NO: 2967 - DNA, 2000 bp, Arabidopsis thaliana
ataagtattttattattatttttagacagtaaggcccaatagtattttattgttactgtctgcgctgaaacaatttatgtttttcagcaaagtaatatcttactaatcagtaattacatacaccgtaacaccatcacgaattttcagtacacgacagagtataggtatgattgactgacaacaatataaaaaggctaaattagttagactgtcttattaattaaaaagtaatattgtactattactatactacttcacttaaatatttattcgacacacaaaaataaaccattcgtgtgaatgtttcccaaacacatttggggccgaagcattcgagcgggcgtaccactccaattacctggtacacataattgaagactatagtatgaaaattaatgttttatgtttttgtcacctaaatttttaataaaatgcagttgcagtttggttgtcattgttctgttgatccgttcattccgcgtcctgtatttggctatcacaatttcaatctatgaaaatttgaaatccgtatggtcaaaattatattttaaaaccacattgctagagaataattaaaaaaataataatcttcatgtggaatttatagaaattaatgatatacatttcaggaaaacttagcatgaagtatattattttaatgtgatgattttagaaatacaaaccgagacgcggtatgggatatggtccattacaagtaggcacaatggtccactaataattgttattacgacaacagaattaattgcctatttaaaacgaaatgaatcatcgaagaacatactagatctttttccaatttacaaccaaaaaaaacattattaggtgagtagtaaaaagattaaggttatcagaaactaactgtagtagtatgttgtgtgaaattcttttgtatttcttattaagccaagggtgccctttcaatgcaacgtgataaacgccaaaaacgatgatatgaacaattataaactcgttgagagcattgaactcggataataaatcatcttttatatacatcgtagataacaaacaaacacgtaattaaatttgacgtatagcaaaagacttgaagaataaaacgtcaagttaaagataattttggtatatatgagaaaggtatcgacaaaaaccataacgctatagatgattgtgatttgacaaaaacaccctcaaatcattgttttcagagtttttttagataaggtacagataagaaaccacctctaaaaatcaagcaatagatctcatcgcttaaaagaagagagagatcttcacttgtatgtgtcccactgattccaacacaatgtcccagaacttgccacgtgtcgttcatttcaaaagattgcagtactgttgtccctagagaatcattatctccctcgctgtaatatctttatgctcctgtcactttctgtctgtacccaaaagaagtaatgaacctctctcatcttcttcttctctgtttctttcatgttttgtgagttgtttctcaacaattttctggtctcttagagtgagaggagagagatagagagttgtgttgggcgtggaacttggactagttccacatatcaggttatatagatcttctctttcaacttctgattcgtccagaagctttcctaatctggtcagtagtactctttttatacgggtttttggttttataagatgtggctatatttggaaataactattttgcaagctttcctagattgccagaatataaaaaaagatgtttaacaagagaacggactcatggacttgctttaaattttaattattttaaaatcattctataatgattagagtaaataaactattaggactctgaattataaaattcgattttatatatgctcctccttgtatctcttaatcataagttatcattagctctgttcactagtgctataaaatatattctgaggttaataaaacttttttttctttttattttgaaatgtctccagagatctgac

SEQ ID NO: 2968 - DNA, 2000 bp, Arabidopsis thaliana
aaaatcgtgaaagcagcatcgtaaagatgttctcttctgttttttttttttttttttaactctcttttgaatattggattagagattttcacagtgtcgtagattcttcgtagagtctgttatgagttgacatttaccataggaattgcattatcgtgagaaggttaaatgataaattgacatttataaattctcaaaatgtaggttatgagttgtcaaagaaatgtaggctatgaaaaaaaaaacttacgtctaaaaaaatgcaaagttaagaaagaaatactcaaagttcgtggcatttgaccatctctcagctacacctcaaattatagctcatgagaatggcccatgaatatgattgtggctccgttaatcacgtggtattaaaactcacacacgaccatttctcatctgcctccaattatagcgaaaccgttacaactcgttgttcacgtgagcatcaaaatgtgcattactcctttcaagttcggcaaatcctaattatccattttaatggactgcagagactttaattagagcttatagaactttaaacattttggtttaaatcttaaaatagaaatttaaccaatctcaaatgatttttttttcttttcttttggcataagtttcataactcgatgatgaatgctacgataatatagacatacagtatgatgattagatgaaaacagataaagaagaaaaagtgtatcgtacgccccactcggtgataatgattaatgagactatatatgagagtacccaaatatgattttttccactcatgaatcgtattgcactatttctgcattattaagatagacccacatttaacattagaccaaaaaaaaaaaaagatagacccacaccacctgttatagtatttagtatttttacacatccactaaacgacgacaattgacaaaatcacacaaacctttctcctttattcatttttgtttaattcgggtcccttgctttttagcattcggctctcattcttatcttcccatggatggatagtcatagttatataatacagttcaattgaagttatgcagtatatatatgcaccacacacgagtcttctatatatgtggatactacgtttcaaaataattctattaacttagagaagataaactttcttagtacttttttcgtttcactttacacacacctcaaaaaaattcttgtttcatttgtgactgcatgtaaatgtcgttaccttacttgaatttttacacaatggtacgtgaaaaagaaaagaaaaaaaatataattgagagaaaatataataggatcacaccactacaatacatgggctttaaattcatcttttctatatgttataatttgggccaagactattatatcatatgggcctatcaatgtaattagaagcaattgcccgatccaataaccttaattaggaaaaaaaatcgttcccttctctcgtttcttttcagctctgactcggcctctatctctctcccgtcgtcagccacattcaccggtactcatctgaccaagctagggtttcgcagtcatcatcatgtaccgtacggcagcttctcgagccaaggcccttaaggtcaatgtcctacttcacttgtttccattgagattctggtttttttaggagaatgcttagtattgaacaatttgtatgattcattgtttttggatttggattaaagggtctcttagattcttatagatcttgattcaattttatcgctttatagtagctggtgccattattcatgctttttgcaggtttatgaaatgtctctgtttcgaaagttcttatttttacaatgttaattgaatcaagagattaatgatgcttaggatgtgtgtgtgtgtgtgtgtgtttatagggcattctaaaccacaattttcgagcttctcgttatgcaagttctagtgctgttgcaacgagctcttcttcctccagctggctaagtggaggctactctagttcacttccttct

SEQ ID NO: 2969 - DNA, 2000 bp, Arabidopsis thaliana
gtcctgtttctctatttaaagaaaaaagtgcttcattttgatgctttgtcgatcaaactgaggtttgattcccaagagacacatacagattgtatcataattagctaggtccagtttgatcactgtgattgtagttgacagatagtcaaaatgacctcttgttgttttgctggtgatcattatttcagtacctaagttttttttacccaaccctcacttcaacacatcttttgctgccaccatttcctttcgctttcggccgctggtcacaactcacaacagcaacaatgactaaaagaatctgcactaagtcaatttccagcttcttgttttattaaggaaaatctcgtgccatgtaaattgtcagacttttggtttgtttccagctcatacctggttttgaggtagtctatgttcttggcttgccatttctttttaatcttgagctatgttcttagaggcggctaagcagttcaggacttggttgttggttaacttattgtagcaatacttgttcttatttgggctttgctgggtgatccagaactcggccacaaagcctttcagtttgcctttccatttctgtctttggctctaaactccatgtaggtcgcattctattttggcgtgctcgctacaacaagtgatatactagttattttttttcgttcttcactaaatactagattttaacccgcggtacaccgcggaaacaatttattttttaaagttagtatacataaaagtttgcaaattgtatctatctataaatatttttattttatagtttacaattgttattaagtaacgtcctgccaaacccgtcccgccaacccgtcccataaaaaaaacatttattttattaatgttaatcttatttatgatatgtttatgaattattgtctaaatattttgtaattttgtaataattaaatgctatcaaatatctctgcgatttgacgattataattaaattgttatagtcatggagaaaaacaatatcaaaaatgataattttgtagtaaataaatgatattaaatattttgaaagttttattttagtaactaatcgtgtagttaatgtggagagatttagggaagattgttaaatgtcaaatatttaatttgaagattttttttctaattatcaaaaacaaacattaaaatccagtggcagctattgtaaataagtcccaactataagatttatttcacaaaattgctgcaaaaatgtatatatagatattcagcgcgtattttattttgtgctctattttcttcttgcctattacactgtcccatatattcctggctttggtcgttgtcactgggcaacggatatcctctccgaatgctattatggtttgttgatgaagaagatgctgaaacatatcacacctctggctctggtccgtgtgattgaaacaaaaaagacgaaaggatgtcttcttatctatttgattcagttgttgttttcataactagtaatttattacgttggtttggaaagagtcagtaagcggggatagctcagttgggagagcgtcagactgaagatctcgatccacgctcaccgcattacgttgtcttttcgtttttattttctttctatatatcttttactcattgattgtgttacatgaagcggggatagctcagttgggagagcgtcagactgaagatctgaaggtcgcgtgttcgatccacgctcaccgcaatatttagtcatttaatttttttcccaaagccatgcaaacgacgtcgtttaaaaccaaaacacacagagatagtcatatacggtgtcgctttatgaaaagctcgaattatactaacggtggttttacaatatgaagttcaaaaagcccattaaaaagcccactacatatcccaccgcctttacctctgaaccgactattttttttccaccctttatattcgttgtaacagcagagatttttatagtttggtttctttgaccggagaatctcgattaggttacg

SEQ ID NO: 2970 - DNA, 814 bp, Arabidopsis thaliana
attaagtactatactttatttattgaaaaactctttttatttttatttttgtggaaaatattgatcatatactcatttgatgtgattatcttaatcttcttgatttaccgttggtaaaaaaaaagttacgaaatccaaaataggaaaatgttctgaaacgttggctatgtattttcacccaaatttggatttagttatttttgagcactgtctttatcgtcagcacgtttcactgcgacattctccaaaggaaatgatcaacaaaaggacaacttgattggtttcaggaatctccagagttcatcatgtcctactaaatgacaaaaccctttacaaaaagggagccatcaccacaaataattaaataaaaccaagtcaaattaaaactgtattaactatttcaccaacaccaagttgaagttttctaattactattttttttttttgtcaaacatcatctttaatatgttataaatcgtttgcataattttgttataatttgtttgtattatttggttataaaatctcccacctttttggttatttcacacatcttttacttatacaaaaatctttcctgattttaattaaataaagctaaaacactttagtaatacaagtaaaattaaaaacaaaacaaaaaaattcgggaaaagtatttggtgtgataaattccctctccagcttctcggtgacacagatattttgcttccaaataaaacgagtccggtcactggcgctcactgacttcgtcttcctccatctccgatccattggtttaacaagcgcgtgagggccagatagaccgagaatc

SEQ ID NO: 2971 - DNA, 825 bp, Arabidopsis thaliana
tgaaacctacaaagaaaagataagcactctatgaattctgtcaagctttttggtttaggactgcattggtttcaacaagtgcagatccacgctcttgaataatacgtcaaagtggtatggcgttcataacactttttggttcaaggcatactctatggatgcaattactgtttttttaacgtttattatgtaactttttgggtatgcaacatggcttttttttaacgtttattatgtaactttttgggtatgcaacatggctaaccttgttggtttctgatgccatggttgttagtttacttgctttcttgtgtatgtctttaagttgtaagtggctgccactgatgtacttttcgaaatcgtgaacctaatgaaaagaaaacaacacttagtaaaaaaaaagaaaacatctttagtttatgcaactctcagactgtttagcttgattttcgagattattatttttcaaattatttatgtaaactaatttttctagaaattaagtaacggttgtggagttgagtttttaattagtgtgtggttgcttaaaaaaaatatgattcactttttaaaaggaacggtttacgacaaaaaaaaaaaacaaaggaacggtttagtataatttgtaccgaacgcagaccgcaactgcaaaaaagaagcgtctgggtgcgattgcggtataagcgaacaatccctaaacccgaaaataaccaaaaggaaaaacgcagagaattcgaaccagagagatctttcgaatcaaaacgatctgaagaagaagaagaagaagaagaatcaaaatctggatcagaaacaagggaggagaag

SEQ ID NO: 2972 - DNA, 2000 bp, Arabidopsis thaliana
cgatttaaatcaaagcttttatattataaacataaaacttctcactcactaggccagccattagatcaaaattatataatttacagatgtacatgttagaacaaaatgaattttcaggaaacctactattgtgtataaattcgaagttaatgagttcgaagtagattttgtcacgggtttcttggcaaagtttttaatcaagaaacaattatttaaaactttgaaaagtatctggtcgtcaagagtaaattcgtgatcagtgtataaactgctgtttggaggcacgtttattttcttctaaaattatattttgccggcttactttatttttgacttgtatagatgcttgaaaacaaaggtatatgtgtttgaaggcgatgaagaacctaacggtaagcgaaacgtcgtcgtttcttgttctacagcatgtaagggaagcgatgtgtactctaattaaggcttagcgtaaacggtaaacactaattgacatattcccatgagaaccttagccacttttttattttcacgttgttgtaagaatataacaaattgaaaactatatgctgtaatttgtatgttgcatatttcgtattatactaatccctataacaaacatctttgcatacaatcctagttttttcttcagctatgacaatttatattagtccctagaaatcgatatataatcttgcaaaggtataacttcgattcttttcgtataaaaatttgaacaatttgcgtttacgctatatattaattaataaaaaattgttttacaaattctaaacgcaatgttttttgttgttgttgtttgcgtatgaaatagaaacaacttttgactaaaacagtaaagttacacgattagatctagattgtatgatttgccaaactgaacatctggctatctgagttattacatattagaaggatcaccggcgaggattctatgattcaacaaacacaacgttaaaccaatgatttcttataaagaaaataattctctctttagaatatttctgagaaggggttgttgttttttaagtgtcgcttactcgcttcaaactaaagggaataaggatagtaaatagctcatccaggcggctatcacaatcatattaaactataggttacttaaataaatatatcattgaaatttttaattagattttcatgctaattccttagaagttttctttttctttttttttgttaaaactaatttcttcgaagttttgacggtcacgccgacactttgttttgacatgcccgtctaactctttttttgtttgtctttctttaatactactaatatacaatttgtatgacacttaataatgttagtgtttaaaaataattatagttctacataccccaatacaggacaataataagtacatctcttttatttcttatgcgatttcatttatgtctactacgaaccaactagaatttgcatccatcacgatgaccaattgacaaaaacaattgcttaacatttaggttttacggaaattatcattccttaagaattttgtttattttattacagatagaaaaagacgaaaacggaaagattttgacttgaaggcaacgtgaaatttgtgcatttgagtaaccgacacacatgaagctcaaacacaaagacagagctgagctgttgttaattccctgaaaagctcaactcttggcttcatgttttatcgacgtcaccatacatttatttcccttatagacccacttctcctccccaaaataaatactataattagagaaagcattaaacccacccacccaaaaccattaaatcattaagaagaaaatgtttattaataataagaaaaatgaaattatacacaactaaaaaaaaacaaaaggaagaagaaacatcacaatcaccaatcacctcactatatcaaattctttccttattcactaaccaaaaaataaataaactcaaaaccattcttcatttcgccgacactttcttctccaccaccacc

SEQ ID NO: 2973 - DNA, 2000 bp, Arabidopsis thaliana
aattaaaatgccaataattatatagtagattatctttcagcagatttttttttgttgaaattgaagtattgaactataacacgatgcgatttgttttttcggggtaaagaagttatcatttgttttggccattttatgacttctattctattatttgagaagcaaaacataaatatctatatttgtaaaatttaatatcttactagctacatatagtttaatattatacacatttaatctttcataactatgtcatgaattatttgacatttttcataagtcatgataaataaaattatgtatgaaataattgaattagggtttcatgttccaccagatgattgaacttgttctttattcggatagaattatgaaatttttatcttctattaaaaaatatattaacaaaattagatttaacatatattgatatctcattaatgtacttaacatgtgttaacaattttaaatttttttactttatataataaaattagaattttattaaaattatataatatctaaaatttgtactaaataataattcttgctgaattataatctagtttttttttttgatagcataaagattataatccgttaactttaaaaaaaaagcaagaaagggaaataaataaattattatatcctttaaagaggacaaaaatattaattatattgcgaaaaaaggagataaaaattaggtggaaaaggggaagatggtggggacgataagtttttaattagctaaccaaaaaacaaaaacacgaaacgagtcaactcaccggttccattacgagtcaaggagaaacacacattgacacgctcaagcttttttttttcaaggtcaagttggtttttttttttctttcttaaaaatatttatgttgggtcaggcttaaaccagagagagagtgtgtgtggtcgagccatttgaccaaaagcaaaaacttaaaactggtttcagatctgaagtaaaagggttttgcttcggattctccggcgtcgtttaaatgatctctgacccatcttccttggcttaataattctggtccctccttttatctctttttactgttgatttatctgaatatgccacgctctttcttccacatgtttattctctcttcctttcttcaacacaagcgtctggtaattgatctcttctctctcaaattgtgtttcgttctttttggttctgtatttggtttctgacaaaattgaggaaactggtgttgggtttgagtctagaactgccaaagatgtgattttgttttttgggtactgaaaattgagtgagatgaagtgataaagtgtcttttttttttggtaaattattcgaatggaacttgggatcggaactctgtttctttgttagggttggttgaaatctgaatctagtcttgatttttgtggtgaaatgagaggtgagtcagtgaaattttgaaatgtctttgattcaatttgacatcagaatactgctcaggttgtgtcttttgtcagatttattgagaattatcagcttccgactgtagatttgactttggtctcagtttaaagactatgagtggactttatagatctagaagcatgcgttgttttgattataagaaataaaaagagagtttttgctttaagctgtttgactaataacttgacttgggattatgatttaaccagcaaaactctcttttctccagccactgtgttttatgaatgtttgttgattccaaataatagtatgtgttgatcaaagtgaagtcatttggtcattacttggttctgagctttcagttgtttttgcacttacaatacctgatggtcatgtttgcatgtaggactaaggaaagccaacaacaaaatctggtttcaagacggttggcaggagtttgtcaaccgtttctccattcggattggtttcagatacaaagttacagtctacattttcaatttatcctccacactctgagatcaaccaccattctagtagtgaagctctt

SEQ ID NO: 2974 - DNA, 1513 bp, Arabidopsis thaliana
aaaacatatcaaaagcaaagagagagaaattgttttatcccacaaagtttttatatagttttattttgatttttgtagttgatttgtacgacataaagcattattatataaaatactaaaattattcattgtttcttactttcttgaaatattctttaatttttctgtttcgatgtttcttatgtattatgactgatcttatcttaagtcttacctctttttagcatttacgttttcaactctttaggatatgtcgtattatgtgttggctataatgtgtttggttagaatgttaactttggtgtcggcataatatgtttaattattgaagaaaaagtaaaacagattataaatttaaaaagcatagacttttggataatttcataattaatagaagaagataactattgacaaattcaatttagatgttgattagttcaacaaaaaataaacttagacattagtttgttctcaaaatgagaaaaggatcaatattattgatttatttctatgaccatttaaagaatgtttacaaatgtggttatctatttgattaactatttttttttttttgaataattgggaaaactgtgaaattttaataaatgccgacaaaaagtaagaaaaacaaattattctctatatagtatatactattttaaaatatagatggtacagaagtaaaaggcatccaattcgaaagtttaatatgtaatttatacaagaatttaatataactaatgatgggacctattgtttttatttgttgttgtattattatatggtgacttgactaagatgttttcttctaataataatgccaaatgaaaaaaagataaggtaaagcttaatttacataaattagcatgtgggaagagacttcacagtttatacaaataagtacgcaactattagtagttgttgacctttttgtctaattcaacaagataagcctctcttctacttttgtgaaattttccgtaatcaaatccgtaatcagatttccccatcaatcgataattttctctcgccgcgttttctatttttctcgctcttcccttttaattttcatcccattttcttgaaggagatttctaattattctgtgatctaaagtctgaagctttgtttggttgcatctcgatgatgatgatgatgatggttgattgtaaatgggtagtttcggtttggttgtagcagaagctaagtttgtcaagttaataagagtattttagttttttttttgttaaatcgatttgtgggttcatcatcctacgatcgaaagtttccatctttgataatttgagattctggggatttttactagaatttctagttttttttttggtttgttgatttcgtagctagaagaaatcgatctaggtgtgtatatatatatctattcaatcgaattttagtgaatcgattggcgatcttggtgagagtaatttcagagagatcaaggttactagagcaccaataaaaacacttatttggattgggagatagaaaa

SEQ ID NO: 2975 - DNA, 931 bp, Arabidopsis thaliana
gatctcttcgtcgtcgattacgaagaattttccgatgggagaattgtgaacttcatgaatcgacgaaattggattaacctagaagacgagaggttgtttgtgaaaattatgagaatttgggggaaactgttttcgccttctttattttttattttaaaggatattaaatgtaatgggctcgaaagtagtgtccaacgaccataagccaacattattgtacattcttaatttcatttaaacctttgtctctctttcttttcaatcttgtttgaatggttatcgcagtcgaggtggacaaatccgtttgcgattagtccgtttcatctacaagatggacaacaaaccgctacaaatcaattatatttgtatgtaaaaacaatccattgttagtttacaatgattttttaggtaaatgaaaaacgttttaatccgtatacggatttgttcgcttcaaccattatattcatttgcatgaagactgaaccgcactgtgtgatataattttaatagtaaaacaaatatttattactattagaatctcatcgcactttatcataagaacatttaacataaatattttataaatatgattatattcaatcacatgattaaaaaaaaccagtttttagtaaaatcttttcatcatttgccgataacgtttaacaaactatcatgtactatttttttttttttttttttttttgctgaattagattttaacaagacatgctattgaaaagaccctttttatataaaactctctgcaactttctgatcttttaactaaattctgcaaattcttctgtagtgataattttaccgaacgccagaaaaatccaaaagcaacaactgtaaaattacactaatcatcctctctcacacaacaacactacgcagatccagagatcgctgatccttcacacgcaagcta

SEQ ID NO: 2976 - DNA, 1313 bp, Arabidopsis thaliana
ttttccggcggcggagagagactttgtatttttttttttttttttttgagagagagagagagtggtaaggaaatgggaaatttgaagagacggcgagggtaaaatcggtaattaagaaagattgaggctagctactacgactgttgtggtagtaagacattcctccacagagatacttggaccagcctttagaagagacgtctctgctaattatccacgtggcgttctctcaatggatttgggatctcgcacgtgattggaggagtcatcatacacacgtgtacagttgagattcaactgcaattaaacgaccccgtgacatgacatggttatgagtcacatatgtgccctctcaaactctattatgtagtataaaaactgtattagatacaaccgacccaagatatagaagaacctttgaaaaatggtagaagccagttcagctaaagctttcttcttcacaattatcgtaaaatattagacatgtagagcaggcttgttgttctcttattgtcaagcgtaagtaaatgattattgtttagtttcgtgaccaattggtttgttttttggttagccattgttcgatttgctttggtttggtcaaagattgtatgctttcaagtcaaaccaaagctgactaaattttattctgtaataatttactttggaatggcaaaaccaaagaaaggtcatagacacaagagaagaagcaaatatgtttcttacgccaaaagacacgtttgtatggtaagacaaaagacacgtttgtatgtttcttacgccaataccattacgttaaaaataaactagtaacttaaatttacgctcactttctatttgggttttacatgatgattttggtcaaaggcctatttacaatgttgcaagcccatattatcttttaagtatctttttgtgcaaccaaaagaatcagtgatcttatgctcattttcatttttttctaatgaaatttttcgtcacttatggcttatgcgtccgatggacgattatggtaaaaggcccatttattcaatccaaagcttactgggttagatgatgattgtggtaaaaaggcccattatagacccaactaagtatcttagggtttcagtttccactataaaacttgttgcggcgtaagttagggttttgagaatcagcggcttcacctctccaggttcgtgtctcgattttgcaaactatctctcgaaatcgtcctacatttctttcttcagattcattactgagcttcgctttctgggtttctatctaaaaatttcacagatttcgtgtgtgaagaatcatttcaagcc

SEQ ID NO: 2977 - DNA, 2000 bp, Arabidopsis thaliana
tatgagtaataaacaaacgtggaatatactttcatgagatgcaaagtggcagaggcatcaatgtaggtaggtaagttctctgaggctgcaagaagaatctctgttttttattttaagcagagctttatatatagacgacgccaatggatggctctaagacagtaagacctctgacactcaaatattactggagtatggttcctgataccatattctatattctacaatcttttaacttttactaaaggaacaattcaaaaaaaaaaaaagtaagaaaaattgttatatcatataatgttttcatattcataattatttattcagctattagtttaaaaatggattttttaattaatatattatttgatattgtatatgaaataagaggttcgaaactaaatcaagacgaaaaccaacttatataaaatcaagattaaataatcgcattccattattagacgtacaccagaatcataatcgtatgaaatcaattacaaacaattgatgagaaaaggaatctataattcttcaaggaataatcaaacatggaaggaagaacaaagaaagcatcccatgtggtggggtggaaaataattcaagtgtccattaatatctctctctgtaaggctataaccaatgaataacactgtcaatccggtacgaatacgatcacatcaaaaagtgaaaaatgatgcttaaaccaactaccattaattccttttttggcgtcaacattgatttttcaatttattaagattttttttactaatgtaacatagatgaaagtgaggttttctcgttacaataaaaaaaaaagaagctacatagccagtaagccagagaactaaacgtttcttgtacatgcatgttgcatgagaactcttctagtgagagaactcttggcccaaacaatcaattttttgaaatattaaattaagcttacaaatttgcaagagtgatgattgctatattgcataagaggtatttaacttggatttttttaaaaaaaaaaacaaattgggacgaaaatgtagtctttctttttttgtgtgtgtaaagattaatatgttagaagaatagcttatatattgctaaaaaaaataaaaatgaatagcttatatataaaatagcaaaatcaagaaaacgacattacttttaagctgaatagatatgaattttttgaaatgccaaaagttattatataatagatgaacaaagttttttttaaaatatagttataattttaaaacgtacgggataaattaaaagatcactttttcacgttttctttttttaacaaaacttttgttagataatctgaaatattactcattatttcccatattctattaagtatttgtgaataaattgtatacagctaaacacacataaattacaaatttattgatttaatatactttactactttggttaaaaagtaaacatattcaaattcctttatttcttctactttggagctgcattaaacaacttccttgaataattacgtaattaaaaacaaattaccaaatatttagtcaaaaaataatttagtgaatatatcaaaaataaaaaataaaggaaagtcggacgatactaacaaaattattaaaggaagatgaatttctctttccttgtgcgcaaaatagcaacaagtctccgcgtttcctctctttctctctttcccttatttaaacacacttcgtcttctacctctaaacaatctcaccttctctctccctctctataacaaacattaatacacacaccaaaaaaaaacctgtttatgtctcaaagatctctgattcctcattcttcttctatagcttttggtctccattctcatctcttaatctccagtgagatcagctccaattctaactggtctctctaaataaaaaacagaaataaaaatccaacctttttcaattttcgttcaattttcccggaaaaaaaagcgatccttttgatttttcgatttctccaagtaacaattcaaa

SEQ ID NO: 2978 - DNA, 2000 bp, Arabidopsis thaliana
tatatactatctttaaaaaataaattgtccccgcggtgtaccgcgggttaaaatctagtttaaactctataaatggaggcttggttcaatttatttggacacataaaaaaatgtcatttctaccataattttcttattcttctgccataaattctatatattattctaccataatgtcatttttaattaatttaatttagttttaatagatattttaacttaatttgtttaacaactattattatgcatcacgaaatataagatataagaaaataagaataaaagaaatagtggggttgggtgttgaattttattaataaaaaacattggagtgataaaaaattaaagtaaggaagaaagaggaaatgatgtgaaatgttcaaaattgaggtggaggtgctgaatatgtttttgcattgtacatagttttaagcatttaactattgaattaatattttcaataagtcattgtagatagtcatagagaaaacaattaatcaatactatttttgaatgcccaccagcactctaaacttgcacattatcacaaataccaacggtcccaggaattttccaatcttcatcggtctatgtaaacatagatcatttattttggagaacacatttatattattttatttttagcttttcttggattatgtgatacatatggaaagcacaaaatgaaaaacttcacgaaaatatggatcgagatccaagggatattctcaaactagcgaaaaacaaagacaatgcttggacgttagcctgattggaggttgcaaatgaaattcaagcctcagtggcagttaagtcggttaatataaatctttcaggatatcattgtttcattgatgactcttggaaagatagtgacaagtttttgggcatgggatggttctgtattttaccaaatgaaggacatccaaccatgtgtgctggaagcactcgtctgggcaatgaaatgtatgattggccaagaaaagcgaaaagtaacgctttttataaactgtagatctgatgaagatgatgtattttccaacaaaatggccaacattcgctacatacttaaagacgattcaggaagatagtgatgagtttgatttttttgatttatctctaatgcttcgaaatgtaaatgttaaaacagaccactagatacggaatgttcggatataaccacatatgattatctttgtaaacaatactttttagcattgatttattatttgagttaatctaataaagttgtcggaaaaaacggaaaagtgagaagagaaaaagtcgaaaattcagaaacggtttaaagttaaccaggattccggtttttataacagaaccgatcggttttgtaattgagacgaaaacttctgatatcacttaaaaacttcacagaaacaacacctcgatctcatcgaagctcctctctcttacatatcatcacttcacatcaaccaaacctacttctgtctctctctctcgctctctatctctcacgctctcacaggtttttttctctctctgtctctctcttgttctccatttgcgtctctgtttgtttgatgagtttctgaatgttaaatgcagatgtgttttggttttctgtggaagtttttatatctctgttgattgagtttttctctgatgttgttgggctccaaaaaattcgaaacttgtattatctctcgtttaggtttcgtgttctctgcattgatctgcttctttaatttgttaactatactcacgtatgtgaaaaatctgaactttgtttgttaactctaatccaaatcattagaaaaatgcagattgagatttctctaatgcagtgcttgaaattttggaaactagggttcttgttataatgtttcaagtagtgaacttatgtcaacttgtgctttaggtttgatctgattcttaaattttgtttcatatgtggtctttcttacaatgtttctggatttgttgttttagtagaagaaaaaattagaaaggttgtgaga

SEQ ID NO: 2979 - DNA, 888 bp, Arabidopsis thaliana
tgacagaaactaacaatgtttaggctccaaaaacaaaaccctaaaaacaaaagtagtaaaaatccactcttgaagtgacaccttaaaacggcaatatccactcttgaagtgaaaacagctcagctcacttctgtcttgaactttcaaaactgaaaagtacttttgtcgtatctttcaaaattattgggcctatgggctcggcccagataagatcactccttttcaacccccacatgcaccttacgcgcgtgtctatgttacaatcgctaaaaaccgttttgtaggcgcgtgaggtgaaggtggagagttcgtgaaggaagaagacaaaacatttcagtttcacccaaaaaaaatcaaatcataaactcatggacacatacactcactcgatcatcagatgggtagtgttagatatctctgtttcaatcattgtgaaattctctgtttccaagtttggttttttgcttcaatggcggtgatgatgcttatgcgacagtaagctcgacttttttgacgacgtttgtctcttctttacgctttcttgtgttccttttttttttcaattatttcttagtgttccgatgaatcatgatcccgagacgtcttgttcttgttgattctactacactatctttcttaatttctggaaatttgaaatgccgatggtaggaaaactttgctaagtgggttctgttttgattttagctttgagatgggaatttagcttattcaacgagttgtttattggatatagtttcccttgcgaaattctgctttggtttctgttttctttcgttcaatcttaataaagagctttggggtttgatctgtgttcttaacagggatattcataacctggattaaagtttttggtgctttgtttaaaca

SEQ ID NO: 2980 - DNA, 759 bp, Arabidopsis thaliana
cttctacaaaaaaattaaaattaaaatttagaagctaataccaagattgtataatcaagcatatgttccaataataaagcaataacttggtgttttctttagttggcgtcttggagattccacataaagcaactcacgaaacgagaaagcacacaaagggttaaatttgcaccattcaccgagtaaatccaagatcttcgacataatatagacaagcaactctctagatagtataatcagaaatgtttaaagagagaaatggtttttttttgttggttgcaaattccaaaatcaagaaactatagaaattggaaggtaaatgatatgcgtccttaatctatatgcactatctacagattctgtctcaaaaatagcttactttgaattgcaaaactgcgcaattactaagtcgaatgtaatattcctctctccggacattagaaagaccttattcagaacataagttaagaaaatgtcattttcaacttcttgtcatctatgcattaccacacacagacacaaagagacatacgtgtcttatggcattataagatgaatgacagtcatttgtctagatatagaaaagtctacaatatggtgaaagagggatcttttactgtcctttagttgtagataaggaatctgcaagagcaatgattccttaatacaagaggggaaaacaaaaaacaaaaatatattaacatagaacgtgtgagtagagagagaatataaattaccgtacttattgggttcggtttg

SEQ ID NO: 2981 - DNA, 2000 bp, Arabidopsis thaliana
actgaaaattccagtcattttcacttgacaattaggattttgagggatgaaaaaaaaaattaaaaaaattagaattttgtggtgaagcgaaggtgacactagtgcgaaactgaaaatcgcatttacattcatttgaaactaaaattcgttggtgaaacgacgacgatactagtgaaaaaatcacagtcatatattatcatctactcgtgaaaaaaaaatcacataactttttcaatagatttgaaatcaaaagcgttggtgatcccgttgtagtatatctcttcggataagataatatatagagaacatagattcgataatcgtttgttgttcaatttatattctatacatgtaatcttattttaaaaaattgtttaaatggtaaaatcaaactaactaagaaatagttgacgacattgaaaagttactgttaggaaaaatatctgaccaactcgactataccaaatatcgaaaaaaattctagtattaaattggtattggaagtaattttcactacaaattagaacggaacacgtggtaacagtccaattggtatagtcacataccaatttaatactggagattttttcgatatttggtatactccagttggtcagatatttttcctaacagtaacctttcaatgtcgtcaaacatttcttcgttagtttggttttaccatttaaacaacttttccaaataagattacatgtatagaatataaattgaacaacaaacgattatcgaatctatgttctctatatattatcttatctaaagagatatattacaacgggatcaccaaagcttttgatttcatatctattgaaaaaggtatgtgatttgttttttcacgagtagatgataatatatgactgtgattttctctctagtatcgccgacgtttcaccaacaaattttagtttcaaatgaatgcaaatgcgatttttagtttcgcacaagtttcatcttcgtttcaccacaaaattctaatttttttattttttttttcatcccacaaaattctaattgtcaaatgaaaattgttggaattttcagttttacaaagtgtttcgccgttgtttcaccataaattttaaaattttcagtaaacatgatttttagttttacgctaatgtcaccgtagatttaccataatgtagccgtaaaattacgtacgttggagttattaaactggagaagagtttagagttttcatttctaatctatcgctatcaagtatcaatattcattattattgaacctaccctcgtttccgtctatatccatgattccaatatcatcgtggtaatcttattacgaaacaagaaaccacagttttaaagaaaacgtcaatttggaaaataaaatatcatgcatgtggtcgtccatcaacgttactcatacaactgttaaccaacaaattattaactcctatatatgaatcgtcctagcacaactttaatattgagatacaaaatgctttttacgtgattacaaatcatcagtgaaaactcatgctaaaattgttaaagacgaattatttgcaggattactaatcaaactagcaataatgtaaatttaggtttagatttttgtaacattaaaataagcccacataaccgccatacctaatcaatactattatactaacaacaatatataaccctctaccaattgcttaacatcaatccaaaatagtcccacttaatgattcagctcctacgacgactgtgtaggacaaatgccattcaattatcacatccatctaatattatttggatcaagacgtgtgattctatctatccacaaacttttcatatatctaccaaaaatctataaattgttttcactttcaatttcttatatcttactccacaaactaatttaaaattagtaaatattttgttcacttctgtctagtagtagataatacttcactcttcaatcttcctacataaagtcaaacttcatttgttgcagaaaacaaaacaaaaaat

SEQ ID NO: 2982 - DNA, 2000 bp, Arabidopsis thaliana
actcatattagaccaatatatattaatgcctacctacctttgaccttaggagaaagtatgaataattaacatgtatccaggaatggcattgtagaaaatactattttacattactatttcatctaaggattgagatttcatatgaattcaatgatttatatttactgccaatatttttttatcttactaatttaaacgaaagagatattttaacttgaaataattagaaaataggttatagatcattcaaacataaaattattaaactgttcaactatttctaaatgatttatgttagccgtcagataattaacatggaaaattctagtttcatcatgataatactccaactatatgtgttaatatgcgtataagagagagtatggcgtagtatccaatcatttcttagtatcatgtagtatttggtatatgccgtatagtagtacccaattatttctttgatgggcaaatgctaatgactaatgagtattttgcaaactcatgatcactgaaaacatgagccttcggtcgacgatcaggtgtcttaaatttgtctgctctttaatttttgtaggataaaaaattgaaaaatttgaactttagaccatagaatagattattccagctagtaatctagaataagaatgatgtgaaaaacttgtatttagtggttgatcatataaccaaaccaaaggatgattacgttttccttaaactctaaaaacatgcagattattgatctgtccatcctagttttaggtacggtattaaatttagatagctgttgaaaaaaaacaaaagtgaagatatctaaatctagatatgttggagcaaatccagtagtggattctaagcaaagtttctaacctataataataataataaaataataaataatattatttaattaagatagtttataaggaaatgtgagagagtttctaattcaagagattttgaagactcttctaactatttttagaaacttttcaaattaaataatattatttcttattttattattattttagtagattagaaactatggttagaaaccaccattgagtatgctcttaatttatatcctataacaagtcaataaatcgtcaaacattaatacgttgcattatttgtttgtcatcatatcttaaatatttcgaattaaatgatacgttttcgtcacacaactaatgctttttagtagatgaaatatagtaaaatacgattttatgtattttgaacccatgtggcgttatgttttaatttattattggatagtagaagaagccggaaattctggatgtcaaatagtcacattaatattcaatgcgaaaacgtaaaaaaaagtaagatgctaccgttacctaaacaaaagttaatggtgtgattttacagcacctgtttaatatttttaaaattacataaaaaaaccaaagagaagtaagaaaaaatgaaaaagagagattggtatataaaaaggaggagtagggggtgaagcccgaagcatcttatagtatttttagcttcattccttcttttgctctgatcaaagtcttctccttcccttctctctctctttcctcctctgcacatttctgggttcttctcttcttatgctctgtttcttttaagacacagaagaaacagtacagagttgagattttcttaaacaaaagtgaaaagagaagaaacaagtgacagctcaaacggacaaaaaccactcttgggtctttcttgcttctgattctttctcttctctaatagaagaaaacgtaagtcactctctctactctcttttttcacactgaagaagagaaaaaacgtgaacaaagaactgtcaattctctttccctctctgttttatcttcttgaattctccaagattgagatctctctcagtctcttatgtgctctgttttctcctctctgttttcacttagttactaaacacaatcgattctttcgctctgttttatttctcagatctagaagctaaaaaa

SEQ ID NO: 2983 - DNA, 695 bp, Arabidopsis thaliana
tgacacaccacgacacagtcacaaggacatgagtaagctttctccggtttagttttggttcagttcttgattccattaaactgcatgagtttttttcggcccaattgtttcataaagcccaaatgggcaaatattcggtacaaaagaaggtcataagaaggcccactaattgcaaacataacaagaaaaaatgagcaaaataaagacacgtgctatgcaacgtgggatgttgagagaaaaaaaggtttcgtcagctacgccgtcaccgactgggtcaataccggagttggtgaattggtgactaaaatgtatttcctaaatctaaagcaattttgcccccaaaaaaaaaaaaaatctaaagtaattaggttcttcaccaacccttgtcataaccatggcttttgcttaacacaccaaccatgccgcattgtcaatctattttttacttaaattaaattattattttaataattagcgtaaaaagcaatgattagttgaaaattaaacaaaagaattagattcgaaaaattgttaaagccatagagcatcacagccgtcaagattgtgtcctttctgaatccaacggtcagatcgagatctcattggtttattaatagcaacagtctcctaaaataggtttgcagagaagctttctcttctattttctctctctcagttaaccagagagagcatca

SEQ ID NO: 2984 - DNA, 2000 bp, Arabidopsis thaliana
ttccgcgaccctttacactggaagttgtacactttgggtctcccagagttagctgaatcaactgtttgttactcaagatttggttggttacttatgcgtaaagctacatcaaaagacgtgttctttttcaatccgttttctagggatatcataagtttgccaaagtgtgagcttgcttttgagcatattacattctattgtcctcacatcagatgattgtgtgttactagcgataaagtttgttctggctgataatctcgtcactgtcagtacttgcaatcctggagcaactgactgggtcactgatgacttccctacttttataagaccgttttaaatccaaaccaaccttgtatatcgcagagataaattctattgctttaatgctgaaggaatttttgtataactttgatccatcttaccgcacatgaaattacatttgataaactcatatgatcatatgcccgtatgtccatgagaagcaatatgtgtggcgtgagaacgtagttgtcttggtagagaagaaaggagagctttttgttatgtttacatgtagtaacgagaagccaatagtgtataaactattctctttggagtggaaggagatgagtaggacaacacttgatggcttgacattctttgtcagttttcataactctgagttgaggaataatctaccatggatgaggaacaatgtctatttctcaaggtttggtttcaatcgccaaacattgtgtttcctactcgtttgatgaaagtaggtacaatctacacaagaaattggagaaatgggtagaactatgtcctcctcaaagcctatggatcgatatgccgaagaacgtgttagattttttgatgaaagattttcataacaattgagatggtttatttattgggttaaaatagatagaagtcatgtttacttgggaacttgggagtcatcactattgtgttttcgtaaaagtcttcttcttctaatgacattggactgtttctgattctccctacattgcagggcatagacttttttcagctttgctggttaacacttctttagtttacataggtcatcatattagtttccctaagtaatcaaggtcatactacggccaataggttatatccatgtatgatctcttaagtcaccaacgttttcaactgaatacatgtcacctgaggcgaaaaatcttttgttacttctacaagagaacctatctatatcttattgtcgttacaaaatagtgttcaatctcagcaacaagacgcatgtgtagttactcaagattgatgtaattgtggctccacttagaatctcatattgaactctctggtttgtgctctactgtatgggtctaattttttgaaagccccaattttcattgcctaacctgcatatttggtggaaaataattatatataaaactggacaagtttgacataaatcacatatcaacggaaactatggaagtgttttgtttatttttataagtgatggatctgggaaacagtatcagattttttctctgaaatactaaaagctgatattaaaaataaataaaaaatagtatatgaaaagatggtaaaacatgcaaaagctaatcaaaggaccaaaaagaagacatgtgaccaccatatcccccttttacatatttctatggtagaaagataaatactaatctatgctatataataatacatatatatcctctcaaacttgaacaagcatatatggaagattataaacagtggtttctactagggaattattgttgtatacttgtatcagaattccaaagtgtattgttttctaatcactaaatggaaaaccatttggagtttattttttaatacagattgtctttttgtaaacaatatctataacaaaaaaaaatacaataaatgtagctctcctataaataacacctcactcgtgtatacacacatatgccttttaattgaaacgcaccacaaatagaacaaagaaccccacacacacacca

SEQ ID NO: 2985 - DNA, 2000 bp, Arabidopsis thaliana
tgtatccaaatttctccgaagtaaaaatacagaatcaaatgaccaagtggcccacgcacattgtttggaatggaacgcgcatgtaacaattactctactttattgggtccggtcataacaggatttactaataaaaaaagtacggactttagtagattgtctaaattcaagaacacagacaaacagagtttctggcttctttcagctaacactgtcggttaccttctacgattttttggtccttttgtgaacaaccaatccgcattaagcagtgtttatttttgaaaaaaatgtgaaattcttgtgagtgaaacaagcagacgaaattgcagaaagtgagagtttttagcaatgaagaaattcggggaaaataaagtttcttcatttaaggaaataaaccaatagtaagacaggacaaggaaaataaatacttactgcactgaacaatgaagtaaccagtaaaatcaaaaacccattttcaccgtttcacaataactccggtggcgagaatcccggcgacgattccggccgttgagaacttgttaaacagagcaatagaggctgaaacagagaaatgtagatctggatgaagcagagaataaaaaacgcagctcactgattgaagcttttttgaatggaatcgaacaaaagtgaaaacgacgattaaaaattgagggaaaatagctggagagagagatgttggcgaaagaaaaagaaaaaaaagtaaggaacagtgtaaacagtgtgtagcggaagagtgtgttgtgtaatatgtttaacccaaaatatacacccctatattatactttaatttatgtttttcaccctcttattttttaaagttccatgcaagtaccttacatttaaaattatcatgcgatgtcggaaactcaattttgtttctaagtttacccggtgaaaatgataaaacggttataaaagtatgagacagttgtggataattatagtagtatagggactataatgaaaagtaattatccagaagaaaagagaggaacattataaaaagagaataaattagagaatttgatggtgagagagaaaagtttgaaaatttagagaattttaaattggcggaaaccgtaaaggcagagttaaatggcaagtggacgtttttcgaaaactgatgaaattgtttttatttatttaaccaacgataaaatgatgtgctcaaaaagtcaagaaaacagattcctttttaaaaaaatttaaattttttgtgttctacttatcctaaattattactcataaaaatcttcaattaattttaaaataagctccacctaagaatcaattaatgtcactatcttttataagtaatcaaaataattgcatccgccattccttctacccaataattattagtataacccactaaatattattatcccctacctataattttggtaccttgttttaatcaatgaaaagaatcgaaaaacaaaaatatgtatagccagagtggaacataaatgaaagtttgaaaaaaatcacatttgttgatgatgataatctttttaactaaagtatcccaatgaaagcttcatatcttaattcttgaacattattcataattcatcatcatcatcatcttttcttcaagtagcttcaacacaagtctattgcccaactactatctatagtttaagcatacgtatttatgtttcttcggttcaattgcacaaaaccgaatttggttcggattcaattctattatttcggtattcctacaggttatttcggttggattcggttattcattcacacggtgaggataatactatccagatgaaggataggaatgatctgaacgccaaacaaagacaattagtgatcagcgaatcgccgcctttttgagtcgtcttgcagcaaagtagattccgcggcaaatcacagaacaccaatcggaataatcacacaagaacaaaacttgttaatcaggagaagacgacagagagagagaaggagagagatcttcc

SEQ ID NO: 2986 - DNA, 399 bp, Arabidopsis thaliana
atctttaagtttgtacgcttgtttatttaatcttttaaagctatataattggataaaaatcatatttgtactgtatatttgcaaggcttaaattattgtgggatattttactgaatttttgctacctcagatagtattttttaacacaatttatcatctgattgacttctagacatgtcttgttggagctggtcctgacgggaaacacacagctctggaagcagtcacgatagtactcgatctaccacctccacaaccggggtccatggctggactgacatcaattgatagggtctctgcatcagatcctaagtcagctctggcgctgcagaaattggtgcaagcagcagtaagacttcctcataaggttttacatgaatttggtaatgttttcaacac

SEQ ID NO: 2987 - DNA, 805 bp, Arabidopsis thaliana
gtttttcgagaccaaagaaagaagtctggacgaatgtttctaaataggtagagatgatgaatgtggttttaaataaactaattagaaatttcgttttaagattctgaaaattactagtcaataataaagtaatgctcgccacttagctaggtgtcaaagtaaaaattgtatcgtgggaaccaatacaaaatgaattagtcaacaaaaccacaaccctaattaaaggcgactactttttggtaatagtggggaatttgttttccctttactcgtcgtttgttgtaactagtaatcgttgaccagcaccgttttcttaagcaagttcaagttataggagctctggcaacacaggcagctctggcaacacagaggaaccaagaaattttctgtttaggtcaatgtaccattcgtccaaattattatacttcgtgttatatttagcgttaaattttccgtttgtatagagtatagaactatatataaatcgttcaaatataaatttatcgaaatacgtttcgtttaacgagagacaacattttctttatcgaaataagagaaaacaaataaagcgcgtgagatactacagctggtacgagtgagagtggctaaaaaaatcaaaccacattttgccatcgaagcagacacgttaaccaactaacaaacaatcctgtataaaaatctctcctcttcagtcttcatcatcttccaccatctcaaaggaccctttttttacaattatacccttctccttcccagttctctcattatcctcctaacatttcttctctagatctgagaaatcacc

SEQ ID NO: 2988 - DNA, 1370 bp, Arabidopsis thaliana
tccttcttcttatggtccacacacacaagaaagttcaaacaaaccaaagacaataatgaacaatgactagaaatgattttttctggtggttatgtaatccactacagatttatactacatgggtttggatcatatagaacaaagaaatcaagttggatttgaaaagaaaaaagagagaccaacttgagcattaccaatcaaaccaactccttgctccaaaagaatcaatattttcttggttgatttttctcaccaaacaaaatttgagttgttttgtgtcctagcttcttctgtcatgtaagaaatcagacattaatgcatagataccaaaaaattcctttaaatagtaatgccacaaaacatgacacaatgcagagaaaaatcaaagaaagattaaggaataaaataaaggaaaattaatggaatatcaaaaaaacaactttgttagctccgtctttgagttgttcatctaccaaaagaagactgtccaataaaataaaaacacaagtcaagaacaacaaacctttcgtgtcggcaaccataaagaagaaatcaaaatcagctcatgaggattgccaaatcaagaaagtaaaaaacgcatgagaaagattttgggaatcatcgaaagcataaaactttcatgcagaagaagagttaaattaaatagacagagcaaagcttatgtgcaagggagaggaatggacataggcattgatgggtacagttggggaaagggagagacttttttgtaacattatattttggttatggggatatttaagggaaggtgcctaacttcggatacattcattaatggcacatgaaaaaattactccatctttttttggtaccagtcttcttcatcacctccattttttttggtttctcaatctgaacaacatttatgaaatggttttttagttataccggcatttattatacaccgaaaacaaaacaaatagatatacaaattaatcaataaatgggtccgccgcaaataaaaatctatgcgttatcttctgatgtgtcatgtatatataaatgatttgatcacctaacaaagacacactttgtactaatgaagttgatttttacattaaagatgttcatgtcactataataaaccggatttgattattacattaagatactcaaatcggcctttcaagaccttttagttgggccagaagttttaaggagatatgttgttgaattatttctatgggctctctcggatccactgtagaaaccgatagacctctctcattcgatcatttcttcttcttcttcgtcttcgctgcagcctgcatctgttgtttcttctagactttgcaatcacagagatagtgagtgagatagagagagtgata

SEQ ID NO: 2989 - DNA, 378 bp, Arabidopsis thaliana
tgttgtattcttgttggttatttaatacttggttggtgaaaactagaagagatattacacatggtgtatacgacagcgattttgcttgttaagtcacaacttcattagctcattctctgtctttggtcaaatccactgtttagtattcaaaaccaattttctcacattctattacacatacatgaatctcttctgcgtcgattttccacgtaattaacgataaaagatcctatgaagactgcaacgtcattacacacgcacgtacggatcagttttgttccgttcacacttcacactcagtcaaatagtcaaacacctccacaaccttctataaatactcgaatcacttaccaccaacaattcatcaaaaactcgaca

SEQ ID NO: 2990 - DNA, 956 bp, Arabidopsis thaliana
agtcgtgaaccattactattacattatctctctttaaagaacaaaaaaaacttatttaatttttctattctacacaactagttttgattttcttagcctttaacaatttctactaattaaaagcgcacttgaatgtgtgagatcattttgtttgacaataatacataatacttcattgtgttctttcgttgtttggtagtaacaattttttaactattatagcctgatcaaatacattatactaggttttaacccgcggtttaccgcagacgatcggtttatttggtttttatactaaatatttgaataaatttgatattttaaacttataaatataaatttctagtgattagtgaagaatcgtaatatatgatttatatattattgattattgatttcgtgattgaatacaatgtttttagggataaaatgtgatcatatttttattttaaaaacgacatagattccttatttttgttgaacggtttagattgaaggaaattaattttattgaacggtttagattgaatcggatcatataaaacttaggtgattgttaagaccaaattacccttaataattttgaatagcaaagaacaaaatccaaaattaaagccaaattagacaaaatttcaatttatactttctttctaataataaagggatgtatacattttctctaattatgtctcattccattttttgtttttaattagcaattaaatgtctttcctttgctcggctaagcatctccgtatttactcggccgacaaaaggcttcgtgtatcaccaattcatattaaaggcttcgttaacggcccatattaaaaactcggcccacatctaaaaacacttatattgtgaaaaacgagacggcaaatcaatcgagggttagggttttagaatctttaaagaatcacattcacacatcagagaggaagaagaagatcgcagcc

SEQ ID NO: 2991 - DNA, 2000 bp, Arabidopsis thaliana
aacaaaacataaaaggtatacagtttgagccaaaaaaagatttgtaagtaacaatgaagtgctttctcatgttaatagagagtatagagcatattaccctacacaccaaatcaaagcgttttcctatctacggagcaaggttttgttctgtaagatatactctgcatagctaagtaccaaaacaggaaatgaaagcttattggaactacattggtaacaaaccaaatcctcaccttcgaacaaggcaaaggaagaaacccatctactacaagcagcgtttactctttttccactatcaaaagtttgcatctacacaataaaaatccaaactttattacctcctccacaaaacacacaaggaaaatgaagactctttgtgccttaatgcgagtaaacagaatcatgtcgtcgtggttcttgatttgaggaagttgttcaagagtcctactatatacattaacagtaagtccaggacttggatacgtatcatcaattatccggagagtacaaatccaatctaagaaaaaaatccaactttcagattttgggtaaaatgttagagctttcacaaaacaaattatatgtatttgagtcaaatttagggggtttaggataagtaccattgttgcgacattgttttggttctctttgttcaaggacgataccaatgagactgacttcttggttgatgagtttaatggcgtctttgattttgatgagcttcggactgtctctcttcttcgccatctcccggctttgctacaacgttttcaagtattatcctgacgtcattagacagtgataatatggtgaaaatgaccatttgatttcgggaaacatgtcattatttttttttgtcaatatatgtcatttcataacttaactttaaagatgttttatacatcaacttaacgtatggttatttatatatatgaactaaatgttaactaatgatttgaaacatgagaatgtgcagaaaagacatatcactatctaggtataaacatttggatttatttgaattagaataattcgggttggagaattttcggattttatgattattctatttgtttttggttaggaaaggtgacgaattttgatcattttccttcggttttcaaagaaaaaaaaaacaaaaaaaaatagtcataaataaaaattagtttaaccttactaaattttgtctaaaatttgcaaaaaacaaattatatataattttaataaatataactaaatttttcttgatatcaaattatttaagatatgttatttaaaatatgttatttgttataaaattatagctaaatataactaaatgcaccgaattacatttagttattaattgttttcttagctttttcaatctcgtaaaattgttccattaatttttgtttttttcaagtttgaattaactacgtaaattaggtttggagaaagcaaaattagaatacttttgtaatcgaatgtctttgaagatttatagaacaaaagaaattgagcaaaattattacatgttccctagatgagtgtcaggaacttggtatatatggagtttagaagtaaggttaagaaaaaggttggcttcgaggaactggagtgcatttaagtggatgaaccgtgcataaggtactatacaagaagttttgaagggagaacttttgaaggaatgaactaaggaatgaacttttgaaggaatttgaactcttcctaaccaaagtatagaagacttcctaaccaaagtagtgtagtaaacgaaaaacaatcaaaatgtgacaaatcaaaggtaaagactagaccagtctctgctcaactgtatttttcaccaaccattgcaaaaaaaaatcgccgtcttactattaacccacgtgttaatcacaccaactaccaaaaatattcataatccaacttctatataaacttttgtttgaccataaattacaaaaaccatttgaattttctttcttcttcaaaagttcgaaacttttttttttccggca

SEQ ID NO: 2992 - DNA, 1157 bp, Arabidopsis thaliana
agtgttcgagaaactcgccacctcttactatttatcaacctagttcctaacgatggtatgactagaccttcttgcttggtttgtaaaaaccgttgcatgatgcatgttcccttcctttttgtatacttttgttcagtgacgtgtgttcaatacgcgtttgcaatcatgaatgaggatgattagttgaaaggttcacaagggacagaaaaaagatcaagacgggaaatgcaccaaacttctattttgagtgagaaacgaacgttttgggcttatcatttcatgtgccatgtgccatgtgcttggtacttggaatgaaatatttggtatatccaactgtgtcgagacaaacaacaaataacatatttagatatttgcatatacggataaagtaataaatctgttttttttctttaaattaacacctaacttgttttactcatcatccattttacatacaaaatttattactatattattaagttttcaaaactacatttaatttatttagaaatggcagatttttgttgtctatggaatattttccttttaattttaatggctttagattaacacataattatgtcttaatacattgttaataattaaatgacataagttagtttgaatacaatactagtataaatctcatgaattgaaatatattaaaatagtatataatattattcatagaaaatgtcaatataaaactaactattgatgtttattaaaatgtcaatatataaagtatataatctttattaaaaataccattcttgatgttttaatcatggttacatttgtcaatttgattatgccaataaaataaattgaataaagttatcaaaacaaacaaataccataaagtgaatgtcgctcggattctcatctagtactaaattagacaatccaaaatattttgatttaacgtataccgaattttacatttaaatttatttatttttatgcatgtttgcgaactacgtaacttataaaaatcacaatatgtttacaaattaacggaataaaaattcaaataatcgtgcgaaaattaacctagttcatatttattttcttttaattttctcttctgtatatttataggttggtctaattattgaaaaaatcaaaaataaagagaaacaaagacgtaatccaaa

SEQ ID NO: 2993 - DNA, 1440 bp, Arabidopsis thaliana
cgtctcttgaaccttgtttaaaggtctgaccggccgttttgttaaccaactgaaagattctaacaacaaattttcttatatatatgctttaccaattgttgtctttgaacaaccataaaaaacaaaaaacaaattgagagttcttaaatacacaaaattgagaaggtagtgaatgaagactattattatgttaccaaattatatattcgtatatgtttaccacatttaaagcatagtcaataaaaaataaaaacgttaccaaatggataatatattgaaagttgattagtaagtatcatttatgtaatttccatctcgtgtatgcataattgtatgcatattggtattataaattcatatgggactttaaaaatggagtagttgcatttgttgataaaacaaaagaaaatggaagttctctctgattcaagaataaaggtaactgtaacatgttttatactcacatagacatttttgattactatgttttacaagattttaggaaaatgacttgtgtgcgtgtgtgtgcttgtctgttgcataaaagagaagagcacaagactgatatttacgattggtatattagaatgcattatacattcatgtttaaattttactgcattagggattacattttgttattttttgtgctaactaatttattttgattagtaatcatttatcacaacggtaagaagtactattccgttatttctgttaccctacaaaaagcagtaagcttttgattaataatcatatatcgcaatggtaagaagtatactgttatttctcttatccaattcctgcttttgattagcaatcatatattgcaatgataaaaaataatcggatattttttgttaccaaatacataaggcggtaagattaacaatgccaaaacgttaccatcgttatttttgtacctctatattataccaatttttctagatgttactcgaaatacatctaaacataaataagtcatctcgatcgaaaaacttttcattaacaatgagatttctagaatcatatctacatatcacttaagtcttcaaaaacataacctttttctttacaagattcttgataattctaatctatttaatttgttttttttcaaaaaattaaaaccataaatcaagtgtaaaaaacaaaaaaaatctcataatctatagcgtaatccacatattaaccaatagtaactcgtggaggtgataattatatagcttaatccaaccctagccaatcatgtaaagcgttagggataatgtactcttagagtctatcgaccagtgaaaataaaaagacagtgaaaatacgataagagaaagaaaaaaaaaaaacagagaaggtaagaaaaattcaaagcgaggttctcgggaaccaatctggaaggaggaggggtgcagagagagagagagagagagagaagcgaagacg

SEQ ID NO: 2994 - DNA, 2000 bp, Arabidopsis thaliana
aatcttctaaaaacgatacccgtgaactaagttgatcctgtgatcttcataatccatacaatttcaacagaaaaatacttttttgtgttttaaaaaatactgcgaaaagctatataaatagtaagataaattggtttaaatccaaaggtatgataaaattctttctcaaaaacgtcatatttggttagtagtactcttaatcgagtggttcatcaaaatgtatcggtttatatatatcagatcttgaataatttgcaaaaactcaaaatttcttacaactaatagcaatatatcatgtatcatatagctaggtaaaagtaaaatcatacgttttaaaaaaactgtggtagggaattatatatgaagccgtttataatagcatgcatgtgcttaacatagcaaaaaaccatatgattagtatcggggtacatgaaagaaaagggcagataaagctagattaggatttgataacgtacgagaaaaaatcgagaaaaaatgtcaacccttggtgggagatttaggcgaattttctaatctatcttcctcttatttttttcttggtggccaataaaactagagtttttagagggtaacgaatccaaaccccacactcacatgcatcgaatccaatctgtttctccaacccattcattaccaaaacagcagataaattttataattcatcaagtctaccaatattaattatcttctcataatcataaacttggttctctttatccaatattatcttctcataatcataaacttgattctcaaacattattactaaatctatttttcttttccccttctaatattctttactttaacaatacaaatacaactccttttaagacttttttttatagtaaagagttatacataacatgtttggtaacatagtaaaatagctaatataatagaccttttctaaaaattgtcaaaatacaataagtgtaattggtggataacatgtctactttaaaaaactttttagagtattaaaattgtcgtcccataaactatataaatgatcatcataaatgtattacaataacagcatatcaagacttgacggttatcagccaaaatcattaaattttggaattagatgttaataatatacaagtgtcatgtcgatctcttgtttacatatccaaacatctctatgtgtgacgtgagttactacttactagaatatggagtaagataatatgggcttcctaaaaggcctatacagaaacaaagcccaacaacctaaaacccagtgtgaacgtgaaggacttgaaatattccaaagttgagtgactgatgaaacctttcacgtgacagtgacttgattttattcgtatacgggcaaagttcttccattactgcaaaaactcttctattaatgaccaacttttcataaaagaaagtacacgtgtctgtcattagattggtaggtacatggagactacactaaagtcattcacatgggattctttgacccattaggagccaaataaaaatcttctctttttagtcttttttttccatcttaattaaaattacgagatcacgctttcttttttagtacgagggatcagcatcttaattagatcacgaattaaaatcacatattttatacaaattgcgacttaaccggaatacctttagaccggataaattcttaccaacaaccaatatctggaggttcaatatggtttggtacctaattttgtaccggaaattgcagaaatcatcgtattcgagtgttggatttgctatgatattacattcaaaattttggtacatattggttgatcatgaaaaccggaaaagtaaaaccaaaccggtagcttaccgtattttgctaagtgttgtcacttattaagattggtaatagagtacttattgtctgttcttcttcattcattacaacaaactctttgagacctaaagagagagagagcgatagtgagatttagatcaacagatttgaatcgatttctgaaaac

SEQ ID NO: 2995 - DNA, 2000 bp, Arabidopsis thaliana
atatatatatatatatatatatatatatatattcttcttgcatgaccatattaatgagaatattgggatcagagacttatttatagtgtgtttttagtctattgcacttgtgttttggaatattatgatatttaattcaaagatgtacccttaatgaatgatcttttatgatgtcaatgtttcagcatcttatactgaaacagaaaataagaggaggtcttaaaggaaaagaaaacatttcgaatgcaaaaatttaacctttaacattttcgattttttttaatgaaattctaataatattggttctaagcagctgattttatttttttaatagtaagaaataatatatgtatacatatatatttaaatatttactatcaaaatttccggcatagcaagtcataatttgtaagaaatcttacattttgttgtttacaaactctcacaagtcacaatgtaagtttcggtctagtgcagtgatgaggtaaacaaaaaaaaaaatctatcgatgagccaactttttgatctagagccctaggatttgacgatttatatataaataaaaccctaggattttcgtttctttttgtataaaaatgaattcataggcactctatacgtctcatgaatcatgaaatataaatcgagattaaatagaaaattgaatgttgaccgtggaacagaacaagtgttgaaagaagtgtgtttgcagcatggtcttatcatagagccaatagttggaaattagcagaatatcgtataatatccactatcctgtaaagcatttttataattccttttttttttctcggtttctaatgtaatcttctatccgataacaaatattcggatagtgtgatctctccactaatatacatacgaaattacgaaaactaaaattataatttcatcgatttgattaaactccaaaaacatccaagtcttgcatcaaatatgtacatttctatcatattgtttataattctttttttgttatccgtaagttttaggcagaaacccgtacagtgaaaccgaggaccagaacaagataaacgtagtcccctctcctaagtatagaattataatgtgacacatgatcacaatttgttgaacgaactctatgttcaaccactagactacaaattcttgggtttatatcgtattagaagtatatataaatcatacatattttttttaaaacttttttcttgactattcttttaagaaaaaaaaacatttcattactagaaaatagtacaaaatatatcattcaacctagcaagaaaccatagcctgaagtagccgcgaagacctagttgcttaaacactgagtggttcatcttaattcgaatattataaaccacattttaattaagtaaattacttagtcttgttctaatgtataaaatagcctatgagaggaaaacagaagagagaagcctttgccttatctcttgtcccttctctcttacctttattttaattttcaaatatttctttttgctcccaaagcaaacgacgtcttgtcaatccactcaagccacccaacttcttcattattgttaatctctctctctctctctttctctcttcttctctctttctcttttttttttttttattttcttctcttccatgtcacttccttgacgaattctatatacctagttcgttttttcttcctcaaatatatctttttcaatttatttggtttttctttgggtgcaacttcacctcacaaaattttctctctttttttatattaatttgagttaggcctttttgatttcatagatgagtcgtctagtcgtctggatttgatgtggttatagtcttacagagacctttgattgaaataagaacaaaagcaagaatacatacatcctcttcatcttacacccatccttttttatttttctagggttttatttttttttaatttattttttttctttgatttttatattctctctctctctcaaatctttactcatctgggt

SEQ ID NO: 2996 - DNA, 391 bp, Arabidopsis thaliana
cgttcgccggagtaagagatttgagttttcgtgacacgtagatgagatcgttgccacgagaatgtaaaagagcttcctttcttcgtaaccgaccccgctaacgaagtgaattgggcgttttcttaatttattaattattttattggcccactatttctcatattttcttaaatgaccaaaacaaatttaaattttataaagaaccccattaccattggagaattcagaatcagcatgttaatattatccttcacatcgaaccgtacacgtgtcacgtaacactggcttcacaaaattcttctggataacaaagcccataacatacgagttccatacaatcaaagatgacactagctagacattttcgttttcatctccccacgaatcaaag

SEQ ID NO: 2997 - DNA, 2000 bp, Arabidopsis thaliana
tactatatatccacttataaattataatatgtttgattatttttctctaatatgtgataatgtggattgtgtactaatcctatatataacttaactatgctcatttgtattttgtttatgagtaatattacatgaaggaaagcgatttttatttacgtatgattgataagtaatgatatggaaagtgatatggtttcatatcatacaatataatacaatgaccgcatgtcaattatttcgtcgcaagaaaacaatggaaaggtcaaactagagatgtgtgcgtaaaaaaaaaaaatgtatgtaactaaaaaggtctaaagatgtaatggtacacactatacacaattagacataattacacatgtggtttagagtattagatattaataatgagcagaacaagctatgtttacaggtgcagagaaccaagatattcctttcttttggttgttgtagatacaaatatattttacaaagctcaatttcaatacaaatgcaagaaccacaaacaacagtcctttcaatttatttggaggtggtcttaactcttaagtatatataaacaataccaccttataacttttaagttttaactaaaccatacttaaatcttttttaatctctataccaaatcttgcaaatatcaaaataactttttctaaccaaagaaagaaaacatttttgaagtccttaacttggaaaggaaaagaacacccgggcaaaaaagattggaagatacacttcctcccgtaacctctttaggcttcgtgctaatatacgctattttgacattctctcctatcatacgcaccttgtattagagatctcccaaagtctcaccactcacatcccttttacgaaatctcagcaagaaaagattaacattttgagaaaagtatatattattgcaacgaaaaaagaagcctcctcctttgtcataaagttcttaatcaattttaatttattgccataatcaaaaaacattttatattttacaaagttcttgaaaaagtaggacactttttaaaataatattcactcatggtacttattttaagctttattatctgccttataacataagcattgaaagtacttgtacattcaactacgtttctgtgcgtatcagagattacgtgtgcttactctactttattaaatttttgacgtaaactgttctaaaacattaaataataatatagatgtatctattgaaataccaaaactttattttataattaatgggaaacaataaaatataatattattcgtttaaagagtctaaagctgcaacggcatcgccatatacagaaagttttaagcgcaggataagagcatgcacactctttcccatttccaagcaaaataaaacctatacatacacatttatactaatactcatatacattagagagagaagaagaaaaaatgtgggatttttcagagaaataattaaaagaaagcaaaagttttttttttcttaaaagcttttgtctctctctcaattgcttcttgttcttgtttgcatccggaaccaaagaaagaaactgtgtggtttcatgatggcacctttggtttctcttcttcattgaagggtcgaatttggtctgagaaaagaagagtggagagagagaaagagaagaggcaagagccccacaagagagacatgcttgtctgtgtagtccctattttgtatgttctttaatctctcccactctgtttttgtcatgtgtaagggttttgtccttcgattttggagtcttctttaaccaaaaaaaaacagattccatgaaatggctttgtctttaattcctctggtttgtcctggatttatcttcttgtagcctctttgctcaatagagctctttttgtctcttcttgtattaaataaaataaaatgaagacttagtaaagaaaaagaaaaactcttgagtcttgctaaagcctagttagtgttgagtgtgggagagacaaaacagaacattgaaaaatctctctgt

SEQ ID NO: 2998 - DNA, 509 bp, Arabidopsis thaliana
ggtaaagacttgtgaaattctcagcacatagtattgttactattcatctttgtattctacatatataaataagcaaaatcttacttcctgagtattcaagttttattgaactctcataataaaaatggtattgtttatgtgtactatgtcacatcatatagcaagttatatctcacagcaatcaaaacttttagttataacatagttataacatagttgcctagttggtgtataggaggactataggtaattaattttctgaacaaaaaaatgtagtttgagcaagtaatttaagaatgggctttacaggcccataaactcaaaaccagcatccacagcacatgcatgctgtttcgaaacagtaaaacggcaaagcgttcaattgtgaaaaagtaaaacagcatcacagcccttgatcagctctgtgtatttttggcgggaaaatcaaccagaaaaaccctcgaagatcagcgagagagagagaagtagattgagaggcgagagagata

SEQ ID NO: 2999 - DNA, 1122 bp, Arabidopsis thaliana
tgttttttttttttggtttaatttttttttactgggattattttttgtgtttggatgttgatgtttgtttatgtttccatcacgaatgtatttaagataagaacgagtgaaaaaaatgtaaattgcatggtgatgaattggtggttaaaacaaagttgtcaaaaaaatatgataattaataatccggtgaccaaataatgcgagcaagggatttaatattcgacataatagtgtacaacaaaatcagaattaattattactttataacattaggaaaagaaatcaaaactataaaatgatacggtataagctgcccaaataattgtgcttagaagaaaagtaattttgtcgtactataagaattaacaaagttcacagtttgttagcccttggagctagttcggtggaattgactaataacgaaaagataatgcaaattgtgatcattagccatgcatgataaagttgaattattacttattagtttagttgtcactaattgtcacaaagggttggtttagacatcgatagcgtgttcggtccttaactttatcaatgtgacaagctagcagaggattttctctaaagtattttgtcctcaaatgtggataggattggtcgcattacgttcgagatttttgtcctcattaatatgcaaaaattcgtactttttaacgaaattgaatcctaaattttaatgtgaaaccactaaactactagatcaaagaggtttttacttttagtaaaaactaacccaacttattatgaaaaagaaaagaaaaaaatcgtctaggaggataattggttttaaatagaataattttaggaaattaaatgaagtggatccttagtgggcctcccagctaatagtccaatactatttcaatttccagcctttcagctataactttcgtaacaacaggtcgtcctgacattactgaaacacaatgtatgcggtttttcatataaataaacgtcatggcgttttcgtatagaacatcgaaaacagcattgttacccgcttcattcctcctctctctttttgggcgggaaactgtaccagaaaaaaacctcaagagtgagaactgagaagaagaacgatcgagagcgagagagagagtg

SEQ ID NO: 3000 - DNA, 2000 bp, Arabidopsis thaliana
gctagatattatgtttcgtttagtatatctttgactcatgatatttgacatttgattaaaaatcatgtttgccttacatgcataatatcttaaatgcttgtatcacatgtctctaactaccacgaaaaactttgtgtataaaaaattcaaatctttaatttttggacgacaaattcattagcgttactaatttcattgtacctatcagttttatgacgataataatacaatttatttcgtcccaaaaaaaataatatttatttattaagttaataggaaaataggtgtaaatatacaaatatgtatatgtaatatgcaattagagaatatatgaaacaccactatactatcaacattaatattagtaagatgagaaacataaattagatgatttgagtcaatatttttccctagtaatcttagtaatagttttttttttcttttatttgcatagttcatatacatatttgtatacatatatgttgtgcagatctaaaatttttgtttaatacctattttgcacctctaccaaataaattgtgttagaattttaaaaaattcataatcacaacaaaatttctaacactatttaatttgttgatcataaaaaatctgaatttttatgcacaaaacgtttcttaatagtcaaaactagtgatataagaagtgcaatgccaagaattatagagatttgaagcgaaattttaaaatgacatgattatacataacttttaagttctaaactataatcataataaaaaaaattaagatattaaatagagcgaacagacgtttaggtttttttcggatttaccatattcatcagattaatccatgctggattgagaaaaagcctcaagcttggaacaactacatgtaaatcataacctcgagatattttaaggctttcaatgtcccaaagaaagttatttggtgtcgaatccatgagtgaaaattgagcttttcacatagaacaaagagggatatgaaatagtacaattttatgttttaaataaagaagataaaatgaaaggtaaattttataggtttagccagcagagaacaaatgaaatgaatgttttaagtttagacaccaagaacaaacttagggttcaagtctaagcttagtcatatacttctgaacaatattggactttattgttcaagtattaaacaaacattgaaatcttcttaaatcacttttcaaaatgcaacgaggatctattctttttttttttttcagaagaagctacaagaaagaacaacaagtttggatatgaattataaagttagtaatccatgtaagagacgcttatattaattaatttatactgttaattatttcatccgtaatttttattattattcaataaagtatttattttactgaattaaaaaataataattatgggtgtttggatattcggtcgggtattttgggtttgagtttttcgggtttagaattttaagatccgttcgagtaattcaagattccgggtcgggtttggttcggtttcgggtttagttatatattgaaatatcaaaattttgtgtccgaatctattaaattatttgaaaatttcaaaaattccctaaacaacccgagtagttttgcttgaatatatttaaaaatacataaaagtaactaaaatatccgaaaaatcataatattgtctatatgtaaatataaatataaatattttagttatatttatatttaagatatgtttgggtaccagttcgggttcgggtttttcaggttttgaagtttagattcagtcggatatttgaaaatttcaggttcgaatttagattgggatttttggattgggatttttggatcgggttcagatcggttttttcggattcaggtattatgtccaaagtaaaaatggtaaacggtggttgttttgtttgtatttgtaaagcagaagagagagagatatagagacactgaaagcaaagaccaaaaaagaaaaattaaaaagagagagaggaaa

SEQ ID NO: 3001 - DNA, 2000 bp, Arabidopsis thaliana
acgcaatgtcaagttttttcataaaaaaataaaataatcataaaaatatatgtttgcttgtgtttaaacaatcctaaacattttgtaaaacttcagaataaaaatgattaatttcaaattatgattgtcagttaggtcgaaatcccaaatcgaccatacccttatcggattggactttagatcttttgttaacaatgacgtgcataaatgaattatgaaaagttgagttaataaggctttttttgttcctgctctaaaaagatggccaatattgccagtaaagaaaagaaaacaaaaagaagcaagcaaataagtgttaacattcatggcttaactatgatgaatattgatgattacttttctatatccaacataatgatacctgttacttacattcataaacaagtttgaaaaaatcgcctagagatgctagattagtttagttattgcaaggagagatgagccattgatgtatgggtgaaagctcgattcgattagtcaacgtagctgagaaagttaagttggaaacattattttgtaacgtttcggaacaaaaaggatcttttgggcctatctagcaaatttgtgggccgttctcaggctaattatggtttgcttataacttagttattcgcatcactcctacgatttgttctaggatctgtggtcaaccttggttttgaaacaaaaagggacattttgtatttcaaaatagccacggattgatttgttaaacaatacattttacaaaagaaaaaatcttttagtcccaaataaaatgttattagatacatgtggaagatccaccaaatccaatgttaaggaaaaaatctttttaaatcaaaataaaatattattaatatagaaagatccatcaacggtcttcttttctacaaccacaataacctaaaatgttgtataaataaagcttctacttacaatctacgaaaacacaacatttttttgaatagattttatagttaatacaacgaggaagacaaaataatggccatcacaaagacttcagcaacgtttgtactcttaataatattggctgcttcgttgtccaatttcaacgtcttggcatcaggtatctttctaatttctacgtactttaattgtagttaggataactttatttgaaagcaataacattgatatgtatgtatgttattattcatgtggtgatattgtggacatgcagatatcaaacctaccgggagaattgataatcaatgcaagcggatgtgttcggcaacgtatgggaacggtaaatgtgccgcagactgtagaagtgatggtttctcatccggacaatgttttacttctccacctttcgacaatagatgttgttgcaacaattgatcgaaatcgatcttgtttttgcattgatctatgttttctttttttctgttgttgacttgccataatacgcaaatggaataaaactataactttactattttatgctttcaaaaaactaaaagtacgagctattattagtctatcaccatgcacatgagtcgatttaatttgcagcccactcttattcctcgtatcatattagtcacttactacgacaagtttaactttggaaacctccaacaaacctatttgagactatgtggtttcgatatgattagggtttagagttaaagagtggcatcagataccgctgttgaggttgaatagtttaattatttgtatctgaactataaaaacaggaaataaaatattttaaatctacatatttgtaaagaagaaatagaaaaagtcaaaaacaattctgatttgttactataatttcttccaggctccactaaaaataaaaatatcttcttcttttttttttttttttttgtaaaagacagaaatatctaatccggtttatacgaatccggtttaaaatcggtttggttttgttacaaagataagaccagattaataacatcttcgtcttcacacactctgcaacacctctcactcaaatttcattcacc

SEQ ID NO: 3002 - DNA, 2000 bp, Arabidopsis thaliana
ttggatgtttcacattaatttcattctctacctgattgatttgatttttgtatgttagaagaataatagctttgtttgatgatttactactctttgattttttttccattaacatatatcttgataatcagttaatcactatatcgtatactattgaagtttaataatttacaaaaaaatgcatttttatgataaaatttatataaccatgtttataattttaatttaaaaacaataattttctaataacttgttttgagctactgacaaaaaaatatcaccatatttatgataaaatttagagcttgatttttagtttctacatttaactcatcaaataattatatcaagaataaaaaacatggatcacacatttaattaaaaattattggataaattagtatttaaattatagacatatatagataaaccgcttaaaaaatgttttaacccatagtatttcttagctccttgcccttttctttgttattctattatgttgccatctagtgcagttatccttatttatgaaacgtatcttacataatatacaaaatgtttaacattttatgtatagtattataatacatgataagtcctttaacaaaaacaaaaaaacatgataagtcatcataaaacttatataaatttactcgactataaatgaataattcaatccacaacaaatgcaaatacctttaacaaaaaaaaaaaaatttaaaatatcatcaattaacaacatgcaaatcagtaagaaatattgaattcatgatatgtagtaagagaattttcaatgaatatactccatgttgtttacaaaatttagggattatatctgtacataaataagtaaaatttcgataattttaggctaatcttactaggattagttttattacagttgattactaagtatttactaaagtaagaaaatccagttcttacgtaaaatcaagagaccaaaattttccttcccggatcttctggttagaaaaaaaaaaaaaaaaatagaaggtaaagtaaatttaaataagaaaaaagaaaaagtaaagaggggcaaaggaagatggtgaggattggtccaacggtcaaacagaaaaccatcaaatcagatttcactacagttacgaaatttatttcactccttctgtcttttaacttaattaggcctatgttcttatccaccatcttcctctctttttttaccattttatcccatcctccatttatatgtgtaacgtatccattgtgttgctcaggctttcacatggttctgtatcaagccaaaaagacaattgccgaggatcttggatttattatcttatcaccctactactcaattcatatccctcgtttgtttggaaatcagatttaagtaggattttcattagtcaggtgctaatgatatttcattgtttattaacacttttattaaaattctctcgtttcaattatttccattttccattaatagatttggcccacctttgtattcttttcttcttaataattgttttcctattttagtaaccaaatcactaaatttcaattcattaataatactttaaccctttttataatcagcatcaagacaaaacactgaaacagttataatttttttttaaccatcttagtttaaatatctgagccgcccggttcatccattcaaatctctctctcacttaccaaacccaaacaaatatctaacaccacaaactcaaagcaataaagaatccttctctctctctctttctttctttcttctttcagagaggaggagcaagaaagaagcttcaaaagaacaaagcttaagctttttcccccggaaaatttgttcccctttttcgaaaaactaataattcgtaacttcatagccaacaagatcaataaaaggaggcaacttatttctttcattctctcttgtaaagagtacttgctaaaccctagcttttgttctatagagaatccaagaaccaatcaattttttattttataaaaag

SEQ ID NO: 3003 - DNA, 2000 bp, Arabidopsis thaliana
actgtactttatccatttaattagtcttttttatttacccaagtggaaataagaaataacctaaaaaattcgattagtgcatggggatacagcaactttgaaaggtccaacaaaactgacctttgttgatcatattgatattccggtcataatattatttggtctttctaaggacatctcaatcatattaattgtgttttttttttggcagtccaaaatttgacttaatgaaaaaactcttgtggaaaaatcatagaggaaaaccccaataattcgaagatttgcattagataaattagaataatgcttttgaccccaagatgcagtatttattgctccaagttttgactcttcaaccaacttatatacgtatgacaatatgaccccaactcccaagttgcccaaagtccatagattctcccccacaaagtaataaagatcgcattaacaaatgaaaagaacaaaagaaaaataacaatcatgttttgtgtgatcgattactattaaaaattaaaaaaagatgaagaaagatttgggttgtataataatggcaaataaagtgaagccaaagagaagacattttttttttttttgtcgcacacccaaagggaacgaagattagagaacgcgtcattcactctctcgtcacgcacctctcacacaacatgactctcctccttggtttagcctaatttgctttgttttatttttcctgattctatttgtattttatttattaaatttgtattttgtaatgtcaaatttttattatgcttctcttttccctttttcacagaagttgatcgtttactgttttatgattttctaaaatttctcacaacatcaatacttttttttaatctcctaatggtatggtatttgcttgataatctttctgcctccattaattttgagtttggctaggatttttgatggaaatagacagcttaattaaaatcatgtaaacaaaataaaaacaggcgaagcaagcaagtggtaaagttgactggtaaaagtctctttcacgtgctcttgaaaagcgcgtgctagttgtgtgtgggtggatcacgcacacgcgtattgaagtgttaccgtcttaatcggtcagaattttgagtcgagaaattaaaagtggtgaattcttcttttaactccccccaactacaaaatttaccatttccacccccaactatttccataatcgaattattagacttcaaacctaataatttaaaacgaacaaacatattttcttaaatgaaaggagaatttaatagcataatcaattgtttgaccaaaaaaagagaagcataatcagctgttttccttgtatacgagtagaagagtcagcacaagagcgacaatggctcacctttgaaagtttggtttcaaccttttgacttttgacctaaaacatatccatattcgtcaagaagaacaaagaaagtattccaaaaaaaatataataaaaaaaaaaagaccaagaaaaataaaatggaaagaggaaacaaagaaggcagcttcctctctccttcttcattgcaaagaaagcaccaccttttaaagaatcctcctcacactccattcttcttaaaaaacccaccacaacacaattcccacttgtttcttcatcatcacctacttcaatcaaaaaacattccaactttcttctcaatttcattccaggtttgtgccctttcttcttgaatcttcttctatggaacttccaatttcgtctacttatgggcttaatttggtttacaagtcttgctatttctagaaaactcgtcttatcttgagtttcttggacagaaattcttgagtttcttgatttatctttgacttgtttcttgaaaaaaaaaaggaaaaaattttggttggaatatttcaacggagaagagtagaaacggtcgttggcttgtcttagtagaaagtagtttactttttttatatccgcaaaaattgcggcttcaaattctgcttcagaagactcttagaaa

SEQ ID NO: 3004 - DNA, 2000 bp, Arabidopsis thaliana
tgctttttttcttcttttctacaatgggtaatgagagtggctgagatagagaaagaatggttttatagaggcgagagagagagagaatagaaaaagcaaaaaaaactaacgtctcgaaactattatgatatatttaaataatgagaaatacagggaatcatggataacgatgatcttcgtaaaagcatatttatttacgttaataattgtaatagcctactacttgatgatgtttaatcatgtaacacaacccacgcttatactaattctgttgcgttggctaactattagtattatattctgaaactccttataaagatagcatgtttgacctaatttattctcaaatgccttgctacaggagtactactcagtcagcagttagaaatgtaaaaaaaaatattacagtgccagaaaactcacaaaggactaactttttgactagtcgacgaattaataatttacttccgaccgttggagaagaaaaggaaaagaagtgtgtggaaagcgattgctttatgtaaagtaacatagtctcgaacattgtgccgggcctagagtatttttaaaatgtttaattaaattactatgtgtactactagtgacaaaataatcacaatgattgtgaatttgaggtttttcaattaaacgatatatattttagaaaaaaagaaaatgaaaattggagataaggttcaattttgcgggggtttccagctcagaaatggattttgcttttctgtgatcacatgttcgtttccctattcccactttcctttttctatcaatctattcaaacctaacaaaaataaaattcaaaactctgttgttgttatcaattcacatatttttaacgctatatgagccatactttactagttaaatggagtttagtgtttaggattcaaaccctattagttttgttgatgttgtcttacccgaacaataattgaatttataaacagattaactctattgtagatatcgatttttaaaaaactgaaaagggaaacaaataatccgaagctaaactatatgattaagaaacaccttttattgaactagtggtggggtttgccatttttcgaaacgcaacccacacacacacatcacagtcgtctagctgcccaaccaacagaatcacgacacgtggttgaagaggcaaatatgtgttggtggtgtttactggggcggtcccgaccaaagtccgtatatgacatcctttctcagttgtacaaatcacatttcattataattcatttcatcgaattatctatcttttaaattttatcaatatctttttttgttagaggcgtggaccgtatgaatgtatgatagtatagaaatagaaataataacgttggcattgttatttaacaagcaaacaaatgattaggttgattgatgaacaagcaatgactaggttgatgaattttaattgttactgactttgtctgtgtacgtagctggtacttagttggtacatgcctatcaaaagaaaaactaatattttgcaacgaagcagatccttcattgcttacatacatgtggaaaaagatacgatcaatattttaaaaaatcgtgaattgaattttgttttatacacacagacgacagacaagcttctgacgtgggctcaaaacactaaaacggcctctgaatcagtcaacactttgaggcatgagagattgattaaaccacagaccaagtctttacgacaaatcaactcgagcccaataggctctaataaggcccaatacgatataatcgtcttcttcctgtagagtcggggacctgggattagtcaataaatgagtagaatttttgtaaggaagagagtagttggtgagcgtcgccattgaaggggaaagcagcccaactttgcattgaatgacacttaaaatctttctctcagcagctgtcttcatttatgatcgatcctacttctttcttctctctaccaatttcaagatctggtcgtcgctcacaggagaaacgta

SEQ ID NO: 3005 - DNA, 911 bp, Arabidopsis thaliana
agtctgaggttggaccttccaccgaatttagatagagagagagaaagagaaggagaagaaatggtggcgaaaagtggagaagaagaaaaaatctcccgtggcacattaatgggtggatttttattatatataacgttttcacacatacagttattagattgaaaaattatttttaaatctgtcttttattttctttcttggtgagagtgggacccatgggaatacatacgtggcatatagtatttgtactttgtgcaattgcaaaggtactagggttagcgtctgaatacacgcgcggttagtgacatctttatggcttgcgtgccggttcagttacatccattactcttatcatatgcagtttcgggataaatttgtggacgtgtgaggtcattcttacttgaatcacattttcgtacttcatgattgtagatagatgccatattgcctatgtaggataaagttttacgaaattaggattagttaacttatgtatttatattaagtatgcattgaactcgttttctttttcttttttggctaggattgaaaattataatttaatgtccattcatacagtatttactgtccataatactccaaaaatttgaaacaaattatccaattattaaatggtcgctaaattcgaaaaacctaagggctttgttgtgggtacatgggtcgaaaacagaaagatgaattgggccttttcacatgtccgtcatgttgcaatgtaagaattatatccggttcttaatcagattttgcctgaccatttctgattcataactaaccggaaaagtcaacagttcaatgcacttaaaccggttctaccttaatctgttatcgtcatcacttacactctctcgcaaacacccaaagccctaaaatccttaggagcaaccaaaatc

SEQ ID NO: 3006 - DNA, 523 bp, Arabidopsis thaliana
ctacatatcaagaacgaagcagattaatccaactgctcttaaatcacaacagaaaacgttatgattggataaaagcaacatcaaaatctgaacccaacatttgaaatccacgaaataggcgattaaatccataacaaattatacagatctgtttcgatctcaagcatagagaacccaaatcgtatacatgcgcaagaagaaagataactactatttgaccccacgaaagatcaatggatgctgaatttaacacagagagaagagaaacgaaccagggatcagattcggaaaattcaggaagtgaaattgctcggatcagagatgctcgtatcgccggagaagagcaacgacggagaaagaggaatttcgcaattgagatttataccatctaaaaacttgagccggtctaaaccgtatttaaccgtaccaaatcagatttaaccggagatgaaaaagtgaaattgattttcataagaagaagaagagccaaagaggacctgacttttctcggacttgggagaca

SEQ ID NO: 3007 - DNA, 459 bp, Arabidopsis thaliana
ctcctctccttatcggaacgagctcagtctacagtgaaacacccaaaatgagtcagcagaagatgaatgaaattggggaaatagtagcacaggaaatttgaagctgagagaaaaggaatcggaacttacctctcaaatggagtggagagtcagagtagggtttctcttacgggcgggaaagaagaaactcgaaatctgatttttgagaaaagagaaggaagaagaagaaggagaaggagaagaggtcacgaggatacgcgtgtgggttgttaaaagatctaatggtccataagaagacacgtgtcactaggaacacggtagctaaggtgcccgccacgcagagaataatagcttagaaagaatagggggtgttgttatccccttgggcgtggagtggattagggagactcgcactcttcttcttcttctttgtacccagaaagaaagagagctccaaca

SEQ ID NO: 3008 - DNA, 1367 bp, Arabidopsis thaliana
ggtcttacctaatcagttaatttcaagcacttaaactcgtagatatattgatccatatcctctctcttcatgtttaatagtacttacaataagatgagtctgttgtaatttctattaatttcacatcacaactgaaataagatatggtatccacagtcaccgtcacattctttaatgttttgcaaaatattcaatagacaaaattaaataatgagtaattataagtaacatcgccgtctagagtctttcaacggtgaaaggatgagagcatatgggagatcgatagccttgtctcttttgtgacgaaccaataaaagaggaactgctttttttcttcgcatgtccactatttactgtttggtatgacatcgaattggtatgatacattgttgtaccaaaaacttcaaaatttggtggcttgtaatcaacattgatccacttagccattccaagcagtgaattacaatccgtggaaggaaaaattatggtccggcaccaacaaattatcacctcatctcccgtcacaaacatatcatctagaagtcggtatgccacaccacataattaaggagcacattactcacatacccaaccaatgtgggacatatctaataagctcattcttggctggtacatgctctatttcatatttatcaaaaaaaaaaatattaggcattgtaaatagcgtttttgctgttgagcaaaatagttatatttgaaagtaacattggtatttataattatagtataacaattaggcattgaagtgtgagtttttgtttttgtttatttaacattggagtattaggttcttagaaatatatctatatactattagtagtttaactacagtttgtacttaattgaaaaaatgttaaaagttgttttaacctagctaattgctaaaaatgactaaatagacatacacaaagacttgtacattttcagcttaacgactaatacatttttcctttatatatatatctctatcgagtctagttattaatgttgaaagttgcaaataaaacagaaatgctaacatgtaaatatcgtagccaaaaatgctaacatgtgtataacggttataaccacaacttgatggccgacctcttttttcttttggtaaccatagaaatggttacacgtaactagtacgaaccaacgaaaactcttcttattcgatagttaaagataatagcaatgcgcaaaaatatctagcactcacacgtgtagttttggattctcattggtcgagagatctataaaacgatactattggaggttagatttttctcatctcactttctccatcttaaaactctttcttgtatttattttcctcccaaaaaacatctttaagagtcctc

SEQ ID NO: 3009 - DNA, 2000 bp, Arabidopsis thaliana
gaagataagagaaaaataactcacattttatggtttatgaatttgatatcgaaagatctcttacaagccatgtaaaaacaagaattcccccataattttacagtcgtccaaatcatcaatatgtcatcatccttctcaatttagtgttgaaatcaaccacagcctctggccccctatatcaaaactttgttcctgaaaagtagatataagtacagattattagtaccaatcagtgagaagatgataaactccatggttacttgactagcacaaaaggatcaccttccaatttttagcctaaacaagctttaacgaagaggagcaactataatttttgatcatctatcaaccatggattccccacctgaactcgatccaaacacacaaagtacactaaagcattcagtctctacaaagcattgacaggactaacatttacaaacaaagctttcagtcttctttcactggaaacatacatatcattttacatctcttcaacgttcacaaatagtaaggattagagaacaatgctaattcacttccctaacttattcaaaacttttagtagacttcaagcttaaaacccatggttatttgatatcctacacaccaagcttaggtttttaatttcagggcaaactaaaatgatggttactgatctcctacacaccaaaacaagtcgcaatactactcaatttagatcattcttatacgttcatgtaaagcaatcaacaactgattctaattgtgattttaactatgactacaacaaacgtgaagatacctagagctatgagttgtttcagcagatcagatgaaagaaacacagaagagtgaaagaaaaagcacacctacgtctgtttagagtacgaagatgagaaggggacgcgtttgttgcgaaacatcatgtaaccaaccggtaatacaacaccgatcatcatcaccgccgatccgatcaagtaccgtaacagactcggaggctccacttctatcaccgtcttaaactgcaaatccgcaggacgagacaagagaattatgaatcagcaacaaaaatgtggagcgacgcaatagcaaacaagcggaaacgaataggagaaaaagagaaagaaaggaaattagatctctgagatctagaattacacattgcgtgaggaatttaccggcattatgacgtcggagaaaggattcgccggtgatgaaccaaacttcgttgtggaagagaagagatctagactctccggtgagattcgtcaggtgagtctctttttttttctgtttctggttcctcactacttataatgggcctttgctttacggcccaatttattgcttactgagcctaaaaccttacctaaatttaatgggcctctgcttatggcccaatttaaatttaaatttagagaactaaagaagacatgacactaattacaagtcattcgattatgtgtcatactcgtaaaatttatcatattaatctagtagaatagttaaccacataataaccacattaaacttcatatgataaaaatatatttcaataatctccgttaaatatatctatgtataaatcacatattttaatagcaagcaagttctccaattagaatcttcatataagttaataagtaccaaaataattattagggatcccatagttaatagctttagaatatattaggcatttcaagaaaataatactcagataattaagattccagttttgctcagatacttggaatcttaattatctgaaatttaaatatttctttttaccttaacatctaattttctttttgtgtgctttacaatatcttttttacaaatttaaaatgaaaaaatggaaaattgagctggtagcaaaattaaatacaaacattagacccttttgaaaaaggaaaaaaaggatcgtacgttacgttgttatctccaaactgtggaccaaaactgcataacgtgttaaaaggtgagatagtgtaaaagcattgatcaagattcatgca

SEQ ID NO: 3010 - DNA, 563 bp, Arabidopsis thaliana
gccggccaatatagtgtacgcttctgtgttttctcggtgtacgtaagtttatatataatccacctgtaactatgtacgttgtgtacgtacgtttaaactctacgttcgtataactatgaacgtttttgtctgtgtacgtggtaaagttcatgtaataagggtacacagaggtggttgctcaatattttgagtaatttgaaataagttttttgaaattctaacttattccccctcttaaatgaatggagttggagacatggttgggtatattgtggttgtgttggtatttaatggaaaggacgtaactgttgctgtttattgtcaaatcaacgtaatgattaccctatatgacggttaccagactattaccaaaaaatttgaatcaagtgtagttgtaaccgcattaataactgtagccgttccagatttcctctatttaagtctcctcccttccttaattttatccacaatcctcattctaaacccatttcttgtgccggcagttatttcattcacaagaagaaatttagtctttcgatttgcttgttcttgctatccgtgag

SEQ ID NO: 3011 - DNA, 1136 bp, Arabidopsis thaliana
tgtcgaacagctaaagtaattattctctgaaaatttgcctcttcgaattattcttcgctggcgttatagtaaggtttataatctaaagtctaaactccgttattcattctcattaaacacctgatttattgtcattaactaaataatgactgtgttaaaaaaaaaactaaaaaaactaaataatgacttggtgaacaaaattatttaatgacaaagatatttcttgataaacgcattaataaccgaaggcttttttttttcttctgatttgatcgatgtaggactgaaaagtaagtcagaagaataagtttcaacccaatttctaaaaatctaatcgtttgatttgattatttttttcccaggattaaaaactttattttattctatttgatatctatatagtaaaaatcaacactattcaataacaaatttttgttcattcataactgatatcaaactattaatgtattaattaaatgagtcaacaaaataaaaattcatatattctttgtaaagtttaagttatttggatctttatgttgttgattcatttagctaacacatttatatctacatttttttttgttcaaccctttttttacatttatatctagagatattggaagaaaaatgtaatgagtttattgtgttacttcttcttttttcatatacaacagatttatttcttttacgttaaactttatatattgacagataaattttgatagcaacagttaacatagtgatttatctttttgtcaaccatttaattaacatgcataagattggtcaatttattccctgctttatgtgatttagttagttttttcataagttgaataacagagactaatgaagacactgtttacaaaaattatgtaagttttattcacatagttaattttattgaggatcccattactgtttctattagggcatgtcagaagacttcgaagtaagcaaaaccaaaagagtaaaaactatcttttcgctttttgcattattggatttaagtagaattgtaaaattaaagaagtaaacagagtagtactcttccaaagcaactcaaaagctccaaaatttctgtgaatctccccaagaacactttttggatctttaattcgaagtgatcggca

SEQ ID NO: 3012 - DNA, 1096 bp, Arabidopsis thaliana
cttcttcaatgtctgctaaaatcgatggcgatagtgagagatttctggaaaaagtgacgatcgagagtggttttgtttttatatacgatgatgaacgaaagctcaaaaagaagttaagaaccctagttttttggaggtctctgagtaaaagactgttttacccatagtggacttataggtcttaaatgggccacttttgagagtaatgaatatatataggcctagagtgaatagcaacaacccaccaaggttctttcacttctttgaaaaaccaaaaaagcaaagatcaacaaaatttatcagattctacgagagtcatttcctaacacatgagatgatgagattattagagtatcacaactctcaactatgtttttccataaactatgcatcgcaccattcaccacatgatattgtaactcttaagtctaagccatgaaatcaacattgaagtaaaagaactcacatagtaaattggttttctattggtttatattttaacaaaattatactgtactcatgtcatctttatgtcaccaaatcacaaactaattttctacttttaaaacaaaacatctaccaattccaccacatatcctaaaaactgactcaaatctctcaaaatctaaaatttcctaaattccacaaaatcatccataatctttaatcctccttagttatgatatcaaaaaaccattttattttaagtatctaatttccttgccataaattttattctctagtttagctaaacttaattggaagtaaagtttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttcatg

SEQ ID NO: 3013 - DNA, 1388 bp, Arabidopsis thaliana
agtgtattaaactcagattcttctttgttcatatccccaaaacaaacatctagaagaacaatttcatcaactccatctgaataacagaacaaaaaaacaagaaaaacagattaagaacctgaaatattgaagatatgatactaaaacacacacaaagttagttatatcaagaacctgaaatggagataaatcccaaaatttaccaaatttattacaacaaaaccattttttcttcttctttattcactcacgaaactcagaaacagaaaaaaatcaccactacaaaccataaaaatcgaaactttcgattctgattctgaaacaaacgcaatcacaaaatcaaaaatcaagagaaatcgcacattacaacacctccgattgcacaaaacaaaggtcaaaagtaggaaaaaaaaaacgatgaataatgaaataaaaaaagcttacaaaaattcacattcaagttcttcttccaaaaaaaaacctccttcgatgttgttgattgactttgaaattaagaatttgtaccctttagatttggctcaaatcattgcgaattgttgttattgttcttgattttggttttctttcttcttctttgagatttgtgacttctcgtgatccagttatctatcattctctcttctcctccgatggctgatcaaacttttttttctcaattctattttaatttaattttaattgtttttttattcccctttattttaatattgtttttttttgtgtgtgtgttcggtctggcctgccaggtccactcctccctcacttgaattagtaatttttacagaattttcaagctgacaacacttcaaaatgttttaaaattccagattttaattgccgaccgtaacactattatacgacatagttttgaatgtatgtaataaaatcggttatattggtttggtttttcggttcaatctttcttgtgtttaatacaaacttaatttcggtttatggttttagttattgttttgttccaaagaagagtgtctcatttcttttttgacattttctcccttcgaatctttgatgcatttggtcttatggatgcacacaagatgtaagttatatatcagatgccaaggtgatgaagtttgatgcatcaagatacaaacatcacatgctaatatttgcaataacagattgacattacaaagtttatatggcaaaaacattcaaaccaatttatataaccaaaactttaaatttgtaattatccttatccaaaaccaaatctctagactaagatagagaaaacctaacttaaagttaaaaccttttttttcattttgttctgagggggcttttgtgttgacggtggtgggaacaaaggaacatcgtatccattctgtccgggaaacacagca

SEQ ID NO: 3014 - DNA, 2000 bp, Arabidopsis thaliana
agttgacacatacttcttaagttcattgttaatttatataatacaacaacctaaacccatggtgatgattacctttagatcactaaaacttttatcaaaaattttgcctaattttcagtagattccatcagagaaacagcttttctacaaaaaaatttcaccaccaaatctcttttctttaaaacttatcaccacaaacacttgtttttctactaacttttttttaatattgtaaaatcttacaatattttaaaagttaaattttgcttatttcacgtcaatttatatgtctcttacaaaaataacaatatttctgcatcaacaatattttcgagtcattaatatatatgttttacaatattgtaaaagctaatgttttttaataaatcttaaattcattgtcaatatacaacaacttggacccctagagatgattacctttagatcaccaacacttttatcaaaatgttttcctaatttttagtagattccatcacggaaactgttattctgccaaaaacaattttacaccaaatctcctttctttaacatttatcactaagactttttcactaacttttctttcaatattatgaaaattaaataataaattttacaatattttaaaagttaatttttgcttattttccacgtcaataatatatgtctctttaaaaaacaacaatacttagcttaaaaagtattatatttctagatcaacaatatttccgggtcattaatatctatattttacaatattgtaaagctaaaaaaaaaaaaatctatcttgcgtgtcaataataaatgtctcttactaagaaaatatcaagattttgtctaattactaattagaaaggaagcactaatttttggggtgaaaaaatatgatttctggacaattagataaaaaacaaaaaaataattggactaaataaaaataaaagataaaagtgaaaatatttaaaaaaattggggataataatccaaataaaaagatttggtcactgggacagattccgcactatatatatattcttgtctaaagaaaataaaaaaccctaaaaaaaagaggcagacagagagatctcctctttgtctttttactttatctcctgaagtttcgcctcagtcatctcgtaagttttctctctctttctcattcaattcaatttttaatgtaatttcttgtttgatttttctattttcttcgagaaaacaaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatggtacaaatcttgtagttaaacactgaattgtgtccctcgtgggcgttgttgctttgatttatggccaaaagtttcaaacttggatatggtacaatcttgtagttatacactgcattgtctctcttgggtgttgttgttgctttgatttatggcttaaagtttcaaactttttcttggagatggttcaatcttgttgttgaaagttgaaacactgaattgtctctcttgtgcgtgttgttgcttagatttatggctaaaagtttcaaactttcttcacttcagagcttcttgaatggaaactatggttttgtggttttggttaatcttctgctaacactttttgccctgttttggtttgggaaagtgagaagaaaatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccg

SEQ ID NO: 3015 - DNA, 2000 bp, Arabidopsis thaliana
aaacggaaaaccacaaagattcttagcaaagaattcatcaatgtaaagaacattgtctaaaatattttggtatagaggtgaaaactcataatcttgggaagcttgtatcgagctagggttttgtttatcgtatcagccttcagtcccctatacaaagttcctggtccatcaaagtatatgtaaggtgtgtcagaccatacatgcctccatcgtgtggacaagactgaagttctgatagctaaattggtcggaagagaggagaggatttgttggaggatcacatcaggaagcgagctgattgagtctatattttcacttgcatctcttgctagtttgacatctctgtagtgatgatgagcgtagcagtcaccggcggtggcaccgtctccgtttccgccgtcgtctgcctctgccattacgttatcaaccaccgattgtaaacctagatatttgtttgcaatgacatagctttttgagtttttgggtttatcacaaagcccagctatatatatccaaaatattttaaaaagcccattactaaacacgcacaacttttttcttgtccggaactcaaaatatgtatgtacttaacaacttaatctgtgaaaaaaaaaaaaaaaaaatgtactaccaacttagtcatgttgatgtgatcatcttcttcttggattgatattactagttgcagaaagtgacaatttgatctattagaaaataattgcttatactacacatttgttttctttcgtaacagattggtgggatctttaagaatgtatcgtcatgattctgattttatagaagaacaactttatttaagatgtgcttacatattctgcgaaaaaaccggcatgttgaatggttttagtctctctgaaccgacaacaagttttgtaatttttaattttatcttacagtcgtcacttgaatcttgatcgccaatttttacatacttgagaagaaaaatatttaaaaagccaaccgatttattcgtcaaagcctcaaaggctacagatttttttagccaacgagcaaatgatatgcacacgcggatatgggggatccaaaaattaaaatatttgttggtgtaactttgaagcattgacttaaaaaatagtggttttatcatatgaaattaaacacttaaaaatttttgtggaagttgatacgggatcacaattttacaaaaacaaatagttagtcaacggagtataacttagttttacgtctaatattgttagagttgacattttataacatgttaagtagtagaaattgtagatttgactttctagattcttcatttgatggttcttatgatcgttcgtttataaatttgtactacagaaacgattaatctaacattattttacgatgaagaactaaaatttgaacatatagtgtcactaggaaaaaagattgattttcaccttaacatctccaaacgtagtaagtagatgtgagtttgatttgctaaatcctaaatgaaaaaaaactaacaaaacacagtcaaacgtgaaagaatttttgagggggtgtttctgataaatttacgacttaaggtactagtttaatgttattttgaaagtttagggggtggttttgaaacgtcgccaaacttgaattgccacttgtcagggaatattttatcattttaaaaagaagtaacaaaaaaaacgtgttgccgtgtagaggggtgcgaggagaatctgttaaatcgtcgctatcaaacaagaaacggtgtcgcattatcgtatagtcctcttcctcaaaatcctacccaatataaacagagccgtacaacaaaaaactcgatatcttatcaaaaactcgctctccatccaacaaaacccgaagaaagagagattcagactcaaatctctcagtaggaatggttagttacgttaagatcaaatactctctggtttatatctctgtcagaccatatctgaaaatgttttaaatttgttcttcttatgtaacgaattggggtatttggt

SEQ ID NO: 3016 - DNA, 378 bp, Arabidopsis thaliana
agctctcacgtccatgttctgttgaggcttacaagactgttctagttggtggggaagttgtccgaaccggaacataatccaaaccgaactgaattaaatttttaaaattaaaccgaactgtccgaccactacaaagttttttcgaatttgcacattaaattaattaatttttgtggcattttgcgatcagttaacgagtggatatgaggtagcaaacgtagaaaggactcgagaagtcatggcttctgcttaatctcctcttccttaaaaaccagaagatcctttgttccacgtttctcgtttgtagcttcttctctctcagaattcaattcgaattttgacaagtcttgacgaagaagaagaaacagagctgcttca

SEQ ID NO: 3017 - DNA, 2000 bp, Arabidopsis thaliana
aggagagagctctcggctcgatccttatccaggagactggtggggttcggagctgctccgagcagctgtttcgatccctgtatcccccaggagaaccaagccgacggatgaacagaggcagagtcagagtcttccaggcgtggggatggagctgtggtcgccggtggccgagataatccggagatctagtgaaccgtctcaatgtctggtccagtccggcgatggagcgaggcaacaaggcatgtgcggcgagatcgttccggcaatgcaccgtttaggtgaggtcttactaatccgggctccaatgtgttatccttaatcgattagtagcttacggttgattggttagctcgggaaaagctctagccttgctggtttgccttgtatcattggtcgggtcagtcggatatatggtccgcttttggtttaggaccggaacaacgaaagccggggatattgagtctttctgatgatgcgtctccgggtggtaatgctattgggacatggattacattctgatcaatagggactaatagtatggatttactttgtacttcagactaggttttggtctcttccgttttagtagttgttctcgtgtcgcttagagtctgtgtaggtggtcaaagagatgataatattctgatttgtggagtattatctatctcattgtggtttaaaaatgcaatggttcctcgatcaggtagcgctggatccgatagtgtttcagcgtgatactagatcaaaccattgcatttgggtccaatttgatagaggagaatgttatgtaccttcaattggatgtaatcatttgataaatgaaagttgatgttgagcaaaaaaaaaaaaaaaaaaaaagaaaaaaaatacaatactatatgtttgtttgtaacatgttaatagatagtagtattaaatagagtagtaaacaacaaaagaagcaagaggtggattttaaattaacaaaacaacttgttatcaagataagactatacacattaattgtttcatgatgataatagtaattaatagtcaataaaacgtgttattaaataatagaagctcccatgaaacatgcactatcggttacttgtagaagtaatacaaaccgttgacgtggtagacgattgtaattcgttatctttgacctaacgtataatggtgattaaaactaatgcttgataaattaacggatagtggtgttagctggtatcctccaaaggaggttgaacccaatgtctttagtttgaacttttgctatgaaaggtctcaacttttctgataatagaacaaacgggttaaaaagttgacatcggcaaagtaaattactgatcttggtccgaccttcttttaaaagattaaacaaataaatatttgcaattgtgaacatattaatggtgaaacgaattacttctataaaaataattgcatgatgaatgaagcatcttctctccttttcatggggcaatgtttcaaggagtttcagatcaaggttttgtaccaagtggatgtgtctttcactagttgagatcagatcattgacgtttttaacttactctaactatttttagtaattgtatagagctcaaacgttttgtggtgaaccttatactttaacagaagattgttttttaaaacacattaacgagtctgtgcacacaaaaaaaaaaataaaaaaaaattaacgagtctattatgcaaatggtgcataaaagttttttaacaaaaccatttattaacagatgaacagaaatcagaccggttcgatccggtttactcatggtttgtgtttgtactttctccacttgccgttttcatgtttgagaaacaaaatacgcagcgtctaaaatagaagcaaaaaacgggacgttgtttactaacaacgacaaaacaatggcacacttacccaagttcttcgtcatctcttcctgattgactctatttaaaaacccgatcggaaaattcgaaatccgttcaattgtaatcggaatcgtcgaaaa

SEQ ID NO: 3018 - DNA, 2000 bp, Arabidopsis thaliana
gtttgttgtagtcttgtagagactagagattgatcagttgatcacactttgttcctatatgattagactgagcaatagcataacttatttgataaagttaggactaccacatttgatttgtaattaactattttcttatacggtatgtgaggtctgtgatctgtcagactaattgaaatggctaaaacttgtgttagttatgtcatgtggatatatctgaagaatccctgaaaatgggggtatagtatagcatcatttgatgacagcaaaattcaaaagtcatgaagcatattataagatttgtgtgtgtttcggtctctaccaacaatcgttgttgctttaaagaaaaccttatagatattgctcataggtatatgcatgcatttgtaatgggagtttcgaacacacagctgaatcttaacagggatcagtggggttgataaatttgatattattagaaagcttcttgaatcttttaaacttgcttactcagatccctcacgttcagaaaaattggacggttattgtgttcttctcatcatgggtttgctttctagcttcagctatatctaatcaaaattttgaccctattttttctcgttgcctttttttggtatgacatatatatccaaaacaagtgcaaaaatcttgattcggattaggtgtttgtggttgtgagagaagtacaactacgaatctatttgtaacactatatcattcaaatattcaatgcatcaccaaatcaaagacttccagaatgtaagaacgttgacacgttttttgagcaatgccatagagttgacatcaagcatgacgacgttaacgcttcatttctttttttaaaacttatttataatcttcctcctaagtgagataaaattgtattaatataagacgtcatttttaaaatcctttgaatacaagagtatgggacattcaattttctttgtttcatactagcaacttgattatatattttaatttgctccagctatgtatataacgcttacaagttttatacaaggaaaactatgtattttaagaataaaagtgtggaatttatacaccgtttgtgtaggttttaagcgtaagtcagattgttaatctagaaaatattgttatccagaagagtgaaagacccaataaacttgtaagtgtaagtgttactcattctgttttataaagtttatgtatattaattgaagattgttggcacaaaaaacaaaaacagatttctaagggtttgtacacatgctaaaattagtttttaccaaatcctattagaatttatatttataatgttttcttcattctaataactaacaaggacaaaatacaaaatgttacacaaatttcaaatatagacatctatctttatgaattttattttttccgaaacatctactattattagtagttctaatatgttagctagaagtcatttttgtgtaataatatccatctacaccatgactcttgacaaaccaacgttaagctctaaagttgacaaaaatacttaaaatggatataactgtaaaaggaaatgccctttaattctgatttatttatttttgaaattattttttgttggctttttgtaacaatggaagtctacatctaataatgagccaaagtattctccatcaagtaataattatctccacgtttgaaaaattgcaatatttgttaaacgcgtatacatggtgatcaccattccacatcaactcgcaaatagtctacttttgacccgaagctaccgtctttgttttagctactcgtcaaaataatcttattatattcataatagtgacgttgatttaatatcatgatcaaacaaataaccccaaaaatgaaaaatctatatagcctcctgaactcttcttctctctgaaactcaatcagtttctcaacgaatctttctaaacaagacaaaggatcaagaacactacttgttctttgtctgagacttcaaacacaagaaaccaaaaatagaaaaagat

SEQ ID NO: 3019 - DNA, 991 bp, Arabidopsis thaliana
tttccccaagtcgcagcctcactggtattgtattttcccatcccaaggaagtgatttatttgtttgagtttgaaagcattaaacgtatgaatgagcagtttgatttttacagcggaagtgtatctgtacattattgttgtttcttgagagataaagaaagatgaatgttgttttagttgcaaatctgtctggaatggaacatgtgataataaaactcgtaaggtggttgtgttcatgaagttgccactgtttcataattagtctacaagcctaagaaagaaattgctctatatagagaatgctatctagatatagtatatatccagctcataaaggagattataatccaaggtttgcagcaatatgaggtctgtattttatgaaattacaaaattagaagaaaaatatcaatcaatttaaagattgttgttgccacgtcaatgacactgtctctgtagttccaatgagcttggaataaccaccgacagatctcattcatagggagcaagctgccattggaggttaattccatttttttcataataaaggttaactgtccaaactcgaaaccctgatttatttagttttcaataaatgttttcatgccttttaagagtgtgtgctaagctaacagatgagctgttattaccttgaaaactctaatctatcttaatttaataagttcttaaatatctttccaactttttttacgctttaagaaaagaaaaaaaatcctatttcttgaaacgtaatgttaatggaaggagtcaagttgtcttttgaaaattggattacctcattagaaaattccaccaatttggtcaaatagagacgatgagatttctaagaagtctctccggttcagatctggtcatctaaagcccttcttccgagatctacgactttcttcctcaagtcgttgtctgaattctctttttttccgaaaacagacaccacctgagtctgctgtctgaagcctcggcggagggag

SEQ ID NO: 3020 - DNA, 401 bp, Arabidopsis thaliana
atatttcttttcttactttcaccctaagcaaaatattcccctagtttgttgcttttttcagtaaagtttgtaaaataatacttatgatggaattattgaatttagaaaatacagtattgtgcttttctaatgacttcaccgacataaagaaaaaaagttttgtatatatgaatatcaaagtcgtatatagtccatagtttttttccgttgttgttatccataaatttatttttcaacattattatacgtataatttggtggatctaacataaataaaatcatgtagtagaagtttttttttatttttgaaaattggagaaccacacaagagatggcaataaaataaaatgaaaagtctctatttgtagatctagagcaatgcaaaaagctgacgtgtacca

SEQ ID NO: 3021 - DNA, 2000 bp, Arabidopsis thaliana
aatgtggttgaaattgaatagcctcctaaaacttatagaagtagagtaagtcattgacaatttctacattgtttgtgtgtttctactctccttctttgtcctttggaggtttactggataagaaagttatggacacttattgttgtttctttcattggtttggaaatccagggggcaaaggaggaagtgaagaaagatagaaaacacaagaggaatgaaaaagatagaaaggatagggataatgaggcggggaggagcaggaagcatcggcataagagacggcggaaagatgaaggcgccattgctagtggcaaattagtaagcagtgaggtcgagttgttagagaagagctgccagactgtggaacttgagcttcaaacatcgtctcagaattcttgtgatagcactcttcatagcaatgagagaccaaagcaaattcagagtcagccccttgatggtaggcataacataacgactctggtgagcttgtttgcttttacttgttgttgggtctgtttgcttatggtgtcattctttcttggtttaaagaaaccagcatacggactcggttacctgacaaagggcaggaagatcctgaggatggggtgatgatgaccagcaaggatcaaaaacagcgcttttcccgggaaatgttagatgcttctcaagctgctactgctcctaatgagtctgttggtcattcaagggtctgtcaagagaaaagaatagatccaacttttggttcgtcgagagagatcacaacaaaactcaacaaagagaagaagtcagttccttcgaaagataacagaaaagttagtaaagagaagaagatgccatcattatcttcatgtaaccctctggaacaagagaaaccgacctctagtcatcaagaaacccctggaccttccaagctattatgcaggaaatgccctccttccatggctgggcaactcttgaatcttatcgagaactgggctcctgatcgggttgagagcaagctcactgactctgaagatcaagaatggtggttgttcatcaagtttggagccaaaagtccacaagttagcaatcagaaaaccaaccagggaagtagttccatggtgtggccgactgctagatttcttcctgaagccgaagtacacgcattgccattcactgtcccgttctgatttcaacaaagttggtcgagagagagtgagagagagagagagagagtggttaacatgaccaacatatagttttcccaagtattttagagtagccttgaaacttaagaaactcagaattatgtgtgattctttgtagatgtactggtaatatagtaaatcaccaattacgtaaatggtaaatatatgtgctggttagatagtaaattacatgagagtttcgaacttctttggctacttccttatcaatcgtaaatcttatttacgatctttgttttttttttctcataagtgttgcctctcattataaagagtttgccaacggtacaaaagtggaacaatccactttcaaactacagacaacacattaaacagaaaacaacattggaagaccaaacaggtggtatccatgttgcagagaaaactatttataatttgatttggttcgattttaatcaaaatgcaaatcaaaaatataataaaataacaaagtagttacaatattttatattaattgatatgtttattcataatacataaaatataaaattgaaataaattttgtttatccggttcggttgagttccaatatagcagaaacgattgcggttaaaattctggattttattcggtttgatgaaatagaatatggaccgttagatctaaagttaagtagaaacaacgaacggtggatagcgaggaaaacgtacacgtgtgaagcatgacataatttttttcccatccaaagactttcacaaggtcttttttttgaaacctgaaaagtgagaaacccagagatcgagattgagatttagagaagacgaagatcagaag

SEQ ID NO: 3022 - DNA, 2000 bp, Arabidopsis thaliana
tttagtagtttagagattttttagagtttttgaaaattttattgaccattgatggaatccttaagtgggtttctaaaacaaaaaaaaattgaaaaagggaaaaactgaatctacatgagaataactgttgctggataagcttaaaggaagagagaacatctttaatcattgtttgcatatgccattggcttgacatccgggtgaggctgtataatcaacaatatcagaaaattagaagagttttcgaatgagttcaatatcaaaaagtaagaaacaggagggagatgaatattaccatgatcaactcggtttcaacagatgtatataatcaacttggcttggtgaagctccatacagttttctttgttgttcttgtctccttatgttacatcgttgatagttaatattattctgcagtacactccagctatcgacgtttggagcattggctgcatctttgcagaggtactaacatggaagccattgtttccgggaaaaagtgttgtccatcagttggagttgattactgatcttcttggcacaccaaaatcagatgcaatttctggagtatgatccgtttttattcttcacattaatttctggagtacgtatatatattgaactgtatagctaaacatttatttctctgatgcaggttcgtaatgataaagctagaaaatacttgactgaaatgaggaagaaaaatcatgtcaccttctcgcaaaaattctctaaagcagatccattagcactccgtcttttgcagaggctgttggctttcgatcgaccgactcctacagaggtctctattctgtctttttcactttgtaattagattcttagaacctcagatccaatgcccacgatcttctctccctttcatctgttacaacaatctcacggcatttcctttcaagaccaactgaacttgttagatcttgtgaaagataaccttttgattttatttcaacaagttctctcccaaactgaaccacaataggatctaaaccaagtacgcaactttagaaacagcatttcattgattagtgattagaaccacaattattagcatatatattggtatagtgagtgattaaaccagagtatgcaataaaaagtttaagcaccaggcatcattgtgtagattcgaagccgtgacaagggccacaaaacaagagttgaaatcacctgcagaaaaagagataaggaataagataaatttgatagcgattcaaagacaaaacttgggagactcaaacaagagtaatacgaagagaagcttacccaaccaggcgtaagaattggtttgcaagctggaagctcctgctgtgtaaatttcgaatatgaagatcaatcaacttttagctatagcattctcgattcctagctaagacttccaatcgattttgtggcgtcgaaattttcaatcgattttgtgtctccgtcggcgacacaagaggaaaagagagaagaagaaaagaataaacgcgagaagcttttttttttggttttgtcaataagttaacccaataaaaagatgccacgtatgggtcgcgaaaaacccaattttaggaacgtttctaactgaattgttgtgttttttgttcaactgggcccatttcaggttaaaaacccaccataaaaatctactaaaaacccttagtggacttgctctaaggcccatcgagaaaatttgcgcttactaatctgttttttttttcaagaaatacccatctaaaggttaatatttacgaaatccgccactgctctaaagactgtaatcttccttcttggtcctgcagatccatgtatgaaacttcccctgaaccctaatttagctattcgaatttcgatgttcacttctaaatcctcgattcgtctctgaataactccatcgtaatcgaactgatttcaagacggttcgtttctttttcctcttatcccagatttcttattcttctcctctcgccgccacagttttcgaaggtgaatttgtgtcc

SEQ ID NO: 3023 - DNA, 1096 bp, Arabidopsis thaliana
catgaactttgcttgttgaaaattattgaaaattctttctctctcttttattttataaatatggcaaaggaaagaaattaaaaaaagtccacgagtgagcctaaaaacaggaaatgaaacttagaaatccaatcatttatatttagacttgaccaatgaaagattggaaagtcttaatttgtccactgatttgctcaaaagtagtcattacgccacatctcttgaccttatagacgccaatatttactttcttgttaaagagtccattcaactatatttagatttttaaacatgaaaatattttattatatatcagcaacaataaactttacttccaattaagtttagctaaactagagaataaaatttatggcaaggaaattagatacttaaaataaaatggttttttgatatcataactaaggaggattaaagattatggatgattttgtggaatttaggaaattttagattttgagagatttgagtcagtttttaggatatgtggtggaattggtagatgttttgttttaaaagtagaaaattagtttgtgatttggtgacataaagatgacatgagtacagtataattttgttaaaatataaaccaatagaaaaccaatttactatgtgagttcttttacttcaatgttgatttcatggcttagacttaagagttacaatatcatgtggtgaatggtgcgatgcatagtttatggaaaaacatagttgagagttgtgatactctaataatctcatcatctcatgtgttaggaaatgactctcgtagaatctgataaattttgttgatctttgcttttttggtttttcaaagaagtgaaagaaccttggtgggttgttgctattcactctaggcctatatatattcattactctcaaaagtggcccatttaagacctataagtccactatgggtaaaacagtcttttactcagagacctccaaaaaactagggttcttaacttctttttgagctttcgttcatcatcgtatataaaaacaaaaccactctcgatcgtcactttttccagaaatctctcactatcgccatcgattttagcagacattgaagaag

SEQ ID NO: 3024 - DNA, 844 bp, Arabidopsis thaliana
ttgagacttcattgttatgctctcttagaatcaaatttaaaagtgaagaactttagaggctcctttttcttaatcataaatccaaataatttcatcatgtacattattcaccagacaaagctatacagataagagtggataggtctgaaagctggatgctgccggagaagtcaagtttacgagtatctcgggtgagttgtgaaacacgttgtctctacataatgcaagttggtccatgacctctttaatattggacccgatcactgtcatttttgtgacaggtattagggtcaaatcaattattatttccaaagaatgggagaacatatcaaacatatggaaaaacgttttgtaaaacattaatttctgtagagcctaccgtatttatattggcacaacaattcaccttttgtgtgtatataaaggatcgaaactaatccatacacctcacaactttccaagagaacttaataatacaaactcctctacctctagcatcgatctattactcttctcctttgaatttaacttctacaaaggtattatatctcctctgttagtaatttctatatcaaccatacaccatatacatacttctattagttaaaacgccattaaaagtttttttacacaagtaaaccgttcaataacttttgaaagtctttgccgagtgaagaattttagatcagtaaatatatttcatacatagttttcttccatctttgtattgattaaagaacaaaacattagataaatctgtaacatacgtaaacttcttgcgcacgtaattactctgttttgtgtttaagaaagaattaacggttctctcccactgagtagctcc

SEQ ID NO: 3025 - DNA, 655 bp, Arabidopsis thaliana
tatcacggccaaatctggtctgattttcctagaaatgatcccgaataaagatttccaacgggagaaacattagaaaaaatccctgagaacccaatcagctggtgtttccacaccatggatccaaacaccataaatcaaacacaaaacgcttctctctctctactagcttcaaaatctctgatcgacgttataaatgcggaagattaagactacattcacgttttacggacgatatttcaaatttctccgacgattacagagaccttaaacccttcggcttttgccttccaatatttccccaggaaagctggagattctcgcagaacgtaagaaattttctcgcgttttccctcggaatattctctcctggtttttttttgtttttgccttgtttgatgcttcgtctctctctccctcgtttctggaaaaaggaagagaaaagagaatccacgtaggcgtgtcaggtcagacatttgatgatctcgaaattacccctgcaattataccggatttcagttctaacatttctcctggaccaagccggtttatagtattcgattctaatggaggagatgatgacaacgtggcgcaagttgagtgtgtctatacatggagcagagcattttcttcactgttctcgcttcgccagacgtta

SEQ ID NO: 3026 - DNA, 53 bp, Arabidopsis thaliana
ggttctatttatttttcttttcttacccaatacataaatgattccattgtagt

SEQ ID NO: 3027 - DNA, 2000 bp, Arabidopsis thaliana
aacagcgaattgtttcctcttcttttacaagaaattacattctgttaaattgtgcacaatgatagaattttttttctccacatagaaaagtcggaatgaacaattttgacttcgtgaaatactattcaagttgatagtaaacaagaaacttctttaaaacatgcatgtattatgaactacattgttttttttttgttttttttacattagtttttactcaaaaatcatctaacagcttaaacggaaccatttactgtattttataacaaagaaattacagattctgactttatgttgggataaataattaatataatgcggatggtaacacatcgatgacattaacacaaaccactatcttatatagtatgtagtatttgaaaaaaaaaaaatggaaagaaaacaaattagaaaactatcggaccaaaagcataattactccgactttcgttatcataaaaatcttcacccattaactcgaattcaatgaactaatggcttaggtcctttttaaaacaattttggaccatttattcagttcttctatggaaagttcgaactaatttctagggtttggacctttggtgacatgagaaaaaaaaagaccacttgaccaaactcactgaagtcagagtaatggtgagtactctcgacacgcgtcaagaaacatccattttttttgttataaagaaagaaacatggatttgaaacgtaagtctattattttccacgaatctttttgatggaacttgaaagatgagtcatggtaataatataattgcgtttgttgagtattagaatgtttgagttccattccttgttcccatcatgacttttaaactttactttcttccatattctcatcttaacttttgagtcgacaaaaactgttcataaacacattcaaaatccaatataaactaacattgtaatatgttttacggtgaaaagaaaacattatacatacgaatattcaaatgcttatatcaacacattttggggttacagaagcaacgataaaaatatacatgaagctatatcctattatccatatctaagtaggatttgtgtcaaattatatcacttaaagctaaacttcttttactactactttaacaatacttggctacttggctacaatgaacgcgttaaaattttttttttttttagatttcacattttttgaagattaatatgattttagtttgaaaattttcagtatctagtttttagtgatcactccgattcaaactaaaaaaaacataaatgttcttctcatgacctcaaatcaagtggtccaactaatgggatatgatatatgaattaaatgcaatatgattattatgattaagttcatgtaattattatgtacgccatatgttaacgtcatacgttgccactacactcacctcaaaaacaaatgatcaatcacagcttcctgaatgtttggtcaccaccactaattcatttttttctctctcaatttgcagttctataagcgaagacaaataaataaaaaccatttttgcattataaactaattacttaaaaaatgaaaagaaaatatttttaactcgtgacacagctctttcaacaaccggattaaggctttaaacaaaatacaattttttctctaaaaaactatataagtaatttttatttttctgaatctcattattggctttttactcgatcacatgcaacatgcttctaccattttaaaagttggtgtggagccataaaaacacacacacacacacacacaaaactacatactaaaaaatattaaattgagtaaaacttctacatgaatcagaaggtttcattaaaataggggacacgtggaaaacctagatctattttcgctttacatcggacggtccaaattctctgtaaactagtcgtcggaaatataaaattatcgccaaaattcgcctgaaaattttcccaattcgaagagctaattagggtttcttctgagcttagagagcaaggacaag

SEQ ID NO: 3028 - DNA, 2000 bp, Arabidopsis thaliana
tagtagtcattttgttctaggattcttacctaatcaatcactccaaacgttcaagtttccgtaaatgatggtacacatgtgtatcgctcattcaaaacacatcgaacacactaaatccaacataataaatagatgaagaaaataaatttttagggcattaagagttcgaatgcccgagctatcatgaacgatggtagaaatgaatatattctgatttcgagtgcaccgtagacacaaacacacatctcatctaaagcttaaatcaaattttataaggaatttcaactcaaaatcaattggtaataagtggtaactcataatctattggcaagaaaataatttaatgcttcgaatacaatttttctctccacgcttccaaacacaatcaaaatgaattaggggatcgctaatctttgaactaattgttgtggatcgctaatctctagtaagaagaaagattttgtggacacgccatatcaaattttcaaataagatttattaccaatgtctttgctctctaatattttgtgtatccagaatatattagtttttgtatgtgccgatgtgatatatttatatacacactataatgaaagcctacctggatcttttaaattataatgattatatacaagaatgagatttctcatttgatcgtgggacctttgttagaaaaatactacaagctgaaagtgaaacaaactgataccaacatatccaaatccaactactcttttgaactttgtgcgatcctattaatgaactcattttatggaaaaattataaaatatactaaaattttatggatcaattatgggattggtacaattaagtctatgtttttgtgaaaataggtacatctcatatggcttatagatttaggtatttatattttcgtcgtttgacgttttcacccttcacacctttcacagttttctaaaattttattgcaaaatcttttttcttttccgatttcattgttgcagagacgttgacaacctaatctcattaataattttcatcattttctctataaaagtccgatcaaactgtaaagagaagggttggtgaggctgagaagcaagagaatgtggtgagataagatcgcgaatttgaaacgaattctgggtttcgagcttgattcaaatgaattaggtaaatctaagcttatttcttaaatttgagagattgataatgacgagattatcaaacgaattctgggtttctcgaatcgaacgaattttgggattcaaacgaattctgattgagagctaatctgctcaattgattcaaacgaaaattttaagagctaatttcctcaattgatttgattatttttttaattgaaatctttgggttccctataaattatctccttagggtttaatattattccattaaaaaacttttaattgattttttgagtttatcagaaccaacatttagatgccgtgagttgtcggagaagatgactcaagaagatggcttttgattgagtgaaattgtagggcaggggtaatttcgtcaacccaactcaccaaagtacctttccccataagtccattgtaaaaatgtccaatttttagtttttgggttagaaaatactcattctcgtaatagccccaaaattttataccgaaagtaggaaaatagattttagaaattaataaaaagaaatacactaaaacctaaaatagaaaccctcaactctaaattctcaatcgtgaaaattagcgtataactttaaccctaaaatctaaatttctttttctctaattgttttactgattatcatcaatctaaatttttaatatgccttactatagtttataggcccatatagtttaatatgtagcccgttaaaattacatccttcgagaattcgtcattccacttttgccctcactcacttgtcttcttcaatttcgccgacgacgaatccgacgtcagtaacttccgaccgcagtttccgaaactcgtgatcgctttctctttcgaaa

SEQ ID NO: 3029 - DNA, 2000 bp, Arabidopsis thaliana
agtattttgaactccgaaatgatttctcactatccgaccactcccaattatataacatgcttagaattattcgtaagatggatcgtagttgcattttacgacaccatacaggacaagtccatgatagtttgagttggtggattttggaacccctgcaaatttattttatacataacaaaggccccaatccattccttagcatcacaacttgggacttctatcttttgaaggatacattcacttgttggttttggtaaatatgattgtttctttacttccgaataagcaatatataaaagtatctaaaaacggaagtaacttttgatgatcctaaaggttttgtaattgatacatgtccaaaaacctcttaatattctttctcacaaactgttgatggagttaacaaagggagacaaggtaattgggacaatatcaacgttagatacaggacaagtgaaaaatgtggggttgatgtcttcagctgcagcatatcaccgttggtatatattgtcaattattagtcctatggatttgaaacgtgttttagtaaataagagtgtccaagtgggacatttccaataacgtatcacagctcctagagcttttgctatgtttctctaggcctgggccgcctagcccacattccaagcaaggaaatgaatggagttgggcatcaaaattttggaagcatttttaagacaaattatcttttaagtttccttttttaaacataaactatattttaggcttttttaagataaatattatttggattttctttcactcatatttttggatttcaacttaacaaaacatagggcgtgtctatttgactccacctacccaccctactggagttcgatcccactaaatcgcgttatcccgcatagtagggattgactatggatcggactttgtcgatccaaagatatctaagaaattcagaaaagattgtataaaattcagaaacgattttacgaaattcatgaaaaatgagaaatacatgttttttttaatttacgtcggcattaaaaacgttggaccggctctgtgtttcaccaaagaaattgtttcagtttatgcatgatcttcaacttccatattcttgttttcaattctggaaatccctaacagatcggagctctcctcattcagtgagttggaagattgcatgattatataattactcttcacatccacatatattacattatattcccctataatttcatacaaccctagaaaagaatcttcaagtaatctaatcgtgtcgatgactccactcatttgctagaaaagaaaaaacaaacagacttcatttagctgaaaacaatcttttattcaacattacaaagcactgatcaaagaacctctaacatggtaatatatctatgacattttacgtatcctaaaagaaaacaaaaagtgatgtattggatgatgttttttttttttactttctagtttcttattacaacgacaaaaagagtccacgtcgtcacgcacttttccggtggtgaaaaaaatgtccaaatggattaaatctataatatctccagagagatcctctccttctatctttttgggctccacttttcctatctctttttgcccctttcctctctctgttcacaagtcatcttcttccttcctctgaatcttgttcctttttgctctctctacttgattcacccactctgtttctcgattagtacgttgaaaactcactttggttttgtttgattcctctttagtctgtttttcgatttcgttttctctgattggtttggtggtgagatctctatcgtagtttgtcctttgggttaagatatttcatttgattggtgggtttgttttattgaagcttattgttgtgaaagttggagtctttctcagtttttaggttgaattattaagagaaagggaagatttttggtgtgaagttaggttatttggggtttgagaagtttgcaagtgaaaaaggttgtgaattgtgagtg

SEQ ID NO: 3030 - DNA, 2000 bp, Arabidopsis thaliana
gttgcttttgacagagacaaacgaatagtttaactcaaaagtaaatgttgtaatggtgagtgaaggtgtgcaattgaaagaagccaagaaccatatcactaaatatcaattgacgacaatttcatacattttacgatctcatggttgtaattatcttacgtaatgacatataccgtaagaaagacatttctgttttttttttacggtatgacactatgaataattgacgtgtttcaaaataatctggttgtctattttattttaattactaactcaccggtaatttaataaatttaaatttgtatttacaaagtaaaattataaatactctttcgaaattaaagattcatatgaccaaaacaattcagatgtagtatcaagtcatatttaacattaaaagaaagcgggaaaacaatgaccaaaaagtggagtcatcaaatcatattctagctaataaatcatttcataaaaattttttgttaacaatatgacctctgattctctgaatcatattagaaaagaggaacccctttacgtacgtaccgtacctacttcgatgtctatgattttccctcttgacaccacaattgttttggctctacatacctattttttaattaatcgtaacggtattatatacattaagaaagaaaatagtgtaagtgtttaatatgcgcatagaaaaatatgaaacttttaatgtttcttattgacttataggtcacccaacaagcttgattgagattaaaagtttgattatttttggcccatgatttgatcggaattgagcactatgagcctctttctttgacatttttatgcatatataatttgaacctttctttcctctcataatgttttatattattttatttcctaatttcttattatttatattggagcattttttgcttaatatcttttttatataactccgtaatccgaggctccgagcgggagtccgggtaaactagaatggagcaagcttgtgaaatacaaacacaccatattaaacatttagactacatatcaaaaccagtcgtccaaaaaaaaaaaaaaaaaaaaaagactacatatcaaaaccaacttatccaataaagttgttccaaaaagaatatgaaacatatatgatagatatatttaatagtaattaagatttgtcataaccaatcaagtaaacggatcatggcttgtataccagtggttttcaataatagcttgtataacagtggttttcaataatagatttagatatcgggtcattaacttttgaagtgggtacacaggtcgaccatatgtcgatctttcatatgaatcatgtgactcatatgcttagtgaaactagcgtccctagaacatgataattcagggcaataattgcataagtagagtgatgtttgcgttttgcttctcatcacacactcgtttccctggttgcgtgttgcatctcaaaaatattgcaaatatcccgaaatagaaagttttggaccctatctggtgatatataaagagaatccttttggcctgagtcgaactgattaaccgttaaatattttactactgaatggcacctgaattataggcaatctttacacaacaggagttacaggacatcgaggctccagtggtattcgtcgacctcatcaaaacagattaaaatacattagaaaaaagttttttttttaatgaatctaaaaaaaaagttcaaaggaaaaaggttaaaaactttggactgtgtagatcaaaattagtatgagaaaatttcaacttggagttgtcccacggttgcattgtgattatataataataatatgtgtgtatatataataacacactaaacgtcgacatcgcatacttccttcaagcatttggcttctttagctctcataaacttcatacccattcaacacttgtccttctaatcattttactcaattgaagaccattttgtttttctttttctgagtgttttttttcttgagggggcaacggaaaaaaga

SEQ ID NO: 3031 - DNA, 1604 bp, Arabidopsis thaliana
ctgacaccataaatgatattgaatcaatacaaaattgtcagcataaatggtcagtacccaaaaagaaagtcagatcaagtccaacaattataagtcttaaagtgtttcttgatggatcaacttcatccaaattaacaaaatggtaaaatcatcaatgtggatttgcagaacatagcttctatataagtcgaacttaactcatttcaggtgaccagatcaattaaaaaatgaagagagcaaacaaataaacaaaaagattcaaaatttgtaagcattcaagctcacattcggaagaaacccttgtttgctcaaattccagattcatgagtccacatttcagataaacataacagaaacattttcacattcggaaggatcaagctaagtaaaatcagagagtggaacagctaaaccaaagaagagaatctatcgacactgagaactgagaaagtaagagcttgatcgatggcaagaatgaggaaggacgtgatggctgtagaagcccatgaaaactgaaacaaaattgcagtaatttagctcaaattctcgagaaaaagcattcaatttgacatttttaaactaaaaatcaatcaaaagaaatgaaacaaaattttaataaccaaaattgacagagtgtgggaacactcaccggagatttcagcagctgagaatccggaagaatgtagcagaatcgacgattagggttttgctctcagggagcgatgatgttttgtttttttacagtgtggttagaattgctgacgtggacttaaatttggtttattatatggtaaatggaacggaagaacaacagcgagaataaagttcatagagtgtgatttcgccggcggtgagatcgcggcaacagccacggcttcaaaagaaatgctcacccagttcctttatcgctccttcactcctctcctcttctccagatctttctcctctacgcttttcgttaaaggtctctctctctctctctctctccctcttcctctgttattatctgcgacttttctgattcttaatccttctttcacgaatctaactacccatttcctgatttctaattccttgaatcgggtatgtcctcaattggtttttgaggtcttaaaggttgtgactttgactgtgccaatttggttagagatagctattgtgtatgtatgctgtgattgtaccaattcttcttattttgatagaaacaacaatagggtatgtgtgaatttactgcttaactaccacatagtgtcttaccaatctaaaagtttcgaactttagatgtaaaagctttgtgtctttgtttgatctgtgtgtgacttgtattactgtcactgaactgaagatttttgctgcaggcatatctttctcaagcactgaagaaacattaacccaagcattttctcaatatggtcaagttctcaaaggtcagtctctaatcccaacagcaatttagttgtacaccttcacttacatatctctttatctttatcagagttagtttgagatagttaagagtctatacacttgtacataaggttttcagtattttcattcattctgattgtcttcttcaacttttggttgctttagtggatgttata

SEQ ID NO: 3032 - DNA, 658 bp, Arabidopsis thaliana
gattcaaaatccactcgccaactttttcaaagatcgaatccaaaccctaatcagcagatctctcgactttcaaggaagatcacgcagatagatatgaccgacacggagttttggttaaaccggggttggggaatgatcgggtgtgttgtgttttctgattataagcaaagaaaagaaaagctacaagaagagagtctcaattagaattcgtatgttgacaaggagctaggtaaaaggtagtttttcaaaaatttaatttccatttttttcatatattggattgaaaaatggcaatgacatgaatcataggattatcaccacatttaaagatgtagtatttacataacaattgcaagaaataatactacaaaacttcctatctagtatagacgctgccaaagaaatacatacgacgtttttatccacacgcattgatgagattggtatatatctctgtctctgtcgagtgaaaaataaattaatagagtaataattaaaagctctctctctctatctcccacgatttcctttttccgccggaagaagaagcaaaaaaaaaagaaatcgaatctctctttcaagtgttcgatttaaagcaaaagtgtaattataatcggaagcgagatcttgagaaatggtgggatgacggcggagggag

SEQ ID NO: 3033 - DNA, 2000 bp, Arabidopsis thaliana
gctttggaaagaaaaaagggattagatcaatgaattattaagtgtagtgtagcaaaaggaacaaattattcattatcacttaaatatatctaaaaggaaatgaaaggacgtgactcttgagaaaaaaaaaaaaaaatactcatccacatgacatataacaaatacaaaagacatatctcaaatttaaaaatatacaaccaactacacgaactaaatgtatcgcattcccatataaatcaactatataatgacatgtagtcaatatcatggccatcttggtacaccaatcgttgaaatctgacattcaccggcattaaccaacaaaaatattatttttttctttattttaatattataaacaaaaaaaaaattattttcttgaatcgtttatggtattctataatgaaagaacctttcaacataaatatattttctgtatatattttatacattgattagtaatagttatttagtgttttcaataataaagtaaactaaatgtgaaataaactaattaagttagcgaattgtttatttttacactgtcaataaaaaaattaacttcttatttgacaaatatttttgctaaaatcatattattaaaatttatatcttctatatatttagaagaaaaattgtgacttttgttgttgtttacgcggtattacgagaattttcttaatacttttaatacaagattatacataaaaaaacttttgactaaagagtgtaaaaatttctatatttttaaactatgtaatataaattttgattttaacaaaaaaaactttgtatttttttgtaccatgcaaactttagattaagtgtcatatactcaattttttgtgatgaaaataaaaaaaaaagttatttttatttcacttttagttgagttttgaaataaataactaattagaagaatcatacaaaatatatttatgttgaatataaaatgtgttttgtttttaattatacaacatcataaacgattcattcgaatattaaaaaaaaaaattgtggtcactgctggtcaacactgatcaatgatagatttaagtcattggtataccagaataagattgtcgtgatgtttaccacatatcgtcatgtaattggtaaatttgggcatacaatacattaagttcgtgtagttagctatacatatctatcatgtgtggccatgtaatctgttatactttgtgtagatgagtatatttttcccaaaaattatatgcaaggctgtaagcgatcttaacagctaagtaagaaatctgatcattccaccaaagatctctcatgtgtatgattattccatccaaatatttgcattaagattttcttgggttataaactaaaccaaatgtatttcagtttttggtatgctttgctttatattaggattcggctatgtagaactatttcatttttagaatgtttaacccatattgtcttcaatctaaacaatagacttctttacgcgggttcgatcctagtgtacattatggcagattcattttgtagtatgtaagtgatggcatacttatttaatattgtacagactaaactatatagagtatgatacctacacgcaggaaaatagctggagaaatcaagaaataggatgaaacaaaatcggcagaaaattccagcaactcttactcgatgaaccagcttgatctttgaataaaaaatgagttacttcgagaaacttacatatccgaaaaatctgatgtttagaagattaactcttataaaatttatgtctaaaaagttttgcatagtaaacatataaaatcgaatatgttatatataagtatctaattttaataacaataattttaataacatgtttagatgggtgagccacacaaaatcactttttatttttaattcaaaaataggaaagcatgtgaatcatgtctataaataaaggtttccaaagcctcatattcactcacaaaatcactactacttactcatttctacttaacattctaacg

SEQ ID NO: 3034 - DNA, 391 bp, Arabidopsis thaliana
tgttacatatatgtgaaacacatcgccatttccttatttttatgttttaccatggccttttgttttgtttgcttgaagatgttttccgaatttattttaaaatttaaatgtttcagttatggatatgtctggttatatatagatatacatataatctcaagggtccgaaaatttccaaaagtaaactcaagggtctgaaaagataatttggaaatttaagtccttttcctagaataccaccgataatataagggctttatacacaaatacacaagagatacttcgagaagagattaaaaaataaataacataaaaaaatggaaattatcttcccgccatgtgtatgtggtaactaacaaaagcttcgattactttatcctctcactctcta

SEQ ID NO: 3035 - DNA, 1155 bp, Arabidopsis thaliana
agcttagaagagtagatctatctctatcaacaataaaaccaggaactcaaaacatacggtcatataagattctcttgcaagtagatacgaggcgttgtgtagcgattagaaggagctttttgatattttcgtttcatgcgcaaatgcatttgtcttgaacccctgcctgaaattggattgtaagtaaagtgctaatgatggatattgctgtaaacagaaacaatgatctttaactgattgatgtcaaaggaatgagtctggttttatctttggtatgctctgaacaatttttgtatgagaagagaagactgagatttgctgtttttagattgttcaatagcttccaagtactttggttttaggcttttagctaattagtttgtgccgtcttcatattttccccttcttctttgcaattttgctattttatggaagctgattatgaccaagcatcaatgaaggaatctctccactataacttatcaggttcacataactttcttaaaagtaaaacagtgaagaaccattcaccttccatatctccagagcaggttcattgcatcttagttagggtttaaccttcaaacttgtctttacactatcctaggattctattgttttcttgtcttctttgtattgctgcatttgattgacttaccactactctcttgagattggccaatttttgctgattaacagttcatttttgctctaagtttcatcagttttttttcttggcatggatgttttgctgaattatcattcgcctaatgagttacacaaacaaaattgtagattttcagagaaaacaaaacaaaacatatgaataaaaaagttatgcatatgatacgcgttaagaaaaacaaatgattaacgtacgtcggctgtgaagtgttgtttgatacaattgggggaagtgacggcacaatgggctggtttcacggcccctttctaagtcatacacgtctcctttttttattttcgtttttttcaaaataataaaaataatatagagagtggcatatccgacggtttaggatctctgccttttctcaacttatagtatataccaaacactttctaaggtaacatgagatatttcacatccttttctctcttattcgtttctgagattcccttcttgttgttgtagcc

SEQ ID NO: 3036 - DNA, 655 bp, Arabidopsis thaliana
agaaaacttttattagaatagatttcaaaaatctttatagattagtgtttgaatgaattcatgtaaattttctttgtcttacctaattatttatttattgtcgtttggtaataataaataacagttcatgtttacaatatgatattttccttattcatacttggtatatgctttattctctagtgattctcattacaaagatatttgtgcaagtttggactcgtcccaaatcaagaaaaatgttgtagtcaaaatgcttttcagttacgagtctgaaacctgacaacacaaaattataaattgtttttatttattttttcctaatcaaaacgattttttcctaatataaaatttgatattttgaggggtaaaagaagcaataattgagaatattgagatactaaaattgtgacgagacgcttgatgggttccacttaaatatctgatatgattacacgtggcagactatgctccgtccctaatgagcttcgtgtgattttgattaattttgttaacttttatttttgtcgtctagttttttaaatttattaattaatttttatttatcttctaatttagattttattcctttaagctttttcgctcctcactctctcttcccaaagttctctgtaaaactctctctccgtcttca

SEQ ID NO: 3037 - DNA, 2000 bp, Arabidopsis thaliana
aaatcgtaaaagtataaataccaagtggatagtctagtggcttagtatcctttagtgaagattgtgctatatacagaatgtactctagtttgaaccttctttattaggaatgtatttatcacaggctggtcctggccgaaaaagaagactacgggtctaaaagttccaaaatttcctcaataatcaaagaaactcttgcaatgctctttatacttgaagctgtaacagatcttaaccattcttgtagatgatgatgaaccaacttttaaacatgataatctaattcgagattttgtaatgtattttcgtaattcttcggtttcagctagatgatgtcaagtgattaataaaaagaaaaagtttgtattgggttaatagttattggtgtttttagttcgaatttctttttctttctcataaaatcttgggacttaggatgataaagttgggatatacttgagaactagaacttttcatacccttcctttgaataatataatattgattcagaaaagcaatagaagttgccacaactaaaatgattggttcatttggttgtctgattatgagacaccattatgtatttttatttttagattttagtaacttaaacccacttactatctttgtattaataagaatatgttgttgattataatttcataaactaatattttaaaatttgattgtgtatgtgtaaaaaggtgtgtggccagaatcaaagagctttagagatgaaggcttgggaccaattccttcaagatggaagggaatatgtcaaaaccaaaaagatgccactttccattgcaataggttcgttttctctcttttacaatttttattctttcaaatttggtgttcaatcattttcacgttaagtaattatcataagatacaaacaaattctggaattatctgttctcatttcttaggagttgacacattcacacacctagtggtggaattatgtgtatttgtttcaaatagaatcgaatttacaatttttcatcaacaaaaagaagacacgtgttgtaacaagtcatatctattttgagtttgagttccctatttcaacatccgtgggtttgttttaggtacaaaaagaaaagtatgactcattttttggaacttttgataatctattgatgggttgtagtaaattttagagtgattggactatacaactatactttaaaaaacatatctataaattatcacttattttaaaaaatagtcagaaaataattgattctaaattatttataaacataaatttcaatattaaatagcatgttttgttaagtaaatcatttaaataaatagcatattattcaatgaaaaattactcaattccatgtgtttttgttttccattatttacataattaacacttacactatagttatctatacaactgaccttatgtttcgtatcccactttacctacttatgtagaatcttttttttatcttacacatttttattctggactttctttttaaccttttttatctgttttcttggcaaaagatagaactggaatctcaaaaagaaacaaaaaagatattcatttatgattccctgtaattacaaggcaaaaactaaaatgataccctgtaatatattcttctatgagaatatgcacaaaatagtcaaattttatcgatacttaagaaaataaccatatgctatagtactttgtcggaaacaagtcggagagtgtgtgaaattacgtaaatgtctttcataacatatttttctctcgaattacatgtgatagcataatatatctcttttatcgtatttttgtttgtattgcatgtcatttataaaaagcacatgagatttctggaaaaatatattatattcagtttaatatttcttgttatcatgttactttgtagtaatatacgttttttagttaatatcacatgaattttattttattttgaaaattcttattttgtaatattacacggtttctgttaaaatcacatgtg

SEQ ID NO: 3038 - DNA, 702 bp, Arabidopsis thaliana
cttcgctcacagagaagaaaaccctaaaactggatctaaaaagagagagagagagagagattttgaaaaagggaaaggagaagcagagaggatcttttgttttatgagagagagaagaagaggagggtccatttataaagaaaaggaggttttaacggctaatatttggtaattcgaaatcgaatcgacggtttagataatgccacgtaaatcgaggtggcaacgggtggcaaaattcaaaaattaatggctcgtgataaaaagtttttttgaatttcgtaaaaaaatatgttcgtgtgaatgacagctggattccattaaggagagcagttactaaaacatcgtcgcactcgcacgtgctttatgagagataaaaaagcggttccaacctggcaatcgcacgtgagagacttcttattgggcctaaaatgggcttttactcttttcatttcaaatctgcatgacttaaaacggagtgatgtgcactagcaaaatcctcagacggcaagcatgtgtttgtaaagtgaaactcatcgttttaatgattgaatatgcttattggatcctgaaccggagcctgaaccggagcgtgaaccaaaaaatacagtcaatcggaaaatgaatttcagattcaaacttgttcatcgaaattttgcttgaagattcgaatcgagaagtccgtggaagaggaagaagaagaag

SEQ ID NO: 3039 - DNA, 2000 bp, Arabidopsis thaliana
tatatgtttagcttgttagtagttcatccccataaactaaagattgcaaaccttaaaccaaaaaagttcacaaaactcctgataatctcccaaagtctctatttggaagatagtcattgcatagttcgaaaaagtgaggaggactacaacaaaagatagtctctgcattcataggtttgaactatttctttattaaaaaaaaaaaaaaatagttagaagacaaaaagtaaaatataatgggaaaaacaaatcttataattcatggggtttccagaactttagttcataatatttcttagtatccaaagtttgattttaggtactccaatttaaagaataagtgaataatttcgtagatagtatatgtaatccaaaagatactatcactagaccattgttcctttggtaaaattggaaatagtttaaaacaagaagaatttcatagacaatatgtaattttaataacagtttgataggaaacaataattttcaattactatccatctatcctttttagaatcgagatacagtaaaccctcgataaactaataatattggaaccgtgaaattttattaatttatcgatgtattaatttatcaataaattaattatagatattttaggctaattttgtaattttaaatactttatgttttaaaaaaatacttatgtataattattatttttttagaactaattacaactaataaaaaaatattatgtatagaaaacaacaaaaaagattttgaatatagtaaaaatattaaaaatgaactttagaaataatgtaaactaaaaatatatagcagagtcgtatttcaccaaaattttcatttataatatattaaaaaatttatacaattattagtttatcgagtattaatttatagaggttttatgtatgctgtatatttaacgaatacatcttttaaatcatatatatgaaagcacgggattatgcggtttcatcaacacactcaaaacttttacctatgagtaaaaattaacaaacaatatacagtgcttaataagaaatatatagttttcatccttcataatacaaactctcctataaaataatatttgtagaaaagaataataatttttaaatatattaaaaaaaaaaaaaaaataacaaaatccggcgggtagcgcggacactcacctagtaaagcttaaaacttaaaggatattccatgggaattaatatgtgatggttatttaatttgattccatcaaatagttaacagaatttaagctgtatatttaatttcgtaaatgaaaatatgttattatttttttactgaaatcgtgtgattattaccaaaactagtagtcaattttgactggtacaaaccaccaccctatccagcttgtaactactaaaaatgatgaaaacaaaatagaagcacacatacaaaatagctttattattgtttcttttaaattcatactcaaactctcaaattcgaagaaaatactaaacaaaattattattttatcagaaacttctttttggcgtcattgcatcagaatcacatgtttatggtccattgacgtaaaaagataacacgttagagaaagagggcaaaagctgtcatcgtctacaattttggaagcaccccaccactgactaaaaaatcaactcgttaataattttcttagaaactactatcaacaaagaataaaataagcatgtgttataaaattagggtgatttatttcaatgtcaatataaagccaccccaatagaatgagtttttctttgtgttaaaggagtagcaatagtagtagtagtaggtgaatttgaattgaaattagtaatctataaagtcttcttcttcttctatctctcctcgtgaccattaaaaaccgagttattatatttataacataaaactttatattataaagtcttcttctcattttctttaaaaaccattccatctctcattgcaaaccaaacaagaagaagaaaagaaacacaaaatcaacaaca

SEQ ID NO: 3040 - DNA, 2000 bp, Arabidopsis thaliana
aagttaagacttgaattgaaaccacttaaagaagaattgaattcatcatgatgaacaattcaaatcagtagtataatacaattcttttacaggcattattgggaaaatgaaggaatagtactagttaaattaaaatatttgaaagagagttgacaaaataaaagaaagaaatttgagaatagagaaaaagaaagaaggaaagaaagaaagtgaagcttcagctttaagacggaggagacgcatgcaaagaaggtaatgatgttgtctctgtctcctacgcagacctctctcccacgccttttgttattttttatacgcctctgaccttccccattccttcttacctttattaccctcctattcactcttttaccactcgtttactactagttaaaacttagaagtagtaatatttattggtataaacctcattaatttcatattgtgggcataaatgtaggagtataagattagcatccgttagagattagtcacaaacattacaacattaaacgttaacattatctatgttgttttccatgattagatcgaagaaattgcatgaccatatcaatgtgctgttagttcagtgataaatcttttaggtggaagtgctgagttcgaaacatattgggatgaatctcttttccataaaagatgaatttaaccgagtgtttttgagtctgaattttcaaatattaaaaaaaaaaagaaaattgcatgaccataatttttttatttataaatataaaaactatagtataataaaaaaactatagtataacaataggtaattttcacaaatagcaaaaaaataaaatttattacactagtataagcatttgattgcctttctcttcaatttgactgcctttttctcgtttacaattttcactgattatatatttgagaatgttttaagctttaattaacctttttttaaccttttggaacaatttttttgacaattatacctatttagaccattttcgtagagtaaacaagagaaatttggttttccctcgaggtgttgttgtttgttggtttatgaaattgaaatgtgccaatcataaaaaaaaacaaaagaaaatgccaacgaaaaagctaatttcacaaacgcaacagcactatcaaatcacattattaaaataatattattattttaaggccaaaaaaaaaaatcaaagttgccatgaacgagctagaggaaaaaaaacacacaaagtagataacatctaaaaacaacaaaacagtacagtagctccatgattcgttttctacatacatctcttcttcatcctctcttctactttcctctttcctctttccttcttcgaataaatttctagggtttttcttttctctaaagttttcatttttatttcaatgagagctcgaagaaggagaatatgggtttgagaactgataatattatggcttcgtttcgaggtggaatcggggtttctaatggctgagtcaactcggtgattctgtgttatagtcacgagcaaatataaaaaagtttgtaactttcttgtttttttaggtgtgtgtgttcagagaaaaggtcgaatcttttttcggtgtttgtaaaagggaaagttgtaatcttaaagtctgtttttctttcttgtgttttggtatttagctcataaaagccgaggagtaatataaaggataggttttgtctttgtgtgcccttttgagattgcatgaagaaaaaaagcctctagtgtgttttgaaggaaacagaattcgatatttatgcggtaatgtgatttgtgaagctactccaagtgcttaggatttgagatggcttagatttggtagttgttcaagctgtggagtttgtggtggactaagaagctctctgtctcctttgtttagtatgttgtggttatcttctgtttagaaggatttagttattcatctggagggggtagtagggtcatttgtgagattctgtgattgtgaaataagaagagttttgctgaggagta

SEQ ID NO: 3041 - DNA, 2000 bp, Arabidopsis thaliana
tatgcttttatagtattccaaatttaaggaaaacgatttataatcttcaaatgaacgctagagagttgaccttattatgttctacctatgtttaagtctaagctagtccttttttatacgaacattggtgtaatcataattgtagctaaaagattctccattgcaatttaagcaactccgctttaaatgaaagcagagccataactttataacttgagcataagatagtccatacacaaaaaataacgatggtcgatgagtatgtaatttcacaaatttatacatacctgcatagtggttctctaggattggcgcaaataaaagtgacgagagttaggccgatgggaatgcaaatttggacaacctaacaatagttcacttaaataagtaaaaatgttaggcttgacttctaaaactataaagagagttttagaagaatcaattatatctctgtcaaagtggcatgcattgttttttttacttcattaactactcgacaatattctgaccacaattatttgacgtatccaaatacaccaatagactcacctgtatatctaaacgccattaactcaatcgatttaagaatttgtatatgcatgtttctattgcaggctttgcagccaaattcaaatacgatgtttacacttcaaaaataaacttggcatggtactatataactcattttgtccctatccacgacatatataatgacaggagaaaatattacattatatcttttttttatttatgcattttgctatattatccatttattaatttacagcgatattttcctaattttctatttaaaaaaaatataacataagattttttcattatttaaaatatttttatagaacaaattataagtaaaatacaattatcatgttttgaagacaacatcagaagtttttgatacaataaaaatatgagaaaaaattaaaacaagaactaatgagaatttaagccaacagtaaataatagtattatatttcattgaaggtgtcttacataatatatatatagttgatatatttataaagttattaatttatgatattgatgggcttagatgttaatatatataaaaaaattaaaaagtagaattttattattttgtcgattaatgtcattttttacattggtctttactcggaaccaacataatttatttaatttatagagattactaattttccgagtttaattatagagattttactgaataatggcgggagaaaatatcacattatatccttttcttatttatgcattttgctatattacccatcctcagttttttttgaatattcgtaaatttatagagcaaactttaaaactatactatctacactatttacataacaaaatggtattggcatacctccaaaactgatacaagatacttgataaaaaggagttatcgattcaaaacaaatggaacagatcacatatatgaaaatgtgatatctactctgggtattgccgtaaaatatatttttctgtataattccctaactcgcaaatatgttaaaaaaaactataataaaagcatattgaaaagaagagaagagaaaaaaagaaagtaaaattgagaacatggatatcctccagcgaagctacctgccttgtgggataaaaaaagcataagaaaccattaaagtctcacccacacaacacaaagttccttcattcatcctttttgtgtaacaaacataactccaatcgccaaacgccaaacgtgaaaatcccatcaacgcgaaaactctgtttttttcgttacctaattctctgtggtcgacctcaccgtaaaccttcaccaacccaaattaaattcttctgtgtttttattcacaaagtacaaaaaaaaacagacagataataataatctctctcccttctctgcctgtctcttcttcttcttcctccttccttctttctctctgtgatttgcataaaacctcgagctccttcttcttctgttccattccaaaaga

SEQ ID NO: 3042 - DNA, 373 bp, Arabidopsis thaliana
tgcaatggcttatcagacatgtgtttaattagttgatcattcactgatatgtgcaagaaggactattatttggttttatttgttcattaactcgtttggagtttgctttcctcccataacttacatattttactatagtgaaaaaatttttagctttcatttttcttttaaaagtatttgggtctatgttgcaatttcaaaagtaattggagactattaaaaacgcactctaaagtcaaacccttaaaaaccaatttaatgcaaatactattctgcggcgttactcactctctgtttttgaccggaggagatagaagagtagggcaaagctctttcgattaaaaaaaaaaaaaaacacttcaagagattactt

SEQ ID NO: 3043 - DNA, 2000 bp, Arabidopsis thaliana
ttacattctattttttcctggatgcaaagcacaacatctttcagaagactaacataaccacatgttctcacattgctttacagggccaaggaacatgaacccgagatagtttctgcagaaccacccgaaccaaagtaagtctagccaacttgacattgttaatcctaaagttcagattctagctcacggatacgaaacatgactcgttctttctgatagttacagactgctactatgctgaaactgttctctatgaacataagttatgtattgtgtttggtatgctttaaattaaactaatgttaatgttgatgttgatgatgatgcaggacaacagagccatcaggatctggatcatcatttaggcccgggacatggcagccaccatcctaaacacatctctcttcacgcagatgacaaaccaacatactattcaattattttgtttgttgtactctacacaaccgattggtttgagccttacagatgagccataagaccagagagcttttcaagaccctaaaattgtgtcctttcacgctgtcattgaggacttagaagagtcaaaatgagaagccatcttcttatactttgttttgtttagggtgtttgtctcttggcataatgcttgagacttttagcctgccttgtccttcatagctgaagaggagcctagctaccttttgtttctcttcgttgacttgaataaaacagtttgattgaataacagttattcattttcatgtcatgatggtagtggatataagaaaaaacaaatacatagaataattattttaatgtttcagaggagaaatcctacttggcttgtgccagactcataacccaatcaaaacttcgtattaccaaaataagtgtagttctaaattttattctggtttaggctgtagttataaattactcattttagtttgtgaatataaaattactttctgcaaaagaaaatattctcatctttcgacgaaaagccaattattcgaatgttctcacgttggtctgtagctgtaaactttatagtttatataataaggtgttctactgttcttatataatttgcaagaacaaataatattaaatgcaaataaaaaatagtcaacggtccaaagtggatcataagccgtccgttcggtcgtctgaacttcatccaacggttaaaagaaatatacctgacgtggccttgggccattgtatattagtagtgagtgtgcccttggaaggttctgtaaaatgttttattcgcctctatcagaagcttgacgaaatctcttctccgtctctctctctctttccctcgtccattccacgatcttcttccaatctcaaatctcccattttctagtgtttcattttgatccttcttccttcctctggagatttctcaaatctcttcaactattttgatttgccgccatgtatcgacgcgccacttccggcgtgcgttctgcctccgcaaggctttcttcttccctctccaggatcgcctctagcgagacagcttcggtttcggctccatctgcgtcgtcgcttcgcaatcagacgaaccgatctaagagtttctcctcggctctccgctcctttcgagtttgctctgcttccacgcggtggagccatggtgggagctggggatcgcctgctagccttcgcgctcaagctaggaattccactccggttatggagaaatttgaacggaaatacgcaaccatgggtatgtctgtttgctttctctgacgttctaagaatgattgctcttaacttgtgtgacaagaatctgtgtttaccgcatatctgcttagatcgatttttcgctttaaaatgatgatctactgattctgatatgttctgattcaaagtaaaactagctagatgaacatttgatttgctcttgcattttggtttatgatttgtagatttagtctactaaatttcttttttgtatattctaaaaggacaagcaaattcatgtgttatgtgtcaattgaatt

SEQ ID NO: 3044 - DNA, 608 bp, Arabidopsis thaliana
cctagactcttgaatcttgattcagcataagttagcctgatccacatctttgattatgtatagagtttgaaagagtttaattcttaacaaaagatttcttttttcctggattctctgatggctttgaaattttgcttgcacttatcatattaagcagaatttttgaacctctgtcgtgtcagacaagaatgttggaaaaaaataacaataatgggcctgtcgaattaatgggcctgagctagtatatttcgagcccagtaggttctcacaaactaagtagcagaaaaagctgagaccatcaaatagccaaccaaaaaatcacctcaatctacacaaagtctcatttctcgttaatttccattttcgttatctctctctctcgccgatcaaaccctaggtgtatcaattcgttcagattcccggcggttggtctcactgtcatgtaggtttgattcatcttctcttctggatcttgagtgacgaagagagaagagatctgagtttttctgagagagagatttttctccctcgttgacccgatcagttttttttcgtcgctggggattttcaaattttttttgagggatcggttttgatttgttacgtag

SEQ ID NO: 3045 - DNA, 1363 bp, Arabidopsis thaliana
tgtgctagaagaaaattagctacttcaacaaatttggtccatcatgttgaaaaccggaagcaaccacagtttgttggtacgacgccgtctgttaacgttccggttattaataatccgtatcctttgatgttgccgacgattacgagtcctatgattagaccgatgattaatgagatgattaataatcttgtaaccaataggccacaacccacaagatccaagccaagtctctcaacttcatgaattgctaggaccattttaggaatgggcagtggcggactggttgatggatccgtcggttttcttgggtttgatacgtcggttttcacatcagttttttttttttttttttactttttttttttttttaagaatgttattaatttttcatcatccattttcatagttttgacgagtcaattgaatgccatacgataatactaaacaagtgacttttattaatttgatcgtcatatagggttaaaaaaaattaacgatactactaaattaccgactttattaatttaattcgtcaaagatgtaaaacaaataaatgatagtacttctgaactagtgataaactgataacatagggatttgattgtttttatgaattcgagtgtgtttgcgtttaatagtcaagatatgttaattaattttgtttaatttaaataaatatataatggttggtcaagcatgccaagaaaaatatatattttctaattaatattctttataatttattttcttacaacataaatcaaacaatttaactgacgcaaccacaaaccttaaacatttggaagacaatcatgtcctaagccagagattaaaaaaagtttttggtttaaatatccaaagacctacttcttctatcggtgtctctctctctctctctcgccaccgatcatcatggtctgcaccgccattgaaatctacgtcatcctttgatctctagctctctccaaaggtctcttctttctcgtcaaacttcatatatgtctctgttttgtccgatcaattatctgtttcctgaaatcgtttagttgaattccgttaggcaaattagttcaaagttgattcctttttgtgatttgtgttgttgactctatacagatgcatgcgttgcttactttcggaatctggggaagttccaattcaatcaattgaagaaaaaagctgagcctttattggttttggaagaattggtggtggtgggatctatcatctatggatcggaaacgtagaggttgacagagagacgtttctaggtttgattgatctgttcaaataagaacacaatctctttgttaattttggtgttctttgagctctcatgtcaactagtgttcaaggagagaca

SEQ ID NO: 3046 - DNA, 787 bp, Arabidopsis thaliana
aaccgtttctctgaaccgctgatcgattaggttatatacaaagaagacttttgaagatcctcaacgtaaagaggattcgattctagggtttttttcttctccttagtgcgagattttcttatctcttaatgatgaagtaagtccgtatttatagattggtgtgagttaattaatttcctttttttataaaacaaaatattaccgttacattacatattctccggtttaccgttgcatacaaccgtttaatataaacgttgcatacaaccgtttaatataaacgttgctgtgtgaagtgcacgctcttgttcctcttatcatttgtgtgaaaatacatcaaatatcaccttgtttttttgtcaagtgctctcgtttgaatttttttttggttataaagtcatatttcccaatttgcataatgatatacaaatataaaccggatggcccaaaaaggcgaaaaccattagtagtactggcccaaattgcttcttcataaaattaattgttttcggcctcaatactatttcatgttttttgggtcaacaacgtccaagtaccctttatataacataaataaggattgttagaaaagaataattttgatgtgtcacgattattttatcaaccaatcactgatctctaggagaaaaagtgaggacccatagtttaagcgacactctttggttaaagaataaagattagatcggtccaatttatatatttacatgttccgccattatcatcttctaatttgaaaactcttcatcattccctaccaccggattca

SEQ ID NO: 3047 - DNA, 2000 bp, Arabidopsis thaliana
aataatatgtgtccacctcatgtattacgtcactcataggaccatatgaccaaaaaaaatcaacaaaacacaatgaaacatgatgttgacaaaatggaccggtgaaaggaggaacgaaacgcaattacgcaacccttgggacattttttttttttaacttttcttatccttttactgtttatgcagttgaaagattttcagataaaattcaattttcacacagcgaacccaatatgttagcattcaaagaaaagtaaaaactcagtgagttaatattgcaattcctcttgtctctatctctataccgcagcccatgttttttgtagataggcggttcttggctgtttccatgaagctgaaactaacaaaaccaaagtaatcatttaattaaaatcactaattgtgctctttaggagagcaaaattcttttgatttatgcaagaatttaaaaaataattatataagctattggtgctgaacgaattatgtaaagtagtgtatgccagtaggtgatagtgatacgaatagtgtattacaacgaaacgtgaaattacattcttgatactcgaaaacatatacaattttttaaaaaattgttcagatatatgatacacatttttgttgatgttaatttagtaatatatgtacattacacacacatgtctcgaattcttctatgtactagtatcaaatatattaatcggtcaaactacttgacagattaaaaccatgtgcgacttctcgtatagcttgtattttaaagttttgatctgatcttaatatgcgtttattggatcatataatataacatgtggtattttaatatcataaattttggtttcttttcctaaaaatacaacaaaatatctaaaactttttgggaaatctgttagaagatttttttttgaatcaattgtagtaaatcacttcttaaaatgaattttttaaataatataaaacataaaagagaagagaagaggaggttccatcaacttcacttacaatgagaaaagactatgcaatttgcacaatcatgactttaaccaatacacatttatcagaagaaaaagaatctatctttatctttaatctctttacaaattcttttttattgataaaatttcaaaaatgatgtgattcaaaaatacaaaaatgatttgattaaaacatcacttttcttcctatatgaacttgtaataataaacgaattaccggacttcataaaatgatttgatttcgtatttaaggccatgaaatcttctaactaaagtttgtttctgataaggtataggatgtatattctttgaattgtgacaattggtcgaatgtatttttaccttaaactgatataagattctgctaatctagactcaagtcatcaagtagtcaaagctgagaaatgatgctctttttgttttcaaaagcaatgttacctttaagaaatcattaaacttgatcaactatttgcgtcacaaacaatttttgtttttaatattatccacggatgattaaagtaatgttgttcagaaacttggtgccttcgtgtctcgtaccatcacttgtgtcaaaccggcgtcaaacgcccactctcgctgacctcagcccccaacaaatacacacatacggaaatgaacatgtaatatcaaaccatataatattcagtaaaaaatcagtatcgataatatagtaaaataataaccttcacgcattccttcttcttctataaatacacacatttgcctccacttactctcgttcaaacaattcttcgtcctattaaatacaaaaaataaaaatccttaaaaatatatccttatcttcaaccaagaatgggagaggtccaagaaggtcccaaagttgaacaagagaagaagccggctgccaccgtagtcccagttgagactactgacggcaagccaaagagcggcggaggagattccgcggcagcagcagcaccaccggtcgccgcggttgtctctgcctttgtttacaaagtggat

SEQ ID NO: 3048 - DNA, 2000 bp, Arabidopsis thaliana
atttgaattatttatatgccccctacatagcgaggattacaaagaaggaataaaactgaaagtgaaaaatgggatgcgactttaatagagtttcatggtcaccactacccataccagttggtccacgtcagacgtatacaaaggcatacgatacgattgcttgtgctttcagattgagacaccaaagatcaccgattcaccatcatctgatctgatgatatgcttttttcccatcttctgagtctttctttttttcttctaaatttcacaatatacatatattaatttcaataccattaccatcaataattttatagctacaactaaataacctacaatatacagaaaatataaaaaccatttctaattttaaaatgggttttgtgtaaaaaagactttaattattgcaactttatttacatcttaaaaaaatatagattaatcatacaaaatcaacaataatatataatataattttttttgctaccgtcaaatttataaaatttgaacaaataatatgtcaaattgaagtcctcacgattaagaatacaaatttagttttagaattttaaaattttaatgtatgtaattgtgaaattgtaggattaatctaccaaaaataattatatatataaaaaatatgatcaaaaatggtaaactttaacaaaaaaaataaaaaatgacaaatctggacaaaaattagtttatgcagtatataatattatttttgtagcaaaaacatgtctttgttttcttggttgtctcgatcaaaaacatgtcttgagagcatatatgaatactaatatagtattaaactataggatgatggggtcattgacgtggtgactagttgacattattatcaccgtaagatctgattgtgctatataatccctaatctgacgctccatttatttattcctccattaccattattagatctctctgtctctttctttctgtcaaaaatattatcttctttgcaccaacttcaacgcattacgaagcagaagacagaacccaaaaaccgacaaagttcccctattctctcggtataacctcatctttatcttctttctccgccattttctcttttctttgtataaatgtctttacccattttggattagattttccccctccaagtaaatgaatcatctgcttcttcaggtctccattgattctcctactctgttttcctcctatatttgtatttgatgttttgtttttttctttggaaccaaacaagtcataaagtttcgatctttgagatcttgcccaattcttggaactagtgtttggttttcttgataatatttctgtgagagaattcttcaattttcagattttcttgataatgttttgctcttttaggaaataatttatagccattcagatttattctcttgtttctttgtggtatatggtgcttgtaattttgcaaaatttggagcaccctatctttttgtttgatgttgatcttattggttcttgacttctttcaaagagttgacttatctgtaaaaaaatattttgcagaaaattcattacttctaaagatggatgttgtaggtggctgatgactcttcttccctagcatgacctttattggtaacatcttctttactcaaaaaagaaacattccttttggaagaatcttgttgttgttgttgttgactaatcttttttatcatgttcttggcagatacagagatgtgtatgagaagaaacaacatcaatttaacaacagtcatagattctaacgaagccattggtatggaacatgaattagattctgctagacatcaatattcttcagtgctcactgcaattccattcttctccgctacattgtttattcctctctctttgaaaatcactatacgtgacgggtttcacgaaagtctttaataacatttccatacacaaaacacaaatagtttagagatttgttcttagggagatttagctatctctctgttcaaaagattggtctaaag

SEQ ID NO: 3049 - DNA, 1017 bp, Arabidopsis thaliana
ggtttggaactttggatattattttggtcaactttttcttacaaaacgaaaagggttctattttctaagatgtatatgaattgtcaagcaagcacctatcacattatgaagattgtcttcatccatttctctcatatttctatgtttgccaaacaatattgttctttgaaataaactttcaaaatcgaagattttcaatttcattcgatataattgccactggttaaaattctttttttttcacgaaattttcactaaaattataaagacgatacgaactgggtagttgaaactaaagagttcaaacttgaagtctatttcaaagaactgggtggttattttcttggaatgtaaccttcacttctttgagattaaaatgtgtttctaagagtctaatttggttgatatttcatttttggttataaattttactagattgtttcttgagacatcttattgttttaatcggattatgcatttgaattgggtcgcaaagtaacaaaactatttaaacaaatatataatcacacgtctgagttagtttgtttaaatccaaattttagttcttttaatcccatctatactatatgccttcaaattatatactatggtcctaatatggacatagtcagaatcatttaaaaaaaatatctaaaagaaataaaaattgcaaccacatagtagttgaaaatatctaagagaatataatatttctttcttttaaaggaatataatctaccccaattaattgtatcattatttccagttaaagaaccagtacagcacattggaagaattaatcttatcttcgccacgccatatatctttctttctactataaagtaatctctaagaaaaatacaaaccaataataatatctcattgatagtgatagattagtattaattatccattttgggctataaatagagaccctttgagatccaagtttatcgtcaaagcaaccaaacacataaaagagagatttaatacaaaagaaagagaaaaaagaaagat

SEQ ID NO: 3050 - DNA, 465 bp, Arabidopsis thaliana
tcagcaaatggagagaggggatttgtaatgtttttattttttttaaaaaggaaaaaaaatcatgaatatacaatttgtgtaaagagagttgtcttcttgtcatcctctacgtttcaaatggtttttttttttttaaatatagtataagatagttttcgcatagaaaaactcttccctgaaagtccctgaatagtttttataaataaattatactcctctttatctttaatcaaaagaaactgaaatctgtctaatataaaatgtgtgtgtgtgtgtgtttttttgtctaatttatttttttctttctttgtctaatttgattagatcacttctttatttgaatgagtaaaaactagaaaaaaatgtgagccatttaaatctgattcatatcaaaaaattttcgatttaaaaaaaaaaccctcaaaaggtgttgatacggaaaaagaaaagggaaagaagaagaga

SEQ ID NO: 3051 - DNA, 1923 bp, Arabidopsis thaliana
ctctttttgtgtctaaggattttttggtactgaaactctcactcttttttttggttcctctggtccctctctatatgattcagatcgaacactgtggttttatattttttaatgttttgttatgttcacacgttgggttcagaaaaattgacggccgagatcttttctataagaggaaatcggtggttctacttagctaatcctttttactagaaaagtttaacattttgtactttttgtctgtatgctctctagttgtttgttgagatctcttgctgctagattcactttttgggacacattgctttgtatttgaagctagaaagtttatatcaacatgatctaaaaaagtattttaagagaactacattgaggtagttatttcttttcctaaattagtcattggtaaattacatcgtgacatttatagaacattgcagagcataaaagattgaaaaaaaaatgagctgagatttgtatgtatataaagaaaacgtattagcatagctttctttcagatttaacggtggaaatcatacaaaactttcttgcagaacaatgagtatatatatgaaggactcgttaacgaaaatattagtttaaatctagatatcttccagtaaaatatgagtttcgccttcgtatatgatacggcaataactttgggaccaactaatttgcatatcacatgttgatatctctttcagttctactcattctttttttttgaaaacaacaaattattggctgcaaatgttttttggtttaactagtgcttctctaattgtcaagtatcttagtctagagttaattacttaaatactaaaaggctgtcgacaaaatcaagcttgaatctccttgtggtatcttcaactcttcgttgtctgcttacgagtggtttactcagtaattatctataatatgttattttttttccctcatcttttagttgttgtttcattacattgaaaagcttgtaatgtctttatatggtatatatggatcttatgagtgaggcaagatccatgatgtttttgatcttagaatgtatatgatgatcttagaatgtatttgaccgcccacaaattattgttcattgggattatatctctagtccaactccaagcaatcgaaatgggtcctgcttttaagaacaacagtatatgtttaagaataataactttatatattctcgattttaagatcttttgacaaaacctccttttcgttaggagcgtactaatttccaagtgtttgattagtggggtctccgtaaatttatttagagtttctatctatttattaatagctcaattaattaatctatactgtatctaaacatcaatttatatatttactcttgagaccaaaactgtcaatttataacattggatagtttcttaattcttattatatatttttcaaacacttttcaagactaatctccacattaggtactctctctagagataaaaatatttatcaaaaacatttttatttatttattaagtagtagataaactactgtggcaaaatcgtaaatgtctaaatgctgatgaattttttttgctgctccaatctggtttagtgctccatatacatccacggccaaaatgaatctatggcggcattaagattcattagtaagcaacgattatattaatataattgtttttagcaatgattttccgtaatttcccaaatatgtttcagttaatgtgttccaatcccaacaactggttgttgcaaaagaccaccaacgcaagcaatcatcaaacatcaaaataatcttaccttagcgaacaaacaataactacacaattctcataaagctcttatatatcactaacttcacacattttgttttccacaaaaataaaaacggaactcactcaagaaaccttcttccttgaagagagggtt

SEQ ID NO: 3052 - DNA, 422 bp, Arabidopsis thaliana
tattgataggttttttggttatgttggtttcttaatatctctcaggagatttgtgattgtgtttgatgaatgaagagagaaatgttatgtgtggtgttatatataggtttaagatgataggcataaaacaaaacaagaaaatttaaggaattgaattgaccaaagagagaattattgaccaaagaccaattaggctttgatagattctcctgtgacggtttttggtctaaccgtaaagctagcctcccaattttacccgccatcctcgtagaacgagtcttaattacatctaaaccggctcggtttatattggtttgattaaaccggttcggttttgttttgtaggtaggaatttggtcaaattgcttaagacacaaatgacaaaacactagagagagtatcgaagagaagaatccaaaaaa

SEQ ID NO: 3053 - DNA, 2000 bp, Arabidopsis thaliana
ttttcttgttaattaagaacttaacgatgtaagattattgtaatgtgactttgtaagttgacccttgaaaagaatgttatacatttgctatattagattgcgactagaatccaaaagtaacattagatagatcatcaatttgccttaaccagtctcgaggccaagataaacttcaagataaccaacagttacgatatttccactggtgtccaagttctgaagtttgatcttacggtacacattagcgtttgttttcatgggcaatgctgtatttgccctcccaatgaaaaatgcgtcagtgtcagctgaatttacactgaacaactccaaattgagaaaagatgaagccatgttttgaggaagatgcaaaacctcacggaactcaggatctgcgtttgttgtcacaatctttgtttggcgtggatcatcttcgttagtccaagctctcaacttgtagttgtatttttgttcaccaccgtcgccaattcctgatgctcctactaccattacgaataagtccattttttgttgttgtttctttgattttctctacacgtaagacatatataagggtgttagaatttatagtgggagagctaaaaaaagctaaattactttcataatagtattgaaaatataagctctacttagttttttttaaaacctccaattattgatgatgtgattagtttgctactgtattttgagtattacttaaccaaaacttatcataacatctatttataataagatttaacaatattttataatttgtgaaaataatttattgacaattatgattaatattaattattgttaattttcacacctgtatcaaaataaatgatggggaagtatgcacttaaatctttttaaaatggaaatatgtgtaagcacgctattagattaaaaactataaaatgccacacgcccaacctctatattaaagatacatctactcatattaatcgtgagattaaatttttcatgtacatttggtattatatccatcctgcactccaacttcattcaaatcattaacaatttatttacttctgaagttgtttattaacaattgatacctcaactgccaaagaaatgtttctctcttgttggattcttctgtccaaaagttagagatgggctttgggcctgtacaaagagctttaggcctaacctgaaaagtttaaaagaagctcaattaaagctagtaagcccatacgatggtgagagatagatagctttcgatccccaacagtcttactataaaatcaaagaagataattcgaagcaaatgaattgtaatttagttttacaaaacgagttatttaagaaaatgaggaaaatatttcagtcttaaaacatattttagtttgtctaacaatatgcataatgtagataaaactaaatcatgatttatctatgatactagtataaagcaaatatgtaaaccgagtcataccatattcagccaaacgtttaaaagttaaacaaaccacggaggcaaactaattatggaatgatatccatctttatatgctaagctgaatcaaataagaccgaacacgcagttcaagaaaaagagtcttatccagctaaaccaaactagtagtacatggaaggttaggcttccgtaatatcactcaattataagggcatatcagtcaattacatacctcctacactcctcattcctcaacgtcaacttgcgtgtctttctttcttcgaatgaacttctgaagcgaaaaaaagagagaattaaagtcattcattatttggggaatggagaagaagctcctttcctacagacgccatcattaacaacatcctcttaagcttctgcgattctctccgtttgtcggaagatttcacgacgattcttcaatccttatccgaaccggaggtaattctggatctcttcctccttggcattagaatcagcgattttcgatttctcttgtttttgctcataattttgttggtgttggaatatagaaatc

SEQ ID NO: 3054 - DNA, 663 bp, Arabidopsis thaliana
cgttggatcggattttgaatgaatcaaagttgctagggttttgaaaaaattaagttcgtggagaagagaagacaacactgggaagaagagaaggtcaattactcgggattttcgtgcttagctctatctctatcgaagagaggaggatctttttattagagtcgctaaataatttttacttgctcaagaattttaaaaacgtgaagaagaaattgaactttaatcacaacttaacaaaataattcaaattaattttatattcacttaacctttgttaatttataatgataacaactaaataatttcaccttaatctccatggtccaaaagaagcgaataaacattttcatttacctaattacattagtttttaatttataaaaactttttttctttctaatattagcctgtgcttttattaatcaaataagtttagaaaaaatctatagatacagttttagtgaggaactgaagttctgttctgtctttaaatattcgttgttaacttaaacgcaatcttttgctatttcatcagtaattttttgtatggataaactaaaagaaaaaaaaaatagagaaaaatcgaatgttaaaatcgtggtaaaccggctgatgtcgtatcatttattaaggtctcaaaccggaggtgtgtgttaattttca

SEQ ID NO: 3055 - DNA, 657 bp, Arabidopsis thaliana
ctttgaataattgatttggtgaatgtaatgtctctctcttaatggcagtaattatagatggtcagtttaatttaagggttattagttattacttattagtatagtaaaaattatttttgccgatggataaaaattggcttataggactaaagttacatgattttggcctttttcattgtttttcagcagggtttatgaattatgatttccctatgaagttggattgtactttatgacaattaataaagaaaggattttatataaggtttatttgtgagttaaagttgttaattcttatgattaaattgatagaaagacatttcaaatgtcacattagtatgattgacttatgaaaacgctttgtaaaagtgatgcaattattaggatgaacagattaaaaagtggaaaactcttccatctttcaaattttcaagcagtgtaaaaattaattccagtcaaaagaatataattttttcatttacaactttttgtctaagaaaagaacatatcgtcattatgggccatgagcccagataaaaactatcaagcccagcttcgagaagagactctgtcgatttcatcatcataagaatctttcagatagtcggagaagacgaaaacgaaagttccgaagaagaagaagaagaaggagaaaag

SEQ ID NO: 3056 - DNA, 1232 bp, Arabidopsis thaliana
tgatgatgattatacaaagaccttgaagaaacgagattgcgaggttaaattaatactatatgtaactcgaaaccaatgaagattccggtttagttgtgaaataaccgggttttaaaccgggagattgatttttcccgaaaaaaccctaattacttagactgacgaaaactacgtcgtgttatgaacagagatatttttagcattttaagagaggagtgaaaaacaaaacaaatatccgtaaaaccccagaatcagagaaagaagggaagatgataaaaaacccaaaaccctactactctcttctctttctaaaatcttactcttattcttcttcttctacctcctcctttcttccatttctctgcacttgattctctctctgtaagtttccatgtgcttttcattttctgggattttttctgtgtgtgtagtgactgttcttaagttcagttatcatcatcatcatcttcatttcgttgtgtttttttccatcaatttcgctgaaactgagattcgggtatcttcaattctaatggtttttgtgaattgactttgctctttgcttttaattgtacttctactgttgtgtatcgcttcattttagtgtgtctaagccactatggaaatctaagtttctgggtaattcttttttgatttcgtgtgttcatcatttgatgcgattattgggttgaattcatttgttttgaattcatttccggtaattttggatttgttgtattgaagcgtagcgatttaagtgatcagtggtgatcgcttcttcctcttgtggtctgatagctttatgatttttgatcagtttttatgggataatgatgatgaagataattgattgcttgatgttgcagaaatgttggagacggctttaactattatgcgcctggttttgataccttaagagagagtaagagattttctgaagtttatttaagtggaaatgaagaggaaatcgccactacaagttcaagctcttgagggtttttatttgggtgcgattttttcttttttctatttgtagtaacatacataagatgatatgttagtttgtgttgatcatctttgtaagaatatctctagaattggcctcctgtggtagctttttggatatggtttacttttggttatatttctcttttggtttttcgtttcttttgctgtcactgatagctatcgtatttgtgaaagcagagcaaatgtatccgactcctaaggaa

SEQ ID NO: 3057 - DNA, 2000 bp, Arabidopsis thaliana
tggattctgaaaacgaaccatactttctaacattgcacattactactcatcatgagttgttagcatgtaatatctatctatataaacatgtgttatgtttttaacccaaaaccagtttcgctaatataatcataattcggtacgaggttttataagctgaaatttggactccctttgaagtttataacactagtcactagtgcataattaagctcactggacattgttcgtttacttcgatcgattagccaatgtaaactgtttggaaaatgcttagttcagacttcatactaataataaagtaatttatttgatcagttgttgtctaggaaaaaggtaacacacatatgtgtatgtatatgtttgctttttgaatttaacctcgacttttgcattgcagcaaacaaacatactttttttaatattccatttactcagaaatctctttctttcatcgagagtgtgtgtggcgttaccttttgtacacaagaactgcaattgatgtgagataacatatcaaaactctgtttgtatctctgatccataaaagtctttttccattgatgcgtgtcttgctctctttttcaggtagattcccgaatattattctgtgggtttttgtttgtttgttgtgttaagtcagattctgctcaacttcaccttttcttttgaaccatcgtgttggtttgtctatttcgagtaggatttattctttaatttcagttttttttcattcttttcttgatttcatattgaacagtgtgttagcttgtaataaagtcataaaagcttgttttttttggacaattgtggaattaaaaaacattccacatgtttcagcttttcatgttgataatctgtcttcatgcctttggaattgttagagtggcttgaaggattaaatccaaatccttgtattattattatttatcggtcaatcttagacactagcttatactctctgtttgtgtcgagtagatcaattggtctctcttaatgcacttgatgtatctttacgtaatcttaaatggttcactgatcgattgaagttatatacactctaaagtatggtaaaccatgtaactgattcaccattacaagttacatgtcatttcactaaaatcgatttttatcatcctatgtcatttcataacttagaactatgttgatgcaataaaaaatattgtttaacatgttattttttttctttctaaaatttaatgtaatttgttaattagcattcttacttttttcatgttgctacctaagatttcttattatagtagtaattaattttgcaggttaatgttcaaaatacaataaactaatcatgacttagttaaaaacttacctaaatgttgttcaactctcatctgcagtttcctagctccctaataccaattttcataagctattttaacctgtttaatttcatgttttgttgttacatcaaaatataagataaaaatgtgtttgatcgattcatcaaattgaaagaaagagacacaactttgactttgtggttttgatgtttttctaaatcatttaattttttctgtaaccagaagaaacccagctgattgatctagaagctcgctgatatttgtgaatcatatgaactatcctcacgtgtagtccaccgtacgccaccgtttttaaatgaacagaagtttctcacacgtgtagatccatcacaattacaaaaccacccctacattcgagcgtgtgcaaaagtcaaaagaaagggtactttagtcagaaggaaagttctgtgcggagacgaggagtttccgttatccccttattttatctctctctctctcgttttctctcacagacacaacaaacaaagcaaaaaaaaataaaaaatcgcacgtttcttcttcttcttctctctcgcaacaaatctgtattagggtttttgagaaatcttcatttcgtgattttgaaatttatttgtatttgattttgttgttgctttggaatcatctgcaaccacc

SEQ ID NO: 3058 - DNA, 862 bp, Arabidopsis thaliana
tgattcattgtgtgatttataaattttctctgcaaatttttgtttacaagcaagtaacataatcggataatatcttaccaggagtatggccgaaacgtttctgctttggggctgaaaccggcggatattccggagtactgttccttctggcaatgcgttgcacctgcggataggcaaaactcaattagtgtttgaggacgctcgcttccatacatacatcattgtggtatcatatatctgataataagaaatcgctgcttcttcttttctatagcttgtgtttgtttgctttaacagtgaagataagaggaagagagttttgttgaagagagagtgtttttttttttccgccgaagttgcattatgtgaggtctgagtttagtgccagctttggccatttaatcttttatgtaggactatttcatcttcagtatataacacgcaccaaagggaatgaaacttttaactcttaatttcttttgttttctcgtatataactgaaccaaagaaactatcaattgtctaaacataccaaaccgacatttaaccggtttcgaattctaaatcattggggaattgagagagatatacattgtttaacggtgtataatctgtcgaaatctgctcttagtttgttgggtttaaatatggaaacgtttttcatatttgaagaaagaaaaatcaatgagaaataacaaaaaaacgatatcgccgtcgtaatagagaaaaaaaaaaaagagtgtcgaaaccctagaggacgtggacactgttggcattcttaaaagagccacaaaccccattgtcgaacgaacacaaaaccaaaccgcagacaaagaaacaaattcgcagacaatagtcgaaa

SEQ ID NO: 3059 - DNA, 2000 bp, Arabidopsis thaliana
cttgagagtagttccaaatatttttcatttgacaaaagttttaaaaaaaaatgaataattgctaagaatgatctttcaatacgggaaaaatgtcaaaacaaatcacgaactttcaaatttgggacgatttaattttgaatttcaaaaaaaacaaataaatcgtaattttcttgttgactttcgaaataaataacaaagtttttgttgacttgtcatttgagtcatgtcgttaagtaggttaacaaaaaaaatttacggcgttaatgtctcctttatctcctctgttagaacaaaaaaacgttgtttattgcagttcgttttgtctgttgacacaaatttaaaccctaaatccccaaatcgattttattatctgcgattttgaagtcaatgtgggtctgtgattttgagataataaaatcgatttggagatttagggtttatatttgtttcaagagacaaaacaacgttgttttgtctcttcaataaacgacgttgttttgttctaacagatcaaataaacattaacaccgtaaaaaaattctcttaacctatttaacgatatgactcaaatggcaagtcaacaaaaactttgtcatttatttcgaaagttaacaaaaacttcacaatttatttgtcgaagtttaagattaaatcgtcccaaatttgaaagttcgtaattttttgacatttttctcttttcaatactatctttttcaattatgttattttctctttctcatttttatttaccctctcttttattttttaatgaccatttacccatattttgaaaatattttaggttaacaaaataaaatattgatttgtcccgtctaaaatatttccgtcaaaaatttccaacaaaatttatttttgagaaaaaatactctcgatatatttttttagcgggaactagatttacaaagatttttgaatgatttacaagagttttaaaaccctattaaaactcttgtaaattttgtcataaccttttgtaaatattcacaagagtttttcaatggttcaaaaagagttacaaatgtattcaaatttttacaaatttttttaagagtaaaaaaatggtttaaagattttataagagttttaaaaagatttacaaaagttcctaaaatccttgtaaatcctttaaaaactcttgtaaatattttaaaattattgtaaaagattttaatatgatttacaattaaagagattttaaaatatttacatatgtatttaaagattttataaaaatttaaaaaaaaattaaaataatttataaagattttaagaagttttaaaatgatttataaagccttttaaacactttacaaagcttttaaaaaattttataaggttttttaagagtttttaaaaatttctttacaattttacaaagatttttaaatatattttttttgctggaaaatattttattacgggaaaaaggttttggtgggaaaaacttttttgaccgggaaaaaaataattttgttgtctgtcattttaaggaaggatactgttctctgtcttttactttggggttcaacttaaaaaactatttttcattcgtctgatgcaagcccatatcgagattgtttcaaaacatagagattcttttttgggccatacttctttaggttcagccgttttcagggtaacaacttctgatgaaactgaaaccaagtaaattacccattcttcattttgtgggcttaatagacatatatttgtaaagtgaggatccaatttcgaaaattttaggtatcctattttccacagcgtgatagcgacaatgctaggccacatgtcattatttccttggtccatcttctgaccattaatacaaattaacaaaattacaaaacattaaattcaaaaatctcagcaaatatagaggatttacgttttagtgtatccgattatggttcgacagagagcatagaaacaaaagtttcctccacttgttgtttcaacaaaacaaaatcctcccctttcat

SEQ ID NO: 3060 - DNA, 2000 bp, Arabidopsis thaliana
ttttaaaaactttaatgaaatccaatgttattaaactaataatttaaaaattaactttaaaatcaattgttattgaaaacagtttgtggagttgattcttattcatcttgaaagatttgagaaaacttctttagttacaaatacacaaattcaaatctcatggttttagatagaatttgaaaagatttctataattttaagaaagttgatgtgattaattgtacaatcttttcaaattccatctacaatcatgagatttgttttcaataacagttgatttaaaagtaaattttaaaatcgttagttcaataacacttgattttaatagagtttttaaaatccatgattgataaattttacacaaatcacttaaaatactagattgaatacacttctacaaaatcatcaaaatcatataactacttaccctccccctcccacccccctctaaattaaccgtcattttaacaaaaactgcatgtaacaaaactttcaaattttaccgaatgtgacaaaactttcaaaactgcatgtaacaaaactttcaaattttaccgaatgtgacaaaactttcaaatgggacaacactttcaaaaacagcaacatttaccacatgtcacaaaactttcaaattttacttttatactttcacgtaatctaattctattaccactttgttagcaaccactccttccccatgatctcaaaatgtatcctctcctctaaactttcttccacttttttttttataagtaattgtaacagtcaaacagatgcattaacttcttctttattgctcttctttctcacaaactcagaagatcttccattttttttttcaaaatccaactaaaggcaattatgttttattttgccaaaatattttgatatatgatgtaatttggcatttattttgtatcagcatagcaggggcggccataatcttagtatatgcatataattgaggctgctcttaaattttagcgtatttatattgtagtgaattctttgtcttgtataatattttggatgtaggacctgaatgttggtacatgaagacaatctaatatttttaaagcagttatcattaagcatttaagcaagtaatgaaacacaacaacacggtagaaatttaagcaagcactttgatgatctctctccttaactcaaaacatctttatagtattgttgtgtttcattatttgttctatgttaattgctttacaaatattacactgtgtccttgtacaaatatttaggtctaatgctaaaactaatttttcttttgattcgcaacactcaaaataaaaaactgatcgaaagctaaccttatgttatactctctgagttctgacacaaacaagagaagaaaagagaggaaagtgatttagatgctttgatcgatgatagaatgagaagacaaaagcttgactttatagctaaagatcaacgtctatgccataaagtcaagcataattcacacaatatataagttgaacatgctatcaaaataagcttactacattggtgaaattatgcatgtgtggatatctcaagaaatatgcatgagatgcattactcttcttttacgctttgtgatttaagatattgtatgccaaatctatgtgttgccaacattgatttctataccaattggttgatacaatgactggaatttatcctttgatttgccaacattgatttctataaaagttaaacaaactaaaaataaaaagggaaaaatatttaataaaaaatgtacaatattaaatttccataaaaattttatatggttaatgttttggattagcattagtccccaaatcccatattaagtaaatccattttgagttttgttctcgcaaaccggtttaacccaagaacccaaagatctctctctatttgtttgccttcttctttctttctgactcaaaccctcaaatcaattctcgcgattaagcaaaaccctagatttattctactcttcgaagtcgatttca

SEQ ID NO: 3061 - DNA, 406 bp, Arabidopsis thaliana
gtatggtggaaattgaaaaagttcaaaactctctattgatttttgtttgtgattttaacactttgtacaaagattgggtgagtatttgtcatttgagaagcggaagcttcattgtgataataaagacaagatgaaattagatgatgcaatgtgactgaaaccataaaggtcacgtgcgtttatttgctttaggcttctcgtaatgaaagtgataatacatgggctaaggcccattaagtatttctcttaagttaagctattgggtatgaataatgagctttataccacccaataaggagactcgtcatatataaatgaccactcctccgttattagggtttctgattctcggagctaaaagaagagcaagcagcggcgcagaagttgaacacaagtgaagctcaca

SEQ ID NO: 3062 - DNA, 1165 bp, Arabidopsis thaliana
gttagttaatgaaaaacagaacggggtaaattttaaatttatggatttggcacaaattagctttatccttaatcaagtgtgtaatttgggtaaagatcggaattcgtgatggtctttgaagtaattgtatagtaataagtgtgcatgatacaacaattacaagaacaaactgtttattgtaaaattttattccaatacaactatacaagatgaaaaaaatacagagtgtgttggtaaaaagccccataagagcccacgcaaagactagctggtttcaatcccctattaattacaatccccttaagcatgcaaaaaatttatataatttttgcttttgtgttagcaatcgaagtgcgtcgacttatatataccatgcatactttgcaacagactagttcaccaactcaagacaaactgcttttccaaacttcagaaccatcgatgctactataaggaacaaagcctcagattacaggcacaacaggccagatttagcttcgaacctgcggcaaaactagttccgtggcacttaaaaatggagttactttcctctactattcaatcaaacttcttcgtttgatgcactaatcgttaagcgagttcacaaatccgcttctaccttttttttttttttgatctctttttgtaaagcctaaatcaggaacaatgtatatccatttaatctctaatgaaatgacgctacaaaaaaaaaaaaaattagttcactgctcaatcaatcgcgcttagactttagtggaatattacaacccattgagtacgctagacttggagactggagactggagtgaagacaaaaagaacagaatgacatcaacatctagctgacgattaaacgccaaatttggagcctagaggaccaaattacacgttaacaataatatctagaggaaaatgttacaacccctttagtacgcgggacatggagacttgagacttggagtcagtcgtctcgagagacagaaatatcaaacacaaacaggttggagtccctacttaataatgtgaatgtatgtatgatatcttagactttaacaacagccactagacacttatctacagcaaagagaatggttataaaaggaccaaccaaattcatgtaattgagtaacacttttcttgttgtgagagtaagagggaggttaaa

SEQ ID NO: 3063 - DNA, 2000 bp, Arabidopsis thaliana
aagagaaaatatatgggggataagatttgttttggtaatactctgaaaaaataattattcgacaaagagacaaaagtgaaaattgatgaattggtcaggagaagtggaaagagcgagggtctacgtctacgtatacacgtgacttgacttttgaagatcttcttcgatcaaaagatgcttttaatcgttgattatcatatcttcttgtaagccgactaattagctttttgataacactttttttctcatgtcgtaaaaataaaattggtattttgactttttaaaacattaaatcatatgatcaacgctttgttttctcttatcatttataaatccgccgtaaatcagacgttaattaagcattaatcactaatatttggagatcaaagaccctacattttaatgaagacttgttttttgcattttttttttattaggagagtgatagtgagaccacactgctgctttcttcccacttgcacacgtggacccctcacctcccattcgtttcttaatccttaccataattaatattcgctttattttatttttaattattgtactcgacactaatgtatgttgataaatatatttatgggttctactgtgtttttttgccatagttaaacgtcaaaaagtttaaaacgtctaataataataataatcaatacctcttattagtgttgtatagcattattatcagtaaatagaaaaaaaacatagacattttttttgtgtcttttagaaaacatagacatgaattccatttcagttagtaattttcaagtaatagttttactttggtcacgtgaaagtgaaatcaattcataaacacaagttacacaacctttttttttttcatctaacatcaattatattagttatcggaaagacactctccgctagagagagccattcaagaaccgatgtgtttgcatgggagaaaaagctattacgagtccgaactttcttagctaaacaatctgctcgagtattagaactacgaagaagaaatctaatacgaaaagaaggaaaaaacaaactaaggagcgataggatgccaattccgctgcgaatgtcggccaatcttcttgattgtcaatgataaaaatcagatctgaacagtcggaagcaaaagcgccagaagtatcgtcaatatagatcatgtattccattgtctatagcaaggaatcaaattccgcatgaaacaataataaacttcgtcgagtactcttgagggaacaaggacctaaccatgtcctataaacacataaaaatatcgtactacataacttgtatctgtaaaactaatgtaaggaaaatgtcttttatgtcacctattctctaatgtaaggaaaatgtcttttatgtcacctattctcgaatctgtttgaatagtaaagaccaaactaactaacatgcaggaaatagaaacacaacgtcggtaactttacaatttgaagtgaatgtatcttaaaatcacttaccagttcaaattttgatgttaaaaaaaaaaacgaattgacatgttatacttcagtgaccggttgagtgacgtcacctcgtaagggttatggtgatgtcatgtaagacgtcgtaatttggatgagagttgcattcacgtggaggagcttcaacgatagctccatgagatgagagagcagccgccggctcgccttgatcaccacttaacctatctctattcttccctttccccaccacgcgactgttcccgcgagtgagatttacgctctaatcttcaaaagttagatatttcgaatcatcccacctatcggaagacatgtgagctacacgcgccgtcattcaatacgtttgttcccttttatccgcaacctctccttcccattaatttcctctcaccttccaaacatatgaaaaagtaaaacattatatatataatcgtcgaagctagagatttggttaagaaaataaatcaaaacacacatataaacatctgaattctcttacaggaaccgaac

SEQ ID NO: 3064 - DNA, 778 bp, Arabidopsis thaliana
ttctttgtattataatttcttttaaaagtcttggaaaacaacatgaaacaaagcacttatgttgtttgtatgcctatatatggttgcatgttataataacggaaacgcgtgtaagtaatgttatttataaacattttcacaactagcaccacaattagtccattttcttatcaaatcttgcaaatctttgtacttgatgatagaaatggctttgtctctaaatttttacaattgaagttctttcgttatgtaatatgatcaatattgtcccttgtgatttataatatgctataaaaagtttatttttctacaggtcaaagaaaggatcttggtagttttatttttgttttgtttcctaatgctatatctaatctaagaacatgcaattttactgtatcaaaatgttagtgtcaatccaaatgattaacttaattccgattctacttttgtagatagaatctataaatagactaatggacatgaaactgacaaactttcagatgaaatttgtgtactaaaccaaattaaaaagttagcccaataatactattcggcccaagaaagaagcccaatgaaaaactctcagcgtcttcttccccgtcgtggccgtcatttgaaagggttgtggcacctacgcagcctcacaaaaacctcacctttccaccataacattgtttctgttctacttcacagaagaacagagacaaaagaaagaacgggtctttggtcggaaagttcgactcttttagcatcttcagatgttctaatctcgaaaaaa

SEQ ID NO: 3065 - DNA, 1415 bp, Arabidopsis thaliana
ggttttagatcgtgttagatatatcagtatcctttcgtgtggattctgaatcatcttgtgtcatatgtacaaaaattgagatgccaattaatcgtgtgttagctaggaactgagggttacttatgtgccacgacaatgtcatagaagctaggaagtgaacaatgtagagcttacatgacggggacagattccggtttagcctcggttttgattgtagtgattcggtttacggttcagtagttttattttgtgtgttaattttgagtagctttgtatattagtaagcggtttttgtgtttgttctcgttttaactttacaaaaagagaaagagtaaatgtcatatttaaatagaaaaatgcaaccacaaatgcaaagaaattcgagtaaaaccaaataatgccataaggatatttacctaagaatcaaaatatgaaacatattaaatgtacacaagaaaaaaatcaaatcactaaaaattcactaaatttattaccgcaaagtttggatcatgatctcctaatttttgcacaagtggattcgaatcaaggactttttatcagtgtttttgttttctttcaaggaagccataggagactactagatagaaacacatatactacatatgtctttattatagccaactagatttaacatttttagaattgaatgtccaactacttctcatttttctttgcaattgatcttgaataaaactttgaccatggcaacatgtaaatggtattttgttatatatatttttattatttgtacaacttttattgtactataccaactaggcctactaaatcaacccaacaaattgacaaaaaaaaaatcaacccaacaaacctatttctttatttaaagtagtctaacgtcactttatccattttcttgaatgtcatcttactaaacactacgcatatgtgacgttttcttttttctttaactaatcagaaaattgaatttttcatgataccggtaaagagatttatccaattaaaccgaaccggctccacataagataagctctattaattattagtccactggtttttaggtttatgaaaacgacaaatatttgaatgaagacaacgacttcaacaacatgatcgagctggtttggtttccaagtgtgaattcaagactaagaagaaatccaacaatctccattatcaattttttttattaactttttgactaaaccagtagagagagagagagaaagacagcaaatttggttgactctaacaaaccaatatcatcaaagtcaagcagttgaaaattcttcaatttcatcatctccaattcttaatctctctgcttcttctttcttcacaacttgaaacagaacacaaaacccttgatgagggaataaaaaaaggagatctctttctcaatcaaacaaaacaaa

SEQ ID NO: 3066 - DNA, 2000 bp, Arabidopsis thaliana
aaagaagtcatattttagctgtgaaattacaaatatatttttgtgataacattataaatatatattaacatgtggaaccctaattctcattaaactgctcacgttaaagcacatgcagtacaccaaccatttaaattgttttgcttagcacgattttgtttcattcatgattcaaaacttcaatttttcttcgtctgtttttatataaatattcgaaacatttatagaatttttttgtttttaatttgtaatttggatgtggtcaaaaatcatacttggatctatattgatgttatacatttcacgacttcaaaagaaactattgctcgctctatttctgtcattaattaactcataacttaacttacacaaaaattgagatgatgacaatcatgaaactatttaaaaagaaaaagaccagaccggccaatgttagactaggattagtggctattattctagtgacaggggtgcgatgagtaccattgtttttgaacatgtctctttgtcttcgcgatgaaccaagcggtcccaaaagtattggcaatagatagagcctcaatacctttaattaattataaatttccctgaatttatattctccaaaaatgaatgttatttttttcatcaatcaaaaaaagttgttgggttttagtccaccaaaaagatgtttgagtttcgattgtttgtgttcaaaaaatcaaattacataacaaaagccagaacttttttttatatcaaaaagtaaagaaaaaataagaaaaacaaaaaatcataactttttttattgaggtgataaggaatgtaatttattgacgtcttgtgaacccgatataaatctaaaacttgaagtagctaatgaaacataacaggaaatgttggagtggtatagaaattacctttaatttacctttaattgtatagaaattaaagataaaataaaaagataaatctatgaaacaattattttgtctatataccaaaagggttagttttcttgtgtttagttttttggaatggaaatatattatttaaattggaatatttttttggttgaacacaattggaatatgtaaaggttgatttcatgtacttgaaagattatggtcagaagccttctcacacggttaagaaaaataaaaaaaatatgttgtctatttatttggttcaaattaagtttttgtgtgggctttgtgggctagctatttagtatgggcctagatctggacttctgtaaatcttaggactacacttaactctattactctcatagtatgccactatgtggggtctatggccactattgctatcaattattacatatttacattacttacgtacattttcgtatttctaatgtaatttttttgtttagaaacttatataagtgggaagttttagagctaaatctgaattttctcaactggggagaaaaactcccttgtctcatcatcccattccactcaccacgaaaactcaatttgttacattaacattatgtgtaaccttttcgagaatcgcgtttcacaaaaatatctattatttgaccagagtcaacggttacgtgaatctgattccaattgcgttccaacttccaagttccaacacttcacaaacaaaaacaaatatcttccctcaaatctcaatcttcaaaaaaaaaacaaatatctttcacaaaatatgatgacgtggaagaagcgagtggttgagtaggctagatattttctcggaatatcccctggtgacgtgttacaatcgaacaagagtagacttactttttttaaacatacccctgatatatccttttaattacgaaaattgccaccaactcctggcgcgaagacttcttgcctcgtcttaaatataaagggtatattcgtcaataagtcaccaactaagccaagatattttaaaagtttaaacagacacaaaaagaaataaaatatcataaggctgagagcttatcagagaagaagaagatatttctgtaagcgagaaaa

SEQ ID NO: 3067 - DNA, 2000 bp, Arabidopsis thaliana
agtttatgtaagaaatttgtaaatttgaatgggttaaaacttctgatctaaataacgaattggtaggaaacttttttttgtcttgttaatatttgatggttttagccaaagtaatacataaaataattatttagtgaccaaaacttatcgcatatttgatgatttaagccatagtaatatgatttgtattagtgacgttgatggtttaatatatgatttagtgatacttagtgaacgaaagatacaaattaacatatggtttaccaaagtaacgcagcgtcactagtgaccaaaacttagcgtatatttgatagtttaagtcaaagtaatatactaatatgatttgtattagtgacgttgcattgtcactatccaagtttacacttatatgttattttttgttaaaaatatatatttatagttagaattctatattcgatagcattaccgaaagtcgaaaatttaatcataggaatcattgccaatcgaaataatgctaattaaattttatttcatataaaaatttgatgaataaactattcaacgactatccttaaagagtttttttttttttaatagtcagctaacgcatttcaccgattgtatttgtagccttgtaggtagagtcgaatttccgacgcgactagaatgctagcataagagacttcaccactttgttacgaagccaagaatcttcttgttttaaaaaaaaaaatcaagacaaaattgtcgtccctcatatctatattcaattcatttcaaaacgttatttatgtcttaaaatttggaactaggccacaaagaatgactttggtcatcacaaaattataaatttaataaaaatttggaccactataggcatagctattgcctattataatctctactattactttatgatttatctactattccgaaagtgtaattgtttaatacgtcatcacattgcagcaatccacacacaagccacgtcattcatatgccgttcgtatttgctttcgtcacttccttccgtcatcaatagtgacggctatttcttaatattaatcttcttgacttaatgctatttcgtgacggcattaattggcatatcattacaagttatttacacctaagaaacaaattaaaactattgaataatatgatgtaaataaaaatatattaatgatgtgatatatcgcagtcaaataaaaatagtgattttgatgagaaaaaaaatatgtgtttatccatagatttgttaaattagagaaagatgtggaaaatgttagtgagtggcgtcatacacggagaacctttggcatcatacacggatttttctagtctttgttttctatttgtcaactttcatttgagtctttctttatacactttattagaccatgtttttaattctaatgcttattaattcatattattaaatttacaaaaaaaactattatattaactctcttgtttcctctgtatcttccttcacattgaagctgtctctttctttcaccatcacttgcacctgttgtgtcctgtttgttctcaatttcatcatcatttatcctttatatacctctctttctttcttgacttttcctctaaattctcttcctttttatctctttgatacatctcaatttggttcttttgccttctctttgatcttatctcttacgattgtgcagatctcaatctctatatccttggttgtgtcagattctcttagggtttattttctctcccaattttgtttgattccttgtccaaagtttcttcctttccttttgacttttttttgtggtacattgaatcagaggtgtaagagtaatagtttcataactcaaatccccaagtgtacaaattttcctcttttggttctgggtttggttgattccttgttagaaatgtaaatttagggcttttgtatctgaaaccgatcttcagacttgtgtaatcttcttgatcttcatgcaagattgataattctacaagaagaagaagaagagaaa

SEQ ID NO: 3068 - DNA, 1843 bp, Arabidopsis thaliana
aacgttttacaaacgcatacacgtgacgtgtcacgtgataatgcggaataagaagttacatttcaaacagggcaaggattcagaatcgcaagtacatgaattaacattctgtaactgttaattgtatcaagttgtgttaatatataagagctaggagaattggtctttcttatgtctagctagtaaccatctatgtttgtagctaggagctacttgttgtttctagttgtttgtctatctaagccaatcatacaaaatctatgcttattcacaaacatggagatcgatgttgcaaaattcatcatttcgattttcacaaacaattaaaatcacgctaccatggctcgcatgcactccatccgccgttggcatctccctccgagcagatcttgttgtcgttctcgtttcccttcaatagaggacttgattcctcatggtcttcgcggctatcttctcccgctatagattaaatacattctcatggtaggctaatgtatttgattgttggtcttccttatgtttattagtaacgttttgacgcctcctctaatcgtcttctcgggcatggggatgaccctttttggccaaatctagtagcactcgtctcaataaaaaaattgcacaaacaatcaaatacattagcctacccgagattctttcagatgcttagaaaccgatttgaatagtcatgttctaaccaaaacaaaaacatattatctttgacaaatcctaaaagtataaatggttcattcccacggtatttcaactcctctaaaccagtattagaaccatatgaatcaaatcgtataatcaagtatccacgaaacatcataatactaagctacatatataccttgatttatcagagttactattgtcattttgcaagtttcagatttgtctttgagaaaattgtcttactttgttgatattgagattatataaaccggataagcgaccttgattttacatgattttgctgttttaaaaaaaaacctaaccggtttcatttaattccgcatgttattaaaaaagagggaaaagtcaaagagtcaaacttattaggaacgtctagaattttccaacttggtccattttgcctactctattggaaaaaggaaacaaatatgtatattattatatgtcacataaattcttttccaacgaaacttcaataatttaccatatggaccaattttaattaattcctgtatcagatttaggtgaaacaatcttaataaacatttaaactcaaaaccaaaaaactgtaacacatttttccgtcaaaattgacgagaagaacaagcggctttctctactagccgttaaacagacgttatcttaccaaactccaaagctctggttcgtacaaacccgaacctcatccaatgcttatacacgtatgtatgtatacatttcttttagatattttataaaaacacgctcccaaaaatatttaatagagttgaattatgtttatctgattattattcagaccgaacacgaagaaacaaaaattcaacaaaaacaaagacaaagtttcgttttagcttaaaggttccagatttcgaaaaagctctctttttttttctccttcgtgttacacaaccatttctaggtaatgttttgatttcgaaagagctctctttataatgattttcatttgtgattctggaaatcaaatcgttctattgaaattggggattttttttcgattagggtttgtttggttcctgttaaattatcaaacgttcctgcatttaattgatttttggtcttctaatattttggagcttcttcttgttgttacagatatcattttggtgattaagttatttaagaa

SEQ ID NO: 3069 - DNA, 301 bp, Arabidopsis thaliana
ctcttccggcgagttttggtaacggtggttccttcgtcttaacccgtgaaatcagccgtcgtctgtacaaaaataaggattaaaataatgtcaaatatagggactaaaaagcaagtttctcaaattgggcctaatataaatatgggcctatataaagcccaaaaataaatcaggaaagctttaaaagaggtaaactcgtcaatcgcatctgagtcgctcttctttccttccgccatttttttctttctaggttgcagagttaaaggagaaggttttcaattagggttttgtagagagaaag

SEQ ID NO: 3070 - DNA, 1215 bp, Arabidopsis thaliana
cgtgaattttctttctgattttctcgggaaaaggaagttgattgaagtagtttagtggtgaatggtgataatagtttagattttatagagaaggaacaaacgtattctattggatagaaatcttcacgaggatcattgacgtgtatatttctcattcgttaaatttatcaatgctcaaattagatctgacggctgagagaaacatcattcatttttacaggttcaagttatagctttgataggcttcaatggtcgtgacaaagaagcccattgggcctgaaatgaagcttgagacgcagcgcataacacatgtcaattggtttctttgattttccctagtataaaaagcgataagaaaactctagctcaccttctcttcttcctctaattgcttttctccgtcactgagtaccttgcctctcgagctcccaatcttaaggtacaattgatcttcactatagtcgttcagaatctgatctgcttatagaaatattcagaagtgtgagatagctgctaattggtctttactttgtttttttctcttgcttcacatcagaaaatttaggatcttagagcttttcatagtgaacttaagaacgcttttcgaattagtcagtcttagctctattttgtctgtgtgtgtattttctggacacgagacctttgtttcaatttctataagtgatttcggtttacattttaaaagcttgatttattcccattgaaataaatattcatgatgagtaaatctgtgcatttgtatcaaatttttagtgctttgcagattttattttaacgcaagctcttgtttgttgtttgacttgtttagtagaggattgagcttaaggcaagatggtaagaaacttaaatatttattttgaatatttgatcaattatctatctttatgaattattgatcaagaaacaaaatttaaagaacatccgggacttgaaaaagtagtggaaatttcacaaaaccgaaaagcaaacggttaattcggttttacaaagaccaaacagaaaattcaataattcggtttggttcggtttaattacaccgaacaaaaaagttggtacattcgtttttatttttccgccattcttgtcgatcttcttcagtcgtaaaaccgccgcgtctctgctgaccctcctcttctcatttcatcgacgggagaaaatcccataccatctgagatttccaacagtgaaattaag

SEQ ID NO: 3071 - DNA, 2000 bp, Arabidopsis thaliana
tgataacattaggagtacgaaattaaatctttttacatttatgtaatccgtacattttgccacatatatgtcacatcgaacaagtttttcaatacattagatcattctctagaaataatgttaattctctcattccaaatcccaataaagataattaaaaagaaaatcaattctgcataatctatatatagtgtgtttttttttctgttgaagataatctgtctatatatagttaaatgttgattgattaccatacatcatagtgttatccaatcataaataaggacgaaacaggccgtataagtataaactatggagcattggtttataaataatggacgaaggagaagggacataaagatgaataatcgcgtaaagagaagaagagtttgattgagtctgaaaggatagttagagagattagtttgcgcctaacaaggacgaaacgaatgaaaattacgtatgcttattgaaaatagttctgttttttagctgttcgaataagtacgctaaattaaattgcatagaaaaagtttttaaagaaaaaaaccaaaatgaatagtttggtaagttatagataaaatcacatttagcacgtgttataaatagagggagacaattatgtaaggttgggggctcactttgatggatgaaccgccgtgttactagagatgtcggcaaatgttgtcttcgcatgtctcatcatgtgccttgtattcgaataacgttgcgttcacactttgatatttcttttacaatatatacttcttatatctttatattttcaacttgcaattcgttagttaaataaaacagaagctagtagtctactactaccaccagtagagcgacaatctttgatcacataacttaatcccatatttatatcctccagaaatctattattatctgatcatttcttcgcattcattgaatcttattcaagtagatattgacaaatgacatgttgttgttgttgttgttgttgttgtagacatgacattccttaccgacaactgatgagtgatgagatatcatttttagagtttatcaattgtagcttcaacatgagaaatttacaaattattattattattattattatttattttttgttgaattatgagactggaatttaataagatcaaacaccaaaatacaggctctttctaaacaagtcaattaatatttacgtagaagactattgatttcggatatgaataaaccaaacatcatttttttctttcttttctaaccaacatgtcaattaatgtttcgaagatgataagaacatatatagtatacatcatgaattttcaacgtttacattacttttattttatgattgaaaaaaaaactttgaaaatgaaaattattggaacaaacttaaatatttattttgaatatttgatcaattatctatctttatgaattattgatcaagaaacaaaatttaaagaacatcggggacttgaaaaagtaatggaaatttcacaaaaccgaaaagcaaacggttaattcggttttacaaagaccaaacagaaaattcaataattcggtttggttcggtttaattacacctaacaaaaaagttggtacattcgtttttatttttccgccattcttgtcgatcttcttcagtcgtaaaaccgccgcgtctctgctgacccttctcttctcatttcatcgacgggagaaaatccgataccatctgagatttccaacagtgaaattaagatgtcaacaggtattgttcttgtggtttagctcattgggagaaatgcagataacttcttcgatgtatttactcaatgagtttgattttgttttctagtagtgattttgctgctatcaatctgctttagtgatgatccattttcatattatattgtttgcttgacatgttcatgcactaataggaatctcgattgtataattgtcttgtaaattcagagtttgtgttgttttgttaatagtgagctttattgtaagatcagtta

SEQ ID NO: 3072 - DNA, 2000 bp, Arabidopsis thaliana
gcaatgaaatcgtatttatatttttttggcgactctaggaaccattcgccgtgggtccaacccgctacgtaaggataccccgtctaggtttgcgaggcttgatacatgaattttttttgaaaacaacgtccaaacaaataattttggtcccgtaatgtagcacagatcccgaaaatgcccgaaaatgtacagaaaggtcaaaatctggagtaaaaaaaaataatagtacatatcattgtcttgcttctgtcgtcggagggctctcattgggattttcgaaaagctatcacatggcaagtttggcctcatgattttatagttatagagttaaaatgttttaaccaaaacaaaaatgagggatgcaacacgaggacttctcgggaggtcacctatcctagtactactctcgcccaagcacacttaactgcgaagttctgattggatctgatgtattagtactgatatgatcgcatctgtttgtacatgcaatgcaatcgtatttctacttttttagcgtctctagaaaccatgtgccgtggatcccaccctaatgtttggtcatttgatgtcttacaagccaaatgaagttatgaagtatcggctattgctttgggtttttgatgtttggaattgtcacatgtagaaattattaggctcattagtttttgaactctttaatgtttggttatttggtgttttgttggatacagaatttggttctgtcttaaacttctactttctcgtttagactagttcaaagacttttagatgttttttgctttgtccttaattcatttcattggttatacaacttctacttctttatatgagttcgggttttctatagtttcatattgattttgggtaattactttatgttttgggtacatatgagcaaaactgaacccaaactcgaaacatattttggaattcggataacacccatgcccgatctgaacccgatgataatttattcgaatccgatccgatgtctataaatatctgaacgatcctatacatgtacgccagaatacccgaaacaccttaaccgaatccgaatgagtacctgaatgcccatgactacctagaactatacaaaatcatcttgttgatcccaaaaatctgtttagaataacaacattaattttctcaatgtttcttcttagcttaaggagaaagaatatcattttttgacaacgaaaagtcgtagtatcagtgacttaaaactactccaaattcctaaccaattaattttgtttcggtggcattaataatgaattcattgatatttatattctgcgattattaataaatatctcatcggcggtctcaccacatttggttgattcaaaagtctccaaaccctttggaatcttcaagttgttcttcatcaattccacaaacccagaaacaatctttcttccacagagataacccactaatcaatttctctccttttccaattcactcaggtaaaggaacaatctttctatcataaactccattgttgatgaaaccctcgatgttggttgattcaattctgtgtaaattgcttttgaattgtgttatactttgagttttacaagtaaagcttgatcctttcgtagtgggtaatctcattctcgagctaaacgtgagacccttttgttccatggtgttctcgttttgtataaaactgtttaccccaatttccgatttctttaatactttaatttgattctctcttttggattttggtatataaagtgcagctaactttctgtacctaaggatttgactggttgttgcttcaagctttgattcgtctgtgtacagcatttgccaggagagccattagcatcactatggttgaataaatgtataagaatagtgaaattctttgagtgtgtatagatgttcttttgtggagtttgatccatatgtaggtggtttgttgctgcagctgattgtgtgggtttaggcagtgagagctgtttagttgaattcagtttttaaaggtg

SEQ ID NO: 3073 - DNA, 2000 bp, Arabidopsis thaliana
aacaaaaaaaaaagaggtaggcaaagtagcttttattaaaattaatgttttccctaattggtaaatcataaaccaaaaaattgaggtaattcttaatatatttactatgattagaatgatacattaatgtaacattttatcatcttcattaataatagtaagttctcctcaaaattacaatttgatatcaaaaaatatatttgtattacaagcaattactgaaaaattaaaattacaatttagcccagttacataactccacgtaaggtttgagcccatcacatcacatggtacatgaccaaagcccagttatgttaccatggagtattcttcagacaagagccatccagacagaagtggaccacacaatcacgaatcgtatggagatcattacaatatattgctcacatcttattgcgccacgtctcttatttggcgagtgatcaacgtccacagatctcttgctccactctgattggtacacgtcatcattttattgtgctacttgtttatgtggtacagtagagacaagtggtaagattttaaaatatcttaaaagatgtgtgaggcccatttagatattttctcaacgggctgttcctcaaaagctgcccgtttatctacaaccatcgaacggctcgaaactattctgggctagctgcccgaaatctcttaaaggaatttgttgagtgggcttgaatcaacggtggataattcgaaggtgtacgtaacatctcgtagcatctgaacttagctcccctcaaaatatctgtggacatatgtcactagctttttttttgtgtaatgaaactattaattaattaggcaatcacatgagagatgttatatacttaaattaataactcaataatacaatcatgaccaccaaaccttgaaataaaataatctctctgattacttgtacaaattctttaccaatatatgccatactgtgaatgtaatggtttattttaaaacagccaaatattattgatataattatatgtttaagtagattttaaacttagctcatggttaaaaatagacagaattttggagtaaatctgagtttacaaaatttatttattaggattaaaattaattacttaaattggcaaacatttttcttggtgattgtaacatacaatatacgaatttgaattcgcattgtgattccaaaacaacactaacataaactaccagtaaaattttttaaaataaaatttcatatatatatgcttaaaaaatgtaacaaaaatatggtaaattttttaaccatggtatgggtggagatgtatgtgggatgatgatggttatatggtaatggcgcataaaggtggtggcaaaggcaaggaaatatcgatgacacgtaagcagacgggaaatcttaaaccgagtggagaagcctccaaatctcttttttctctctctctctcctaaggccaccacaatctcttcttctgtgtatgtattctttttttctccgatattcgtcgatctctcaaaaatatcctcaaagccaaaaaaaagcaagagtagagataaccaaccaacaaactcataggaagacatatttactttcaggtctttcttctactacctttttcgtggtttttggttgattgattctcagatgagattttttcccgaatcatttgatgtcttttttttttaaataagttcttggtaaatcactgtttctactagcattttttgttttctcagcttagatttgttgtttgatttgacatcttatctgattgagattttgttcttctgaattgttgttacagggtttagctgtttgattcagcttcgatttagtgtacagtgtgttgattagtataaaaaggatttaaaagaatctgggagatgtgtatagtgattgttcttgctggcgaatgttaacactacgtcgtattgattctcgattgatagtagaagaaaggtgttagttagattgttcgttcatctagttggggtttagtttcggttcctgg

SEQ ID NO: 3074 - DNA, 2000 bp, Arabidopsis thaliana
tccattgactacacgacacgtgtgataattaccggagaaattaacgtcggggaaactggccgccgcgtggcatacagatgctgacaaattcagacgggaacggtggtagacacgtggcaataaaagacaggaggagcgtggagggtgcttgaccatttatcgccttggaatttgagacttttaaggggcaaaaacggtagctcacaagtcaacacttttgataatctttttgccgtttcgtataattcaattcaaaagttaatgttgataaccacgtaaacacttcttaaaccgaccaaataatataattaaagatttgattgattgataagcttttgtgttttctttttctgttgttgtgcgtgtcaacgtgttgtactctccgtaaacattcatgggccttttcaagtaactgctcaagctggccgatagcaatttaaaataatcaataagcccatattgtttttgaataggcccatggcttattagggcaacatataacgctttaaccacttcgtcatgaaaaaacccatacaacaacatgcagcaactaacattcaacataactgttttcattagcatataatgtacgaaaacatgcaacttatctctataaactgttagatcatgtacttaaaaatgcatagattaaacgttttcaatttatcataacatgtaccacacaaaaaaagtagctagagcagctattcatcttatagaatatatagacgtatctcaccttcgcactgcagatcttatacaaatctttttaagaaaatgaaaaaaggggggctaatctcatatattcttcgaagtctttttgggttattaaatagctttaaccaccacatgtcataaataattgttgttagatacttgtctgattcatgcctttttttttgcgagtcaaagctttgtatacaacaaatgtgcttctttgctctttcgtctcactccatttagtcaaaaattccatttgtgatataaaaatgaatagatgaaaccttgaaatatgtaatgaaaccggtctcgagatgtggttaaagcatatttgtaatcaaaaatatataattaatgaagaaaaacaagtacgttttcggaccacatcggaccagtagaggcacacaaccatacgggtgttgtgcccacttttgacgacattaccatcagaccaaaggaatatatgaaagatacatagagagagatatgttctcgaactaactatttctttttttaccctcttctgattataatattattttcccgttttgctgttctcttctaccaaactttcctcttatatcaaactttcaaatcgaattcctgaactttatatcacagtccttatttgttttctcttgcaacaaatgaatttttttgttattgttgaatagttatatttttaaataagtagctttgacagaatgtatatttaatgtagaatagcaaataaactagaaacaagaacacatataagggacatactggtcatttcgaaagtcaaagccagaggagaagctactatttctccaactgtctgtaaacgaggaatttttacaaccgcaagtcaaaggatttaaaataagtagttatggttgtatctgtcgttcttctttctctatgaactaaaggccgttggaagcaacacacacacacacacagtgaaacactacagtttacagattcgttttctttagctcaatcgaattatattatttcttaatcagtcaatatttaaataatggaggatgatgataagtattaaataaataattattctaggattaatcagacatgcgcagttatataataatcagtttgattttcttttccttttcgagcccctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcg

SEQ ID NO: 3075 - DNA, 445 bp, Arabidopsis thaliana
ggtggcgacggagaaagagaaagagatgagagacgacgaagcaaattgcgtttttaggtttttcaaagggttttgacttttttttagttaggagcgcagtttaaaatcggtcgggtcgacccgacccattgggccataaatctggtttcaagttaaatacgttgtataatgccacgtaggcaaatacaaaataagaaggaaatacaaaataaatatttgtagagcctctagatgattacgcgggttccatatccaccatatactacttatcttaagccttacgttttaagatactactctgtttttcaaattcaatggacctttttcttcaaatctccagctttctgcatagatccatgaccatgagagtctgtttcttagaacgaaaatgaaaaaaatatcttcacattattcggtagtcatagcgatactcgttgtggtgacg

SEQ ID NO: 3076 - DNA, 354 bp, Arabidopsis thaliana
tcaaaacctgattgattacataagagacagaagcagcaggtaaatctgcaaacgggtgtcatgaaacatataagaaacatgtttggtgtccattttgtatataatctaccagacttgacgttgactgaagatgcaagtaaatagagagattgatacagatacgagtgcaacgaagttctgattaaaaataacacgcgagatgagctaaaaattcaaaaccggctgagtatttatcataagcccaataaatctaacgatgggcccatttgagaaagcctgatagagtgagaaaatgtaacacgactgactcgactcagtcgctcaaagtcgaaaaagaaagaaggcgcaaggagg

SEQ ID NO: 3077 - DNA, 2000 bp, Arabidopsis thaliana
ataatcatattatctaatcgtttaagtttttttttttttgaaaccgtctggctaaaaaaacagatatgtatacaaattaaaaccatatagatagatagatatagggtaaagatactggaatacaaatgatcaattttcaagtacgaccaaaatctaaagaaggaaagtcaaaaggtgtccaattagagaagggcccccaaatgtttgggaaagacaacggataaaatgatgggcgcacgtgacattcgctacttttttacccaactttcacacgtgtcgattccctattgctcattttcccactttgtcatagattcatatgatgggcgcacgtgacacataaaatactttttaagacgcaatgtgtgggcacgtgtcgattccccattgcccattacccccacttcgtcacttccttatcgatgtcgaacaaaactttctttttcccaaataaattcgcaccatattcgggacctctttttttttttttttttttgggattttattatatagtttgtatgattttggttttctttttcttttactcgcattatgggtctaagattctggagtgcttgatttctcaagtaatatgcaggtttaatttctgcccaaagattttcagatatccgatagtccaaaatcgtttatattggtttactaagttttctttaaacattcgatattagtaaagagacgtgactaagattttggctatatcaatagaaaatgaaaaagaagttttgggcctataaacgctgactatacacacatgcttctattagagtggttcttattgtaaattggagtatcaaactatgtagattgtgtctgtcgaagctcgcaagggttagaaaaatgattgtctcgtccagataaaagcattttcttacacaagacacgaaaatgtttgcgatcaaaacttcaaatgattaagcattttataatttaatttggataacggatacatttttccaggcaaaggtaacgattatgtttggaaaatctgaatcaagatgacatcatcgtgaacataattacattttaagacggagcagaacaacgagacaaactacgaatacattgaaaaaacatatgcagatcctgctgatttatgacaagaaattaactagtttttataatcacacatggaagtactatgactactacttctacatcatttttatagtaaaagtaggagatcaaattacatgagatggtaatggatcaaagcttaccaagttaacatgcatgaagtgatttatacgtgctattgagtatcagccatactcccgtttaaagtccagtaagctacctagcgttttatgcctcaattttgtgaaagttttatggcgtgatacttctacataatacgatgcaaaagagaattaacaatgtttgtgataaagtgtagctctagccatgaagaaaaactcatgaatggaagcaaagtaaagaagtcctgctaagtaatcgtttttttaggacaagagattcattaccatctcatgtcgccacccacactttgtaattgtagtggatcggatggtataacaactaagaatacgaacctatatataaaacgtatgttttcattagtgtattgttataaaacttatacatagatttgagtattcaattaccacacgaatatgtattgtttagttgcgaacaacgttgcacctttcgtggccacacaagactttccccgatcgcagcttcttctctgcttggcgccaaatactatcacgtatcttaacaaaccaacaaaaaaaaactgcgggatgtagaaagaaacaacaaaaagttttgggtcgatttgctacagaattacatttattgtggtctttttgaagataaagttcttttagttcttgtggttggtagtcaatttatttcattttcggaaattaatatttattttagttttttcgtccaacgtaaacgtatccactctttcgcttcttctttcttctgatcatcctcccgtagctgattca

SEQ ID NO: 3078 - DNA, 2000 bp, Arabidopsis thaliana
ttcgggagagcattgaacctgatccgtcgtctttccacaatgcccaagccggctaaattcattccaaataagtcatccaagtccataatcccttatctagtcgtttttcaaacagtaggcatcaccatatctattgtgttcagcctaatgttttggagacccttaaatttgtctaaactccacccaatctctcttgtgtcctttccttctttattgctttctctacagttgatccaaaagtatgatatatccaatttcttgaaaaccatttttggggaaaattttgaaaaccatttttagaattttacaaacacaagtaatatgttatttttcagtcaattttttactgtttgttttgattaaaattatgaaagaagcatacgatttctaaagaacacgacttgtcaatcccactcccatcatcgaagatgaacaaagccaatcacagggaaaaaaaatgaagaagaagagagctgcaatgtaactaacaaatcttcctaaaactgagtttgaatatctctctgaatcgctttagattgagatatttaataataataataataatagtaaaattcaagtctgagatgtaccatctattagacatgaaaaaatggatttgttggttacatactttacaattgtagaaacgaaatatatgatgtttttgatacaattaatcggcgatatagcgaaaagaatgtggtaatagcgataatgtagacacaaaattgttgcaaaaaatgaaaatgtcaatgaaacaatatttacgcattgttaaaacttcaatcaaacaaacaaaatatcaaacaagattttctttgtttcaccaaaatattaattttaacaaattgcatgtacgcttaaaactttaatatacttattaaatcttacttttatggtccttcatatgtaacataataacagtaaaagattacagaaacgtttaaacctaacaattatgaaagtttagaaagtgttataaatcttaaatgaggaaatggagcagctcaatgcactcaaacaagtgcccttgattagttgatttcaatcacccaagtagataagcacgtaaacataaatctggttattgccaatatgaaaaagaatgaattttcggatctgactcagatacgttttgcaagaataaagttaggcatttttgaaaaaacaagaaagccgtttaaatagttcttatgtaatactctacccaaagaaaagaaaaagtaactatggaacaaaattcccatatagaccaaaataaaatatatcataccataaatgattgaacagatcttattttcttgaaagtataaatatttttaatgcttggtgtgaaccgcaaatttttgtccccaacatttttagtggataaatatttctatgttgcaatttattatcattttctatataaataatatttccagcttgtatatgctatattctcgttactaaaaatatatgtatatatgtatgtacatatatgtatatttaaaaagttattattaaaaatctactactttctcaactatactctctttacaagaaaatctgattttaaagaaatttcacagttttctagatagcaaccaactttcaccaatcatacttaatttgaggaattacttacaaataaaatctttaaatcataaactagaagccacagtatctgttaaaataataataattgaatttaggatctgccattagtcgacgaattttcttgaatattcgtttctatgttaaaatggaagtcgtgttaagaatacaaataaataagtatttgttttgaaaaagctgaaaacatttttgaaaaagtaaaaatgactaaataaaataacaagaataagaattatcgttttaactccactgcttcctctgcagcactataaatatatgctttggtactctgcaaggttgttccgtatctctcaccaaaccatctctttctctctttctcaaaatcttgtttatttttttaataaaacaaagaaattaaaaag

SEQ ID NO: 3079 - DNA, 2000 bp, Arabidopsis thaliana
acgggtctggcctgttttgatcaaaatcagatctactctttgttaacattaagagattgatgactagccatcggatccattctctttggtttcatggccgatcatagctgatctatttctttgaattttaagctagcattctattaatgcttttatttcattggtcctctcttgttgtaatctcctttcaaactatgtagataattttttgttgaataaaatttaacattccaaatttccaaccaaaaatctaatatcttaaggtcattttgtttcctcccgagacctttcttcactttaggaggtattgagactcaattcatcaagcatctaatctaacgagacaaatgaaataaaagtttggttgcgggttgatgacttttgaaagatgtgacagtcttgttcttttcctaaaaactaggagtggatatatcgtaaaagtgtcttaagatgccaaagctgagagagtgagtgttgaacaacctgcgttgaatcattgtagttcaacttgtttatatccaacaatattcatagagagacataaccttatgtcattccatttagtttgtagaagtagagaagattcgaacatgcatctttaaataaacgaagaatgggaatttaaagagaatgcaaagaaagaaaagtagagtagaggccaagaaacataaactagattatacatctctcgacgattctacttattatttatctcttaagaaatttatgcatatcccccaacaaaaccaaaaacataagattttcaaatgtaaaaatgtcgatgaaacatacaaaatttggcagtgaaagagtgaaaatcagcttcgtcggccaaagatttgtctgtcgccaaccaaaatattaatattaatggttacaaacaaagtatgggggtttcttggctggggcatggtgctaatcattatccagaaaattcaaacaaactgtcacagaactcagcactcacatttaatgaaaactttgtatttgttcagtcgaataaattaacgtgtagtgtttcaaaatgtgttaaatcaatacttcatcatgtgattgtcttgattttatgagtttatctaactaataaagctattttcacagtaaaaatagaggcaaatcatttggtggaaatagaccatattttcagcatatttctacatcttgattgacttttccaacatcaataaatatgtttttgcagcacagttttcaaatatagaatttctgtggtatgaaccatagtgaatatgtgcatcttatccatatataaactaaaatgtataaaaatatacaatcttgtttaacaatacaatcagactgtaaacaaaaaaaattcaatagatatgattgattaatacatgtgaaacttaggcatacgacttttgagcgaaccgaaccgttcggtttggataattggtttttcgagtatctagttaggagataagactgccaaatttaaccgaacaaaaattcggtttggatcggttcagttatcagttaactcagttcggtaatgtgtctcaaatccatacaaaaatttggtttgtatagcaattttaaagaattttggtattagtttataaaattggatatgatttgtttatattagtttaaaaaattagaaaaaatggttaaaagattgttcgattaaccgtacctaaccaataggaaaagttaccgatcggaccacttctattaatcgactggttaaccgaacactcaaatctcaattaggttctgttcgaaaacacatcggaaatgacgacaggaaaaaaaaaaaaaaacacacacacatcgacgtagttgtagtagaatcgatccaaaaatgttaagtagatattttccagataggattgttgatgaaaggggcagatgaagaatgtgtggctctcctctctttcacaacactccacaaaaccctttgtctcctcctcatttggagatgtcactaactcatcttctctgattcaccaacatcctaaaacccttttgatcaaaac

SEQ ID NO: 3080 - DNA, 2000 bp, Arabidopsis thaliana
tagtaaacataaaaatatatttttaagacaacattttatgtttttagttaaaattttgtacataagttgctataatttatcatactcttaatgtacatgtttgaataaaaaagaagttgttttatatttaaaatcttaaataatcaagatatacaaaattaggtacgaaataatcggattagatggaaggtaattagataactgatttcttcaagagattaatcattcaataaggcaggcagagtggatgtaacaattaaaaacggaataatcggagatacactgaaatttttagaataaacacaactttaacaaattcaaagagaacgtttgtaatttccttgtacagcgtaaggaaagtttagataaaagatgtatataatataataattgaatgcatacgtaagagatgagtttattttcaaatttaacgtaaccgaacaaaataagttttcttctaaattccgtaacatatgtcctaaccactcaaactaaaacaaaaattaaatttttttctggtctgaagtattaaaaccacaatcttgacaaaattgaaaatttattttttatgataacaattttataaatttatattattggagcgatatctgacaaaactagtttaaaactgaaaaaatgtctatgtaactataatagagtagtttacaacacatttatttacttgtttatacttgatagtgaaattggccgtgtttgaccgggtcagaattgataggtgacggtccagttagaattgggctttgacgtaaaaaaaaaaaatgtgtaactttgttctttgcctaaacgattggctttgtgtccaagagtagaccgccgacttagattttttcgccgacgagagaatatatataaatggctcgtctttttccaaacgatttcttcttcttcgtcgtcgccggtttagggtttccgttgctgtagcaattttctctcgcttctctctccccttttacagtttctcttatattgctcttgccttgcgtccaatctcaagagttcataaggttagtttaaatttgtctttattgatataatctatgattctgtgaattggtgtgttacatttagtcgaaattgttgtgaattgtgttgttcttgagatgttttggtgtcaattgatggtttatttgcataattttattaggggtttcgctgaaaagctgaaaaagattgctattacataatttgttaagagtgaaaatgtctcgtctaagcttctgttgttatgattcatgtattcacctaaacagaagagagcttgtctcgacagctttgatagcctgttgttatttgttggtctgtttctgtctttgaaggttaaattttttggcttgtcttacagagttgacatttgtgaacatcgaagaaatacggtgacgtttcttctctgattactttttgccaacatgaatactaatgtatttatcaacaagtgctacagcctggtaagtctcaagctttccgatgagtttaccgttctatctagtccggatttgtatctgcagttttgcttctttgttctgtcatgtttgttataagatcttgccttctgagtagctgaacctcttttttcatccttgtgtaggttagttgtcacttctttcctttcttgtaatctttcttatattgtttttcctatgatttgtaaagggattttactggtatcgattcgacagtgttgtttcaattgaaacatgatgctttgtaggaaaactcatgaataactgttcatatagttgctttctgttggtgtttatagcagtgtctttttgttaagtaggttattgcatgatgagagtcttttcatttttattttatatacagtcactgcacttttttcatatctgatgcacacctttcttcttgcagtttttttcgaagctgttggtgagttcccatccttagtactgctagacagttcggtgtgttagttgactttatattcaaggttataggtttagtgttgttagtagagaaaa

SEQ ID NO: 3081 - DNA, 1242 bp, Arabidopsis thaliana
tttctccaacttaactcacaactgcttcaatgaatctaaaaattgaagctataaaagaattagaattacaaaacacacaaaaagtaagaaaattgagtatcttaggtgaaaccggtggaagcaaatcagacaaaagtttgtatctttaacacataattgaaaagaagaagaacaaaaaaaaacggacttgaattaaaggggctatagtagttgtttagtatcttatcttttacctagcgagtaatcgtgaagtagagaaacaggagacgcagcgaaggaggaggctagtggaagtagccgataacaaaatggagtattcgagtgcccatatggtcttgtttggttttcagaccaagctcttttgttgcttacgaaacatgtagatggattaaataccacacaaattaaaattttgatttacgaattgatgaccatatgattcttttccttatttggttaattgagtagagagagaccatgcatctcaacgtaatttggtttaggggaaaaagaaattgacctctcagctaatatgtttttgcccaccaaagtaactacgacaaaataaaaataaataattttggtggagttggtgtcaaatagatatgaattctgtgttatcttattcgttataatcatgatcttccttctcgtgattcccaagtataccctaacccaccttatatttaacggagccatccgaatccgatcgaaactttgtggaatacacacatttgtacaaccagtggcttgtttattcggtgagagagtggtgatatctcaagttctgttatatgctccaacgcatcaacttctgttcccattgcatttcctccaaatctcttctcgggtcggttcggtttggatatccgattccgcttagtttgcccacataatttagcccaggaattgggtccattgtctgatgacgaagtatgttttagaatctaaaactagtggacttaaacaaagcccaatcataataagttgtgtaacaaattttaaatataaaaaccaaatactcctcctccttgcattttctcttttttgacttttcctttgctttgacttgtcagtcttctcttccccttttctcttcttttttttttttgatcaaacaaatcaatctcacacctcttcttcttcttcttcttcttcttcttcttcaacctcttaaatctcaaaatctcaatcatcaagcttctccttcttcttcttctttccatcttcgcttcaacaaca

SEQ ID NO: 3082 - DNA, 2000 bp, Arabidopsis thaliana
ttggtttgtttgccaataatttgtcatgtggaaaagtactcgaatgtgtttttgattcactataaatggttgtcccgttttgagtttgataattcattagcatgtgactatatcatatatctatttattacactagaagcattattctctttttaaagcaatattctctgttcgaattaaactctagctatcttttacatacctactaatggatattttcatttgggatatcgaccaatcaaaaccacaaattttagctgatcaagatgggatctcaagtttggtaggtatggaaaaatacatacgtacacatccagagagcgaagaatttgtgatgaatttctaataaatatatgagttgttgagaaaacaatatttcaactaatcttatatttataatggtcccatgcatgatacaaacgtggtcgttatctcgtccatatgaccagtgaccacatatgtttcaatacgtgtttcatctcaatgcttcacaacctccatttgtattgttccgcacaacttaatgttatgtacaagttgaatatgcttattatgtagtaaaatgtaaaagacataaatcaattcattagtagtaaaacaatatattctcgttgtcatcagtcattactcatcatttggcaccaaaatgcggaagccaagccagctgtgaatggtaagtatattaatctctattcacatgcaacatgcactagtgtgtcagtaatttggtccatgacaatacacatgtgtgatctagatgtccttgcttcttcaaaggttacagcacaaccatatctagtatattactagaaagagaaaagaaattttgttatagcattcatctaaaatgatcagagaaaagaaattttgttatagcattcacctaaaatgatcagaacaaatctgaatgaaaattcagtatatatatatttagacgtttagattgtgcagacaaaatgtatttagtgctacaactgatgtgtaatgtatggactactttcataaaaagtgcagaataatatgcacggaacaatattattacaagttctaagattattcatatctacaaagattgatatttttaataataaataattcgagtttccaaatcgatttttaccatttttattttaaattgaaaaagcaaaacattcatgcaagaaaagttaaaaacaagttagtggaaccaacaaaaaaaaaacagtgttaatgaatgtcccaagtccgaacttttataatggtatcttttcccatgatttattcatgatttagacaataatagggatttacggattttgccattttttgctataatttttacgaatttgttattttgttaaaattttacggatatactatttttctatatattaaaaaatgttcacatttatgagtctttttttgcttaaatacacattttataagttataacaaataataaattctataaacaaatagaaccgattaatttaaatataataggtaaaacacatgttaaatcgtatttttatattataaatttttttttattcataaaactttagacaaaaattgcaaaatccataaatatcactaagaaaatggcaaaatccgtaattgattccaaaaatatgacaaacttttgaatcttttaaccaaaaaaagaaaacagaggtttttataacaagttcagtttacaattttcaacgtgtggtttctctattagaaccaaaagaataatatatatccaaacgtgcacaacgtgtcaatttttttgttacaaaatgtgaagaacaaaaaaaagtgtgaaaagctggttatgagttatggatctgcgcctataaatatacaaacatttctccatccactccatagccaaaccatactctccaaagtccaagctcacaatgaacacttcgtaagtctctctccctctctcaaaatgttctttttgtctgaaatgtaaacacaattttttgttgctctcgttgctcagcccaaaaatggaaatggaaatgaaa

SEQ ID NO: 3083 - DNA, 1875 bp, Arabidopsis thaliana
aggagccaaacaaaagtttattgcactaaaaatcaacaaataaagaaactaggtgtttttgattcggttcgtgtaacaaagtaaaagcttcaccaggaatttgtattccctcaaacaaaataatctgatgtttgtttctctatggagtgaattctgtaactaatatctgattatatcgtggcattcatgaaaatgttatggaacaaagagggtatcatcgcaaatagtcaaaaatgtcacgcgtatttaaaccctaattagacaccgagaacataagtaacgtacgacacattcttcatgaaacaaatgcgaattcaattagattcctattcttcttcttcgctctcttggtccaaatctgttgtcgaggtaggagagttacaagtcccgaaagtgtatcccttctgtgtcaacttgacggagaccatcatgaataaaggttcttgtggcaagtcagatttttgacttcttatcccgtttggcttggacaatctgatcagctatatgttcggacaagacatgatcgtggaattggcttaggagaagttgatagacgtagtttggttcgaagtttctgaagtctagaaagattagtgggtcgggacctcgagaaggattctggtaagatccgagactcgtgacgctaccatccctgtcgtttatgataaattcctcgaagtctctgtctcgactgatcattaccgagtttaagaaacctgacgatgatggagtacgagaccaagcggttacatgaacatcgagtttcattaattcagtatccattgtcgaatttttattcgacaaaatcagagagaaaatatgattcgtggagaattaaagtgtaatgttatgtttttataagcatagatctgattataatttgttctaacttctaacgcgtttatggaatttccttttttgtctccattttttttcttttttcgttcttattttctttttgtttaaattgtttaatattatttgcgggtttacgatgtgtttatagataagatattttataaaacaaagaaaaaaagaaaatctttctaaaaactgtaattaatatttgctataatacaataaaaagtaaagtttggtagtggatcatgctgaaatttaaccttgaaataactaagttaatgaaatttgatcattttataaaaagttaaactaaattttaggatttaagtgttttttcgaaagttcataattttttcgttcaaaatttaaaagttttttttttttttggttcagactatgaatgatcatttgatcgataacttgttttttattgggttttgttggatttctcatagtaatttcattgttcctccttgtctttgcgattgtcctctttgacttcatggtactgaaatcttttttggatctttctattttttggaaattgcttggatagctcccgatcgtttatctttcaatcaaactacggtttcatttttctaagcccaaataatctcgatttccgaaatttcatttcacaaggcttcaaactaactccgaaagatgtggaaaaatttagtgaatacgaaaagatgtgggacgcttcataaataaagatgtgcggcaattttgtaattacgcaaagatgtaggcaattacgtaactacccaaagatgtgaggggatttcgtaaataggggaaaggtatgggataatgtcgtaattaccaaacgatgtgggggtgatagagttactagtgccaatcttggaatagatagtctccctccagttacagtgctctcttttccactatcgccatgattgctcaaacgtgaattgaatgatctgatccataatctaaaaaattgagctttcatcagtaaccgaagcaatggcacggaggtctggaaattgc

SEQ ID NO: 3084 - DNA, 2000 bp, Arabidopsis thaliana
tatgtacttggtcctttcatgaaagactggattatttgcaatatgcatagcagatttgttgtcacacatcaacttggcttgagttgtgattgtaatatgtagatcttgaagaagctgattcaaccaaaccatttcatcagatgccactgccatggctctgtactcagcttctgtactactactacttgccacattctgcttctttgacttccaagaaatcagagagttgccaagaatgaaattcagctccagtgttgagacgatctgatacaagaaccaacccagcatgatccgagctatgaagaaagaacgaattatcatattgatctgtcgacattgttgtaattttgaaccaaagatgatgttgaacgaaagaatcgatgaatgatgatagaatcaatgatgaatcaaagaatcgaagaaccgaagtatcaatagatgattgaattgaagaaaacgaagatgaagatgatagcgaaagtaacaatttcttcgatttggtggatgaaagaaatgatgaagaaaatggagcatcaatggcttgattctctcatcgtacaataaggatgatgaattttggagaagatatgatgatgaagatgaagatatgaagatgaatcgaagaaattgttgaaaattgatgatgattttcccagaaatgtttttgttatgattttcctggaaaagaatgagagaatgagataaaagaaacatacaagatgtatttatagttacatgagagtagtgaataacataagctaaaagagacttatatcaattctacatctctatatattaatatacgagacgagtgttgcgcaagaaaggtctcctcataagttgcgtgttctactgcttgcatacacatctgaatcttgctagagatttatctggatattaggggttttagagaaattttatacaaatcaaatgtccattgggcctaagatcccggcccattttaaactctggatctaactctaacatttttttttatttttttttggtcaactaactctaacattattatcacattattttcttatctgaatacaaattgccacatgtctcatcgaattatttcagataaatgattatgaacaatgaactaattctaaaccgagaattaagaataaggatcacagttttcgaaccggagggagttacagaaatactatcgtagtagacagaattcatgacaaatacaaaaagatactaaaatttttgatccccacagtcacgtgcattgtagggctcgaaggcttaatgggtcccatagctccggtccggctcgaggtttctgtgtcgcacgtgtgtggcacacacaccagggcacacaaatctctggtacgtaacatatacatgattcccatgttgacctgactggagcagaaggtgctgtgtagtgtggaccattgaatctgagccgttcaaacttttaacctcatcgtcacattttatgaaccacaattaccagagaaacccaaatggcatctttttttttttaaccaatcattcatcaaccattttcttcttcgacatgttttgtccgttggattaaaccacacagattgtgatcttacggcgaagaaaccaaactcaaagacattattatcccttttccaccgaacattgtcagatgaacaaagtagttttttttttttttaataataaaacttcccaacttcaaaatcagtacgtgaggtcatagattctcacctccttttcaccttttgttttccttattatgccaaattagttacaaacatacaatcacatcaaaatttattttgactaatatggttagtccataatatacgtaacaaatcatataaatacgaaactttctctattaaaattatttaacttttgcctctcttttctcctcgtgaaggaaaattctttagtcattttttctctcctcgagaattacgcaaacacaacaaaaacccagacattgaaaagtaaaaaacaaaaacagagaaagtgggagatagaag

SEQ ID NO: 3085 - DNA, 2000 bp, Arabidopsis thaliana
tattgggctcaccatagtcatggacttttaatattgggctcacaataatcagggacttttaatattgggcttattaaggcttatagtaagcctgaattgggctctcgattaagttgacgttaaaagccgagtgacacgttcgtatatgtacgcactgtacggaaacacgaagctgatgagttgggatttatataagagaagtgtttggaacaaacttctttctgattcctattatcgaaaggtccaaatcaatttgttttttttttgtgattcggaaattgtgcttaacttcaactcatagtttttgctcatatatagctaatttaacttgggttaatagaaacagggatgggcaaaaagaaacatatatatatgatcacgaaaaacgaatatcttcaccagctgggtgggtcatatccattatgaacgtttaaacgtcttttagctaggatacggactacaacaaaatatgattaaccatatatacaaagaacttgtcggttggaaacacaaattgattttaaggaatattggttttttggtttacgtattattgtcggtttaatatttttgttttgctttgattaagtgtgtaagtacaatttacactgcataaaaccttttttatatatacataattttgttagctaatttatcagagtataatcactcatctctcatgtgctttttattttattttttagtggtcattttgtttagttatatttcattactttaaaattccaagaattttttggatgcagcacaaacacgatcttaatttacaaatgaacgtgtaattgtgtaaagtaactcaaaatatagaaagcttctcttctcagatttgattcgtgggaaattcaccattttagctccaaaaagcttagtgaatcctccaattactcaaaactagatctatctttattggtctttttaaaagcttttttgtcctgatatgaatatgtatatatatcaaccatcatcaacgtacacaagtaacgcaactagaggacacaccgtacacattttgttctcgtaatataattttaattctatatatattttttacaaaatcacagacaagtagatgatcactagggcactaaccttattaaaaaacagtagatgatcactaacaaataaataaacgacattataaaatgagatggtggggatttgatctcgtgtgagtgttaccgaataggttcaaaactttgtcccacttggccagcacacgtgtggtggcatagttgtcttcatcttcgaagttcaaacatgctaagcatgtaagctccgacaaaacatattcagataataaaataatttcaggcctttcttcgatagatcatattttcagattcaaaatcaaccatagataataatatctgcgtaacgaattacacgctaaaataccataatagtttgacactactgttttttttcgtattgtgaatttgtgattgataacccatcaaaacgtttcagtgataatgataaatgtaggctaaaggttaatgggacgtgtcatatttaatgtagattcttcgggtttggactatctgccaagcaagagaaatatggcagttttaatctaatccaacggtcatagaccttagtcttcatctaaccgttcatttatttagactccatataaactcctttaaagacctcttgtctttcactcattcttctcttgatctcttcttctttaacgtttatactttatatacatcgaaagcatttcttctttgtccgttcacatcattttcgaatttgtgttttccctagaaattgtctttttttttttctttcttatagagaaaatcaagaaaatgtaaaaaagattgatatatttatttattctcgttcaaatgaatcactctttatttgactcgttagtccatgtctcgtctcactctcttaatctctatttcctctcagatctctcaaaaagtgtagttttgtgacaaaaactgttttttaaagttagctataagaag

SEQ ID NO: 3086 - DNA, 1616 bp, Arabidopsis thaliana
gttttaacgaggagttacttgactttttatccctctttagtgttatttacttagttttgcatattaaggtgctatattcttaaatagattatcaaacatggtcagcaaatcatcctaaaatcttatatataaataaatcttaatgaacaatgcataacttgttactccagttttgatttgttttttttttccttaacaataaaatttctattttgctgaattatttagtgacttttgacgtcaaatgaatcaatcccgataaagtaatgtcatttttttcacacattcgtctgtgtttgtgtatgtgtgtgtataagttaataaaagctattaaatgttaggtgttatgaaaacgtccgtgagcatcatcacttcgtcaccctaagaacctaaatagaaataaatagaaataaacttccaactttataattattcaaagctctttgggtttgttcttaaatgcatacaccttcctatttcctaaaaagccaattactaattaatatctcaccacattttttctgctattattttaaatagtttttcaaatgttgacagccaaaagaaataacgaaaacataatgtcggtacagttttgctagagattgtaaataaacaatctagaaagtgttactaatatgaagtcaacacggcaagaaactcgaaacagcaactggaaatttcaaacaatattaaaactcgaaacagcaaagaacaagaatatatttagtgaaattattgagtaaacattttgaactaattgaatcgatttttgatggcagaatcaatcacggaagccaaaaagagaatatagacattaatcactaattaaagtcgtaagggaggtttgaaaagtaattatggagagacgcttcggcaattaatgcgtctcattttcaatctctctccctatatctatcgtagagtatttaataaactttggctctttcgcctagaattcctctcctccattcgacgattcctcttgtaacaattactacaatattagtctactttcggaaatacatatttcgagactgattttgaacagtgtttcaagaaaaatactgctcgagtagaattatcactttatcaggtcgtttgcatgaaaatcgcatcattttgtatgaaaattcatactatttattttgcaaattaaatagggatttaaatgtgagaaaaatatggtaagggtatgaagaaaacgaatagtgagaaaacgtgtagagcgtgaaatagggaaagaaaaaaaaaggttagagatcaacacacattaaatacattaaaatttaaatgctagtcaataatggtacaacgataaatgtaacccctcattaaatactattagctctttgcacaccagagaaagtaaactaaaatcaattttgaaaacgaaataaaaacgaacatttaatcgtataatatttaatactagtagtaatcaattgaattttttttaaaaaatactattatataacgtgccgcatttaattttgccccatagactttaaaacaatttctacatttcggcccttaaatattggctccgtctatataactctctctgcgtttacacatccccccattactctctctatctctcgatgattcttgat

SEQ ID NO: 3087 - DNA, 599 bp, Arabidopsis thaliana
tacttgaatctgcatttttctaaaaagatgtttttgtatttcttaacagaagatactatagttctttcacaatttatgcttctctcattttattttagtcatggtaaatctgtttcgcttcctttttgttagtatatgactatgggatgcattactggggcataggttggtcttggttctgcgtgaaattaaaagttttcaagtgattctccaatcaagtctgcaatatcagcgatttaattcaagttacttttgaagatgatttttgagtttcttattgacagtgttctgaagagatacccatcaaagtttgtcggttgttgccttgctaatcctgcagaagatggcagtggaattacgcaccttgagaatcttgttttagaggtcttccctttcactgttactcaaagcatctccaaatattatatatgcatctcatttctgagagtacttaaatctttttttgtagagtaattatcgtgctgttcggtttaatccctacttgtggccatcgggtcagaaggtaacagtttaaccattccaatgaccttagatcaagtttccaccgtattctgttgattgtcaatgactcaacacag

SEQ ID NO: 3088 - DNA, 2000 bp, Arabidopsis thaliana
ttttactaatcaaagtaattacgaatcagctttccataatcatatcatcgtccaattttattcattactttgctttaggaaactctattcatcttattcctttctaaattgttgattaaagtgatttgaaaaggtaataatctcgtgcatttgttgctaatgtgccaaaatatatttgttttggggttattcaccattttcatgtgaccttgttgtatgttataacttataaccgttgggttttttttataactctttttggtaatattatatatttatatatattaatatacagtagtagtagaaaactaaattatcatcagtttgttgcttttctttaacaaaataaccaattaactaattaaattatattaacattgtttgactgtttgtagtgggtatactagtttactaaataaaatatttttgtcaccagccgtactacaatagcctaatgatacgttaaatttaatcatatttgcgatcattatattgtgagtttttacattctaactaataacaaaaaaatactacctttgtattaaaaggtaggatgttttagctaaaatgcatacacttgaaaaaaataaattgtttttgaaaagaagtattaaataatttaattcaaaaaaattcagccaatgatataaaggctgcataatacaaatggtcataaaatatcaaaatatttaaaatttgcataaaaattggtaaaaagtatatattattttaaaatttttctaaaacatcttataatttgatataagggaagtagtgtttatggaaaatcccgacatatatgtaaccacatttatggaatctccgtctctcaatttccagttagctcacatacacaaattgtatttactcgttgacaaacggtttatatagttgataatgcattagatgtatccataagaaagtcgacaaaataacattgaggcgatcattatagtgtgagtttttatttcctaactaataacaaaaattttaagatagtgataaatcttactctctttgtattaaaatatttttttaaaaaataattatttaatatttaattcaagaaaatttgtcaatgatataaaagattgcataataaaaatgatcataaaatatcaaatgtatttaaaaatttgtaaaacatgatatatattttaaaaaaaaatcctaaaacatcgtatattttgatataaaggaagtaatgtctatgaaaaatcccgacacgtatgtaacaacatttttgagaactcggtctctcgattcgcagttaactcgcatacacaatttatacttactgcttgacggatggtttatatagttgatcatacatacatccatttgaaagagcatgttggtcttaattgcatcaaacattcttatcaacacaaaatgatatacatggcatcagataaaccatcacgaacaaatacaattttgaaaggtaatacacacaaattcactaacactattaaggtaatacacacaaacattcttatcaatttcatgattttctattaaaatgtcattataaaaaaaaaaaaactgaaagaaattggactgaaagagaaataaatttaaccataattgtttggtaaaaatagtaaaatatgccaaaaatgagatttaagaggaaaataaaaagaagaaaaaaaaaacagctgtagtctacatttacatacaagtcgtggactaacagctatactactactaagtactaactctttctctctctaaatatcaaattcaatttaatttttcttctgcaaatggaaccaccgccttcttctctgtcctccaccgcggtggcttccacctccatctccgccgccactgctcctgttcctcctcctctacctcctcacgtgacttcttcttaccccgaatctctcgactcctcccctcgttctcgcaccaccgatggctgggatgaccttcctgctccttctggcggcggcggtggcggtggtggtagcgccgtctcttctaaacttcgtttt

SEQ ID NO: 3089 - DNA, 1045 bp, Arabidopsis thaliana
tgatttctttattttccttccactttttgaataaagaatacaacaatctcgttctactttgtattctgtgattttatggctttatggtttcctaccaaaagagttgttcaatcttctttaaagtgacaatttatcaatgttatctcgaaaaacatggggatcaagtatcatgaactggattcttttgaatcagcagcttgctttgtcggattcagctaaccatctacttccagataataatattttaatattttattaatgttaatcaaaaactcattccaccaaaaaaactcattttattttattaatgttaattttatatatgatacgattctaaattattttttaaatattttagttaatgtcgaacattgaacatatctattttcgtcaattgaatattatgtatccgtttttaaagttttgaatcataataatttttgattagaataagaactagtgtgtagttgtcatccggaattaaattttaaaaaacttacagagttggttttgattaactacaattggaataacaaaagatataaaagtaattaatctatgttatgatcggttaactaccgattaaaaaacataatataaggccccaaaaaacaaaaaataaaattctagaaggcccatcaaagtcgtaaaccggcccggttccaacttttctttggcatagcaaaatggcgatatctgattttaagcacggacaactgcaaaaagataagataagataaggttttgttaagagttttaaatataagaaaattataattaatagcgatatacgtttttcgaatcgtataaactaaaattaggtcacatggaagtcaaacaaaagaataaggtaatacaggtaaataggtaattaacaatccttagtgggctgaacgttgaattaagaaataaagccacgagtttgatttgtttcttatttactttacgtccgtgtctatttatatgtttaacgttacactcattaagatcgtaccttagggaaaaaaaactcaagagacaaaaaaaaaaggaaggcgcgtcagtg

SEQ ID NO: 3090 - DNA, 1392 bp, Arabidopsis thaliana
tccaagcgtttagagaccatcgcaaatttaatcactagcgttggatcaacagaacaaataaggggacaattgagaatacatgtataaataatggggttacaacttttcttagatatatgttccatttgagtgttgaatacttaaatttggcttgtgtttatttcgtcggtagttttgatgtaaacatggctatgtatatattttcctatcttaatgagaagaatactatatacactaggtgaatttattgatgatgaatttatcaaatcaaaaagtagagaaatgaataagataaaatatcgctctcattctctcaagttgttcatcgaccaaccataacgtttcgtgcaatttaattccgatcatatatatggagaattgcaggcacagataattattacgacattattcaacaatacgtcttcctcaagtatttaaacacgcacaacgtctttactcgtacatccaaagacgtagtcattttttatatatactgtagtagtctaaaattattttggtgatcattcgagtattttgttagtccaatgtttatttgacatactagtcaagtcatgctctcgtagttaacacaaacaccaaaagtttctgggcttcaccttcacaacactcggctttaccttctcaaccacagtctttaccgccaatcgctcatttccaggctgctcttctatttctataattcttcgtgtgagcttctccactgaatcaccaacgaccacttcagtgcaagttgattcttggggttgttccactgctttggatggtatacatataagtatacaacatgcaacaacaacaacaagcattataaaatagagaaaagtatcttaaagcatagatcatgaaaaagatgatagagaaatattcttacaatgttgaggttgtgttttaggacaattctcgagaacccacaaatatctcaagacaatggagacagagagaacaactacgatgatccatatacgtgatataatccattcccaaaccaaatactggatcaaatcccaaacccaaaccaaatactggatcaaatcccaaaccaaattctggatcaaatcccaaacccaaaccatgtctttctttttcttctaaattttctcaaaacatgaaaggttataaaacatctatcatttattttctcatgcttgccttgttaaatgcccattgattatctatcttcttcaccactagcacgcttgagcctaataaaccaagtttaaccgaaccaaatcaattttctaaaccaggattacaaacccgacgtcgttaaagtactttgacgaaaaacacctccgaagaaactcaaaattacgatggtataccactcaactttcgataactactagaatccatcaatcaccacaggaaaca

SEQ ID NO: 3091 - DNA, 2000 bp, Arabidopsis thaliana
caattatgatagtgaactaattaaaatagttaagataactatattgtccccaattgtacgtgtttccacatataaaaacactgtctgatatattcttaagtagcattgtagcaacatcatcactttaattttaagataagattaaaaaaatattttagataataaactgaaagttaacaaaaatagactttaattgtcaaaaacaagcaactccattagtagcagcttcaaatgtttttatagagcattttcaattttggtcaaactataaagcaaaagtttttatagaattctctttttttttttttttttttgtcaaagtttaccagaaaataataaatgagtacttaggtcaaattgtgtttactctttgattcatcgccaaattactacatgcaatgcaagtcctctgaaggcttagaatcgacggtccagatcagaagatgaggatggtacgatcaacgtaagggtaagaattgactattaagccgcctttttttataataacaaaatacatagaatttgtacatcagagtaataggtcccacatcccactctaagtggcccagatttacacaaatctcatcacgtctcgtttcctctactcgcagtttgctgcgtgttctcacgcgctagccaaaaacacaatccacttgtatatatatttcgtggacgtcaaatattaaagagaaataataattaatctacgtgggcaaacacgtggaatatgcagctgtttcccactactaatgtatgttttttttttttttgtgtgtggcttggagaatattatttgtctttatttagagaatcaaattcgtgtaggattggcaaaccgatggtgggagcgaggactcaattattagacaacgtacttcgtatacatataacttgagaaaataaatcaatcatagaatggaagtttatatataaaaatgcaataagaaatattgacaatttgagtgtttcaatattttcttaatgattgtatacattatttatttcctacagtatgtttttaccaacaaaaaacaaccaacatttatattataactaaagatatttatttcgtattaatcgatggattggtgatcaaaagcaaaaatcatttacaaaactattaaaaatttgagttttatttttgataaattctttaatagattttttctacagcatgtttttattcggctgaagccaaacataatattatcatgtgccaagtaaaataaatgatatatatatatatatatagagccaattagatgcatagactgataaacataacagttaaaatataaagtattatgatttgaatgattcgaattaagtttagataagcatacctaattaaggtgttgtaataagtctctggacaccattgtatgaaaatgacaaaattcgttgatactcccgagtggtgtagtataatacaacaaactcatactactatattctggtcccttaaaatacaaaaacgaaaaacgtattttatcaaaaagtaggaattcgatttagataataaaagaagagatgacgtggataaggtgagaaagaaatttcaaagggtcagaaaaaaggaaacaaacacaaaccaaaggaccgaaagtaatgacgctgagccacaacaccacgcgccttatctcacgcgcatacaagcaaagacgaaaacaaagagatctcttctcgtcgctctctctctctctctttcgtaccattcattcattcattcattcattattgagagactactgatctctctctctctgcatgcatctttctctctattaatctctccagtatttgtcaggatttgggtatttttttaataacgatcagtgtccaatctctcttatcgtcttcataagtttcctattatttcattcttcttcttctttattctcatttctctctctctctctttttactcacagacaaatctttttcacatctctttgcaaattcttgagaattcattcaagttacataaaaagctgagagca

SEQ ID NO: 3092 - DNA, 2000 bp, Arabidopsis thaliana
ttggtgaatgtaaaaaatgtaaatgactagtgacatccaagagtaaaccatttggacgcatcaattttgaacgagagattggtggattaatgtctacatacacgtttactctcaagctatttatggttgtgttaaaggttcctatcttacttagcggctttgttttgggtataaatatattgattgaattttaacatttaagagtatcatcgtttagaaaatatttgtgacgaaaataattagactatggtcagattgattataactttacaaaacggtttctttttacttgtgtaatgacatttagctatagatcaatttagcgttcttaatttgtgttgggttagattttgaattggaaaacatttgacgtatatatgagttggatccagtttgtattttggttacattttcagttatatatgtgataagaagagttaatttagaaagttattttttactgtctgtatatatctctataaggaaaattttctaattaaatcatttctttgaaactcttatttgcatcaatcatatatgccatatattcacacatatattcgtgtcgaagatgttatataatatttctaagaaaaaatcattgaaaatgcgaaaatatttcataccgatatgaatattggtttgtgattataggtttataacaagatctcaccaacgttgcttcgttggagaactacagtattaaggtgacaaacttagtttcatgtcaattactcgttttcgttttgttttggtctcgtttcaatatattagttatatatggatgatgaaagaataaaattttgtattaatatgaattggtttttgactttacgtatatttcagtagaggaaaacttgcctaattcacaatttccttatgaatataaacttttttataactatgatatataataaacctataatctcaaatcaatattgatgtttgttcagaaatttctcgcggtttaactatcatcaatgttgatttgttaaagaataggcatagcaacatgttacctgaatcgaaattcatagcaaagatttatgtttgctaacgaatatcatatactattattgataataataaagttacatttaagcttttagaagctatatgcatatacttgcatacatcatcattatacgcatatgcttcactaattccacattttaaaacaaatttaaactttgtgattcaattcaagatgtaatgactttcaaatatgtaaaatggttccaacgcattactctttggttatcttagttaggactctcttaaagagagacacatcacacatgcaacaagttgtgtggcaccacacacaagaagatggtcatctttggtcggattcaacaacacaattttccaccttaaactcatccgatttcatcaaatcatagttcgttacactccttgattagtctagttttcaacgaacataaccattaaaaaaaaaaccataagcattctccaaaaaaccaaaaataccgtaatactatcaaaacaaaccatagttttgaccaaccttgcttcaatccccattttctcatcctacacaaaaccatttcaatcgattaaacactcaaacaaaaccttacagaattatctacacaatgaaaaaaacaaaatcaaaatccataaagtaaacaaaaagttatgataaaatcaatcaaagctaaaagcacaccaatacaatacacaaaagcacctatccacatccattaacctccgcatccttacattcgtaatcctaaattataaaccgtcgatagatttaaatccaacggttgaaattcaaacctgagttgatacaccgatccgagtactcatcattttaaccaatcagagaagagattacaaactctgtctcataaacacatctgactatataaacatcattcccatagttcttctccttctcctcatcacaaaattctccgacgcattacattttcttccgatcaatacagagagatcagtttctgagagagaagaag

SEQ ID NO: 3093 - DNA, 2000 bp, Arabidopsis thaliana
gcatccgatcctaaatatcacttgctagatggttaggccagaaatcgttttctttcaattttctttgggtctgaacgtagacacaactcaaacacctctcttgatcttgtatgctttaaaatgtggtctcttcaagtcgggtatcttgtttgttttggttccgagtgcatctgtctttagccacctagctagctagaaggtaattgtagatatccattttcaccaactagctagtttttgtcctccagctggcttggctaactacgtacgttccaaatgtcaaacacttaaaaactatatgtcaacactaactaactaaatttattatatcctatatctcaagtgtacacaatgtataatattaataacataattcaagcacctcctgatcttatatacttcaaaaatgtgatgtctctctaagtggagtatcattttaattttggttccaattgcatctgtaattaaccatatatagctaacttgccgatgtgtgtaatataactaaactatagagaatatttgtagataccctcattctccagctggctagctatgtaagttccaaatgtcacacacttgactatttgtctttctccacttataaccttaatcacagatcaagaatcatctccaattatagttttctttattgaatccacctaatctctattcaccaatttataatttttataattgcggcttagatacctttttagtcaataatcaaaaatggattccagtgaggatcaaccataaacgagatcattgaagcacataaactaattgacaataagttacatagtttaggagacataaaactgtttaaattttatattgtgcttaataataatttataattattgtaacacagttgttaaatccatagttatgtagcatgtacgtgtcaattaatgcgcacattcaatattagaacacagaaggtttgtctaccaccactaccaattgaaattaaaaaatttaaaataatctagcgggacacaaagcgaagtcaataacataagtcaaccattttaacggtcaagattgtaagagtagctctactatgatggagccgtgacgtagaggaacataactgaaagcgaagaatcctcgatttatgctactgtcactgaaccattttcctctcaggtcggagctaaattttgagagtaaaataaaaaagcaaaagagagaaattgaaaaaaaaagaaagaaaaataatcctctcttgtttcggctagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggag

SEQ ID NO: 3094 - DNA, 458 bp, Arabidopsis thaliana
cggaggacgttatcaccggaatctctcaccgtgctgagaggctttgctttagtttttgacacctcaggacatgtatggatggataggttttaacttttaactttagctagagatggtttaagggcaatttggtaaaatagcaatgcaaaggctgagtttttcttattttcctatgattttttttttttttggttctggtattttcactttttgggaaccaaccaatcaatatcttttaaaattttataatattttctgctctttgactttcgttttttaccaaaagggcaaaatggtaattgaaagaagggaacaaatccccagttagagaagaactgacgttgttctaatcgagagatcagacgcggcggagactggcggagatgatgaattcataaattccttcttctcctttcctctcttttcatttgattggcttcttacacagcttcgtcatc

SEQ ID NO: 3095 - DNA, 2000 bp, Arabidopsis thaliana
ttagctgttgataatgttgttcaggctgctacttcagcgatgcgggtaagctagtttgggatatagtgtattagcataacctaggcttagctggtttgtatcctgcaggctgcaggtttagtggcaatggtggtttctagttctatcatacctttctccaccacgaacctctggtagttgagaaactggagaaaagcctaatcagtgattcaagtgtttggaagatttgagaactagtacggctatagtttcaggtcagaattcatcttcctctttgagaacttttagaaactttgaaattatggcatcattcttaaagaaattgcattgataacacatttcaaacagatgttagttcctcatgttagcccattaggattggtggctggcctatccttgatgtattctgatttgcggattgtgttgtggaccttcttggttgattgggaaagcaaagcgaacttgaactcaagtcatctagaagttattctgatccataggggtaaggaaataaccataactagtctctgccatcacatgtgtaccagagtgtgtttagtcagttgaagatgcttgaggtacggtatccatgagtggggaacttcaatcttcctaacaaactacatctatcatataatggtttctagagtgacatgctgtcacgtacaagcatttgatttggatgcacaatgatgtgaaacataatgctaattttaagaaagcatcctttcacacaagcccgaattcaggagtctattaaggtgtgctggtgggtttgaagacaataagagcgcagaaatagtaaatgaggtagtaagcctttgcaggctagtacttttgtggactaaatccgtttatctaaggaaactgtagtgtattcaatttgtggatcagaggagaaggaatagaatttggtgttctcattgtattagtgaagtcaagggcctaattgcttcctgttggtctactttaaaggtgtgcagaaatgatgaatcagtgatcaatcaagcacgacggctttatcacttgggtagtgtagtgtattcgtggttaggactttctaaacctatatccttctaggattatttgcctgcaggtgcacttttgagggtttcggttcagaaaaatattttaagcttaagtcctgctattggattttccatgtaattttcttgctcatgtcatctatggttgtaagtttagtgaaatacatgtacaaggcctttacttgaatataaacgaagaagtagtacattgatagaaactgaaaagatgatatcaagtgttacctattttgcatgaacttgctctgatgctcttttatgcggatacagtatatgataatttgccatcgtgccttattctttcatcctcttctatttcctaatcagtttcctatagacttttctgtaaattctatagactttttgaaagtgtgtaatttgatgaactccttgtattactcttcacttttgatggctctggtttggagagtcgagaaccttagtgatactttaaatgcaaaggcttcttagtttcccaaccgtgcttgttttctgcctctcttttcttttggtttaaaagaagtatgtctgttgttattgacaaactcttctatgtaagtttttcttatgaactaaaagatctgtactattaaggtttatttttcatgtataagcatcatgaactttcctgcagcacagagcctaagtccacaaaaacttgtttgcttatgatatcatgagatctgaggtatataatatggtaggtacatgttacaaaggtaatggtactagagcttgaaactatggactgatttcttatatatttacttgggaaatttggctatcagactgaaagtaaactatgttggttggaaattatagattttttttttttctgagcttgcggatgttttcctgggattttgaatggtgagagaaatttttgtgcaggtttaatggggcacagacattttcttggttcatcccagttttttg

SEQ ID NO: 3096 - DNA, 1408 bp, Arabidopsis thaliana
attattacaaaagtaaaataaatattgttcgatttcaattatataattttctatacttctgtaaaaaggtcgttaagaaactgatattcaaaaaatatcgatattcatatttcttgatccaaaaaatattgcattgtatttatatatatctaatatactgagtgacaaaaaaaaatagtatattacactgaacaatgggattttaaatctgtggatctgtagatcagatataaaagattacataccaaaacgtcatagcctaaaagaaaatcagattcaaaatcacaactaatattcaatctatttttatttgtggacgtaaatttgacttaaagagcaaatcatggcgatgattatgagcggagaccatatatggacttctggaactccgcttaacatatctctcgtgtacacacatgcgcatttaattataaatcttattgacacaaatttctttgttttaacgttttttttctttgtaagttaaacgtaaagctttattaaacaaagaacaaatactacgtagattgcggagaaaagaaccaaaaagttgattatgttttgcttacatataaactcagtgaatgcaattagatgaacacagacgattagctaggtttcgtcattgtaatttataaattcatgttggtgcttgcatctactctaaaatttgatgaattcagcgccagttaataaatattatgctccatagattggcttttttcgcccactttggtgagtgcaacttttccgatagtaattttatcaaaaagaaaagaaaaggcacaacaattcctttattttgttaattaaagggaaaaattggctagacgacaattcatttaacatgttgagatttttttttgtcatcgatcgacggttggacttggagttcatttaatgtcttgattatatttttcacagcagcatcgctcgtgatatgtttgaatcacaccatgcacatgttaggattcgtgcttggaaggttcgttgcatatttttcagcgtctgatagctcactgcacacaaagtcacaaagcacaagacacgtatttttaattattcttttggtaaagtgtaaattagtaattttccatcgtttaatacaaaaccgaagtaacatgacagacagtgagtcatacattgcggctcgtaaggtgcggtctttaacgtggttcgagtttcccttcgtatacttctacacggaaactttctctcataaacaatttttttgccgacaatttagttttgttgttgtatatttccaaaaatgtacatgctgctgcttcctctttgtttcttatttataatatctcatgtcaagtgataactgataagtataaaacctcctatatatagcccacaaggtcctcattgatataggcgaactaattaataagactttaaa

SEQ ID NO: 3097 - DNA, 2000 bp, Arabidopsis thaliana
actaattatcgaaaacatcttgacgactttatgaccattctaaaataactacaaacacttataatgtcagatatctatatatatatatatatatatattttactaaccattttttgattaaaacttgaattcgtcgtcaatttgttttgaccatttatctactcattatatgagtccaaaaaatttcaccaattactgatcatttcatatattcgtcttagtttgttcgaaagtttttcaataaaaagtttgaccattttgttggtaagaaaattggtcaaaatttgacattgtatatagcagctccatcggcttcttctccttctccattacctgattcctctgagttcttcctaccctcacaacttttgttggttaactacaagaaaacgtagatagacattttttggtccatttgcaaagtctcgatatatggaagaaaaatacttccatgctgtacccaaagtatgtgaaatctctcatgtgaatgcatgttctgcatgccgtcgtctcataccgccgttgtcctctcagactaatactattgcttcaatctatcaaataaaggcaaataccatatatgcttatatgttatcttacatagccacaatctccacaatcttagtattcactagttactataaaatcttgatgctgaaaaattcgtacattaccttcatgaatatgtgtaaaatggcctctttttttgtcgtttgtagccttgtaaaacataggaacggctctgcatttagacatgcagaatggacgagttattaaaaatcaacgaaactaaacaaaaaaaacaatgtcaatttttgtttaacctaaactaaaccgaatctaattttaaccgataatacctcttgatagacttttactaatcaattaaccttccttgtcttctaccttgatttggggaaagtgttgtcctagattcatgtagatcatcagtacatagaagaaagttacttgtaacataatctgaccaaacaaaactaaccacttaaatatcctaaatctctctttctaagcctatctaaatactttgaatttgtatcatcgtttgaaacaatttaatatagaaaagaaaaagtaaacaaatactagtatgtatttatttatatgtggtccaatttgcccacagaaaaaggatcatgagacataagcgtgagaccgtctccaagctgttcgtctctgatgctccagctccctttcccactttatttttatgttattttaagtttgaactacaatcaacttacatatatacccaaaaaatattaattactgtatacctattttcggatatttcatctattattgcatatattttgtcacaaattttgttttggctattttgtgtagatttgagtatatatagttatacaattataattttctaatattttggtttttttttttttgttacatgaagatacatttggattaaaaaaagtaaggaatatgaaccacatctaaattttgtttgtccatgagaccatcctcaacgtaaacactagaattgtcccaaacccaaaaaattgaaccaaccaaataaaagaaaattataatagccgaatgagacctaaatctctaaaaccaaaaacctcgtaattggaatagaaccgatctaaacttaaacgaatatccaatacgaaataaaaagccactatttaatagcaataaatcataaattcttttctttttttgtaaatcataaattcttacgtctatttttttacttattagttacctaattcactcattagcttgacttaatcgataattatatttatagatacagtatatggtaaacatcaaataactaacgcttattgaaaatttcctttaaaatgactaatgagacgaaaaaatcaaataattaaacaaaattacaaaactgccatttcttcttaaattatttcaagtaataactgtactaaaagctgtttttgttctttctctctctctctctctttcgctgctctcacacgcaaata

SEQ ID NO: 3098 - DNA, 992 bp, Arabidopsis thaliana
cactcaccagcaactgccacgattttcttcccctttttctttcgatttacataatcactccaaaggttttaatttattcttaaacagtctccatacttttaattatctcatattttcccctcggttaactacaatatccaattttactctcataatttcgtgtaaccgacttaaactgatatttaatatcataaaattatacatagaaattatcatcgcaaccaaaattaatacttactcgaatcaacatttttttttctaaaagcagattgaaatttaagagataaagtaatccggtcaaaaagttacatttaaaaacaagggccagtttgtattttctcacgattcggatattattttccttctttttatctcctaattactattttttccaaaaatataaaaaaatatctgttttttttttctgttttcttttttctttcttcatctctctctattctttgctttgaaaagtaatctggaccgcgaacaaagctttttcgttttctggttcgttgccgccttgcacgttccttcttcttccttctctcccccccatcttatctctttccccccctttaccctaaccctaattttcttcgccgtcctctcttttctctctatctaatttcgttcccatattcgaaatctcttaccttttatctccagatcttttagatccgtaattccctactattgattatacccaaacttttactcttatcttcctcgtttgattcttatgcttccttttatgaattgatttcttcataaagtcatcatctttggattgaattcgactcattaatcaatccgttaaccaataaccaccttgacagtttcttctccgaggattccagattacaattctagtggagctgtaattggattcagatctaactcaagttagtgttactgttgtgtctattggatgcaatcgtgttgtgatattgaatatatttctgatgggagaaggaactatttgtttggag

SEQ ID NO: 3099 - DNA, 2000 bp, Arabidopsis thaliana
cggtctcgaaaaagttatagaggaagaaggagaaggggaagatagtagctatggcaaaggttcttttgatctgagttcaagattctcaagcccttccatttctcgaaacaggtttgatgatgttgaaaacccgaaaaaggcttcgtcttttaagcggcctccttctgcgtcgagactgtctggctttcgagaggaagaagaggccgatcggagtagaaaatcgggttcctttgtggatcatatcggtcaggaggacaagagaatatgcgcctctggatgtttcagaaaatgctgcgcttgcacctgcatgtttgtttctgttgtccttataatcgtcttgttggtaggattgtctgcaaactcttcaatcaaatctatactacctcaggtgcttgtcacaaacctcaagttctcgagattggatatcgccaaatcatcgacagatcttctgatgaatgcgaacttgaacacggtgcttcagctctctaataataatgacaagacggtgctatattacagtcctatgaaagctgatatatcttctgagaacataaacctcggaaagaagacactttctggattcaagcaggacccgggaaatgttacctccttgaagatcctcacaagactcagaaaatccaaagtgtatgatgttgatgctacattgctgacaaacaaagagaagacgcttgaagctttggttgatgtgttcttgagagggaaactgagtgttgattggttgggatttaaggttcatataccaattgttattgcgtgcgagagtgtgaagcagagtgatgtgataaatggtctcaaaccagcgtgcgatgttcgaatcttttccgaatgaaaacaatgagagctattgatacacaaagaccctctgatctttgttttgttctgttcctttttgttgttgctaatttactcgttgtagattgatgaatacatagaaagagagaagtgactcaactttgtttctctaaacttaacatcaagaatccacaagttatctaccttttttttttcttcacatcatcagtctatgttttcttcatcattgacttggcttgtaagtgatatagttacgtccataagtttgttaaaggttggtttgatctctttctctttctatacctagagagatggatcaaaactcgaatcacgatagagccacatgcaaaatcttgggcgttgaagatacgccattaatgctctcttccatatcataccacaattattgagtctttggaaaaaattgtaaaaaaaggaaagacttttgaggagattaaaataagcaggtgagtcataagtagctgtggagttaaagacgtgtagagaaagcgtgttcactttcttggccgcgtttccaattatcaagattcttgtgagaaactaacttcttgattagttttttttgttttgttttagagaccgtgaaaaaagatgattagactaatgaatcatcttcaacggaaagaggtaatataagggactagagaggccattatattgtcacaagcttcttgtcttcttgcatcatctgtgtaaagtaagcttttttctctctgcaatttttgtctcttcttctttctttctgcaacttaccattattttattagcttcattgatttctctgctgaataaaatgtggataaatgcttctaacttatctctagattttctagagatttgtgacaaatgtcaaatgggttgttgaatcttcacgtgtcctcttttctcctcttatctcatctaatttgtttctttagttttgttcaactcaagcacatccgagaaagtcatagtctttgaacatcaaattgccttttgtttgtcaaatgacttaagttcttgatctttttcttgtagggtttttttctctgcactccacggtcatggcttcgtctacggtatgaaaccttcgtgatcttcactatataagttcattagatccttgtgtttagtctcttggtcctaacatttagtcactttgtctg

SEQ ID NO: 3100 - DNA, 2000 bp, Arabidopsis thaliana
ttatccttttctttatcttaaaccaaatcagttatatagaagattaagtcattattaaaaagtatcatcagatcatctcataaatggtagcaacaaaaccactcaaatattcaactataaattactccatcatttatagaaaggagcctacgcatatatctagcaaatatttggaactctagtacttgactttgagaaaaccctcattcaatatatatagagttgtgttagcctataagggcctgaaagtatgtggaatttcttacaattttcttccttcacgatgtatatatatatatgccgtacgaatattgtgaacgtgaattcgattcaaaaaatgtgatgtggaaacgagcaacaacaattattgtagctcttgaggacccataggacgtgcatgtccacttatacctaatgagacaattctgtccttttttataagagcatcttccacagcttaatttgcgagcctcattcacgtcaatatataaggggtatgtgatacggtagatggattgattatttacatccatctacatgtaagttgaccagcatagaccttttacatagtgacatagaaccgttgaaatgccatccgattgatcaataatgttgggacagaccaaaaccaagataccaaaacggtaaagggacaaatgcgacaatcagatattgaactttaaagttgtggctctgatccagtttggcaacaacttcacttaaatttttgtgttaccaacaaaacagggaaaaagattcgctaaaagagttgcctaaatatatgtttgagcttgttgtcgatattttatgtttatctaaacagtaaaaaaaaaaaaatttatgttttatttaccacatttagaactaggcatatatatatatatatatcttattatataaagtatggtttttaaagttgctaactcataagattgtgtcacgtgtcaagtcaaacgatcagatgtttacatgtatcattcaaaatttaacttttttattctctaaaattaaatagaaaatcttaaaaagtaaacaaatttacatatactaatttatatgtctatatatttataaacaattaacatttattcaacaaaaggaaaattaacaaatttgtctttaactcatgtaatcataagtgaaaatagaacattttgagaaaaatagcttatcttataggatttaacttttcaattattttcatttattaattttaactcatttaatattaatttgcatgatgtaaaattaacttacgagattacggcatatatagaaaatatattttcaacaatgtttggtttctaaatattttgtggatttcttttttttattaattattagccctaggcgtttgggtattcgggtcgggtattttgggttcgggttttcgggtttagaagtttaggacccgttcgggtaatttaagatttcgggtcgggttcggtttgggtgggtttgagtttatttatatattgaaatatcaaattttgtgtgcaaatctattaaattacttgaaaatttcaaaaattcccaaaacaacacgagtagttttgcttgaatatatctaaaaatacacaaaataattaaaatatccaaaaaatcctaatattttctatatataagtataaatataactaatatatatttatatttgaaatatgtttggatacgtattcgggttcaggttcgagttttttgggttttgaagtttagatctgttcgagtatttgaaaatttcgggtacacccgcctcaataggcgggccttatctagtatatatatatatatatatttttgtgatggatttctttctgtctctctctatatatagcatataaatgaaaatgaattatatttgcctttaagggagaagaaagagacttactttggatatcaaaacatgtcttgctctctattctaattaagtctagcctatctacaacatacataaacctctatctacgattatatttggatctacaagtgaagattgatcg

SEQ ID NO: 3101 - DNA, 2000 bp, Arabidopsis thaliana
acctctaaatgaagagctcaatgagaaagctcctgagttggtgctgagctggatagacaagtgttttaatgtatagagtcgtaatccagtctaaatacaaagtagctgtgggaagtagaaggttaaaggttgttgtaaagggaacacattctactttctcgggacttttctttggtcaatcaagaattggtgcttgtttctatcagtaactgaacaaaaccagagagtatgagtttgatctttaccaaacgcaacaaggcatacaaaggcaaatccatagtaatgacaaaagatatctaagaaataataagataagtaatacatttgcttaacaacaaagaacaatatagttcttagccaaaaaacataaaaaaacaatgaacaatatagttgagaacaatgtgatagaccaaaatcttatgtattcattcatcaaaagagaacagtttatattggaattctaaacgttttgcctactattgaaggtttcacaagaaacaaaacaaaccaaagactagaaaacaaagtgtaattcaatagtctacgttaacatgacgtgttttcgcaccgaagacaataatatataaactgtgatgacagaatatggagtcatggactatgtaaggctaaactagattatggagtcatggacgaatgaagagtttttaatttcgtgaatttcataaataatgtgagcctcgtaataccactagttgtagacagcggttctttggtggtcgatattgcatggattatgcggtccactccacgatctaattattacaactatatacatatatttatatatcatgcactatatttgtattttacaatcttaaaaccataacatatcaaaacactttgattagtaacttttgtaattttataagcttcttgtgatttttatgtgataaaacataaacgacaccaattcgtttttttttgttttcatacatattttctataatatctgtcaggatctaataattaatatactgctctaaaagtatatatcatatcaattgtctccaagttttggtgaaacacctcaaactcaagttaataagactattttggttgtattcatgttttttttttggctatgttccattctgcttacttcttaaaacaatgtagtgtccaataacagcataaacctgataagaataataattatgcgtgtagaattttggtgaaacacgtcaaacttatttaacaaaacatatatgtttcatttttttttggttaattttttcccaattttttttattttgaaataaattttcggatagtgacatataaccttatgtagtctgtcaattgtcatatttttctatttccatcatcctatatactttacctttgttaaaactccttagataagaacttccaatattttccttacctatattttaatttccagttttatatatttagtacttaaaaaattcaaatggaaaatatgtttgactctaattagacacatataatatatatttccaaatagtaaattacaaattgagaaactcatgaacaatagtgcatccacgtcgttatccaagttggatttctttctaaaacaaataattagacctttaaaaaaaaatataaataggtacttgttaaaaagtaggagagcccacaaataaggctttggccgcttctgcttggactctccaacaaaaatcaaactctttaaaaaaacaaacaaattgaagagcgattatacgatcacggagaactcaagatccggtgacgaatccaacttcttgtgacggagctcaagtcgagagagagaagactgtactagtagtagtagctgtggatttttgtgtcatcatcggagatcggaatcttcttcttcttcttcttcttggagcttctagaagtggagagaagggggaagatcaagcgacggatagtgataggttttgctgtatgtcagtggattgtgttgaaactgattttggtggatttggagaacttgtgaaccctattca

SEQ ID NO: 3102 - DNA, 2000 bp, Arabidopsis thaliana
agtgcacgatcgagagtgagtcaccaactaaccaacagcgaccaaattccatttatgccacaccaccataaatggaacaatacactgcctaacactatttgccacttccttctcataactcttggtcggtatgttcgtatttacgtggatacttaatgaccgaacatgtggctaatttgatgggaggataatattatgaaatttgctcacatcccaaaaccataagatcataaataaattatatgtttccgccaaccgaaatagtaactgttcatactattttaatcttttttcctgatgttcaatttttgttttatttatttatttagtgatcttggttttttccaaggctattgtataatctttttattataaatcaatatcttgtaattttgttttataaggaaattagtttacatttttaatttcaattttgtaatctccaataaaaattttagtaagaaaagtaaaatcttcactcgaattagttgattatcagacaactacgatatgatatttgggattcagatcactaaatattattatttaaaataacataaacatcgaaaactagaagaaactacatatcacttcatgtggttgctctctaatctattttttccaagtttatgacttataagttaaatattgtattaacatgaggtgggtttaatttatttgtttcgattttattagatccaagtaaaatacaaccttcgattctaaaaagtaacgtacgttttagtagatcacggtctaccacatacattatcacaactatctttgaaccagacaaaatcagtgtggaccgaaaatcctaagcctacaaaatatctaaaagatatctatgttacgaaatttaaaaaatatcaacaaaataaatatcgaaattttctacaagatatcttacatgatatatcttaccaatttgagaaccgtatacaaagttaacatcgtaaaaccattagtccatgaccctggccaaataactccatacgtaaggggaagtgaaagtctgctaatcgcgttgaccatagccacattggtcaagattcacccaaaggcataatattgatttaggtcaacttcacacaacacattacacaagaaaacctagtgagcttctcgaagacttcatatatctccaaggtcaacacgtggaccttaagcaaccttccacgtcattacacatgtcagggcattgaacaagtccggtttttgcttctcgaacaagtggtttctctaacaactaaaagataactatgattctatcgtcagcttcttttcatgttcattgcccatcacggcataacgcgtttttacttcaaccgagaaatgcttagaaaagttttgtttgctctcttggtcaaattggtgaaatgtttttgtaataattgggagagaagaaaataatctaatttgtgtgtgtgtcttttgtattcatatttgtgtgactagattggaggaaaatctgaaagtttattcaaaagtttacggtccaatcatatgtatttttttctctatttcttctggtcaaaaagtatacatgcaaacaattttagacttttttagttcgtaatttctaaagataccgttgcagtagagtttgaatgtttgataataatttgaaaacaaccttgttattctagaatctaaatttattaaacgcaaaaaaaaaacgtattcagattattttttttatagatatggataaaattcatttcagtaatttattatcaactaaccaaaaatgacggatattttgtcaactaatttaagtttttcataaacaaaataatttattaaaaaaatagtaagaaaaggagaggtgttgagagattgggaagctaaaatatccaaccatatataaaagagagcaaagcttcacctatttttatcaaacctcaacaaaaatactctctcttatttcagacttttcagacaaaaacagagagaaactttttgtgtttatgtgttttaagatctgattgataaaaaag

SEQ ID NO: 3103 - DNA, 2000 bp, Arabidopsis thaliana
atgacatgatcttttatttaaaaacatatgtagatcgtttgaatcaggctgcatgcattgctacctaagtacctaacctacttgcgttgttattgttgttgtgtacttgtgttgttttttatttttcttgttggattcctttgaagcactattttaaatttgtaatatacattattattggataacgatttttggtatttaaaacaatctatcatagatttaagtgaactagattgttttaaataccaaaaatcgttatccaataataatgcatattaattagattgttttatgataatttctcaaataattttttatattaataagatttgaaattttgacaaaaaaataaatagatttgaataacttgattaaattaaaaatgataaatagaagataatattgtaaatattaacatatgtaaattaggagaatggatttaatacattaagtgttacctaaaaatttaatccattctcctaatttacatatgaaatatttatattcttagcataaaaaaaaagtccgactatatttcaatttagatcattgtttgagaaaaatttcactttttaggtaaatgaccaatcacgttacaacatatcagtatcaaatccacataagacatccatgtgacacattgcatatgcaaagagaaaacgagacaccaaaattttgtacaaacaataatcagtcaatccgaggctactatattaaaaaattcaaaaaaaaaattgtgatttaatgatattttgaaagtttaagttttttcgtcctaaatttgaaaactgacacatttttgatatttttacctttgatacatccgtagaaaaaatatttacctactaaatattttcttatatgtagcttataagtataattatgtgaataacactaactaaaatagatattagtttatttaagtttgaaaaaaatgtgacggttagcttctcatagcttgagttttgtggaaactttactttattatattaaatatcatcatatcacataatatgatagtaacaaactaattagtaatgtaccatcaacttttctagtagtaagtactactttgaggaatcttgcactctgatgatatcaggaatatgatcataaacttcagagcatcaactcctagaagaaaccgagtgaggtggtccaaatcaacaaacctgaacacacaagaaccttgaataagactttccaaataaaagtagaaaaaaaaaacagagaattagaaattcaaaaaccatactcttattttctgggacaagggtttttttatacccgaacaatttacaaagtgtattttcataccaaaacaaatttgaaggatgaattcatacccaaactccaaaaacatttgaattttatagctaaactttacatttagtgcttaattcaaaatcgtaaataacgagtattagtcaactgttacagttgctgagtcaaatgacatgtatttgatgttatacttcaaaacgacatcgtgttaaatgttagaattaaagttatacaaaattttgtaaaaatcagatattgaagccacgacgtttcactcatttaggcagcttattaacatttgatcgacaactatcatgagttcgagacctaatttttttgtacaactctataaaattttaattctaacacttaaaacgatgttgttataaactcttgaccaaacctagatatgaaaatacgtttttcccctgatttgatgttagccccacgaaactcatgacccgaacctagatagtttgcttgtcttcaagcaaacgctgtccagatcaaccaagtgaagggacttattttcttttttccaatgattcggaattcaagacccactacactattgggtcttcatataataaaaggcccaataaaagtctccagaggaaacaaaactaatcgaaacgacgaaacagttaaggtaacaaagtaaacaaacacgattcccaaaacacgaagaaagataaagcaaagaaaaaaaaagaaag

SEQ ID NO: 3104 - DNA, 539 bp, Arabidopsis thaliana
aagaagaaaaaaactaaacggctttaacatatggactacgccgtttgtatcttgttgttacaaaccattaaacgttactgtttgatcaatatgttaattcagaactgtttggtttaaagcataagtattgaagtcgtcaaatgaacaacttgcaatcttttgctttgtatgagatacaaataaaatcgtggtccgtttataaaatagctttctccaaacaatttcaattcccttttaactaacacaacaaacgacccggcccgtcaaaagaagaccaacagacgatgaaataaaaggaaaaactcaattttctaaactatttttgggggtcgtaaataagtgaaaagcctgccgacgaaaaaagaagaagtgaaaaaagaagtgaaaagcccttgtcttatttgtcttttactatttttctgatttaaaataaagaaacaaacatttacagtatttgtttataacgggggctaagtagagaatcatgagaagattaaaatccctaaaagttttgggggaaagaagaaagaaggaagacg

SEQ ID NO: 3105 - DNA, 1124 bp, Arabidopsis thaliana
tctctttattcaatataatccttttgattcgctggtgatcggtacgagaaacttagaatcacacgaggaagctgtgtttcgtttatcctcgtttaatcggaatcgaaatttgttctggagaagaaatttaacgaatcatagattcctgatacaaaaaaaaaactatcacagatcggaatcggaaacgtaaccattacataattcgaatctggttttcacttgggtataatgatgaggtttctcttcttcttcttctccgttcttcttctctctgtgttttttccatcttctctgagtttttctattttccactgatttggttttctgttgttttctggatttctaattagtttctatggatctgagtttgattgtaaaaaaacttgagattgactctaatgtcaaaaacttttgatctcctccagatttcgtcttctttggattcaccagtttttaactaatctcaatttgatccaataaccaaattgtttttcgccttttgaacaaaaacaaaataatctcagagcttctccgtcaaattctgatttgggttattttcaattaaaactcagaagaattttgagaagattaactctaaaatctcgcataaaacacagacacatttttacaatttttcacagttcaatcttccttttcgttttcatgattttgatctaattatttttgtgtttttgattaggtatcagagagtaagcccagattgtcttcctctcacaaatggaggtaagaagccttacttacgaccatcaccatcaagagcaacaaacgaagacaccaccaccaccaccgtcattaccacaacctcaatcgccggaagaggatttaacggcggatcatgcacaaccaccaccaacaacacctcatctctagacggagtccccaaaggattccgattcagatccactcaacagcagcaacaacaacaagatcctagtcctagccgtcgcggcggtgatgtactgttacagtggggacaacgaaaacgatcgagagcctctagagctgagatccgatccaccaccaccatcacaaccaccgccgatgattcttcgtcttcttcaggtcaaggtaagatacaatcaaacaaaccgcaaagaagatcg

SEQ ID NO: 3106 - DNA, 2000 bp, Arabidopsis thaliana
tatatttggtaatgactaatgacattcaatccgaatatctgatcattgacattcaatttgaattttggctcaaatagaggttagcagagataatccgtctactggattagctatactggaggagaatgtttttttttggttattgttctttcattgatcggtatttggagaaaaaatataatttttcaggatattgttcgaaagattaatataacgaaacatcaaatatgagtttgtcttcaacggagcctacttccctgcatacaaatatagaagcattaatttgggcgaagtaatgtctaacggccaagcagaagaatatagtttctttcgtcacgaacttttatgaactcataaaaatggtgacatggtgtacatgtcttcaccaaaagagtggcccatattttcgtcatatctcgaggaaatcgtaaagtgtaagtaaaaattttctcttgtttttctgtttcatttgtttcttatcgagttaatgctagaataggcacatgtacactagcataaaatgtccgcactaatccacaatttgatcatgcacgtaaatattgttttctcaggttgcctacctacttttgtttgttatatccttgataacattatcatgttctaacattttcaaccttgctactattgtaatatggtacaaaagaaattgaaatattttatgcatgagatgagacaaccaaaagaaaataaaaatggttaataaaatatgaaaagaattgttaacaaaaaaaaagtaaaccgcaataccttttttcgtctagtaaaatagtaaaactggagaattctctttctttttctctagtaaaccgtaatagtaaaatccgtcccaccatctaatccagtttggtaaaattaaacattttttttttgttctaataatatttttattaaaagaattataattcaaatcaatttaaaaagttttcttttgaaatggttatttaattttatagatttcatatattatatatattctaaacgtttttcgttaaatattctaaacattttagaaactttaaataactataatatttatctttaataaaatcctaagattttttctttttaaaagtaattaaaattgatggagatatattaaataaggaaatgctaataattaggaatattatttaaatgataataattaatgttaatgacattccttgtaaataagttccaacttgaggatttatttacaaaaatggttgcaaaaatatatatgtagataacatgtagataacatgtatttttatttcagttgtctttgatgtcagattgaataaccagtttgagtttttgtctcaagaacagtggttttgtaagatatttctttcataataaagaaacagtaaaaaagaaaaaccgcaatacttttcaaaaaacaaatatgaaaagaattaaataaagatagtaaactgaaagccttgtccctattgcattttgccatctccgtccgattggtgaggtgtgatggtgtttgtacttgtgtctctggttttagcatcctcttgattttctctctgtcggtttgctactggtttgacttcgatgtaaggtctatccaattttattggtgcttccgacgttcacattaggaaagtttggtgagagtttctgatccttttgctcatttttagtgcttaaatcttgtttttctcatagtttttgaccttcattagaattttgtctcttggtttgatttctttgatttaaattagttttcccatatctgttgggttttttcttccctcttttggattgagtttctggagacaatccattgatccaccgatttatatattttaacttgtatcctactttggtttttaataaaatttagaggacaacaaaaaaatagtaaactgcaagcccgacccagtaacctattaaggtccaaaacgacatcgtagaacatagcaagtaaaagaagaaaagatatagagatagagacaatgatatcatcatcatcatcatccaac

SEQ ID NO: 3107 - DNA, 719 bp, Arabidopsis thaliana
gacctttgttagaatatagatatgcttagttgtatgactgatctagcttgtgttttttttttgggtggagacagtttttgtcatcttccacattttagattctattttcgaccatcatttttttcttgatcggtgactatgaatctaatggggtcaatcattttcacatataaaacttaagtatttggtgtttgtacttcatcagttcatcttattccatagaaagagagtgagaagtgatcaataacccttttaactgaaaaaaagaagaagatcaaaacctaaataagatttaagtacatatgtctaattcgacgtaagacatttttggaaacgatcaatgtactaacgagttgaattctgatgaatcttgagcatgaataaacggactttgtagtttgtacaattgataatgaaacagagagcaacattatgtacatgtgatatatgctgcatttatttatgggcttttattagatggaccgagctctagcaaaatccaaagtaaatgggcctaatcctaacgtggacagacaagggacacgtgtcacactaccgacatctcgtggagttggataagccactcgaaagtcgaaactcagaagatccaaccagagccatcatcatccttccaatggctattacttgagaactcttctgattaaacatagcaacaacaacaactcttcttctcctctctttctcacttcaatttagcg

SEQ ID NO: 3108 - DNA, 328 bp, Arabidopsis thaliana
taatatcgtattttcaaccttcaacgcaatcgccgatcaaacgaatccgcggaggaggactgactactgaccgcctgaaaaaaactaaaccgggaagaacccaaactacgtgacgtttatttgaactgtcatcgaatatcatgccgtctcgtcattcacttatctgagtgggctttataatagaaaggcccagtacataatgtatatcgattcctaagttggcgaatacataatgttgctgcgtctctgtcgtcatcgacttcctcttcctctgactttgagcagctctgtcttcttctcgaaatcgtctcctgtttcttctgctttc

SEQ ID NO: 3109 - DNA, 961 bp, Arabidopsis thaliana
cacgttgattgctaaaacccgggcatgggaagaggagaacagtatgtcctttgagtacgatggagttcctttactcgccatgctagatgaatacactatgcttaggcaagaacgagaagatgagaagcggaggctgaaagtaagttgtttcatcctgtgttaaaccgattgttgaaactaacttcttttaaaataatcttgccttttcattaacaggaacagaagaagcagcaagaacagccacacacagatcaagaatccgcctttgggtctaaaccaagccctgcaagacccgttagtgccaagaaaccggtgggaacacgagtcaatggaggagggctcaacgaaactcctatgaggcgtttgtctatgaactcaaaccagaacggaagcaagtccaagagagacagtctgaacaagatagcttcaccttcgaacattgtagccaacacaaaagatgatgctgcatctccagtctctcgtgctgacccagtgatggcttcaccgtgacaatatcaaaagaaagagagttataatgcttacttacacttttgttagttgctaatagtgctgtttaagaaacaaacacttagaaacaaagacaatgagagtagaatgttacttagatgtttctgtttctgtattcattcactcaaatttgtttggtacttgttagcatgactaatgtgaagtgaccggtttagtgaatgaaagtcaaggttctaattggaattacgaaataatatttgggcaaaattgtaatatactgaaagatcttttgggcatgatttaaaagtttaaaaagtttccaagaaggtttgggattttagaggtcctttctgcgacgtcgtttctagtttgcaatcagaagcgcgttaaatacaggaaaatttcttgagctgttttgtcttaacaaatcaatcggagaaaaagctacggagctcgagagaagagagaatct

SEQ ID NO: 3110 - DNA, 2000 bp, Arabidopsis thaliana
tttcttccttttttctctcttttgatgaaattacggaaaaagccatttgcttacgctcgtaaaccacgtgagcgtgatctgtacttttgtcacgtggacttcttctgcgtctcccacttttttgactttcttatgtaaaagttatcctggttgttaatattttaattgtttatattttcttctaaaaatgggttattgtgaaaataatgtgtttgcctgcaaaaagatgagaaaatacatgggtgttgtaggtggtaatctcttatccttgcggtaaaaaagatcatttaatagttaatcatcacaaaaataagaacaattagtgggattaaaatcacaaaattagttggattaaaataataacaagtaagttataagagagttgttgccttaacattgaagaaaataaaataaaagaaaaaacaaaacacacacataataaagaaataaacagtagataagaaaatgggggaagagaataataaaattaacaactttacttgaaatgctccattattgaatttaagtatcacagtcccattttttgatcaaaatgaataacctttactgctctttatctcggaatatttggaaaagattagaacagcggatattcagaagattgttattatattcgtgaacaataataatgcccaccaaattttcacgttgaaattcttcttgattaaaatataaaagtaagaatatgattctatttctgtgataatagacaattgtgctcagtctatttcattgtatagattctagaccaacgtaatgtatgtgaatgtgttatggtattttgcagtcttttacggcgccgacagtttatggttcttcatcttaaaattgacaattcccattacattattttctgctacactttttgactatgcagcattacaaattccaatttttttcctaaaatgtcagaatatctctaagtatcattgcataactaaatttatatatgttgcatctgagaattttagaaaaagaagttccgtgaatatcgcaaacattaaggcaagaacatttgcaaaaaaaaaagagaaacaaattcaacatccagcagaactgcagaagtaatgggggtgtttagggcagaagacaagaacattagcaaaaaaaaggtaaagattgactggttccatatgcattcatgtcatgcaaaatattgaatcgaaccatcacaagcataaacattaaggatttctgttagacaaattaacgttgtaagtactaaaactagctagatttgtgattgtcacatatcaacttgttctacataaagtttgtaagagctaaaactttaagcgtgagctttttgtgaaacaaatgaaagttagatattaaccgttctcttattctcgagatgattttcaatcgatggttatgctacaaagttggctcgttcaatataatgagctcttgtgtgttcaacatgaatacatgatatttttgtgctcgttaaatactcggtttttacgaaatgaatttttttaagagttcgaacctaaaacccgaacttgattgaccaatgtacattcatagtagaatatttgctttgtacctgaatctgcgtttatgaaactacgtctaaagattgaaccaaacaaataaaccgagttaaaccaaaatctagatcctaccaaatcaaaacgaatgaacattcaatttagaaaccaaaaaaataaaccggacattcctcattagattctctatattattcttttgtctgtaattgcgtttgtacaaaaccacgtttgcgtttagattgtttaaagatatttattgaaaaaagacccgcgtgattaaaatgtgtaaagaaagttcctccgttattaccgtccaagtggatctctaagagaccgtacaactaactccactcacggcggcgcattcccaatctgctgacacgtttctgcttatcactctctctttttcttctcttcttaccacacctggttgactcaaccacgattcgtccctaagcagcc

SEQ ID NO: 3111 - DNA, 2000 bp, Arabidopsis thaliana
gtacatgggtgatatttttagagtatcacaaatccaaaaattatttttatattagtaaagcaattagaatattcttgatcagtatcagcccactgatatttgtgatatcagtatcatctgacgtggcttcttctgattggtcacatttgataaaaacaaaaaatattatttagatttattaaacaaacattataaataatactaaaaaaactcttaatgatactttgtgagtatcacctatgaacatgctctaatagtgttgatttttgatgagtagttagcttcttcttcaatgttttaaatcatctaataaagcagggaaattaaatagttggtgaaattaggtttgtaatatatcatgtatccccacaaaacacatgcattcggattttttttgttctttttagaggaaatgttaaattttattgttttgcacgcatgagtctagactactagatctacaacaacattaatgaaatacaattcacataacaggaatccctttaacataatcttgtaatttgccgttaagcgcctcaaggaagatgatttttagtaatgcaacctcaaattaatgaccactattaagattgtctagtgatcacatgatcaccactatatattgaaccttcattatgaggtatagccggaataatgcgtacgtaggatttaggatcactagaccatcaaatgaattctgttattttctgtacgtagaagatggatatattcaatagttgaaaagaagatgcttaaacaaacgaaaatagactactactatagtctctacatcacgtactttgtctaaccgagagaggaaggtgcattaattttgaacgaaatgatttttatcgatcctgaacgtatctttcatttctgtttttgtatttgtatataaatcatcaatctcacgccagcatatgttttatataaaatatatatatcaacgtctaattgtgacgttttgcatcaagagacgatgattgaatccttaaaacctcccaaatcaaccattcgagttttgtccaccaaaatttgtacgattaatcacatgcgaaataaaatttccaaaagtgttgtaacacaaacgtgacaaaagctatcttattatataaactaatacatcaattaacttcaaaataaaaagatggaaggtgttttataatgcagaaatgataaacttataggattttttagcttaaagaaaaaaggtacaaatgaaggcaaaacgaattaggttaaagaagaggttcaactttaacttccacagtaggttgtttgtacttgtttgtgctcatctttatgacttgtcctctttaactgtaacttgcacttaaaccattcacactatgtaatagtataacatttgtttttattcttttccccaagctcacgagtttatagttaaatatatttttacagagaaattgggtataacatgcaagtagtgtaaaagagggcgaaaatgagataatgaatataacaagaatgaaaaaggtggtctctactttctctcgttagatttggaacaatgacacatttcctttaactctccattgatgttgacctttcattttttctaactatcaacatctcttctcttccccacctcacttaactatcaagagtgatggatttttactatatttactttacacttataccatcttacaaaaactgacaaattaacaagaaagatacgcgtatattcatttcacagagtggctggctatttcagttcacaagatttaaccgcaataatgaaaggctggagaggacttttgtcaaatattcgaacttaggtaattacgaaaaggccctttgtcgaatttttaactttgaagggtaatgttgagtaaattagtaattacgaacagtaaaaaattgacacaagaaaaaggaaaaagttgttgagaatgttttgaggtagagaggagaagtagaaatcgataaaggcgaagaaggaatcgcaaggaaggaagaaacttgagaggaagatc

SEQ ID NO: 3112 - DNA, 1206 bp, Arabidopsis thaliana
tttgttcttttgcatcgagtttgattttcttgtttaaaacctccagtcttgaaagatttaatattagaagaggattcgattttcaaaagcaatctctttcatatgtgatgtgactacgtgtaggactcattcctcccttctttttcatacgaatccactatgtatatttgtaaccctgtttcacaactcttttaaggtatttggcttttaaatttaccggttccgtggaaactgaaccccgcaaatgcaccattatattcaaatcgatatctttgaaagcttaagcgaaattctgtagttttgtttttcttatgatgtcttttaaatttacatatcttgcattataaatagtactgattcatatccccgctgtagggaaaaatgtatttttcacattttcaaaacaaaatgtggagattttaccattttccctagccaacccaactcacatgccaatctcgctcgatataggacccaatacaaaaacaaaacaaatatcgtttatttccgaaactaatgacactgacgcattagttgaaaataaaaacgacactgacgcattagttgaaaaatacaacacgacgaattagcctaatactcatctggtccccttccaagttccgataagctgagttctagtaaatttcgtggttctgatcgtttcattatcgctggagtcagcagtagatgacagcaacaagctataccagtgtgcaacgaacgaagagaatgaacaacacacttgattattcgttttttcaagctacaataaccacagagttacattttcgattatttatttatttatttttattttgaatgaactgttaattcacacaaaaaaaaacaacatgttttacaagtatggtcatagactaaaaacagagctttacaaggacatagcatttgctgcggaatataatttaattctcgaaatatgaaagttgctatggaactgtgtcgtagttctcacccattattacaagtaaacgaagggactcgtcattttcagggtattatctaaactttcaaacattattgacattttaccatcgactatgtaggtttagggaccacttattagtttgatggattcaacattagaaaaatcgcagagaaacttcacttatctgttcgaacgggttagaaacagatacatgcgtaattactaacacaaagatcacagctataatctcgtaaggcaaa

SEQ ID NO: 3113 - DNA, 2000 bp, Arabidopsis thaliana
attacacgacaggttagtaccatcttaaacattactgtgacttttgtcttgaacattattgtggattattatgtgttgaacatttctatgggttctgtaagccaatatatagcatgaacagcccattggaaaataatttcattaaactccggtacaccggaagttctagatcgaagagaaatagaatgaagaagctaacaaacttttattattaattaacagaatgttacaacaacttaatcaacaatgtcattaactaagcttatatacataagattaaaccaacatcaataaccagaaataaccaatatgtaaaccggtccatatttgcaataattatatctcagaacattcattaaattgttataaatgccatacgtatggcccatatatttttaatactaaaatagcaattttggtgaagaattttccgtaaatccatcacgaatgttagtaggtatgtggtcatgatggatttgttgttttgttgttacagtttcaattacgagtgattgattttaaacccgttgttgatagtttggcaactcattgctatgagttttggtgattaatgatcacataaatttttgaaatttggttgaagaattagcagcaatgaaataaacatgaatttactatcgaaacaagatgttatcaccaaaatatgttggttttaccacaaacaaaaatgcctgatatatctttggtttagaaaagtaagattcacataacatgtattggtacacgtgtcccacctcctttcactgtagatccgcccctatgttgagcagacagataaaacaacacgagcattaaatagatgggacattccatagcccacaagcaatttcacgaaattaaatgagaaatgggtcaagattggatcactcgaaaaactgaggaaaaaaagaagaatacgtaaggagttgaaacggaacgtggactatgtcagcccgaagaacacgtttaatgactatggccccatgcaggaccattcccctttttttgaggtgttaccctgttagatccatatttgttttgaacactatcaaaaaatatttgctaaagaaaaacactatcaaaatatgttacagtattctcttccgttttgcctaaactcgaactcataactttaaacctcctcttttaagattaccatatgcatgtacataaactggtttaacaccaagacaccaaattttaaccacaaaacaccaaacaccaaatacgttggatatcttaacctatttcttactcacttaacctttgtgtgtgtgtgtgcaagtgtattactatatatataaagtaaaatatatgcatatattgttaaaaatatcacattaataatggagacggtttataaaagataagaagttttttctttcacttattgttagttaattttgaataaaacaaatcataatttcacatagtattaaacctatatatgtattacttaaaaaggtaaaatttgatacgagatgaataaacaaaaaaaaatcaaccatttcaaatttacatgttaaaatatctcgatttggatatagtcatatagagatgattttatattgatatataaatcgccttcacttattggcaattagtattgagttgaaaatctataatttttctacatgcattgattcaactattatctttcacatcatgcattaaattagcttgggttccatcgtacattagtgtatacatatgccatcttcttcatcattagataatttttcttataaaataaatgcaattataacaatttgattggatatgtcttgtcatttagttgcggaaaaatcttgacgtctcttcttgtctgaagtcttaagtatataactggaaagtccgtattggagttcaacaaaagaagaaaacgaagacttttagttagatcctacattactgaactcattatatatatctggtgagacattctcctatatatgcagtttcaactttcaaagccagcaaataataaacagaggagaaat

SEQ ID NO: 3114 - DNA, 584 bp, Arabidopsis thaliana
tattgtttttttttttggaggggatgtatatatagtttgggtcgtttaaccttgttgggccttattgggttataatgggccactaaatggatttttatatgatttcctattataggtgctgtgtttgaccatgtctaaaacaaagaagtgtttggtatgacaaaattgatgaacctactttttgagcagagtggtaaatgtgcggaaataagcacacaaggaaatcgttgttggtgactaacaaaaggagttatccactgcccaagcattaccaactaccaccaaccaaactcaatttggaaatttcaaaggtccattagtcaaagcagcattaagtcattcagtaatcaacaaatatattcatatgaaacccaaaataaaataaaataaacacttttcaagaaaaaaataaaatactgagtactaaactggaaaccctttataagcaaaaagaccaaaagttaaaagttaattaagatttggtttaaggcgctttgctttattagagaggaaggaacgaaccatcatagaaatctctccttcgttcaagtttttctctactgtgttggttgagcaatcgagtg

SEQ ID NO: 3115 - DNA, 2000 bp, Arabidopsis thaliana
gctagccaaactgagaatgcgttagtgtggaaagtaaaaaatgattacagcccagtcttcttgttgttttagaccaaataccttcactaacttaatattgaagaacaatatgatctctagttacaaggagcaagccaattatgatctagtttcaaggaattggctaattatacttaaaacccctaaagtctaataggaaaatattagatcatgagggaagctaaacccttaaaactgtgagcgttagtccaaccaccatggccagtcttgagggaagctacttgaaatatttgtttgtggctcccattttgtttaacttttttattactacgaaactaaacttgaattaatattgccataactttttcataagaggataggaaaatctaatatgaactctatcaaattatatgtttcaagtaagaatacttaaaatgtttagctgagctccattatttttgaaaacagctaaaatattttttagattctattaattaaaattaatacataaatgatatgatacaattgagaaaatgaaaaacgcccccgaatataatacgtatgtggcttcataatcgtatagttgtaggatcgacccagcacaccacagccgtcactagtatttaatagattacaagcagaaaaagaaatttaggtctatttaattagtgaaaataaaaaaataaaaattaaataaggcaaataaagtttagatgtacaacttgaatctttaaacctttgacgtatctaagatgcaaacaaccaacttttctaccgaaagttataagataatgaggccaacattttatttatagtaattgaggtcgcaagcatgggattggcccgcttgtgctcatgaacggctatgcacctaatcacctacaaaatatcaaaacaggaaaatctatgtaaagtgatcatggagatcataaacttcctagatgcttactatgacattcagaaacccacttgaaatgctaggaaatgtattagtagacatcaagaaaatcagaattctatatttaatagtcatgtatggacacatactctattgtgaaaaccaaagatttattagtgaaagttagcatccaaataatcctgatttgcttaactttcttaaaaatccttaacagtcttcaaaatctactttacccaataggcatccaactaatctgaattatagtagatttatcttatagtcagtgtcgtgagtcgtgaccagagttatagaagcttaatgcagtcttaaaaattgtactcttttcaaaaaactattttcgtatttataaagttatcatcttggctatttgtgatggaccgaagggatacgattattgggttttcatattttggtgtttcggtcttttcctttttagtattggttttgagagttttctttttaattatgtttaagtcggtttgtatgaggatctatataagatcctcttataatcaataagaaatcaaacctccaacaattaacctaattctctaagagagacttggattaaaaggaaggttttgcttcaatatctatcttgttctacttcaaatcacggctccaattactagatctaagtcaaaggctttagctcataacacaatgctatttgatctcagcattcttatttctctaatttctaaaagaccaaaataacgcaaacggcacgcagtttagctctcaatacccgagacaacacttctcgtagtccgtacttaaacccgccacgtagttcactttattcaacttaaaaaagcatgacgttttggtacatctatcttcttcttcccccttcctctctcagcttctctcccaccactaaggaggaacgttccaaagatccctttctcagagaattcccagaaaaatcttcaacaattgaaaccctaatggagaatcattcggatccttgaatcctttggtttgtctctcacctccatttctgaaatttcattgctttgtgattcttctgcagattcgttttgaagagaagaaagaa

SEQ ID NO: 3116 - DNA, 2000 bp, Arabidopsis thaliana
ataaaccagaagatgcaacgttcgtgaacaaactcgactgatattctagatggttttatttattttttacttatagaaaggaacaaattagatttaaagataatatgctctaatctaagagtttggaaccactataccacatactatatcccatgattaaaaaaaatctcaattattatagcgcaaatgattggttttcatcagttaatagaacttgctgagtgagtccccaaatttgaggatgattagtaatttagtatcgtaaagactaaaaaagacttaagaaaaatagtaatgattagagaagtcaaacctttaataattaagatagataaagagagacaaggttgctcaaccccacttggagtgtgatgcttttttggcagtgttcctttatgataacacatctcttcacacacaactttagtgtatcacaggcccatgtcactttaagataagataacatattctagtatatgattattttcatatttgtaagtgtattaaattattcatagacacaccatgaattaattgtaataatgcgaaggacctgtatcatgtaacagagacagacgaagtgtgcagaggtcggtgagaagcaatttggtcaccatgctccaactctcttctctaggtcccttttgctttaattttctcgtttaataacaatatcttatgaaagcagttaccatatcaattgaaggattgtataataccgtaatttatttatatatagtacatctaattaaacattaattatttctactaatagcctaaaaccactactaatacaacaactagtacttgtttacgataattattaaacttgtctcgatacctacaacatgcccaaaaaagtaatcaatactttgtttaatcacaaagatctcagtgagatggttctatagatagtatttctgatttgttagtatattagagaattgaccatctattaaaataagagaatgaacactatttgataaaacaatacatacgcaattatcattgtctttaatttttatcaaagtaatcatacgatcgactatttgtatgcaaaaattcatcattttatttgcaaaaaaaaacaaacaaacatggtagaattgtatttggtgtgtgttttaacaaattgttgcaatgtttagtgcaacatatataatccactatatataatcattgacataattaatatttgattatatgaagcaatttctctttaattatgtgtttataaatatagggagaaaagaaaaatagagagaaaggtaaagagtagagctaatgattcgggcgacgctaaaaggttgaatgttcgagagaaacggagtctcagagactgtgaaaacaaaaaatcaaaatcctcagttacagacgatttggtcccctctcttctctctctgcgtccgtcttgtgcgtcgatttgtctccatctccttctctctccgcctactttctcaggactactccaattcgccgactttttctcctctgttctctgcatttggattgatgccactttaatactttgaggttctcactctctctttctctcttcgctgacttcgattgcttcagtaccctttttctcaggtcagctacgatgatagctttattcagacaagaagatcaaagttttgatctttttgttttggttttcttaagagatggttaattaggtcttgagtgcgctgttttgaatcgttcttcagtgtgattaaacaattggttttgatttgactaatcatgttgccattaaactaagtgaaaatctctgctttttttatattgcatattgatgattgagacattgatttcttttctatttctttatttcccagtttctaatttgggaactgaaaagttttctaatttaagcattacaaagtgtacaatttttgtttctggcaagtttttcttggcctaattcgtctattttatgaattcacctttttaggatcaagacttcgtaaaagattgtttctgtaaaacgcaacacc

SEQ ID NO: 3117 - DNA, 2000 bp, Arabidopsis thaliana
atcaacaactaaaaaacgaatcccatacttcatgtaaaaggtttaaaaggtcaaggagtttccactatatatcttcttgtagccaaaagttcaagtcaataagacatgtttttataatgattaagcgcataacagtaacaaggggttaaaaaaatagaaaatgcaaaaaaatgaaataaacaaatgcagaaactacaaagaagacgcgcttgaatcgacgacataaaagaagacaaaaaaattcgacatgacccatacaatccattaaccaaaaaaaaaaagaatgaaaaggaaagttttttcataggtttcatcaactcttagtaaagagagagaatggatctgagatcaattaagccactaattgattcatctgagatcaattaagctacttcttagagcgagtctaatccttacttctcttcgtggagtcaacaaattttgttgttgttccataacgcatcttcaaatttcaattgtttttttcattcataaacttgaatcacaggcttggtcttggaatcattggtcaaaagagagaggctacaactttaaaaggtaaaccaaatatgaaaagaattgatgttgatcttaagcttatcttgttccctttgctgctcttgtttagtgtctcggtttttgcttaggggagtctgtagatcgagtccaatacatcttcttggcatgagcttagtcgatgcattgaatcaatctcgaatagtttatgcttctgtttttaaacttttttttttctttttgcatgaaaccatgtttttaggatttcttttatgcaatgttttgaaacccgatccggacgatgaaccggactaccttttgggtcaccaggtcatcgggtcaactggattagaccacgaattaattagttaaaatttatttaataaatttaatattaatagaaattttagagtattttataaaaaaaaaaatttagtattataaatataaaacaaaaataatcatatcatatttaatcaaatataaaattatattatgtttaacaaaatataaaatcatttacacccaaatatatatagaaaaaatcaaacaataataataaagtggttaaaaatttgaaatccaactaaatgtctaacaccgtaacaaatatattagaagatcatcaatgacagaaataaattaataaaacattgtgaattcaaacaactaatctcggttgtctctctcaccattcaattcaattttaaggcggtattgtaaagtcttcaccaaaatctaaaacatcaaatgaatttaagaactgaaaaaacttttaaaaataattgaataaattctaaaatctcatattttattataaaatcaagagaactttttaaaacccacacccggccggttcaaccggttcaccgggtcacgagttaattgcgagtttttgtgggttttttcggttttgaacttgttgggttttagcactaaacccaaaccggaaaagtgttcgggtcacgggttaaccggtcggaccggacggttcgggtcgggcgtgaaaacactgcttttatgtaaaaaataaactttcattttcactaatgattttttttcctattaaatcaaaacccaagaattaatatatgaaaataattaggggacgcaaaaaaatttaaaagaataaggacaacgatgtaataaatgatttttataataaatgatgtttttatataaaagaggtagattaaatgagattttatgatttcgtttgtaaaaaccttaaactacaaccaatatgaaatagagggagtatgttttactcggtagataggttactattcagtacatcagattcatgtcgcattaattggattacaaagatgtttgttgcttttataaagggtagtcatatatcttccttttgtctatgactttataacatttcaaaattttaatcctgaataggccttcaataacgttggaccggctctaagaggacaaagggtagtcttatatcttcagtcttctacaagcca

SEQ ID NO: 3118 - DNA, 590 bp, Arabidopsis thaliana
tgtgaaaaaatattgcgacaaatggttttggttcgtaagctggtggaagactcaagaggccaaaagagactttggttttatgctttagaagacttttgattcatcctaataagtattcggattttggagcatttaaatgaatcatagagggaaccggaccggttgaagatggttgtttgtttcgactaggcctgaaggaccaaggttatgcatgtacgattatgtatcaaactgaacgaagtcgttacatagagtttagctcaagcatatcatcatattcttttttcgatctttaagatttttctctaatctctatgctataaatcattaagatttctctaaaaaaggattaatttcccttgagataaatagctttaaaaataacccagatacaatgggtttatatgggccatatatattttttgtcataagaaatcggcccatagttagcttcaattcaacgccgtataactatgagtcgttccgatttcctgtgttgcgaaacccccaaattctcttctctctatctctctcgcgtacgccgcaccgtagcgaccaattgaatccacgaggaaatctcagtaaatact

SEQ ID NO: 3119 - DNA, 1951 bp, Arabidopsis thaliana
ttattttcacgttcttaatagttggaagatggttagataataattatgggagttgggatggtttaacaacaaatgttatttttttgggcttcacttacgtatacagatttataattaaattgtgacgtatagacggaaacgtaaactaaattaattattttttgttggttatgtgtttgtagagtatgggaaatgcgagtttccaacagggcattgaaatggatatagagaagaagaggatcgtgcggatttatttacgttatttattttgatacattgttcttttgtcattcgagtatatgatttgcgtatatttatttttattattgtatatttggttggtttcatcggataaatagtcagattttctttcccccttaagccttaacttctttgctcgtgagtttataaaactgacaaaactttgttgatataaaccattatatcctgcaactgatccaataaacaacattgcaatattattttcaaaatctcaaattgattcgttttgctggtgatcaactgatcatgatccaagcaaaactcaacagtatatattgtccatattgtttcattccaatactccagagtcaaaaccttgagctgcctacttcatcaaacttgattagcgcctaccatcaattgagctacgactacactaccaactcccatatagaagcctgtaactcgaaaaatgggttttgagttatagtttgtcacaaagctctgtgaatacattatactacatgaaaactcatcaagtcttttgatatggaatcttcagaaccaagaatagctttaatgcttttatagttgtgaagtctgttattattctattactgaatgtgtattctcctccagaaatatctaagatcttagatgagtcagtttagacgttttaaatagcaagaatgttctgcttttttatgtcattttaaaaagcttaaggttttggattgtaagcatcgtgtggttgctaatcgaacttccttccctttgcattattgagatagtgtactcgcaaaacacggtggcaatttaaccaaaacatagtacaaacacggtttcaaaattttaaaaacaaaaccatatacagtacttgattaccatcccaagacttacatattcttagatggactatgagtctatggctttttcttcaactactaccaacttgaacttctcctccaaaccaattaagtgggctttcaattggtcatgccttctttccatatcacgagtttcttctagccagcgggagtgatttgatggaaaggtggtcgcattcgtggagtatgcttttgtaagtcttgattggaaaagctgtaaacaatgctctttctgaaatattgagggctagctttggatcgcgccatcgcggctaactcttggcaacaccaatggcttccttgtgtcttcttccatcaaagcgtgttcctttcattaattacattctcttttgtggccttctattatattgttgcgtagttttcagtcttttatttctcttcgttgtatctccgtgttatgtaaaaaatctaaaatttcgtataaaactttaaattttaccaaaaaaataattaaaaacagacaaattctttagaaataaaatctaacaccttttatattttcttcataaacaattgaaccaaaaaaaaaaactcaaatccaactcctctcccctataaaactctatcttattgatgattttgctcaaaatgtagtagtaataacaatgacgaggcctatgatggatcaggattcaggagagcattttgggccggatccggatccggatccggatctgagcctggatccaattctagattaccgggtttgagtatctgcgtcattcctaagctcactatactctctgtttaaaaaaacctatctctctctctctctctcgccgccttcctctcaccctcttcgcatagcttcactttcgccg

SEQ ID NO: 3120 - DNA, 1569 bp, Arabidopsis thaliana
tacaccaaaaaactcacgattacgaatctaaatccgtttctcggaggtaaaaacaaaatatctcaagcataagctaagcgcccatgtcaatggaagactcaaagcttttctctttacccccgaatcgtggatttttttatgttttataaacagaggaaggtatgattgtaaaatcaaaagtatgggggtcaaaagttggaataaaatataaatgtagggttgcgatgtttaacttaagaaagtgcaaaagtgacagatgttcaaagaaatcacgtgttttgccgacggtattaacgtccgtccgttggttgtgggccgtttgctagctgtccacgtggactctaatgatgactcactctcacgtctttaaattattttgtactagtgtaaactaaaccgacaaaatgtaccaatataaaatgttctaaacgttctcattttattacgataattccaaattcactcttttatcaataaatatatctaatgtaagaaatgataaactataatttaaaaacatgaaaaatctattcagaccaataaatcttcatttttgtagtgttgtaaacgtcatacatccgacatcaaacagtaactaaataacagaattggaattttcaaattgtttaatatttatttaaaaaaatctgtttgaattacggataaaataattgaaatattgaatatttcttaataagttttataatcttaattggctattttaaaatatttggtttgggttttacattttgggccaaatgttattagcccattaaaataaaaagggtccaacgccgtttgttttgttctgacggcgcgtgactgtcgtcccattccacgtgcgggcacgtcatcttatatactaccaagtacaactgtacaaggaccaaacaaccagcatcttttgtctcccgtcggaatctaaatcaactcctacttctttctctctttctttttgcaactcccccttaacttttagatttttacaaatttcaaccctataaaaaaattatgacacacccttacccatatgaatcacacttactcataggcacatgatattctctttgtcatactctccactaaatctcaaaattttgagatttgttgttatagacaattcatgtattctattgtttaacttatttcagttcaaccaaaattttcattaattcgaatattaaaaaaaaaaaactagtaacaggccattccaaagagtctgttatcaaaatgtgttttggtactattatgttgaatatttcccacctttcattttcattcataaacttggtgacgtggatttattttgatatacaagtaaaaggttcaatttgtaaatataacaaaatattgggagctatttcgataaaaccaaaacaatgggccaagaattaaaaatttaccatgaacatgagagagtgagagaagaagatcgatcaatcaatcatcaaactctctgtgtgccacatgcattactactgttgacttgttcaataaaggtaaagtaagatcaatccggcgaatcttctttcgttttccggcaccgatctcggtggatctccgattcac

SEQ ID NO: 3121 - DNA, 2000 bp, Arabidopsis thaliana
attccgctcaagattaatgtctaacggtcttaaatatacaccaaatttaacgtaatcgattgaaggtattagataaggaaactacattaaaccattcacttttaatcactagactactgaaaagtttcatacctagctagtactattttcttcagttctcaaagatatgttaataatgtaaaatgtattgtaaatatgttaagacttaaatatacctgaaggagataagggcaggcacttaaggtccttgcccctcgaaaactgttaaggaagccagaaagaactgttccgtctaatttggttatttgattcggttcatcgtaatcgccctctgcgcagaagtccaagtagacttgttttagtttcctattcattctcttgacatggaaggagagaattgagcctgatcgtacttaaagatctctacattaggcaggtcaaaggaacaaggctttttagggaagaagtcgcagttatcgaatacgaattctttcatatctcctgcaaagttcttgatatcaatactccagcagtaactaagacttagactcttgagcgtaggagagtttgataacaaagactcggcctctgtgagcttgatccaaccaatagagagctttctaggcaatcccgagtttttgaacttggagggatcaagcccacacgcgtaaatctttagtgattcgagatttgtgtttaaaatccgaattaaaacctaatcaaattaaaactaaaccaaaccaaatacaatccaaaattaaactaattttggttgagtttggttatagttttactaaatccaaattaacagaacataaccaaacccgaagatttttagagtctttagaattttaaggtgattttagataaaagagattaaacacaaatctcgaaaactaaagaaagagtttttgaaaatttttaagtgttttcatgtaaagtggatttctctgtgttttctgcattctgcggattataactcctatgttttttttctccgtcaattatatgtgtttattttctctattttcttttatttttatttttattctctatattagggtttagtttatgaaaactttttgttatctatataggcttgggggatgtatttaaattagaatttaaagtgatttgagttctttgagtttttaaataattttaacgattttaaaaaagttcgtatgatttttgtaaaatctattaaaatctcaccttaaatcatgggatttggatttctgtattttgaactaagaaaatcctctcaaatcctccaaaatcattaaaattcaaatccacaaattgttctgaataacagtgaattttaaggtggattttgaaataattagttcaataacactgaatttcatgagattttttaaaatacatgtttgaataacatatgatttataaattctacacaaatcttttaaaattctaatttcaatacattgtttttgaaagtgttattgactcttgccaatatagtatcccaattcccaacttgtgtttcattttttcatctatctaataaacaattagatgaacacaaaaaaatattggtaggtgatggctcaattggatatgtttttgaaaaccatgtgttaaaaacttaaaatactatccaacttaccccagtcctaccaactttttttttcttctcttggtctgcttacatgtgtctgcttatatctccaaaaggaaatagatatataaaaattcaaatttaaatatttgcgatttgttaaattttaatcaatatttaatttttgtttttttttgtttttttttatgaagacaacaaataaccaaatttatcaaatctgatcaaagcagatttaggattttacaaatatatttttttaatatgaattttgtggtcagattttgaccaattctctttgaaaaaaaaaaaaatctatctataaaaacatgtgttactttgaaaggatatttcaaggagaagaatatatttgactcagagagagattcattcagta

SEQ ID NO: 3122 - DNA, 435 bp, Arabidopsis thaliana
agcattatcaaactttggttatattattatgcaaataaaggcttatataaatttggcttttatagttgtaaatttcagtttaagatcaatattttgatttaagtttaaaccaaaagaaaatgagtgtgcagattgctaatggtaatcgactaatcgtcaattcttggccttacattgtgggggtatgatcgtcattttacactccgataattctgaacctcgcgtccatcgaacccgaaaatacgtaaacatccccaaatgtcttctttcttcgttatccatttgagggtattattgacctcacggtaagaaaatctacaatatttcacggataacgaaaacaacactcgaattaaaatttggaaatcaaaagtctcccaggttcctttgaaagatcacactactgttttttggactcgagcttcttcttcaaca

SEQ ID NO: 3123 - DNA, 1050 bp, Arabidopsis thaliana
acatctgtgatgtcttagacatgtgattagtaaaaaacaatctgtttgagtcacacccaacccaaactcttaagaagcgtctccttatttgtgataggtttctgaaaacttctcggctggtgagaaccatatgccacggaaacgcttggctgatgcatctaaaaggattcaagctttaccttcattataccaagaagtgagttttagttttagttttttgagagagaattaagaaagcaagaaagatatgtatctgaaagttttttcatattttgcagacaagggaagatggtatttatgcagggaagagaaggaagttggagaaagaaatgtgtaccattatacattaataatccttttattggactcgtcacaattttcgtctaccatatttatatttactgtactgtgtacatcagattatgttggatcacgttctcttctgttgtttcacttatcaactttacatgtttatcattgttctccaattgcttcgaataaattgtatgataacattctgtatttgtttaaattatatactactagagtactaggggtattttctttgatttcagacttttgtttatgatttgttacttgtttcacataagaataattggtcaaatttatttggtctctctttctcgcaaatcatatacaatatacaactctaatcttctccaccaaactctaatcttgttcatctttttttattcaaatagtttagaaagttcaaatatactaatctttatcaaagaataatctttagtcaaattttaataatgaaatcaaatatcttacaaaatggaaaaacaaaaatatgggtgtttgatttttacaaaacaaagatggaagagcaagtcagaagtcaaaatagctcgaagatgtaagtgacggcgcctgaatactcttggctggtagatttcacctacctcatttttttcatatatctcaaacgtggaatcgctgttactcagtttttatatataaaaataaacactcgctcttcttcaaccaaactcatttccaaaattccacaaagtttttcaa

SEQ ID NO: 3124 - DNA, 2000 bp, Arabidopsis thaliana
ttttatttgaataaaacatagggggcaactgccttctatcattcaccaaaaaaaaattcactcttgctttgctttatgttcggctaaatatgaaactcacacaaaatctatcagtcctttttattgtcgtcatactcctttctttttttctataattgtttttaatagaaatgtgctgggccggccctgcaggctagattttaaaacatgaagctttgtactaagaatctgattttgcactattacacgatttactcctttcgtatattctctctatttttttacatattcgatttacacctttgtttccgtttctatgttttatagtgattttttttttttttttttcacatgttttatagtgattttttataaaatatttgcttggctttctcgatgtgataagtgaaagacgcgattcgttgtggcaatgaatgaaaagggccccatttgggtcctacagatattaaggatgtattgtctctttggcccgttttcaaagttacttgggccctccataaagtcaagttgtgttttcattttttgtttactccatcttctcacgtttcctctttcaccattttaccaaaaaaagttacttattatttaccaaatcaataaactccataaaatcatgacgagaaaaaaatataatccataaattgtttcatttaggacataaaacagctcttgtgagttacgattaggcttaaatcgaccataacttccgattcattttatgtatacgtggcgaaatgcaatttgtagaacgtggtgaagacaaattggttataacccgtcgagtcgtgcttagagctgctggttgacttgcgaggcacaaaccatcgttgtctcaagggacataattgtaatataacacattaaaccgacgctttttataaactactttcccttattagccaatcataactcaacgattactacaaaaatagacgaaataagacataatgaataaataaatatgagaaataaaaaaggaaatctgttagatccttgtcttcaataaaccactatatacttccaaaaaagttattatagcttatgcatttgtttttgggttaattcgctaaaaaaatcaaacatttgaagttttgatgttttttattctgtcttaaatttattatttattataaaatatgagaattgttatatagacgattttattatagacaattccttctgactctctttagatccacgacaaacgttacctttttctcattttctatgattttgatgaacactttcaatgattttccctgcgtaaaatcttgacgaatgactataattgtacatcgttggagatctcctgcatacttgtctctattaatctatcgaagttttgaaattttaaagtttgtgtataaaatgatacggtaaaaaattataactaaaatgaataattgattttgtgcatattttacaaataatatgatatcatgttattgtattttattacatgttattttgcaaagaaatctctatattttaattatcttccaaattaacttaaatgttttatgattttttttttgtttaatttcttatgtaagcaaccaatgcaaatttaaattcatgaaatactttactttcttttgtagcattcattacgatgtgtcattttttttgaaaatcaaaaattaataagaaaaataaaatggataaaatgaaaaagacagagagtttttactctatcatatctgcaccgcagactttatactgtaaacaaaattttattcatatttttcgagatctgcttgaagagacaaacacaagaaaatcacaaaaaaaatctctcccattaaaagactgcacaaagaaatattttatacaaaatgaaagagagaaacacgacacgaattttgtataattaagattacacaaaaaaaagtgttagaaagagaaatatcttcttcttttttctgtgtgagttgggtttgttaaagttttatcctttttgttctcaaaatcaagaatcg

SEQ ID NO: 3125 - DNA, 1442 bp, Arabidopsis thaliana
tatttcctccggttacatcaattctaataaataacccaaatggtacgtaaaaactgttgtaatttacttttgttgtgttaaaaaccttgctgatgttttgattagaaggatgatttactttattcacgtgtaagattgagatatttaagtacttgtaataaaagttgagaattagggtacttgtaatatctttagttatggttgattgattctatcattgtcgatgtcttggtatagtcaaactttggttgtgtgtagttagatttttactttgactgatgaggctaacgaaagtctaagatgacaaaagcaatcttatgtcatattctttccatgatttcatcactagtcagagcctaaataaatctcttattagacaccaaccacaactccatatttgttctaagtcaaacaaaaccaaatctcccatgaattttcacatactcatttattattcttccattttactatttggcattctaaaagtcaataatattaacagtcaaaagccattcatctgtttttggtcaatctttctatcatttgttggccgtgcgtctagccgtcaagctatccaaattcatattcaccaatacttatcaatttttcaacaataattttcggtttattaaaaaaagtatcatcatatacgactttagaaatctaataatatcaactacccattaaactacaatttgtttttgtcaacaccgattttaactacattacaaccttccaagtttgaaacaaatgcattgtctacttcttccctctcaatttgaatttcgattttcatactaataatatgatgatttatgaaaatggacaaaaatatctcctttgtaattatccaaatactatttggtaataaatgcaatttcaaagcacaagtcatatactcaatcttttgcatactattattttcaaattacatttattgcttacaaacacctcatattataattattttctacaagaatatttattttgaaagctagatgaaactaatcctactaattcattaatatacattcaatgagaccctctctcatcttgcgtgtatcttctcctctatctatatatatataacagccactaacatgcagacatcaaactatctctctttaaatctcaagaacaagaactaaactactactagtcttcaccaaggtaaagctactttggaacccgagaaccaagttaatttgttctcatcgaattttttttgttctcatatgttgaaattttgttattgtcatcttcactttttgattgatcgatagaaaaataagtattcaattgatcaattctttttatatatatacatgttttataaaccatggatctccatctaaagttttgttttactgtgtttcttattctgattcttgtagaataatatatcaacacacatagtatactcttcttggaaggcaaggaac

SEQ ID NO: 3126 - DNA, 528 bp, Arabidopsis thaliana
ggttgatcggagattgagagagatcggcaggcggtgaagatatcaagatagaagaattacgacttgtttttctcgtggtagacgaaaataaatagcgaagccaatactatataacagcctgtgacttttctttagtgactaaccactcacagccgttgatgtggcacaaaaaaacacatgacgctttatgagataatcgaatcgctttttggtaatgaggtctaatatataaaaaggttacgggttcgaaatcagcccacgtcaactttaccctctaattctctcctatttgttttataaacatgttaggcctagctcctgatgggcttgttaaacataattatactgggccaaatttactctctaattctcttaatttatttataaacatgtaaatgattgggcctagatactactgggcttattatccaattatggcccaacctaaatgactatcgaaccctatactatcacaaaccgtgaaggtcggatctctttcttgatttggccgacacatctgatctaaca

SEQ ID NO: 3127 - DNA, 1723 bp, Arabidopsis thaliana
cttggcataacccatgtgaggtttcacgtcttggcgattgtgcagaggacaaaaaaaacaaatacaagatagaaataaaaaatgaaaactattgaattcaattagtgaagcaagagtgtgaaaattagaattttgaaaagtttggtttgcacataaaggagattgttttatatacataccaatggttgactaaaaatcaagatgacgtggtgggattggccagcggtcgaattcttatgatcgaagttgaaagattgcatttcgttgacaagagattttttctatatcagattcaaactttaaactctaagacacaagttctatacacacaagaatatatatttgtatatttaaccatggtacataacctagactactctccaaaacttgtataaaaaggattttattgtcatcctacaagactacaacgtgtcaacgtctacaatgacctaattaaacagaaccaaaccagtttttaataatgttgggctgaaattcgatttctaacctcttgaccaacaaaacaatcttccatttgaataaactacacgtttttggttcacttgaaaagtttttatcatcgatacgtcaatttatctacatttatcttacgtatgtttggtaaatggtaattgaatatgaacattaaaaaaaaaaaaatcaaacattaaactatgagttacgtcgttaatatgtaattgcttaccaattttttttttgttaaatttaagtcattagagaatacttaagatatactttacgtgtagggttggcggcttgcatgcttcgtgcattagttttagcaatcaaaaagagatctataatgagtatttttgtatgtttgaatgtaagaactaaggaaaaaaaagcgtgtatctatgttttccgtcaaaggccgaatatatatcccgatatagtaatgggccgaaacccaaaactaaaggcacatactaacaaaactacttctatagaaaattatagatgcactcaacacttttgtctatatactattcccaatagtttgttttttatcactaatggtagtagacatgttgatttgcacattgcagctacaaaactacaaaaaaaaaaacgagccatatggatgcttgtcagattgttactgtcacatgaagaaaaccaaagtcttatcttttatttttatacatccaagtagaacacgacacgattggtaaacgaaacctatatagtcaaaaaactcaaaatcaacggattttgtttactgtttgaattatgttcttgttagttagatttattcttttgtatgcatatgtaacaattttgtgtagggaagaaattatagtcataataactcattaactaaaaataaaatatggtctaatgattagactctaatccgaacaataacaaacaattattttcgtttagtgtctctcttattttatccaagaaaaaagaagtgtcaatttataatatcttctggaaagcagccgacagaaaattgtgggctcacatgaaaaaaatttcaatgatgcgtcaaaaagcaaccaaacgactccaaaataaaatcaaatcaaaaatcaaattctctacacgcaactttctttcaaatacaaaaccaatcatctcgattcatccaacccgcgaagacccagaaaccaaaatcgaagacccaacaaaacccacaagtcgaaatctcgaaatccgttgagagtttgttcctttttttgtttgctcggag

SEQ ID NO: 3128 - DNA, 2000 bp, Arabidopsis thaliana
tcccatggtcagaaaactcattcgataaccctacatttgatgatcaaagtggcacggaagctcgttcgatctacaagttttgtggtgaggagacttctcagtttttcttctagtgtggttgtacttcaggtaaattcttttcaatacttagtggaatttttcgctaactgttttgtgtaaataaggacgaggcctccatagcgttcagtgctttaacaatgccgtatccactctgctaatcttggatttcaagaggtatgacagtttgtgttgtgataggagccttcattaaattaaataatttcaacaatttatttatttttagaaccaaaagatttttcaaaaattttgattatcaaaaaaaaatccaacagattttctgttaaaatgaaaatatatattagattgtttttaaaaaaaatcatctgccggaatttgaatctggacatgcttattttcaaaaaaacattttagctaatgtgctagtgcatatgtttttgctaaggtatgaatttaaattggatatatagatcaatttatttattttaaaaccaaaaaaaatttaaaaagaaacttagcgggatataaaataaatatatattaaatttaaaaaaaaaagattttccgctacgggaatttgaacctgaaaatgctgatttttaaagaaaatttagctaatgtgctacatgagatgttttttttgctaaagtatgagtttaaattggatatatacatcattcaatttatttttctaatctagaatttgctttcctaggacaaatataggtactgaattattaaagaacatattttttggtaagatataagtgagtttttatataattttgatgattttaggtaagttgatgtgatttactgtaaagtcttttcaaattctatctaaaactatgagatttagatttctgtatttttaactaaagaagtcttttcaaatcctttcaaatccttcaaaattaataagaatcaaatccactaactattttcagtaacagtaaaaaggttgatttttaaatttttaatttaataacactcaatttcatttaaaaatttaaaatccataattaaataacataaaatttataaattttacataaattattagattgaatacaccgctctaaatatacacaatgtaaaaagtctgtttaagatcaattatagatttaacttaaatctaaaggcccataataccgtcctgtacatcatatagttatctcaagttgtaatactgtaatacccgttgggcccagtggcccatttatcagatttcaaataacagatctcaacactagcatggctacacacgtgtcagattcaatgcatcagtcatatcttcagcatccaacacttgtcaaccttccattggatctcttaactctacgcctcgaaaacagtttttatttatttatcattccatttctcattgtatcttcatcagtctcttcttattccattttttcaaaccacttgcaaaattcgaatcagatcttctcttcaatcgaaaaaaaagaaaggtaaatctctctctctctaatcatcgttcgtttcgtagtttcttcttctacgtgtagatctgatctttgattgtatgtttctggagatctcgatctcatcgattctctgttcttatcactgattcagtgtgtttgatatctaaatccgatttgtgtgtaggatgttaaaatttaggtttcggttttgtttctgcttttgaacgattttgctctagattcgttatccgtgaagaacatagacgagtatgtagatcttacttcggattcgcgttgaagaattttctctagattcgtcacctatgaagaagattcattgtgttcttaatctagatgattaggttattgtttcgactcatttgtttatgcctattttctctatgttcttaatcggtgaagaaatgtatcaatgtgtgtatgttttgggttctgattttgtaggatttgctctagattgttgaatcgaag

SEQ ID NO: 3129 - DNA, 325 bp, Arabidopsis thaliana
tttagtttgcaaattttcattctgcgaaatttttattctacaatttatgtcattatgctattatgcaattttagcaatcggaaccttaaggaaaaaaaccgacaagcgaaccgttctgtatgtatttcggttattttcagccagccctatttatttggttaagcttagattaaaaagtttcggtttggttcaatttgatatggtttggaggtcaacaacaaaatcaacgaactgaataaagcgatcgcgttggttctcttcttcaaaacaagctctctctgtccctctctgtctctctctttgggtaatcggaaaaatcagaaaa

SEQ ID NO: 3130 - DNA, 2000 bp, Arabidopsis thaliana
acttctccttgcccgtgtttctcactcgctttaccctaatcactccattacaactatacctacaagaccattaagataagcttatcaataagaacactgagataaagttgatctctatttacgaattgtttactaccaatagattttgattcgtaccaatcttttaaagtatgtatgtattgtttgaatagtagttctaccgaaccaaaaatattttaattgatcatgtaaaatatatttaagattgttgtgtgttaattatagtgatctttagaaaaaagagtagccaacgtgataatgaaagcgcgtgttaagagtattgaaacactcacacgcttgtggaggttacctgctaagtcggtcgatttgatcgatggtgggtcttttacacatccccaacgtcatttaccatttattcaacctcatatattatgttcttgatgatgaaaaagaacataatatttttttttttttttttttttaatttttttttgatgatgatgaaaaaaaaaaatattatgttcttttttaatttctttttaatatttttgacagtaattttattttaatcttattttgttacaaatagtttttaataccttaggacctgttggaacttggaaaaaaacaatattttttaatatctcaggatctttgcccatacatgttttgggcacccatgcgtttatatgaaaaacagcatgcagatgtaaaatataaacaactgtagatttggtcagatgttaaaatttaaattatgtcttttgaaatgtgacctataattgtccagatagatatacataactatttagtaattgtaagtctatttcctgtaatgtattcagctaaatgcatgtagataatctgatatcacatacatctatagccatatagagaatgcatagtaacatcaacaacatataaattttgggctattttctaatgagggtttttgagtataaatggatctcctaaaacgagtttaccggatgggtaaggtagtagttccctttgagttttctttctgctttgtataattaaaacaaagtaattgattaggaacttagtaggtcctaaagagaaccaacaatggtttcggttataaataaaccaaatgggtacattatccttatatctagaaactttaaccaaaaacaagatgttatctagaaacaataaatacatccggaatgagactttttcttatgtaagtcgatacaatgggggcattgttttatttcccttcaaatgaactttgctttttgatcattttaaaaagccatattgaaaaaatcaatgagataggaagatagatattataatattctttttataaaaaagacaaaaaaaatacactaaaacaattgaataagagtcagcaaaacaacgacgtccttaccttttttaaaagtttcccagttttgacttttgacctaaaccatttccatgtagaaagagagcaaaaaacaaaacaaaacaaagataagtaaaaaataaaaatgatataaagaaggaagaagaagaccgagaaaggtagacgaaagaaagagcgtaccttcctctttccttcttcgtaaaaaccaagttccttttaaaaggagcctctcctttctcatttgatccttcttcaaaaaccccaaccacttcttctccccaaaaacctccaaagtttcaatctttacttctctctttttctccaagttatcttcttttctaggtatgtcttgattctttctctctctgttttttcctatttcattcaggattctgggtttggttaaatctttaatctttatggttttaatggcttgattttgacgaaacggtcgtgtaattattcattactttgcttaaattggggattgattttgtgtataaagaagaatcttgaaaatgaaaaattgaaactttgaatcgaaagaactcaatttgcgttgctctttctcattctttgttgctttctcctaaaagtttttcacttttgaatcacaggaagagat

SEQ ID NO: 3131 - DNA, 2000 bp, Arabidopsis thaliana
aactagacaatccacattcaccggcggaaactaacctagactagtttccaacatcaaaagtccaatttttgtttcgtttaaatagatggcgcaaacgtacaactaagattagatttaagtatttaactctacaactaggttgagccaaatgacgacaatgacaatgccgacgactgttgatatacacaactaacgtttatctgattagatgagttcgtgaacggctacacatccattagcttctatttaaaccatttgttatgaaacaatgtttgacaactcaaatgaaaaagatgaacaatatttctataccaagtaccaagtgaaactttttgtgtttacatcaggtatgtaatcattttccgtgttcctttgttaaaaaccgtccatccttgattcttctgataatggtaaaactatccgtttgttaaattgttttattgtatttttatctattgtaaaaaactaattaaattttaaatttgctatgcataaacaatactgtatatacattttttataataagattagagaattatagtaccatcttgtaacaatgatgtaataagagacgaaaaaaaaataactaactgatcattaccatccataaataaatagttgctgccataaaccaaacacattgtgcttatcaaaaagaagaaatttgtacttaatgaaacattcattattagcaaagtgtaaaaccaaagaaaaacaaactttatttctcattttattagtaaaagtgaagaagagtaaagaaaaagagagactgagatgaggctgagagcctgagtctgcgggtggagagagagagaaagaaagcctctttacacgtgatttttaaaagagaccaaaaccccaaaagcaaacctcttttgcatgcgtccttaaaagacataaatttctctcaaaattttctacatcacaaaatcaatctttttctcttcttcttcgtcttcatcatcatcatcatcatcttcctctttctcttcctactgagatattttctccacattgagaggaaagctatcttctctagcgtcactcttcttcttcattggtcggtgagtgttttattttttttactgtatttctttttaatatagcggacgggtcattttctctccgtagcaataaattcacttatataaaataaaattttcattcttcttggagatattgatatttccactgctcttttcgatgtttattccttcactttgttcacttgctcttagtttttatctttcactctctctctctcacaccaaagttcacagcaaaataaaattaaaataaaaaagcttcgatttttcgattaaaatctttgtaattatctgtttgggttttctccgggatctcattttccggtttcaaatagagacaaaagattaaagctttctccggttttgtcttctgggtattcccaatttcccccatttcacttaaagctttaatctctgttccttgtttttgtctgtgattcttcttaatgaaaacaaaaactgtaaaaataaaaaaaaaacttctggtgattggttccttttattcttggtctttacagtgttttcttctaatttcatggtttcttgtctctctcttttttatcgagaaaaaaactacatctatctctgtaacactgtatgtatatacttcagactctgttttaatctctgtttttttttacctctctggtttctgaaactttgtaatagaagaaactagaacaacaacattttttacttcactgtttcaaagttttgatttttattattaaatttaacccaaaacaccatcatcatggttttgttttctggattttctccatttaatgcaatctgacattttcttataattattttttgtttgtacttatttttctttcatcctcatgattttgcaggtagaataaggccaaggaagggatcagttttaagttttgtttcattctttttgtagtggagaaaaagagtttttgaaaatccaaacaacaaaaa

SEQ ID NO: 3132 - DNA, 2000 bp, Arabidopsis thaliana
ataaaatacaatcgaatttatggaagcaagaaaaaaaaattacgtaggggaggtgtattattgggggacccagcacgatcaaaaagtcaatattcatcagccaatttgctgaataaataaataaataaccttgaaaacaatttttggttaaattacaaaaataatgatatccacaaacatgtgaattgttccagcaattgctgaccttgccatgaggcaccttggaagagccattgcttcattacaatcctttaaagccataaatatgagattaggattaccaaaatttcacatataacaaattgttttatatcattactagcttaatatgtgttttattatagttttagatcgacgtcatctgaatattttcccccaaactcctaaattttataatctgtgtctaaacctaattttatatttcaaaacatccctttttctggaagaaacttgtcttttaattttttttttttttttcacacttgtcttttaatttccttaagagaccaaatcaagttaatttagtgtactcaccacctttaaaacaggtcaagttaatttatttgaacatcagtaataaatttatgaacatctcttttcaacatcggtattcttaaatagtgttttagaatcgtcattttaactttatgtttcactaaacttagaaaatatttagttttttttatctcaattagtaattatcatttaaatttttattttctcggtttctacttcgccactattatttaacatattattaaacaaattagtattatacgggttgattttaattttccaattacaaattaattaaaattcaactttttgattggttgtataatccgaaggaaaaatgtttacatacgaattgttttaaaaacactttgatttaaaagtccgacctaaacaatcaacatgaaaattaaacttatgagcaaattaggttgatctagaaaataacttttgcatttgtctcatagggaattataaagttagtatctacacacatatatcaaatatacatgttatatctatattactctctctctctctctctctctctctctatatatatatatatatatatatatgtatattcacaaatccatgtatgtattttaaattttgtttgttttttttttccttcaaaatgagtaacttatatagaagtcattaagattagctttgcacaactctttgggaacaaaaaagaacccaaattttaagcattattcaatgttcatataattattatgtatattatttttccttattgattatcaattttatatacacaaaaagatatcagtgaagaacttatgattgtgcatattttctgtccatacataaccacaatattaatcaaaaatttaaatttatcttagatatttttcttatgataattcaatactgtataattttttaaaatctatacattacagttttgtcttttaaatcatattctaatatgcataaatatctagaaaaatactaactccatagaattaaatttcttatgtaagtttagtatattatcctaaatttgtgttaatgttaagatttctactaaatttgatactcaaaagtaaaaagtttctcttaatagaaaaaaataaatatagattctcttacattacaggatcagagtataaaaccagtttaagtaaacaatgtttcaaaaaacagtatgatatctgaaattttaattataaaaccaaaaatccaaagtcaaatatacgttttccaagtgagaaaggacccataaacaattaacaaccattgatgatcaccaaatcataatcaacggtcgaaatgaatgaaaaataaaagtctgaaacggtggagagtttcgtcgttttgagtggttataaaaagagaaggcgtatatctcctctgcaacagaagctcgctttctctctctctctctcgtgtgtgtgtgtgtgatcgagtggtgaaacgacagagaggggcgtcgttttgttgatttcttctgggtgaag

SEQ ID NO: 3133 - DNA, 1580 bp, Arabidopsis thaliana
agtagattggaataataataatagttatgttgttggctaattatacgacttgtctaatatatttcttcttctttagtgggtcgtcctctaatgaactttattttcctctgacaaacttatttacgttgatatattcatgcttctctgaatttccaagaaagtgataatatatgacaacgtaaacttaaatttgtgatgaattttgcatggtgatttccagttaggtttggatatcgtctttatctataatattgaagggaaaaaagtatggaccataatcgaacaaataaacttaattttcaaaaaactacagttaaaaatagttttttgaattcacaagttctctctagtagactttgataagagtttttaatggatagaatttgtatttactttcacacttataataataaaagtgatcatacataatgtttatatagagcttgagactgctacatctagctagtttcctaatacactttttcaataataaaaagagaagagattaatttgttttttttttaaaaaggtcaagataatagtcaatctcatcatttgctccaaaattttagtgttaatcaaatgtgggattatataacagactacaatgtaaatagtaggattctacaaactcaaaaatatttgtaacagttttttcttttaaaatggctttcaaattttgaggccgaatcgatggcttatgtatcttgttttctggggtctggctagatcatctgttagcacactaaattttgtaatttcctacaaaatgcatgaagaatattcccaaaatatcttataaggatcttcagtatcttctaatccattataagatttgagttaacagtttaaaaggtaatctcaaatgtcactgtaactctgtaagattttgaaagatgaacatgatcttgaaaaagagagattaaagaaaaagatggatttaagttcttcaacactctctttcttcttttcttcttgggcctaaaacaacccaatatctcactcttcaaacgagcccgagattctcaaccttgacaagcccaaagtgaagatagttttttagataaatccaaattggttttatgttttacaagttacatacactcccctatcttgatgattaggaaaatcagactttagatttttggtttcccatatgccaattcagttccatttgattggttgacgagaatcctcactccactctaatatttttaaatccatttaattgacacgtgtaacaacaatggacccgacactatcttattccgaccaatctcaaacaacattaaaatcctcttaagatacgcttcgaagataaaccgataagcctgtatctcctctcaaaccaatctcctccgtcaaatcaaccacgtcatctaatccaacggtagatactcagtcatcaaaccacagccacaaaactcgtttcaagaaacgaataaacttacaaaatcccctccaagtcttatttcttcacaaccatctctgaactcatctttcaatctctcttgattccaatccattcttcttcaagtgccgggttctcgggtcggatcttctaagtctagctagggata

SEQ ID NO: 3134 - DNA, 326 bp, Arabidopsis thaliana
aagaagggggagggagggatgcggcgaccacagaatcgaaacgagtggagacaggcagtaataaacactttggtcttttttttatccacttattaaagaaatgggtaatggtagtcgtgtataaaattgagagagaggtgtgtatagaaacgagaggcgaagattgcatcgaacgccgaaattgggcctacagtaatcccaaattctaatccttatcctcttctctctcgtttttattctccttcttcttcaatctcttggtctcctcgactcctcccagcgcttcaatatctcccaagacccaaccatcggagggagggggcgag

SEQ ID NO: 3135 - DNA, 2000 bp, Arabidopsis thaliana
ttggtgtggagatggtgaaggcaaacaacaaacaaaaattggaaatagaactaaaagactagaggtgagctaaactaaaggttttcgtggtaaatttgggatggagttaatctaatttgtgatatgttttttttagcatgttaccatgcattatgtacattcttttagttaaaaaatgttgagttgaagttaattatttttttatagcttaatatttttttttggtttaacaattagcttaattttgttatttgataaagactaaaacacccctggatgctcacccaccacatgcccacaaacggagattgccaacccccgggggagatgacgacagacgagaggagagaacagatttggagcttttatagcttttatagctatattgttaaaaaaaaatcaataatataaattaaactgcatgcaaaatcaaactcttgtacatctagagtcttactagattaacgtgtaagaacttagaacttggaaaaatctatatggacaaaatagatcagtcttttttcgaacatcatcaaccacacgaaatacgctagctaacttttaaacctcttctgtatcaactatcaagagacaaacgatataaaaaaaaaacaattggtgtatttttgaattttcattgcacgcacgtgaacagcataattgcttgattggaaacaaacctttttagaattcattaatcagttttaggtgttttggaaaattaacgaactatagtggagattaattaattttatattagtcttttttagtacacaaatcgaagtttcctagattttttcaaagttgaaaataatattgataatatttatcaacaatgaatctacaaaaacataatttttttgccaaacaaataacaccgaaacaagattcattcactatttttggtttaaaaaaaaaaatcaaaattacactattatgaagccaatttttgtatgcaaaaaacctgtatgtatcaatttgtttgtattaaaaagtaagcatttatgtcttttttttataaataatagaaacacttactagatgaatagattttttggttttagaacagaatactataattgtatttatatagcttttttatattattcgatatagaaaagtgttataataggaaaaatgtaccatatactgtcaataacatatttgattctaaatataaatagaattgttttaaagaaatatgatcgtttataattaaatggtttttaatgtcttttcttggggcaaaaaacaaagcttctctttcgtccatatatttgcatcgtaaggggtgacgtatcactctctctttctctcaaatattattcttcaatctctttttggggaatcttcgagcaaattagtgagagaacccacccactttctttctcatatgagtacataagatcccttttgagttttcgtgttttgccaaaatctccaggtaaagcttctccctttttctctgttttctctgttttgttattctcccttttctccattgtagctttttcctgtaaagtgggattgatagttttgtttcatggatttcaaatttgtgttatttgactcgataccatcttaaatgcagagtcttttcgtgataataaaattatggattcgtttcaaagttttttttttttcgtatggaaaacacttgagctctctcaatcttgtagtcttgactcttgatgattcttctatgttctcgttgtgattgcttgtcactgttctatcttttatatatgattaaatgcaattttgcccctttttacgcgcgaatgtatttattatctttcgcactctgggtccatttcttgtcacttgagcacataatgattgatttatgactttttaaagttatgaaaatttattatttttgttgctatggttttttggaattagaagctcatttcaaagttgttgattttctttgcagggtagggaattggtgtggtagcttgtgatgcactgtgtttgagggaaaggaaaggataacg

SEQ ID NO: 3136 - DNA, 2000 bp, Arabidopsis thaliana
gtacttatcattgtggtttaagttgatttatgatttataaaaggttgtatacatacatatgttataacgaaattgtgaggacatatttttaagatctactaaaaagttacttttaatttctttggagaatgttgtttttgttggatttgaaagacttatagactcaacccagagattttagtgaatggtgaaccaaaatctgaccaagagttttcttcgagtgagaaccatgtgtgtgtatttattcagtttagtttacataggatctttcaattagagaaaaattatttatataaaattattttatctaggttggaagaccaattttaaaccaaataataaagttattaacattttcagtgccacttttatattttctttattttagcgaagattttgcgtcaatgtacgattttaaaataaagatggacatctctaattcatcaaaatgacacaagaaaaaatatttagcattagagcatgaaaatcaaatcaaatcatgaactgatgatatcatttatttcagtctttcttattttttgttttatttttgcctattagctagcctaatgccagttttatctccctacatccaaattcgagcccacgcaagtttctgaacaagatttacacgatttgatatttcaataacaaattgggctagacaatagtaaatcttgatgcgttaaaaaatacgtagaatcacctacttatattctataatagcaacaatatatatatttaataaaagagaagttgtgattattaaaactaaaaagataatgtgggaagcatttgaatgatacatctttatgcgattaaagtttgatttaacatgctaccaaaccatataataaaagttttctaaatatatttctgctttactacttttgaagatttggcatgtggccgttgctatagtttttctcttctttattatcttcttatttcgaataaactaactaaccgaaaatttagagcacaaaaatgtatttaaaaatcattaatttgttgttggacgtattattcattgataagattattttttcttttatttatttgttagataaataagattctctttcgttcttaaatagcttttcgttaaacataaatattttgtttaattccaattaattttgaaattactttatcacgattgataaaaaacacacaaaaaataacatattgagaaaatatatcagtattcggtatttatttttagtttggtagttacaccaggtaccaactaatatatagattctctaagtacctttcaaatactaaaatcatataaacaacttactcaaacattttgtggaaaagaaaaaaacatttttgatacgaaccaatatgaaataaaaagctggatttagttaaaatcagataaattttgattgaaataaaaaccaaaaacgaacgttgtgattgaattttatgttagttgtttcatgtccaaccactaattacaccaactacacatataaatcaatcgaccaacgacaccatattcatttttttgagcctcaaatttattttatttatttgaacttctctctttttctttgttctgttgtaaatctagatttgaatacaatggcgacaaattagatgaatggacaatgcatgtgttaaatatggactgtttcttcatcactaagctataacaaacatttggtttaacaattttaatcacttttttattttcagaaagtgaccttaaacgagtcctattggctattggtgtcccacaaaatatttttctactttcatataaatcataaaagttgggtcttgaaaaataataccaaccccacatagtgccacatgactcaaaagtcgttatacgtataaaatacggtcatacatagtatttcaaaaattaccaaaatacccttaccaattttcctttaaattccagtctccttcaaatcaatgcttcccttttctccttctcttctctctcttctctctaattaaacaattttaaaccggtcatt

SEQ ID NO: 3137 - DNA, 2000 bp, Arabidopsis thaliana
gtattgttaccaattgggggtgtagctcatatggtagagcgctcgtttcgcatgcgagaggcacggggttcgattccccgcacctccattttgatctctctgtgactcttaccgtcttacgtatatactttttgcctgttcagatgaaagcagattatgggctaacaaagcgagcccattagttaaaaagacttcccaatcaggcaggcaatcacaagcgaagcccttcaatttttttaatattaaagaaaaacttttatgcatcaaaatttgaacttttattctattttattttgtgttcaatttcaattatattatatcagaaatgtgttacatgatacataaaccatttaaatataattattaccaaaataaaagaccataatttcgataaaaaaaaatggtagtaacacttcttcctaaatggaagttttagagacaacatatgaaatctgttaagtcttttttttatatacttggctaacattttatagatgaaattctcaaaggagttttgcaacactcttattatacaaacatacaaatagtttatttaaaatggttttggaacatgtcttttataataccctatcaatcattaccgatttgtaactatgctttctttttctatggaagatggataatccaatcaaggggcatcgataacatcaccatcatcagaccatgtctttaggaagaggaagttatcatggagatcaattcctcgaaaagatttgtctattgtcatatcaaatacccaaatgacttctctaaactataggttatgataaaattcaccgattgttaagaaagaccaccaaaaagatttttaaaaaaatattacattacaagtcaaacaaatcgatatatcacgagacgagagacatcgctaagatgaatttgtcagaactatcgtgttgagggaagaattggacaagtctcaattctggcccaaaaagagttgacagctcgatttcgacttataagtcaaagcccgttacaaacaaagcccaatccattgaaaatgaatgttctggagaaaggacagatcatcgcattaaacagagggaattggccggattaccctcgtcgtacgccctaaacaagcggctataaataaagaatggaaagaaacgttgatgggacgggaatttggcactaatacagcgacaatacaaccacaagcgaagaaacgattgttgacgccctaattcgacgagctgaagactcgaggaaggatcgccctgacctcaggatcgccgctcccactcttccccgttctgagatcgttgccctcaacgcgtctacctcacttagcttccggctcgaacaacttgaagattcttcttacttctccagagatcccattctttgtacttgtttgattcctgtatcaacatatcggtagaaacatgttgaattgataggccaaccaaatcaaaaatttaaagcaaaagcgaaatcaaaatcttatatggggtcgttgtaggaaaaccttgatcattttgtttgaataaaattttacgcctaccgaagaaaacaatgatacgtcttccaatgaaatgctaaactatcaatgactatgcacgatactactataataacgcaacctctttgtcctagcaaaatagatattcgaatttaaaaattcgtatgcatgaactttttgtggaaagaatcagatctcaaaagtagtctaactatatgtggtgattatggaaacagatcacttatagtaatctgatactattgggtgtccatatgtacggtaatactaccacacatcttaccgacctaaacttaatctcagctgttaatcgtacctacaacatctgttttcacaatcaaataaaataacactatacttgtaatgctgtaatgttttaatacctttattttatcgaacgtaacccactctgacccgttcgtatatatatctatatgcttgcctataaatgaagatagtcaagagtcgataactcgatatcatcaaagtgaaa

SEQ ID NO: 3138 - DNA, 1465 bp, Arabidopsis thaliana
tgtatgtactctttttcctttcgttcttgtttggatatatttagagggagagagatgtaagaagatgatcaatagcaaatggaaggtgaagattttaaagcttcttgagttgggattaattataatgtatctggtgttgggttcttgtttatattcaaccaagcatttattgttttacacattttatatacatatcttgtttgacgttttgaatgataagtgacaacttgccaaatagcataataaactcactagtaactagaacattttaataacaaaagagaccaaaacaaaaactgtttttcttcagtcttttatgtaaatatttaagttttcgaagtataagaataagttttgtaattgtaataatactatcattctattacacctgtatatacaaattttgtttgaagatttcacctttttctaaagttaccaaccaaaactaataaactattaaagtattaattatcaagggaaatcttgcctcattttaaattaaataaggaaaaattagagatgatggagttcttaataacttgctttgcatgtaatctctgaatctagtcagaattggaaatctgcacttcctacttgtatcggtatgctgtaaacaaaaattattgttctttttggggttaattactagatagtcaaaaaatgtttttgttaaaattcacaaaaaggttgtggctaaatcgtaaataatgtgcttattctcttcatttttgtttattttgttttctatgaaaagtgtgtataacatataaaaaataaaataaattataaatgctttattactcttttgtaaaataattatttacatcattgtaatattgaataaatatctgaaagacatatatcatctacattattcatcttcgttttgttccggatgttattggtccctttcttactactgcaaagaaagcccacgtcccatacctcctatgatttttatattctcaattggttttctgaaaatattttattataattattgagctatacgcaattagacaattacgcacatctaatttacgtactatataatttatctaatctactcctctgtgattaatattaatgaaccatttctagactaacctccaacacttaagtaattaaacacgtcatctttgagtgttgtagatgtagtcaccaattgtacctaaaacgattataagttgattgaatatggacaaacccaaactgacaagaaatctctataacctaactacctagatcaaataatatttatttttaagtatatcataccaaaatgttgaaacttatattttcatttcactccatcaacccaaactaacatctactaattctcttattttaatataaatttcctagtccgccatatatataaacgcttcgtctccactctacatatttagcaacaacaaagaaacccctaagatttttatttatttttttctcaatttcttcaacg

SEQ ID NO: 3139 - DNA, 2000 bp, Arabidopsis thaliana
tttaggcgaaaaaatattaatatttcattttgttaacctaaaacaatttcgaaatatgagtaaaatggtcattaaaaatttaaagaggtataaatgaaaatggcaaataagaaaaggtagaattgaaaaggggtagtgtggaaaggacattctgagcaattattcaatattgtatgactactaaattctcatatgcaaatgtgaaatcaaatttgtattcaatcacttgtttatataatgtctggttctttagatattagctcacttcaggtaagaaaacaaaatgtggtagcctcattacttcattagtgcaaagaaagtgattctttgggataaatttggataattttgaatcaaagctgtagtaggacaatacacttttatagtattttttattaaagggaaaactcaacatctaaaggcaaggaatatccaacagtttgaacgctaaacaatcaagggacaagcagagcgttttctaaataaagttgccgttctttgagagccgagctcgaaccgtaatctggcttcatcacacacatagttcatcttcccggtcgtcccatctctgcaatcaggaaaatgcaacctcgatccaaacctcatatcacctctttccttaatattctccataatatctttcacaatcacaccatccatatctccttcagaggcaatcgatgtaaccttaagcagcttaggccaccacggtttgatattgtaactaaatactcacaagagttaatctatgttagttttcgaaacaaaagaaatatgtgaacaaaactaacaaccaaggagtgaaatcttttgagtccacatgcaatatgtgatacaacgaggattcatccctctcagtatagactagttattctgaaacatagcttcctcactaccgcaagaatcccatgatacaacaactacgctcttacaacaatggttaatttgatcacgattcaataatcatctaccatgattcactctctttttggttaaagttcaaagtaatattttcgcatttctttgatataaaacgatgtcgattatttggttcatgactttttatttctcttagtttcacaacaacttcgctctcacaacaatggttaatttgagcactaaccaatgaccaattgaccatgcatgattcactctccttttggttaagttcagacagtgtaaaagcttttcttgttacaaaatgctgtcgattttttggttcatcaattttattaatttcttttgcactttcaccaacacctaatattaaaaagaaaataaaaacaagatccaccaattcaatgcgatagggtaagtgactaaatgttcattgccgttgtcaccctttgaacccaatttaggactcaaagagccgtctgattatatttaaccttggtcgaagtatttctaacgagctggtaagtcctcattggtccattatattcactgtccacaataattttaattacttgtacgactcggttaactccttctaggaaaaactaaagtgtacctacctagtacatacgtacttcttcatattaccacaagtttttttttttttttcttgcattcaactacgtgtttaaagtttcggccccaaacttcggcccaaaaacaaaaaccaaataaactattacaaaaatctttgttatcatatcacactatcatttcaagttttcaaccaatccatactcttaacaatcccattaaattgagatttattcatattaagaaattatgctgataatatttaactaccaaattaggccgattcataccaaaactatagaatatgtactaaataattccattaccttcgtttagtcatttttggcggtttatttcttttggatagatctcatgtcagacctttttagactattcattatggcacctaccacactagtgtgtctccatcttctgtatttatatacatatatcataagtcagaacaaagagaaagcaaagaagagaaactaaaacagagcttttttcac

SEQ ID NO: 3140 - DNA, 1691 bp, Arabidopsis thaliana
taaagctgatgtttgaggaaaaaaaaaaaaactacaagatcaaaccctagttcctccgatgaaattgcggttagaaaactaaatattgattgacctaattcaaagagaccttttttgtgcagaaactaaatattaaaaatccaaggttccaagagatcaaataggaatttaagcgagaagcaacatacctgagtctcgtgacaacggcgcgtggtttgcgtcaatacttgggactctcggtgagatccgccatgatttgctagagagatcgtgaaacgcaagaaaacagagagacaaacggtggcgagatcattgatggtgtgatcaccgagttacagttccgacggttctgacggtggtgaaaatggatggtgatcatcgagctttgacgttctcgtgatcggtgagttctttttgtaagagaggaacagaaacaaacagaggctaaaaagacaaaagaagaagaagaaggtggattttttgttttcttctcgtaatccatgctttggaccttgtatcagccacttatgatcatttgctatattgatgctttccaattttagagtattgaaatgggtttctttgacaatcattttgagttagtcatcattccttgttctgaatcaagaattggcttttgttatgttgtctaggttctgcttgtaactagagtaatgctattgtagtctctgttgtttatttgtagaatcatagagagtcgtggaagcatgttttagttgttactctcgatttcttgtcgatgttgtggtgttataaattgagcgttttaaccaatacaagttaggagatggttagtatgtgactatgtgttagtggccatgtatgtagttcgatcagataatctgaatgatgtgctaaagagcttgcataggaagactgcctttgtgttagcttgcatagagacttgttgcaatatatgagactgaaaactattatgtgaaaactttaatttgtgtacaaatatttttaactcttaaaattaaactaacattgtaccaattagcacatgaaagaaacacagaattctgtgaacatatgatgaataactatataaacacattatggattcagttaaggagacagaaacaagaagatgaatttcagatatatagcaatagagtcacttataatcatatcagagcttatactttatacaaattatcactttagtccttaaattaaaaccgatttaatcgacaatcttgttattctttaaaacaatttgttcttattttcaatctttaaattttgcaacaatcgacagaacttatcgttattccgtgtttttattttcatatctttcttaaaatgtttcaaaataatatatgtttaatattttctgatttacaatagttattaagttatatgaaatataattattttaaattttattttatttttcagaaaactcttataagagagcttaccattagaatatgaaaaaaaattaaaactctcttataactttttaaaaattttaataataaaaaaatggagaaagcccgtgaaagagctcttacgaaccaaaaccattcagtccggttaagaattggttatcaagtttggttcctaaaagatatccaagttcaaaagcaaaaaaatatcttcttttctctctctctactctcttctcttcttctcttcttctcttcttctctggctgggcaacc

SEQ ID NO: 3141 - DNA, 2000 bp, Arabidopsis thaliana
tactatacgtttgcaattataaaattaggagagccaaccgacatgaaagagcatttatgtaaataacaatataattgtggaatatgggcacattgttttcatttgttaattaaaaaagacataaaaggtcacctgataaaaaaactctaatacctacgcttttgtttgtgttcgatctaaagtacacattttcgttctattttatacaatcttttggcaaaagtcgcataaactaaaaactcatagaagctacaaatgttttcatttgtattttctttttttaactaggaaatgtcgtaccaaaattcatcataactaagctttattaatttaggcatattagctgctactctcgatgactcgatcaatcgattgtctgaactccaagacataattgcagccgagttatcaacctttgttacaaatgttttcttcatcaattcatcaaatgaagtgacataaaataccgacatgtctctttattcagctaggtactctcattgatttcatgtactttcttaagtcgcacccgtcaattcctcttatagtatgtgtgtttcaaacagtatacacgatatatagagagagaaaagaacagaagatgacatggagaacaaacaactttatgcggcttctcttctttaaaccattgcactctgaagatacagaacaacgacaagctaagaggatatgttgcgagaaatgttttcaactagatattccaaaatcacatacaaatagtctttagactctattttttacttcattttatattctctaatttttttcaaattcaaactcaacacataaggatgaaagatgtgtataatgtaaccatattttatgctgaacaaatttaacattcatacaaaaaaaagaaataaatagctacttatttatattttcttttttatgtgaaataaattaaatttgataaagcaatttacagtagtgaattaccattttactcttttgtacttgtgtcgttctactttctcgttctcatcaaatagctaaccatcaaaaatctctagttatactgtattttctaaacttacaacattagttttaacttttaacaaacagaagttggataaacagaaaaaaaaaggattcaaaataatttttaaataaaggattatcaattatcatttaagtgcacattaatacccgtttaataatttattcatgtaattattaattgttctaacgtctgaaaacataattgccaactgccaagttcttctacacacatgccacatccttggagccttaacgaccttccacgaggaacttcgtccaatcttattatattactaacccttttgaatctgccttttcgttaaaatatttttataatctatgaaaacgatttaaatttatctactgaacaaacaaaaatttgtcttgatattttttaattctaccgttttgttttcactttaactattaaattttcttctacattttgttattgtcaaccaaatacggtccataatcgaaatctacggaacatatatacacaaaagaaaaaataaattgtgaacatgaattcaagttatactatcagttttaaaaagtttaaaattcatgaactataaataaaaataaatctttgcaatcttctctagatacatcaagaacttctctaaagctatatttgacttttcatttcgttagttacatcacccatggaaaaaagccaaaggtttaaattttcatatctgaaaagtaaaacttatataaaaatgcaattaatagaagaacaatatcgaaaaaagaaaagttattcataattaatttgttccggatttacccttcgcgctacgcctatttaatcaaacgttgtggtagccttcgtagaaactactcacaagccaaagaccaaagtaactaaaaagtttacaagtccatcaaactgttcttttacttctcaaacactcaagaaaacttttcagttatcttctataacctaccccaatactttttctttgctcaaa

SEQ ID NO: 3142 - DNA, 598 bp, Arabidopsis thaliana
aaatgcatgattggcagtgactgagaattccattgaatgatagatgaaacaagagaagaagaatagatggtgactcggggaaaaaaaaagttaggtttttagagatctttgctctgataccatatgaagagttattgaattgattcttgtatatttcactgaatgatattcttacaacttatatacacagcccaaggcttagctagagtaattacagagaatattgagacattaatgaagaactcaattacaggaatttgacgtgtgaaggagaatcagattatgcactttccttaacactctacattatatagagttttgaggcttaattttaatgaaagtattaaatttgtccaaaaaaaaaagaaaaacaaatatggaaatgttgggttggtataagccaaaccggaaatctctataccaaaaacaaaaccgaaaaattcatgaaagagagttttattctttcagacttctggattcctctagagaagctgagaaataccaatttttcttctatacatgtcgcttctcctaacttctccagaattttattattgtctctgctcaaagctttcacttgccgttgaacaaacgaaga

SEQ ID NO: 3143 - DNA, 2000 bp, Arabidopsis thaliana
agggaagttagcatgatcataatctcaaaataattggctaaacctcaaccaaccggtccataaaacggatgaatcgatttttcgtctcaaaggtaaccttgaatctaaccaaataaaatcaaaccaatctcccaaaagccgacataagagaagcaaaacccaaggatcaaaccaggtaaaaatgagaattagacaggataaattaaaccggatgatttcccggtttattctgtccactggtttatttagttgaatttcttcgtcaacgtcattcttcttccttaaaccctaatcaaaaatctcttcttcgagctatggcggcctttgaagacagagcagatgaaaacgatgaaattgccttcaaagatggcaacactgatatctcccaacagcttatggaccgttacggcaagtcctcagccgctcagcaccgtcatctcgtcgccaccgccgtcgctatgcgctctattctcacctcagagtctcttccaccatctccttcagctttcttcgcagctgctatatcttctgtcgattcttcaactgaagatcccgtggccgtttctgctttgcttactttcctttccatagtcgttcctctggttccttcaggagaaatttcagctactatggctcgagatgctgtggctgttttagtaaaaccaattgaagaagaaggaactaaactaggagttgcgagtttgagagctggtgtgaagtgcattgggactttgcttattggtttctgtgatttgaatgattgggaatctcttcaaattggttttgctttacttcttaaattcgccattgataaacgtcccaaggtagtttcccatttctttgattttagtgaagaagtattatattatagtaacaaggaatcgtggtttttgtgtttttgcttctgttaggttagaagatgtgctcaagagtgtctagagaagttatttggttctctccgatcatctactgttatcaaggaagctagtaatacagtatatgctttacttaaagaatataagcctgtcttatctgacttaagctcgacgaagattgaggaaggttctaaggttgactcgacgttgaaatccgagaatgcagaggctgctcatgtgctaaatgtcctcagtgctacaattccatttctatctgccaaagttagttcgagagttttttcagaactttgcgggcttatggcttctcagttttcgccgctgacgaggcaaattctcaaagggattgatactatcttcaagaattcggaagataaaattgttgttcctgagatagaaggacttgtaactactttgactagttatttatctttacacgacaagaatcctgctgacactatcgtgcatgtgaccaccctgttaaaggatgctttggagaaagcctactcagtcgaaccgacattatgtctaagtaaacttccactagtttgttcgtcattggcaggtttgttagttccctccctagctttcagcatgtagttcttttcgtcttcattgtgggattcgatttttcaatatatctgtcatgatgaattccaactttccattcatatgctttaggccttctgacttccacggacgacattgcatccaaagcgtcaactatattaaaagacttgatcagtagccacatcgataaaaagaaacttctgaccgagggaagcttgtctaatcaagacgaggataacgtaaccagtggagacaatataaatgcagcaagatgtgtatgctctgtctttgagagtgtcctaaactcatgtgatggaattccaaatgagcacattttaactgtcataaatcttttgatcgagaaacttggtacgtgtactttcacttgggtgctatgttttgtcatcctgaacatgttatttacagaacaattttttacaagcaaacaatttgctttccaaaaagttaattaagattggtgtgcataacaaacatttttagcgacatattttaattctatctccaattgtttcagga

SEQ ID NO: 3144 - DNA, 2000 bp, Arabidopsis thaliana
ggcgttcatacggtggaatattaaacttgattatttctcttaaatttttaaaacataacagaaatgtgggcttaatcattaatttaatgagaaacaactaaaaaaagttgccacaaaaagaacttttagtattttagtgtgttaattgagccgctataccgcataaaatctaaattatataacacagatgaagacttatgtaagaaaaaaagttgaattatgttaggaaaaaggtgtattaatgagaggaaccttttctccacgatattaaaggttgaataatgtctcaatgagaagaagcttttcttcacgagaactatatgatgtttaaatttcgcaaactaggccatattttgcgaaaatggtgagttattaacctaatatgatcaaacattcctaattacacaaggaaaaaaaaaagagagtatattcaaaagattgaggaaatggttttgcattctggtacaccaaaccaaatagaaaagaaagaaaacaaaaaaggaaggtaaatttccatgaaaatgaaagcaataagtgaaggagagaacatattctttctttttcctttgcgagttagagagaagagtggggggctaagcaaaagaaagaagtgggcgtgattcttacgcgctgacttaatgatcagtcaatctctggcccatgggcttctcggtcattttctccgacattattacctcaaaagttagcccattgtggacccgcttactttccccctgctttttaccgtgttatgtgggctccacataaagcccagtggtcactccctttttcctttcctttgttttttgtcgcaagcagcggggattagtgtccgttaaacatcatcgactcaaattgtttcatgcaattttccccttttttattggttatcaatcgaataaacctctctagcttttgtaactagtttgagattattatgtgatatatgcacggtactaaataaatacataatattgtattttgtgtggtactaacaactaggtttagtgagaataaaaacgacgttgtagagtttgtttagtaagaatatttttgtccaacacaaactacttttaaaaaaaaattccaaacgttgatatacctattgcctattggaataatcaacgcagattcatagttttttatttatctccatacttgggtcaaaaacgtatgagatttaatgatcgaaaacaatatccacaaatatgaaatattttaacgctgatctcaaactcaggtacaacatagttacatatagccgtgctgctatgtttgagaaagattatttttgatcacttaaattgtcatatgtaataaaaaaaaactttcagttaaatgtttttgtaaaatactgtttaaaattttaggatgaaaaagactgaaaaaaaaccactcagacaaaaaaaagagagaaatcattaacctttttaaaacatcctttttctcttttattttcaactttcacattcttgatgatcaacatagtggagcttggatctcttttcaatcaaatgatttatttttatttttaaagcagaggaactttatttgtattttatccctttaaagagctgtagaagtttccttttcattagctacagaagttgctagttgtgcatagtatatagttttggagatatattatgagaaattaatacaaaataaaaactgatttaaaatctttcagttgaatttcatgtgaaatagtatgttattaataaaaaacggaatcatatacaaatcattgtcaatcagattgtttcgtgtataaatattattctgtaaaaccaaacaaacccggatcagacacggttaccaaagttgaaatctctttatttgcacgcactcactcaaagataaaaagcttaccactctcacctttcaaaagccccgccaccttcttcttctcccacacacaaagaaaaaagacagaaagaaaaaaactttttttcttttcgttaaaggctccacctttctttcttcttaacacacaacac

SEQ ID NO: 3145 - DNA, 1943 bp, Arabidopsis thaliana
tcgccaaaacggcatttgtcttgttgttttataataagtcaatggttatggtcaatgcataagaataataataattttgttaatataattgaaatttacattctattgactttgtattagtattttataaagatgtttatgagaaaaaaactactagaagaccattaaaatggatcttgaaagctgtatgttacagttagatatgttgttcaattgcgacatggaaacatgtctaaggattaggggacgcccatttctgcattttttatatgatttttaacatgcaacttttttttatcttaataaagatattttatattttaataataaaatgacttaaatcttagtcctatacacgagattatttcaataacattcaaagaaaaattgaataccacattattgatctccaaaatgtcaagtgactgtatcgcaaattctatataaattttttcaaaaaggctgataaaattaattatttttttcgaacatatatcttataatttacaccaagcttccaacattaatttcgtaatttaatatctaaaaacttgtaacttttttttttttaatactaagaggttctgaaccgaaacccgtaagctctccagacccgaaaccacatccacatcatgtaaattacatgcatcagtgtatcacttaaacaagaagtcgtgaaacttccatgaatttataaggttgatcttatagtgattttctcataccatataaaatacaccaatgaccagacgtctaatatgtttctgaaattcactataaacaaattagtgttaagacttgtagttacatgcgtcacctaaaaacattgaaatttcatgagttctccggaaaacaaaccaatatatttatttggtgtggaaggtacaaattaagaccgagtctctcaaagccctacgtcggccacataagccaaccaatggatataaaaaaattaaaaactcaactatgacatgttgccaaaaaatctgatatcaatacttttcggcttatccagaaagataggagtcacacgtatataacaaggcaatgtgttgtgtgtatctagatctatttatatgcaactgtttagaaaatgtactaatcctaaattattctacacaaatattcacaagtctacttcatgactttcttggttctatctacggaaaagagacaattctacacaataagcccacgcgctctacattacctcttcataaatacattcttttcacaacatttaatatgaagttttattgtagtattctgatttcttctatgattatataattattccattcaattatggagctacatataacataatttaactagctgaactgatctttcatcaatattacatgatcgtcatggttttcatgaatctatgagtttacatttccctcattaatttaaattctcaaatttacattgataagatttgaattatggtgcggatttatcgacgataaggtccatagactcattactagagggatcaaaagacacttatcagttatcacgcacacaggactgtaatcacatccataaaaccttatactataaccggataccggtttaaacaaagaaccaacattgaaccacaacctaagacattttctatcaaagtcttcacatcacgttctttacgcgcgtgaggtaaaatgttcaacaagttacgtaggtggaggagaaccttcgtaatactttttcattagtcttttcttcatttgattttgcgaaatttctaaataattgcgagctgcataatccctccgactattaacttacaaagtacccttttagccaggctttttctgtcttatttttttgtcattaaactatataaccaaacacaaacatcatctttctccttcatttcacaaacttaaaattctctgtttttgtttcttcttctttcaaaatctcaagcaaaagaaaaa

SEQ ID NO: 3146 - DNA, 626 bp, Arabidopsis thaliana
ggttatttcactgtgaggtattgctttgaatttgctatggagaggttttaaagaaatgtacgtttaggtacgtacggatttggattttcataaaactggattctcggcgtcgatcatgttacttttgttgttaaacacacttcttgatatatataatattgtatatctttttgttaggtattgtataaaagctaatacgtacatacatcctatgatgacactgaaaaggaaaaaaaagtcctatgatgataatatatgatgtcttcattcgtatttcaacatctttccggattttggaggaatccaaatgttcatacggaatattcaaagttggttttgaagtcagattgtcatggatatataaacgcagagaccagatattatgactttttgtgatatgtgatcggtccattttgtttggattcatagattggaatcatagactggtccagtttcaatttttcgttagcgttttacaaaatattattgggctttgattgggcttgggccagtttggtaacgaactttgttaaccaagtttggatgtaaacagaaaaaacaaaatccgaatcaaaattctcaaatagccgattttgagcaaattcgatgcttaacgaaagggttta

SEQ ID NO: 3147 - DNA, 1490 bp, Arabidopsis thaliana
tttaaagaatttacttttttttttgttgatatcttcttgagaactttgatttttcgatttctgatagaacacacgaaggatttttgaagctatttaaaggtactaaccgaaatttctcgagcttctcgagttgttatggggaatacagaaacatctagaggacgtctatgagaaaaatcaggtgaatccagaaaattctaggagcattttgaagattgtttgtgttcgttgggtttaatgggccttcatgggctttagacaaatatgtagtcttccaaaaaaaaaactggatttctacagattatccggttcgactggttaaccgaattaaattccaaaataattggactctaatcacactatccataaaatctaaaacattttctttgttaatctgaagcatttaaggctgtctgagtattatgggccatgggctttaaaagcaattgtataacgtgctgaattgaatagaatattactaaaaactgggcccatctaaaggaggattaaacaaatccaacggtgtatattggacattgagctccactaagtaagtagggtcacaatgacgtaacttcccgcgttcattacggaatcttgagcgtacgattctactattgggcccatctttataaaaattatactgttttttttactaaatccgtcggccacaaaaagatatgttttttttttttgggaaaaaaaaaaaacaacttcgacgaaagactcggcgaacaaaacacactcgcttcaacaactctctatctctctctacttgtcactctctaatctacacacaattaacaaagctcaatctctctcttctcttactctctacctctgtagctgatagggtcagcttcgtcggcgctatttctgccggatttcacggacgatttgagatctgttcttccttcttcttttttcctctcctgatctgattcaactctaatctgcttcagtctctgtgttacgaactgattccgttcaggtacggttcgatttttttccaagctttttcactctctgacactgccaataacactctcgtgttagtcctggtgttagtgttatgtgaattcatcgattcctgctttgtgtgtgtacgctttaggcctttcctgttactaatcttgttttttagtacttctttggtaaattaagaaagtttgagaagaatgtgattttgttttggttcttttgatactttagttttactttttttcctcagctttaatcttgtagagattcttctaatcagatcttacggattcttaaggatctataaggtctatgaagattcgttttgtaattctattacattgtgtgtggataagaaagatgtacttttttttttttttggtatttgttatgacttaccattttttttgtttctacagtgaaaaaaaatgttgagcgtttcaagcttctgcagtttaatgggagactgaggagtcatttgagtgaaacgtttggaactttggaaacag

SEQ ID NO: 3148 - DNA, 426 bp, Arabidopsis thaliana
ggcttcgagaatgtcgtagagagaaggaggagagatgtagattggcacggcaacgaattatgtgaagaggtagagtccgatatatagagtagatatatacaaataatatgtgtgatttttgatcttatcaaacaaacactaaaaagtaataatataaagcttaatgcaaaaattggaaaacaaaaaaagcttaatgcaaatacaagtaggattttaacagtgtaaacaattttggaagatttttatatatagttgtttgttatacaaaatcgaattgtttacaaatgtagaaattcgattggaactttatgatattggactattgggccgaacatgaatacatgtatagcccaaacatatttttatcgttttaccaaaaaacccattaaatgatatttacgtgattggtggtattgtcggggggat

SEQ ID NO: 3149 - DNA, 1352 bp, Arabidopsis thaliana
ggatatggagaggataagagagagacagaggatttgattcaagaacttcataatggacatatgattactcatgaatcagaaggttagaaagaaaaagactcagatgtaagagcaggagatatttgttgaagaaaggagagaaagagagattaaatatgaagaggaaagtggggttagctttgttggttaagctgtctaatagagatcataacgtttctcttttgttatatgatcaaattatgcttaccttgctaatatctttttgctgttattttttttgttctagtgtgtagaacctgttttctttattagcataagtgtgtgatgcaacaataatgtggctcattattacacaaggaaatgcaacaataatgctcgttgacttaatcacagttattcaggtaaaaaaaatgagaaccaaacttgtttacagaggatatataattaatcgggttaattataatggtaacctaattaagatcaacaacaaccggtcacacctgtctcgcctgcctttgtatataccaaattctctctcattatgagtagtatatcacaactactattgggtagcatcttcaacctaaaagtaagtaaataattgatatttagagcttaatttgtttggttttattgtgttgtcttttacttacattaacatgtggaacaatagatagattagatagatgtgtacaataacaaaacgaaaggacaatgagaagtgaatgcaggtgagcaaccgcaccggtctgtgagagatccgatgccaagtggttggggttgtgtttttagagttttagttgtgtacctttttgggtcaatatctcaactgcttccatgtggatgtgggtctctattactttccacgtgtcaactaaagattgttgacattcgtcaacgcatatgagtgctaaaacccaaagcctcttaacaatacatagtaccctataatgagctgcttttacttttccagatcatgtgacccaacaatcatattgcaataatactaatttttgtatccatacacttatgctccagtttgacacaagacaattactaaaagacacactgcttggtggtgacttaacttttaaatgtaacaataatgttgctgctaccctgaatttctatctttctaatggcaaaagatttttcttttcaataggccgattcatagttgaaaacatttgtaggtgatgggcctctagactctaaatgggcttatttagctaaaagtttacagggcgggttaataccaatcttggtcgggttaaccaacttgggtcgggtggatgttccaatatgaagaagaagactcgcgcaatcctaaaacagtgaacgattcgattaca

SEQ ID NO: 3150 - DNA, 2000 bp, Arabidopsis thaliana
ataatttttagacctctttttacgtcgataatttctagagctaattggtattttaaggatatttaaaattagaaactaatcaatttcgaagatacccatcaaagatttccaagtcttcacatcaaataggtctaattgtgcatctcatgggtggacgaagagacatcttattattggcatttattagaatatgcatattcaaatatatcacatggaagtcattcgattttttctagctaacaaagtatgttataccatcttattatttggtgattttattaatcttattagcattatatgtttagaagtataatttgcccaacaaatatattccatttcaagttcattgagaaatattctcataacatgcaaaagaagctcaaaactgaccacactagaatccaaaatcgccaaagaattgatagagtcagtctcatcatagcttacacgagaatataaacttgactagataaagaatattaactttttcagctgttaaaagctctctagtgaatatattggacatacgtacttgattgtagtagatagacgtgttctttcacatgtgtacaccatgcaaaatagaaacattgccgttttataaattaaaaaaaaaccattaaaagaaatcattccaaacccgaccttagcaataactatgttgatatgaaagctaataaataagttagagaaaaaaactaatgtaagtcacgaggatctcactcgccacccaacggaatgaaatcagcggcgcatttatcttaaaagactcgcaatgctcacgagtttcgcgacgccagccattactgagtggcatacccctgtaattaccacgacaataacgagggtaatcttggtataaacatgttttcttgaagtttattttatttttttaagtcactccaatcaattttgcctttgaaaaaaagaaagccatttgtctgcattggggactcatcacttatatatatgcgttactctcccttttttaagtgttttttttcttttgttcctttccaattatttttagcaataatcataatgataattttaatattttaacacaataatagcgaataaataatatatacatggaagcgcgtgggtccaaaccgtcaaattatgatgacgtggcaaaatctcgtgggaaattgaatgaaaactgtaaaagataacgaccggtgacagagagagagagagaggagaagaagaatagaagaagcggctcatatccataataaaagccatttgctcctttatttattctctcattctttcttcttcattattcatttctctcgttattcgtttcgtattttgtttgtgtttatgattttacctccttagttgctgtgagatcaagaagtggtgaaagaaaagttactaaatctggatgttatttgattgtcgtcgttggtcttgagctatgaggagcgttaataatagtagtgtcgacaccgtgaacgccgccgcttccgccatcgtctccgctgagtctagaacacaaccgtcgtcggttcaggtacttctatgagctcttttttttttttctgagtgaaaatgtttttattttggttctttttttttttttttaaagatcagtgttgttgctttgatttgccgacgtttctgacggtgtatcgtgattgtagttttgattgctcagagacatggtttttataagtaaaagtgagaatttcgtgatgtttttgatgtttgatctgtttttgcaagtgttacgtaacgaaattaaacaaagttttaagagatttttgcgttacttattagttatgctcatttacctgttattgctttacttaactaggattaaagagtttttgacgaaagtagaaatataagaagattcgagatttgaacttattttaaatgtctattatttatcagcagcaccagagtaggtgtggtttcagcaagatttaaacttcttgataaagctataagccattgaatctttagctgatcactaatcttgtttttat

SEQ ID NO: 3151 - DNA, 722 bp, Arabidopsis thaliana
atcattaaaattatttatggtttaatgtttgaatttaaattaactatgatttaaaaagcaaataatgatgatatatcaattacgtgtttgtggtcgtatgaaatattgttcgtcggtggagcaaaaatgtaactaagatgttaaagtatcaagtttaataaagaaagctattgtgtttactaaaatgttgtttggtaagagctcaaatctttgattttcttcttacaatactttttctgacatagagatcaattacaacctacaagtcacaccttacaaaataaacttatcacacatagcaaaaatattatcacgaaaattaaatcgttagaattgtctttttttgatcaacgatttgtctaaattctgaaattttatggttaaaagaaaaaaatcatttgtaagattatttttacataaaccaaaatagtaaagctttatattcgatcgtatttgagtaacaatttttaaatttcacacaaattccatgcttttgaaaagcaccaaatttaaacgtatcataaatcaatttaacccaatattttaaaataaattaaaatatttgacttgactttcgtattcgggtcggatccacccggatttgacaaataaaaacccggtggttggccatcgccttatcttgttgactcttcttcaatcataagcccacccacttcgattaccaactccgaccgccagagacagcgagtttcagatcaaag

SEQ ID NO: 3152 - DNA, 333 bp, Arabidopsis thaliana
ttaccatacctgttgttacaaatgttcttcctattatggataagtgtttactgtactgccatattaaccgagaaaatttcttccagccacctacttcttcagaaacgccaattctatcattctcacagagtccaggtgatccaagttccttcacctacttcttaggcattttctttaaattgctcatgatgatatcttatcaaagcatacttggtttgttctcatctaaatttgtattttgattctgtatgtatcaacgcaaaaaaattatgtccatgttgtctccgttttattgccactaaccaaaaactgcatgtttcttgtgacaagcca

SEQ ID NO: 3153 - DNA, 1174 bp, Arabidopsis thaliana
aacttttcacttctttttttttgggcttttgggaaactattacttcatgcaacgaagtagacttgcaaacaaagagagtgtttttttgttggttttttgtttggcgtgaaaagagagcttttatgttgatattttttgtacatttgtggataaaattacttgtgctttctaggaaggatgtatctgtacaagttattattattacagaaatttgtcttagtcttaataataataagattgttagaagattttaatttataattaagaaaacagaagactatttctaatttctttttattgttttggtatattttagctcacatctttttttaatcattatatgtaaaaaagcttgaaccaagactagttggtaacatttcagagctctctactgattgagtaatttcgattactgaacagaagtatcaatatcgtgtggtgctctacacaacacaattgcgtctaatattataagattgttaggttgatttttaattattacatgttgattgttgataaagtttaaaagcctttagttgtggcgggaacgtgcaaagcttaatacacgaccaatgcactactagagcttaacgcgctactttggcgagtcaattacatcgctcaaatttacatcttgagagtaaacggcccgcgtggacggaattttaggatcaagatttacagagacgagtcttatgattcattgagtcaactctcttgcatctaaaatgagaaaacaatattttagattttgtttttgattatagaaagcaggttgatcactatgtatatatatttctctatattaccctccactaaaataactgaaaagaatagtcaattttggccataaccttctttttttaactaaaatttacgaatcaactattatttgtcggtaggagcgaaaaaccgttatgagagcatagtgctactagtggatcggtaaacaataaatgccgtaataaaaatctaaacgtcacgcgcgtgatgaaaaaacaggaagtaaatcgtcgacgtcgttattcaactaccatttctggatcacaactcccatacactcttttaaatcaaaacaaaatatctctttcctgttagagacaatggacggattgatcagaggtttggtcgactcgacgtggctatcggaggaaaccaacgccgcggcgagacg

SEQ ID NO: 3154 - DNA, 2000 bp, Arabidopsis thaliana
actggtttctctatcaagccttattgtttttatggtttctgtattgaagatagatctttccatgaactcggattccttgaaaaggaggtttgtggcttcatgacaaaggttcttccatcgtttataaagaatacatatcaatacataatctttgaaaaacaacatagatatgaccaaaactagaagctaattaggtcaattcgatagtaaatctgattcttttttgttgaatcatcccttttaaaagaattaatagataggaattcaacaacaaaaaatcagattcattattgaatttacatgattgccttcttgctttgaccatctctatcttgctttccatagcatgttttctctaagcgatagaagaatctttgtcgtgacacgacaaacctcgtaatcaaagaattcaaatttatgaaactatttatgttttcggtagagaaatcgtagagcccataagacttgataggattttgtttgtttgtactattcgtaaatggaaccactagttgtccttgtttaattttgttcatatattttcaatgaaaaattagttcaaacataataccatcctacctataactattaaaacaaatatttgaatatgatatcaaacttaattctttcatctatgaccagataatatcatctatcataaactttacgttcatatgctctctaaaaaaaaattctcgaacctcaaacaataattaattatgagcttttatcccttatctttttaaaagaagaaggaagagatctttcactttgtctcctccgttcccgtctcggtcaaactcatttgcagcctattacctatatatataggttattgttccttcgtttgttctactctcaaaattttacgttatgattcaatcgattaagctacgactgcccttctattaaaatttgaaatagcattgctacatgagctgttattttttttttcttgacatttcactgatgctggtaaatcgtgtttgtttatcgtgagtggattgaaattcacaaaataacaaaatgataatcatgaatccggtctctttcaccggactattcaaaagtcccattctatatatacatcagaactcaatgcatgtgatgtgaagagtataagagtatcgattccaacttacatctagtttagctataagctttgacaccatttccagatgatgactttttttagctattgatctcgatatttttggacatggatcgaagaatcaaatataggttggactaatcatcagtggatcgagttgaaaacgtgtgaataagattctaataccatattagataataggtctttaattcaaaacaaatttgcgtaaatttaaataatattccgaaaaaagataaatacaacgtaaatttaaataagtggaagcacatggttcctttgtcatgctccaatcaaccatattggggcattgtatgattgattgtttcaaacaacctgagtttggattcaatacttcaatttgattacatgattgagactttctagctagctcatcatattccacatttacaacacttattggtttttcacatttatatatttatgtctttcatatatgtacatcagtaaatgttagtaatgtaggtttgttttaggatgtaaccagaaaaagaaaaaaagaaaaaaagataatttgaatttctagtatagtagtttgtattagtatgatcagtgtatgacagtttaaattttaagtttggattattgactactaatataattgacaaccaaattaccaactttgcggcaaaatcatagaaatgaactggcatgtaattattggtaaggaataaatgtgaatgaggtccacaacatacacgggaataaaaccagtcttgtgtcaaagctttgttcacaatctctctctctctctctctttcacctttctcactttttctccctaaagcaaccgcaactctctcttccttcttcatcttcgtctctctcgttccaagtttaagctcaagcc

SEQ ID NO: 3155 - DNA, 2000 bp, Arabidopsis thaliana
gtcaacaatagtgcatagttgatcataacataattcatatgccgtatttaaatatatatataaatagcaaattggagaatctatttgcaaatggtagtacacttgaataaaagtacattaaaacctctaaaaattaataatattggaatgagatattttgttaattaattaagttaattaatttatcaagatattaataattattaatttgaggaaaatttgcctaatttctaagatatttaaattttataatttaaaatagattttgtagttagaataataattttctagaacgaactacatgaaaaaaatcaattatcatgcctcaaagacaacaccaaaatatttaattgcaatacaaatattagaaacgaactctaacaaaaactaatgcaaatttaagaataagcaaataacactaaagcatgttaaagtcttcttgaacattgaaataacacatctcgtacagagccggtccaacgtttttggatatctttatgcaaatatgtttttgaatttagttcatttgttaaatctaatttggttttacatattccactaccgttgatgtccttactttatagaacaaatacaacaatgataatccaaaccatcaattattatattgcttaattatttattattgatctataaacaactaaatataaaatctctatttacaaagttacgaatctttcaaatttggataatttcatgattaatgtaatcaatgcaaaatattttgttattgaattaaactcccctagttaagcaatacgacaaaaggaaaatagaatttgaatcaatcaaatattttttgttgtcgtttaggatgattgaagaagaaccgttcataatatcttggcagtaggtgaacagacccgttgttactttcttgtagcaaaagattagttgtattcctatttatgttagcaaatcggatgtctgccacaacaattttgtgtatttcatccactgctattctaccatgaccgtgtttctcaatggtaccatttgactctacaaattcagtcaaaactctcatcttcatttggtgatacttcaggtaagccataaacttgttgagactgtgatctatgattatcttctggatgatccaagatgtaaacaataccctcattcctaactgattgttcatcattatcatagaatttttcaaataaacaccttagttttctatctcaatcttacacctagaagatgtgttcataaccactgaattcatgtagtttttctccgacattcgctttcaaatatagctttgtgttttagaataagatatcaaaacctagagattcatgttcatgttcatgttatgcaatcaccttcacttgaagttgaaactttaccacttgatcatattcatagcatcatattgatcaaagcaaagtattacattatgtaattaaactcaactacctaagcaacatgacaaaagtaaaaatataaattgtatcaataaaaaaagaaaaagttttgttgtctattagaaatatatatttttttaaaaatcagaatttcactaataatatccttgatttctatttcactaataatatccttgatttttagtttgttaattgaaatacaacttactaatttgaaaaataaactttgttaaataaaaaatttactacattgtatacgtttaagcaaaacatatgttgtattcagaaatctttgtttgtttgtattttgtttacatcgtgtaatgtgaaaaagtcattagatttttacattttgtaatcaaagtatcaaaccaaaacaaatcaaactaaaccaaaaggtttttaagcaatttgaaccaaatgaaccaacatcaaaccaaatcgcatgatccaatacggtttgattgtttgtttcggttacaatggtgacaactgaaaatagctaaaagaggaggaatcagaatcaagcatccgattccgatcgacaaatagggtttagaatccacacacccaaatcggaaggcgaagaaa

SEQ ID NO: 3156 - DNA, 2000 bp, Arabidopsis thaliana
tgcataccaaacgtaaagagtaacgcactaaatgaaaaaacaaacaaaactccatttcaataaatataatgcatgaatgcgtccattcaacacatgcaaaaagaattaagaaaacaaacgacaacgaagaagagaaaggggacgacgcggcgtgactggctgtccttcaaatagacagaaagtcaaaaactatgagaaatataattttattactcaataataatgtcaagttaaaattatatatgttacaagttatattgatcgtccaattaataataagtctttctatctcaatatataatttcagttgatttgaaaataaaaatacttgtttggaatttttactttgaaatcatcataagttctattcagtggctaagtactttcaagtttcaaccaacataaagatcttcagaatttaacgaagtggatcgttcttcttagatcgtaatctttgtgaatacttaaaccatatttttgtctatggtaaacgaaaaaagaaacatgcatgtggtatattgactggtgacttcttaagtccaaatagataggttcatgtttgtaacttcgatgtcacataagaatatgaaaagctgtaaagctaagaccagccagagtaagatcttatcgtttagatttgagatcttcaagaaaagatttagcatatacaaacaataaactaatcacagtatatacgtacgagcagcttcataatttgagaaagtcaagtggggactgtacatttataattatttttatatcaactaatgatttagatggtactggtaggacaaaataagatgtgaaatatttaactaacaaaataaaataagctatgaaatatgtgtaagataggcgatataatcggtgcaggaaaaaccggaccaatgcagacgatttagccaatacttttagggataatttgctagataatctgtttttatattatagtttgttgaactttcattttcttaacaaacaactctttttttttttttcaacgtaacaagttagacatacctatgttgatacaaattgtagttgtactattaattaacagaacgttaaaagtgtgttatagctcacgttttaagttattaattattggtggtatgaaaaataatttgatttttttcatgtttattgataacttgcaaaaaattggatactttcacaagttgcatgatttatttcaagcgtaacaaatatgttttgagtgatatacagtaatataacaaatatagcaactagtcttggaaactttcaaattctttcaaaaattcacaaatatgtttggaaactttcgcctaaatgttgaaaatcttttacaaacttttggaaactttcaagacttgttgattttcttcactatcaattatctaactttgattccttttcttcaatttctttctatcttaatgtttcaaacttatatatatgtcgtgacgagctgtgacgagctgtgatacaaaccacaagtccataaccggcctttgatgcacatgtctttttgccacctccacctccaaaaaaacttaagtctacacgtagaataaaaggctgctacatcactccaatttatctatctctatctcttttattttataatgttagaataattcagattggtatgtcaatattataatattatgagctgtacgtgttctattcggttccatctattgatgtccgtcgtgggacattcctcacgcgctttggttgcccaatctgaacacattggtaaatgtgttttcaactataaaccaacgaagatttgatgaaaaagaaactcgtttttataacaaagctaaaatcaaggaaaattgacccaatgaattttttattatatattgttggactgaccagtcactattttacccatcttaaagacttaaactaagttttgttctgtcttctctttcactcttcagacagacacaacagtgaaactaaaaagattagatttcttcggacaaagattttctcgagattggagaaaa

SEQ ID NO: 3157 - DNA, 2000 bp, Arabidopsis thaliana
cgactgggaccattcgtgataatcaaatatgagagtgtctttcagataacgctccacatgtggataacatgatctgtccggattttcatgttggggcattgcgcagaaaatacgcttgtcacttgttttcacgcagaccaaaagacacaacctagttgaagactgactcgcgaacgacctgatgaaatctggatgagtggtgattgatgaccatagctaagagacccagtggaacctcgcagcagatttagcaggaagtctcaagagtatatcaggaattagatcaagaggaatcatctcgagaaacttacaaaaactctcatcttctttagattgtatacttacttccctatcttccgcctcttcctctactctatccattggcgtcgatccactagtttttttttttaaccctaatttttcaaccctaagtttttcaaaccattatagtagttgtcatctctggacaaaaggaacaagtcaatgcatcgatcaccgaaaaggaagcatcgtacaaagagaagaaaactgaagattaagaacatctctttctctttaacttgcatacatcatgttcaagaactacatcttagcaaatccaacgaccgaagacgaattgatcatggacactctagctagtgaccattgttttaaaaaccatactcaaaatgtattaaaaaaacaaataaaagaattttacatttggttgtatttgacaaaacatatcaacactttagattcttgcggtaagtcagaattcttaccagaagaatctaaaactttggttcactgattcatgagaactttgatccgaacaatatttacctagaaaactgatctcaccctcatcaatactgatcttgatgaaagtgaatcttacaaaaacaaaaaaataatgatagatttgcacttaattactgataagtagactaaaagaagaacgatgaaattatagcaaatcagcaacatgaccatcacggaactagttaatactaaaaagcatcaaagttggatttctaagtgatctaacaaacgcttttttaaagattaaattcgagatgaaaatatggatgaaaaagaattaaattgctaacataaattgaccaaaatcgtaagcattgatcatcacccatatcttcatctcaaatgaatccatataatcaacactctaacgtaaccagaaaacttgttatacttatttttgggtaaaagattataaaatttagatttccaagcaatctacgagcaaatttttaacggattaaatttgagatggccatatgggtaaccaatatataaattggtaacttaaattgaccaaaatcttaaatattagttacccaaacagccatctgaaatgaatccatgcatatgatcaactctctaatgtaacaagacaagtttatccactctaacgatagatagctccacaacgtcatcaacataattaacgaaagatagacgtcgatatctatctactgtgaaaccaaacatgagtattatgaatcaaaaagatccattaatgttaattcatactcatgtttgacttcacaacagagagatttcgacatctacctttatccatcggcgactcacttttgtttttctaaaccctaattttctgtctgggtctctctgtctttgacgtatttatagtacaaaaaaaattgttgcccaagaaaaaaaaaaaaaagaaaaacaaaccttctgaatccgacagaggctttaatctgttaccgttaaagtgttgtatgattccgttagaatctgcaactccgttaatattttttccgttttctttcagggaagagaaaaaaaaaacacagacctctcttttctctcttcatgttttcatcgatagtggaagagatcaagtgaaagaaaaacactcagatctggaaattcagcttcttagatctatgaattttcaaattcgttgatccatttttccgcttcaatcgtctccgatctgatttcatcagcttcgtaccgctccggtc

SEQ ID NO: 3158 - DNA, 813 bp, Arabidopsis thaliana
ttttcatttcatcaaatctcaaaatcatgagtatgtgcaagtgcaagtgtttctcacattgttattcgtatgttcatctctgttctattgtcaatatgtacaatacccatgtacattctgttgtgcccgcctctagtaaattatgattaacgaaaaattacaattcttttttatatagcttatgatgtgtaaatatcaacactaaaactgggacattcagttggcaccaagtagatcgatatctagactagaggttcctcctctatgtcccacggttgcagaggataaaatgaagaatgagtacatggcctacaaaatcttggttctttttgcatgtcgattccaactaccacgcatttatagcaaggatattaaatttccggtacggttttagttggatttcggagaaggcaatgtacacttttaccgaacaccccaagttttattggtcgtaaacaaatactacaggccaccatggatacatctagtgcgcatctatatcgaggctcaattaaaattttaacggaccccaatcagacgtgtctacgcaaggctcaatcgaccagtaatacaactataaataagcaatcaaagcagcaaatgggaaaaccagcgttatgttttggtatgagaatcatgtcagcaacaaccaaacggtgtatatattaataactatcgagagaacacaaccagagttaggtaggccttgttagattttcacaccaaaccctggcactatatatagacccatctagtatccaaagcataatagagatacaaagaaacaagaaaacgaaaagaaaatatacagaa

SEQ ID NO: 3159 - DNA, 875 bp, Arabidopsis thaliana
agacaacccagttgagaattccagcttctttcaggtaatttcttggctttactaacttttcagtttggaattgggataacgatccgtaattatgatatagttgtgagagaatctatgataagaatcttagagaaatcacttggtgatgcattgtactttgttgaagaccctttttgtttgtacagcttatgtttttgtttcttaggtttctataagtagtgtgtcttttataagatttgaaaagaagagtcttttttgtgatgcttcaaatggcaaaatctcagtgaagatgtttttataataatcaaatgttcagatttagtatgtttttgtggtgtttgcagaagaaaagctacaaacttgcaagtgatggcttcaggaaagacacctggactgactcaggaagctaatggggttgcaattgatagacaaaacaacactgatgtatttgacgacatgaaacagcggttcctggccttcaagaagcttaagtacatgtaagttgcagagtaccaccaattgtcatttttcaatggttaatagattacttatttcctttcttcttcacctgatgatattctcttgagcagggatgactttgaacactacaaaaatctggcagatgctcaagctccaaaggtagctttactcttcaacgaaattttattgttcatggaaggcttgagatatcttctgtggtttgaattttgtctggagaaaggaattgttactaacagtttaagcaacagtttctggtgattgcttgtgcagactctagagtttgtccttctgctgtcctgggattccaaccgggtgacgcattcactgttcgtaacattgcaaatttagtacctccatatgaggtataacattta

SEQ ID NO: 3160 - DNA, 2000 bp, Arabidopsis thaliana
aatagaattgagggaaataattagagttctttcatattatatcttcttctttattcatatgaagtttggagattcatttttcttttccatttcgatcttcatccatttcgatgtatgtgtttgttgaattgtgttccacatgatcaaaaatcttggtttgattttaagtgattcatttacagttttgaagatcccaatgaaaaataaatatgaatctccaaattttcagataaataaaaattcaataattttggtgtatattgttttatgggtaatattagtagataaccaaataaaacatacaaattaagaaactagcagagagaaagttttttgttacaaaataaccatggatcccacgttgtcggaagaaaggaaataacaaatctacccttcatttgttgtaagatgaacagtaaacgaaatacatccgtgtaatttttcaaaatagcatgtaacattaaaatttcacatgttatatttagtttaaaaacatgctatttcaaaaaacgttatgaatttttaagaaaaaatattcttatgaaattcttttacgtgaacagaatcttaaaaaaaaaaaattatatgtgattttaataaaaaccatgtattactaaaaaataggaatatatttttaaagaaatcacgtgtgatcttaataaaaaacgtgtattactacaaaatatcatgataaaaagagatattaaactgaatagaatgttttttccaaaaaataccaggtgctttttaataaatactatgtaataagagaaaataacaagataaaaagaggatattatgttatcgcatgtatttcggaaaaataacatgttacaaaggacatttacgtaattacacgtgttttccaacatgtttccgacaagatactgtgattcaaggttagtttgtacattcttttcaaatctatagtcatttattataaatactcttgttttattgtatgttttctaatgtagttattggttgtcatgtcatcactacacaaaaagataatattatgagtgatttttaagattgtagtgttgacattcatttatttgatatgaagatttttttttacaaaaaaagtttacatagaaattttttacactaaatctttatgtttttaatagagttatcgtctatatcaaacctacatttatttgacataatagtttatcttataaaaaatgacttcatctgttcttttttatttgattggttaggaaaaacacacatattaagttaaacatattaaaattgttaaatgtattattttttgtattttacaattttttataactttaaatcaataatattcaattatttttatcaaagtttataattaattaataataactaataaatatttcataaaaaatctaaaaattaatcttttaaaaacttatttttttcaaaaaacagagagtgttaaatagatagatttttttacacaaaacccaaaaaaaaaaactaagaccttgaatgttttttagattttgtaagagtttttgatttttgttttttaaaaacttattttaataccaatcaagattttaaaattttggtttccctacaatttagtaaaactattttattgtagttttccattcatatttaagttttttagtttttctaaagtttagaaaatctagtttttactcaatcaacgttattttttcaaaaaccaaaaaccaattttttaggggtttttaaaacaaaaatataataacaaaaatctaaaatctatagactaaaatctaaactcaaaaactgaatcgaaaatatccattcaggcctaatacatccaatatttcaatacttcttaactcttaactcttaagttttaagtaattaaatatataaagatctgttgccaagcgtaccctttttataaacattccaaataactatctccattctttggagttacccaatttcgacgttgaacacaaacccttgcttctctcttctctgtttctctctcgcagcgaaaaatc

SEQ ID NO: 3161 - DNA, 580 bp, Arabidopsis thaliana
agttactgaagaaataaacaacaatttgagtttcaaaactcgtcgatggtcaaaaatatcttactcgttgaatcagaacacaaattcaagtgaccggagaaaattttgaagggggcgagagaagaaacagagttaggtcgacaaacgaatttgaatggcggcaaagtgttcagtgacatcggaaccgttcggagttattacacgtgtctgatccaaccgtcgatatttttgtggtgtgaagcccaataatagttcttctcacggcccattaaatttaaaagtttgaaacgacaacgtctcatgtcgtttttaatctgaggaagaaaaaagctcgtaactaatccctaaatcaagagagaagtgagagacactgagactttgtagttgaccggatcattctcacttcgccggccgacgttcttccttccgccgtcggtatctatatttacgatccacgatctctcttgctgtttctgtcttcatcggtgagtaattttttactgatcttccaaatcctatcaattcaccatctctgagctctttcgttgatttgagttttgttcttactgcagtgacgaaa

SEQ ID NO: 3162 - DNA, 943 bp, Arabidopsis thaliana
aactgaatcttgcctggagaatgatccaaactgaaacttgctgcttttctcttttactctgcttttgtgagctctcgttccaaatctttgttgtcggcaaatctttgttgtgacttgtgagtgtagaagaaagtcgtttccacttgtagaataaactaaaataagcataacataataatgatggaagatctgtgccttttaataagtttaaatcatttttaaaaaatgacaaaaagaaggttctaccgagaattgaactcgggttactggattcagagtccaatgtcctaaccgctagaccatagaaccatttgatgacagtcctgatataaactagtatatactaaatattatatgcttgccgtaaaagtacggttacgtacgtagcgggtttgaaccaatcactaatggtaatagccaatcccaattggcagataatgttataaccgtcagattcaaattcgaattaaagggagccttggcatctgaacggttcagatttgatctttcttcttttctctctctctctctctctctctctctcagtttcagagatcaaaagagaccaacgaagaaaaaagcaccgcttttgcagaatcggtgacgatagaaagagaaagacagagagagagggagggttagagagtcaggggctatttgattcccctggaaaatttcagatatttgtttcttcatcttctttccttatttctctctttctcgtttttaccagatttgtcttacgaatcaattctcaaagatacccaaaagtggtagggaagcaaagtactgttttattttgcttttgattctatcaaaatcagcggtgaaagaaaggaattttttttattatcagagaaagagagattcttgataatcgaatagacctagatttttttttgaatttagggcttttttgatttttgagaaattgattgtggta

SEQ ID NO: 3163 - DNA, 680 bp, Arabidopsis thaliana
agttgattcttcgtaaaacaaactaaaaacactgcaaacaacaagatgcacaccgcgagttcagattgacggagaaatcaaccaaatcggtgaaacagatctagagaatctagctcaaaacttaatcgaagaaaacaatcggaatctgaagaaagaatatacttacatgagtggttgaaatgaaatacaagatgatcgaacgttacagaggctggtataaagagttggtgaatggatctttcgagaagcgagagaacaatatcccttccttatataaaagcagcttggacaacaccccaagaaatgtccctataattaccctttttgccactgtgtctctccttggattccacggtttaaatatattatttttcggatagtgggctgatggaccttaatgggctagcccaattatataactaataggcttcgagcctctttgagtttaagcgtcatctttctccttcgaagtattaggacactctcaacgacggatcagtgtagataaacctccttaccggagagaagcgtaagtcttgccggagagtcgagtgagctgaatggttggtactcaccattttccttcagtaattttctcagagagagctctttaatcgggaaaaatcttcaaatgcgtctggttttgttctctttttaatttttttcttgtgatttcattc

SEQ ID NO: 3164 - DNA, 877 bp, Arabidopsis thaliana
ttaggtgcttcaccaattcaaaaatctgtcctcttttttctaacaaaccccaaaatcgattcttcaaccaaaattcatcctcaaagcccaaagggtttaaggaaagttgatcaagaacaacaaaagatgaaaacttgcctgaatcttagcattgacgttcagagtgtgagttatcctctgcaggtcagtgcacagaggctcagctgcgcaagcgcttcattacccggagatcttctgcctaattcagtcaacgtcattactcaatttatcttaacagtatccaaaacgcggcgtatatgtctcattatcatcgttacgtgtcgtcttttcattcgctgtaatgattcatcaccttctcttcttcataaacctcacttcttcttcttcttcttcttcttcttcttcttcttcttcttcagtttcgcaattcgattcctaaagtcagcagttttgtttcttcagtttcttctcaaaccgatacttgatcaaggtaaaatatttcttgcttctctctcgttttgaatggtatgcaatcgaaatccaattttttcctgaattttcctttcattcgtacgttgttctttgtaaattagacaaatttttgtcttctcttgatctccttcacgtttgttctgatgtgattttaaatcgatttgtaaatcaaaatttacttctgattaatcatgttaggcctgaaatttgaaaaaatgtgaggcaaactttaatctcaatgtctgataatgcaagcataacagagcaattttgttttatgtagaatctctgattgaaagggctctttaaaataagaagaagggtctaaaagatggcagaatcagaagagaatagcgttttgtttcccattttcattttgacaatg

SEQ ID NO: 3165 - DNA, 2000 bp, Arabidopsis thaliana
ctgtgttctaactacattttttggtgattgcttcgtaacagggaagtattgcagaaatccagttacgtgactgttgaactttctcagaggtgttctctttcagatccttaactctcaggtttcaggttgctctcttactctttcgcatcttgttgagcaaaatttcgtaaataagaagcataaattttatcagaggaggataggagctacatgtctactatttttagttttttagccaatgggagagctccacttcataccccacttttaccaatcgtgtgattccacactcagtctcacccatgtcgcgttgagcgcgtgtctacgatttctaaagggggttaatccacaaaaatcatgcctttttggatccacgcacctcattctcaaaaacccatcgcgtgtcttattttttttggttttcttctctaaaccaaagtaaaccgaaccgagatcaatttgaatttcaaaaccaatgtaaacccataaaacccatcgctgtgaaaacaaaaagctcggccactgtaaccacaaaaatggagacgacacaacttcgaagagaaatcaactcgaaatagccaagagaatgttcgaaaccccccccccccccctcaaatccgatgcttcctttgattccagcctccaaaagcccatctgctcaaatcttcatttcgaggacgaggactcgaggagtattacaaggtacctctatagaatcaatggcttccatggattttgaaactttacttctaataaacaccattgtaatgtctttttggttgtgtaaggaacaaaggatagtgaaagctgaagagtgggattcgtttatggagtttcagagtttttttgactaagtggcctctgtttttgattcttcagtggtcaattttgtgatgggatttgattgaaattgtttttgatgctcactctttatcttagttatgatgcattttgtgattcctagacatgttaacaaaatagtattgagcctttgaacttttgaaacagagcctgactatatatcattgaagctttgtcttttacgccttttaaaaggaagttggcttttggggtgtacatcaacacttaatgtttggtatcattgttgagaccttgaggacaagatggttctcttaggggtgagtaaggtaatatggagaagggctgtctatgatgcagagaagaagaagatgaacagtgtagacagtgcgcgaaagggtaaaaggagaagcaggagatggttagtgcaaccacagttacatgggtttaggatctttactggcgacaagggaccttttgatccaggaggagctgattgtgtgtatgagctggttagagtatggaggctatttgagaagcctcatggaacttgtttgatggtcgaaacgttttcttcaatgtggccaacaaagacttcgatatatcaagataaatggcactagagctgtaaagggaaaaagaattaagaatatgaagccaaaaaattacttatggaatgctaactgttgataaaactgcggagaaaaagatggttgtgtcgagatactggttggaaatcgtaattgcatttgagaaagcactcgacaagataacatattctcgacctaagaagcatgtagttaagagttttctgtaagaacctaagatagaggctatagtacaaccccaaattcacgtttattagctgtgtaacacattgctagagggaataattgagatggaaggtctgcgtggaaaatttcagtcaagaagcatgagttattttgagaatcattttgctgaaattctcacacatgaagtgttccattccacttgctaaggccaccggagctaccctcctatgaagtagttttcttgttgtgcaagggccaaggggttgtagttcgaaagagaagataaagaacctctacttaggattcataaccatcttaggaatcgccactgtgcttgtttctctcctcccggagtttcgggtggtgggggcgtctctgttctttgga

SEQ ID NO: 3166 - DNA, 503 bp, Arabidopsis thaliana
aggggttaaattggttagtcaatgtgtaaattttgtaaattgtaattagaaaatttgacttttacataatttttaccataaaaaatataaagttgatttcgttatttaatacaactaatacatagaaatgaccaaattgggagactttcacgtggatgaagtgttcaaaagctactaataaattgcatttagtcatttagtggtaaaaatatcaaatcctctctggcttttcttggtcaacaccgcgtaatggttacatgaaagacacagtgtacagttgcaaaaagtggggataaaagcccaaggcccattgttcctacgggcatagccgcatagggttgaaaaatgtagtcgctgtaagtaaggatgattttgttataataatatatttcaagggctttgattgcaaattagtttagatttcccgaccacataaatgttgctttgttttttcggttaggcaaattcgttgtggttaccaaaacgacgacgtggtgaagcaa

SEQ ID NO: 3167 - DNA, 1462 bp, Arabidopsis thaliana
tttcaaatcccttatgtttttaaattccttatggttggacatgtagttaattagaatttagctcatgttaatatatgaacattttcatggtaatattttcttcttggaatctaatgggtggcatactggcatgatgggttctggctttgtgtgacaatatacatatattattttaaagctgttaattaatccgacgcttcaaatgagttcaacagccaattaaaaaatttcataatataaacaatattatatatcgttaatcaacatatatatgattttttttttttaaactaagtttatataaatgtttattcgcggcaaggcgatgtatattataaactattcttaaactgttatctcatggttatttgttatttcttacaacaatattttacttctttaactgttttttttctttttctacagtttataataatattggatgaggatcaccttctttgacatcgttaacaaattgttgatcgcaccacaatctctttcatcacgtcaccaaaaatatgctggatctttatctgacaagtgtcaaattgtggctttcttaaacattttagcagccaaaaacgacacaattacatacagtacccagtcagagatcaaaacttgtgctagctttcttcttcgtcagcaacacttatcgctggcataaaacattggagcaaagtcaaaaacgtaacaaccggtccgatgtaaaataaaactactatagttacaccagaaaatatccgaagcttatatatagttttcaggagatttttgttatctttggtgaaaatagagtcaaactcggtgtcgctccatttctcgaagcagactggtccctgagtcgtggtgaagtgtctctcgttctaagatgtggactccagttttgtttttcttcttttcactgtagacctagattgaagaaaattaaaaaaaactcataacgtttggcttttgcgtttttgttattgaaagatgaatatattcatttatattttttatcccgtaagattgccttctgatttgacgtcattaatatgaaaaatctaaaccaaaacaaaccgaatagttaaaaatcgatttaaaattatgaaatggttttgcattagtcaaattaaacggttttacattccttaaaatttagtatcaaaccaatctactgtatacattcggttttaaattggtaaacagaaaataaataaaaaactcttaaccgaaacgtaaacggaataatcaatctgtttagtaagtagtgtatctgacttaccaaaaaaagaaagaagtaagtagtgtatcggaatggttgcaattaaatagtgcaaaccgatttggatcattggtttctggttagaaaccgaaaccaataaaccgctttggttcaagagtcttcccttgggaacagtttagacttgagagcgcggagaagttggagacggtgaagatggcagtgagacaaaaagca

SEQ ID NO: 3168 - DNA, 442 bp, Arabidopsis thaliana
tctttgtttcagacaaacgacccttctcgggtcatttactatgatcctccttagtacttttgtactgttatctttcattttgttgttctattgtatctgccattattgaaccgctaaaaagatttgtaacggttggaaacatttttacatgtattgattgattcatcttttcctgaattccagtgaaattcccagaagaacagaaatctaactgaaaccgcaagaacttactgtaagcccaattctgttaatgataatgttaaatgggctataaaatgagccccgtcatcagccgctgaagtgaaacgcatcgtttagtatcgtcgtcttctggggaaaatatctttttttttaaacactatcaattcgactggaaaaaggatatttccagattaggtagagagagagcaaaagtactttcattcagacttcagtttaagct

SEQ ID NO: 3169 - DNA, 2000 bp, Arabidopsis thaliana
aaactatgtcaaaacttgaggaaatgttacatttacagcaagcaaaatcagaaactagcccctattacaattcttttttttttttttttttttttgaattgcaatctttatagagctttatggttatggtacgtgtaatctttatagtccacgtgatttagcgtgaatggaactcaagactggtcgctaccatcaacactatggaaactttcgcgagcacatgcacatcattactctttttcagaacattcttttcctctatccaactaaatcaaattttctattcaattggccggttatctgaattctacttcacttgcatttcatattttctaaagtactgaaaatttagctaccatcatatgaactattttattcgtgaattttatataagtgaaagctggtgtcgctaagtatatatacaaattagatcgaatatttaaccatgttaaaatttacgtttgttatctgaagttgagttgcgttaaaagttttcctagattccaacgattatccttatatgcttggaaaaaagcaagaacatagataattgctacacctttacttgaagtcaaagtaatagcctttctatgtacgggtattatcaagaaaacatatacatatcttcttcttttttgttgataaacatacacattatttttataaatagagatttcataccaaaatttataatagaaacgagaattattctttaaaacattcatataatggttagtcataattaaaaaaattgccatgataaaacatgaactatatatattttcacgtaacacttcaagtacttaatcaaaatctcataaaaatattcaaattggtaatccaactaatgatatattcatttagaaaaacttataatattttatagagtcaccttatacattgtcaaacctaatttaacctacacctatgacctataaaaaatccctaaacttcctaattaaaaaattacttaaagagaatatttgacagagaaaactataagattgttgatgaacgaataacaaacaagtaaatcttgggttgtcgactgaccaaaccaattaacgcaaacacaatatatctctatatattatcaaatatcagcatcatagaaacaataaataaatacgaaactatgaagcaatagtgacacaacaggtacaactaccgttgcaccagttggaatagatatcctcttctgattctgaaacctgatttaccttcagatttggtcaaagctcttagtttatggccttcatgtaatgttttttccgctgtcaattttgtcaactaaagtatttaatatcactacttatttcgttttcatgtactgtattttattaccttcctttagctttacgcaaaaaaaaaaaaaaaaactactttccaatgacctttgtctggtcaatgcttcattcgccaatgcaccattccaacatacttattttgaaaactcaaaaaccatcaatccgaaaaattcgtcttggtgttagtattcaatgtcttgatctccagattgcacgtatatgaatcaatattaatacaccaaaaagtttttaaaattgagattgaaaaagtcatcattacacctttttaagctaaagaaagaaagaaagaaaacctcctttataaaactccccgtggtccattaactttgtcggccttaaaggaaacgtcgatcaccagtaaccttcctaccaatcacaagttcacttcccaaaaaaactacgaaaaagaaaagtaaagaagatgctatactgattcttttttgaacaaactcatatttcccatctaggatcataattcatacatttagacagttgagcccaaaatattgaatgttatgggcctaagcctgtattaacggtctactatatacttcttaaatattgataattatgggcctaagattgtattaacggcccatttagttatcattctatgtttcaacgccatcttgcgagtcactttgcttagttcttctcatcatcatcttctct

SEQ ID NO: 3170 - DNA, 2000 bp, Arabidopsis thaliana
actgagaacaacacaatggaaatcagaagagaaaatgggaaaaggttattcgaacttattaaccatactatcaattttatacagtctatttgaattttattggtatgagctcattcgagtgggaaaacaattttggttcaagtcaatgaaagctaaccaaaacgagtttggtaatttggtcttcttactcaaaatctgtttcaactttcaacaagcaactacacatttgttctactgttgggcttctacttccaattagtgatctgaccaagtatttggggcttctaattaactactacaaattgttttgggcttccgttggttaaagtaattgttataacaaacaaaagagaagagaaattctaaacaaatatcattgcttaagcatatgatgatgctctttaccaatttttatatacattcttttgtttcaacatactttatatcatacgcgctcgtgatcatatcattccgaagcatagaatctcatttgagatttcggatagatcggacatcatatatacgtggatactatttattttcgcatgtgtattttcatgtatggaatctcaaaataattgaaaagattttggaagttttcgtcgactctcacatgcattttggatattcttgtagtcgacgcctcttggatcttgtctagataagaaaaacaatacatgaacacaaatttcaataattgcaaatcttaaagaagaatatggtatgggttcccgtttggcttgtatgacatgacttcggatggtggaggaaatatacatccatgataaattaatatttttatcttataattccggaattaaactgataaactcctaaaaatgaataaatatctatcaaaaaaatataattttttttaccgtcttaaatttattatttattgcaaattatgagaattgttacatagccgaatggatataattgcacattgttgaagatctcctgcacacttgtctctaccaatctgcaaatctgctaataaatcacagtatctgggactcgaaccccagacttttttagtgtacaaaagcattaatgaaccttcggtcaaccaatgaaccaaaaaagcttctaaatatgaatttttaactgacaataaataatttttgatgttgacaacgactattttcattaagtttaaacgaggaagtaaacatttccaattggtgcagaggcctatttccaattactgttaataattagttgtatctttataaattataacagttttaaaactataaaggaggttcctagctccttcatggttgtcatatttgtttgtataatgactctgtcactcttccagtgacataatcaaataatctttgttggaaaaggaaaacaaaaaacaattttctcttttattcgaaacttgtgtattattcacgaattttttttttccttgtagcaaagttttatgacaaacagatttttttttaaaaattatgaatcaaaccttttgtgtataaattaacaactcgtacaatggcctttcacatatgtaaggcaattagcaaataaataaataaaatcaccttcaaaaagtccggtcaaccttttttttttttctttcaaaattctctttaatttccttgttaatatatatgggaactaaaaatgttatttatatgtggaacaatatataccacgttaattacctaaacatggaatattcagactacttctatccaccgccccttttcattgacgtgcaaataattttcacgtaattgtctaaagtccattttagtcttatatagtctcggattgaaacaagaaaaacaattttttcgactttaaaatttattaattattttgaagagttatttttctagtgacaaagttcattacattattttttctcttgcctttttctatttttaattcttgtccacataaggactagctataaataaacaaagccacacgaaaacccaccatcaggtccatcacctcttacattttttctccaaagtctctca

SEQ ID NO: 3171 - DNA, 40 bp, Arabidopsis thaliana
atgatatgtggattggtgtgttttgaaatggcagtatgca

SEQ ID NO: 3172 - DNA, 1679 bp, Arabidopsis thaliana
tttttttttttattaaaaaataaaaaaggaacccaaccaaacccagaaaaatcggatcaccaacaattgcctaattctcccaaaccaccacaaaacccttccttgcaaagtttaaaaagtcaaacgacacgaactgatgatgataagactttccagggtaaagaagtaaactgttcgagcttttgctaatacgattatacgactaagcttagaatcgcttaagcaggctgaagcggacctaactccaaacaaaatttgtatttatatataattgtttgttaactaattaactaccacataaatttcccaaaaaaaaaaaaaaactaccacacaaatttgtagtttttaatgaatttgtaagtggattaggtttggtgtttcacaataatgaccaaactcgaactccacttgccacttatgagtttttccaagtcatagatgaggattactgtgttggtttcgatatcttaattaatccgtcacacttaattctttatgttttacgattttttgaagtttaagattttgctaacattacactattcacgataaatcactttttcagatttaagatatttttcgccggaatttagaaggtaggatatcctttaaaatgcttttgtgaagatggattatattatacaattggactatttggtgtagataaaatcttatgtgggaaacaaatattttaggaacactaaaccaaaaataccattgttacattttttaatgataaaaaagttcacttgcaaatgtaacaagatacaacctcgttgggttgatatgttaagaaaactagctgatggattggtttttcattgggtctattgggccaatgtcatgggcctgatgacttttattcagtttcttaaatttatattccagtttaatataacatactctttagtgtgtaagcatttctaaccacgcgactagccgactacgcgaaagaaagagaattgtcatactagaaaaccgttaccacgtacgtaattaagaagagtccattatttttacaaatagatcccttggccgtgtatttggacaatgccgacatgcatcttatgaataagggcaaaaaggactttcgagtttactggcgaccacaactcgcaagccaacgcgagcctctatttattattttgtatccttttttttggtaaaagaattttgtaacaatatccattccctagctagattcttcttcttcttccttggatttgttctcgtaagcattcttctccaaaacgcccacttgttaaatttgatccagtggatttgggttttgttccgtctttaagctccatggcgattgcataattatgctctcaggatgggtttctctcaggccattcgcttgaatcttgcttccttctcctctccctctccctgcgatgtttgtttccttacctttctctatattatcccctatattttcatttatatatcgctgctgattcacaacactttacttactcttaactttatcaaacttgaatttttgacttttgctggccttgttctgattgttccttgttctggcttaaaaagattgcaaatttcaatactgttcctttaatttgaataagtttgcttgcatccatattgattagtgtctgtccaaaataatcaaacttttgattttgattttgatgtcggccatatgattttttctt

SEQ ID NO: 3173 - DNA, 1681 bp, Arabidopsis thaliana
tattttgaatctgttgatgacttctttctgttttgtacgtgaaccagtagtttaagaaaacaaagtgtatcatcaagtgctttattataatgctaatctaggctaattaatcccaatacgaccatattagcattgacagagaaacgaaacagagaagatgatgaagtatggaatttttcagtaacttaattctattacaaagcttcttttatactctgagagttaatatgtatacatagaacaatcagttaagagactaactaaatcatcatatgactcaagggactaacaaacttatcattttaaactgaggtagtatctaatatccaatgagacttggaacatgattaggaaacaatggttttgtaaacacatctcctagttaattctctcttcgtaagtgtagagccatgatcaaagtagcttggattcttcttctcacaatatgactttggtgcgttaatgaaacaatggattgttgttggcaatgtgtatagctgcagtagtagccacatatgatatagcattgacaaattgccaaaacacttgactctgcattcgcctctgttttggccaactctctgacacctctttaagccacaaaaccattgtagtagacaagagatttaaatgacttacatctcaagaaatcaacaagactgcctaatcaataacgcattgatcaaaactactgagactttccatcagcttttcattgaaagaaaacaaactgaaagatttgaataaaagagttaaaagagttcactcccaagtcccaatcaccaacctccatgtcccagaagacgccaatctcagccgcggcgaaatctcttgtggagccgggagcgagacatggttattggtgttctctgtgttgaagatgactcacccacctttgtgtaatcctctgtctcataaccatcatcgtttctgttattggttaactgaagtctccccttgaactgaagtacttgtccacttcttggtgaccagttgtgagatcccacgattgaagataggctttcctccatatgataggcttgtccaaagccacactgcagttacttgactaagaagcgattgtgataaatcatcatcatgagccaagttctcaggctgagctaagagaatattcccagtcctgcttttcatcataaacgaaagacacttgacgtacgagcagtcatctgtgattttgcttgagattaccatgagattagttggtatacgtgtccggtcaactgtccataacataagctcctccaaaaatcatagaatgtatccattaccttaataaatcttgattaaatagtaatataccgttatcggaaaaataaaattcaatataatagtttcattcacttttaaaattttggaaaaaatagatataaatataaaactctttaacatttatctccctaaaacacgagatttaacctaatatagatcataattaaatcaaataataataggaaaaccaaaaaggaaaagagtcacgtttattgtcggtgacccgtagcaacgaaagaaataggaaggtcaacaattttctcatacccgtatataaaacaaatctatctctccttccctctttaatttattaatcagatcttgcccaattcttcaatttcttcaaccctaattcttctctctttctcagatctaccaaacttgatctcca

SEQ ID NO: 3174 - DNA, 1049 bp, Arabidopsis thaliana
tcccgtgactttgcctccaccggttcaagaccttccttcgattttacctcccccggctgatgagttgccgccaccggttcaagaattccctccgattttgcctccaccggttcaagatttccccccaattctcgctcccccggctgatgagttcccgccaaatttgcctccaccggttctagaattccctccgattatgcctccaccggttcaagatttcccgccaattctcactccaccggctgaagagttcccgccgattttgcctccaccggttcaagagatcccgccggttttcacattaccaccgaccgtacaagatccaccgacaattccagtattctccacaccaccagtcctcggagatttcccaccccaaactcccgactttaccacgccgccagaggtcacaaatccatggcaaccgccggtgacgtcattcgcaccaccaatagagtccatcccaacaataccggataatccgtttccggttacaccaaacccggacatgggttcaaatcaaccgtttgttgagcttcctccgcctacttgggattccccgccatttaatcgttaattctctttatatatttttaaattttcgttttttttttcagttaatcatgtaatgtgtaatctaaacgcaataagccacataatgcagccattttgtaaattcattgctgtcatttacatttcaataagaaaataaattaatttccacgtgtcattttattttcctctcacaatttagatttagataagtaaagtattagaaaaatgtaaatactgagttggcagaataagacagtggtgagtgtgggtgatgtggatatggtgaagtagtttctgactcctaattggtcagaaatctatccacgacagcctctgagatttcgtctatagattctcattatctcacattgtccctctaaatctcctctctttgattctttctgctccgaaaaacagagagagagaacaacaaccaaacactcatttctccacatcttgagagaaaaaaacagagcaagtatattagagatctc

SEQ ID NO: 3175 - DNA, 2000 bp, Arabidopsis thaliana
ctaaccactgatgcacaagtttatattagtgtaggtatcatccacaatatattatccaataattgaaccttgttaatgtctttggttcataaagcgatctataatcaattcagcattattgctaaaattcaaattaagaagacggcatgatttgttaaaaccataaagaaatacaaaagggtcaatgataaaactgtttaaacgaatcagtctacccaagagccgtctctcgaatactagttttaaattcataagcgtatagagtttagtgattccagaacactttacaggccaaaatctaatatttcgatattttgaaacgacatttttagtcctataattaaatttgcaacgtattagattacttttaaaatgtgatactgcgaagaaaatgaatcaaaagattgaatcgaatattcgaacagacggacaagaacccacgaagcgatacagatcagaaactctgcttctttttttaacaagagatcacaaacttggttgacttgagttcatattataatgacgtactcagtgattcgaatattccataaatagtcgtaagaataaagaccttaatgtatacattgttcatttcgtatgccacattgacgaagatcactgatataaatttcaattatataaatgtaaaataacaaaacaaaaagttacatgttatcaaatagtgtcattagctaaataacatgttacttggccaccacatcacttttgttgagaaatttctaaaatttggctatttagtgcatataccctttaaaacttgttgtaaaagcaaggaagaggaaaaaagattgaacctatagcaaaggaaaaagaaaagagagtacatattcttaagtcttgattacaatattttgttcttcaacatattctcttagagttgagataacataaattataatatagatgctctattgggtagcagtagatagaagaacatatgctgaaaatcatttttatagatctagcaaatcacctttataaaggatccagatttttttttttttaactttttgaaagtcaacttgatcatatgtgaaagttagagtcagagatttatgcatcttcgtgcatagacaaaatgcatgcacgagctcacacgatcctgtttttttttcttaatgaggtaattttcttgctgtcatttttttttctaaagttaagattcatataaaaaccatatcaggtaattccttaattttgtgtaataattaagaaatcaggatcattagatctttgaccaccaaaactcaaatttgttcccaaatacactcagttaaagtactatctttaatcatttcatattcgttactttgtaaattagtacaaagtaagtaacaaattttagtttacccaatgaaatggaatgaagttaatgaaaatattcgttcttttagaatattcttctgctcttgacagtgtttaattatttaattttcttacttgaaaaaataaaattgaccaacaattatttttcttacctcatgtagataacttacaaaataaaacatatatatatgtatatatatatttattttcaactcagaaataaataattctaacgaaaaaatatgaaataataaaaaaatctgacttaaaaagcgcgcatcgctcatgccaacacactccctcgtctataaatacttcactctgctttcctcaatcacatccatctctgaatctgattccacatcttaaacccttattccctaaacatcgaatttggttccttctcccacaatccgcagagatttcttcttttcaggtttgtcaattcattttttttttcagtttgagttttgttttgttttttcgtgattttcggtcagtctaccaaatcccctgtttttccggcgattcagttgtcaacagattttgcttttctttttccctttttgtgtaaaaaaactcatttcctttttgatctgatgattacagaagaagtaagagggtggcgaagaagatttgattgatcggcgata

SEQ ID NO: 3176 - DNA, 1063 bp, Arabidopsis thaliana
tgaacttttaggatttgttgcagcttccaagtaaatggtagtgtttggtttgttcttagatcaataatgtagatttggggctagtgataatctcctttctttttgtacaattttacgtatggtataaagatggattcgcataatttaggtggctgatttatcattctggtaatgtgtatggtttgagtgctgatttttggtgctatgagttgttctttatggctcaacttggatcaatatggaggttgagtttgagattttctctcagtttaaggaggtagaatagtgcgtatagtggcacagtgagctcagctctagggccaaagggcataaattcattatagctctttcgattctaccgtagtactgtgtgtgaaccggcactgtgaaccaagatgattaaattttcgtattctctatgtacatgatcctgcggctcaatcgcttcagtttcgatccacatgatgtatatgttatagaattgtgggaaactccttgtagaaagagtatgttcacgtctaggactagtcggatgattcgtttctctttttggtgtaatgagtatgttcataactgttgatacaatgtgaaaatctaaccgttgagcttgggagttttacgtctatatgaaaattccggttgtcgtctacattacggtagtaaacaggaccacagtgattccaaatgtcccaaggaatttactgaaaaccccaactaggactgtgaaaggcttgtggatgacatttaacagttgagattttcatgtgtttgagattcttgtaacacattttgctgtataggtgaaagcttagccacacaaaaggagaaacagaggatatggataaaataaattatccaacaaaaaccaatctaaaagccacatcagcatccacaaccaatcagaggacagaatcatatttcacattttcaatccagaccaatcaaaatcctgaacgaatcctactctccaccttataggagcagtttcgtctcttcctccttctttcacttagctcttcctagtgttaaaccagagtaaagcttgaaactttggactaaaaga

SEQ ID NO: 3177 - DNA, 2000 bp, Arabidopsis thaliana
gtttggggttaattaggtacagatccatttgtattataggctctttattcctcagaaatgggcttgctacaataaaattttagttatgatgatataatattaaacttcaacaaggtagtgagattatacccgagaggtgggtgttacacaactcagatcgttggttgttcaaatcagcttggtgggaaaccactttcgtggtcggtgtatgaacatgggccttacttagcctaaatagagtcaaaaagataattcaatacactactatattaactagaccatatttgtttatgccagggctactttctttttggctatcattgactataataacataattgtgttctttagcctaaatgttttcaaacacagatttgttgtacatggtcccttctgtttaatgagttggttaaggctcattattgtgttattgacaaaatgaaatcaaaattaatggtacggcaataaaagatatttagaaaatgggatcggtggctatcagtgaaatatcagagattagagattggtttagtctttaaaccaatattttggttgtaacctgataaacaattttgtaatcctcttggacatttgtacaaacgaattagataaattgtacattctagttcattaatcattaaacatttatctgatttttcattttggtaatactttatctgtttatcagttcataatcaaactggttctctacactttatggaatcaaacaaccaaatttctttaacatcaaacaacaaattttcaaagtagcgacttgtagcaatatgttcatcttaacaatgactattattttggtgtaataacatttgagcttattcgattttatatggttatactttttttggggaaagaatagatgttataatatcacatcaagtggcaataaaatgccaactatatatgatttcagattcactaataaacattcgatcgataagaactttcaaaatgacaccttaccttctgaatcactgtcgaagtagcctttacaggctatcaaaaagtcttattttatacatttttcttctgttaccttattatatttatacaaaatatttaaatccactgacagctctttccaacgggtctattagcaatgtacaacggtaacaacgccaataattttcacaaaaactaattcaatgatcttatcaggtcaggcacatggtttaatgattattacaagtttttcacatttctttattatactaccaatattttgccaaaatatataccataaactaaagaaaataaaagtgtacatgaaaaaagaataaaaaagactggtggatcaagtagacaaaaagacatgctaagttgcaactcttagttcttgaactgaacatgttagctgtctccccacatttgccatgtcatggactttgtttaccttgatattttcaactatacgtgtatcattacaaatatttgattctctctccaattatattcaccatccaatcacagctcgataagtcagaagtttattcacctaatcataatttacagctcttatgttaacgttaattcatgattatggattgtatactaaggaaagtcaatataataataacatgttaagacttcatccgcctaataagtttgatattttttctttccatatgtaaaactaatttacctagtaatatgtatgttcattaatcatattcaatatgtaattaagcatagtctaatcatattcatttatgttataaaaaatacttaaaatatattaatgctagggcaaccccatgttacaattatgcgtttgcatgttagtctgcaaaatttatctttaatatattaaaagagatttataggaatcttgttttaatttaatcgaaataattcttcacatttttcctcctttttatacatctcttccatttttcctcaccttcacaactctctcataatctctctccctcactctaacaccaaaagaagaagaagcattttccaaagagaaagagagagaa

SEQ ID NO: 3178 - DNA, 1516 bp, Arabidopsis thaliana
acccttctggagcaaaattttcatctataaggtgtgagatcagttaaagcctttcagggctttgtccgaataagaagtgtgtttgaaagatctccaaacactgttttataacctctttggtctctttgatgagtattgtccctggtctgtttctaaaccaggatatcgtttttttcaatgtgtctgatttggtttacccatgaaaagaagaaaattggcagttgcatggttatcttttgcgattatttttttctgctttagcaattagcccaaaattgatgagctcttcgataatgggtttgtgcaattgtgatttgtgaggaatggtgttattgtgttgcaattgcaaaaagaaatgctactcttgcagattcataccaaaaccaaatcactagattaaactgaaattctaatgtggattattttaattttacttctatttttcttcacccaaatattttataaccaaacaccaagttgacaccaaaatatacatccaaaaaacttagattgcttctattttacgactatccgaaatcgaatcataaaccgtaggcaatggtccattaataaggggtatacgaggattcaaagtttgagagaacttttttatctttacctttttccttttgtaaagtaaaagcagtggattttgattatagattctacttggtaatgactaatgagaatcaagttctcacctttaagccatatagactttagatatttaatggattctacaaaagtgggcatgaccagaatcgagttcatgaaccaccgtcctcggccccaacgttaaaaaacttttttctctagcataagaagataagagtatcttcactgcgctttaggcccactcaacattcaaacaaaattcgatctcttataaaaaaatatctcacaagagaaagttcgtacatgatcccgataaaatcgtagatgagcaaatcaaagatgagatgtcggtaaaaaaaacgctattataagaacacacgccactagttgtggataaagttgtctacttttgtctcgttgtgattattatattgcacaattattaacattcatactctcatatgggtattgtttttggtctccgttagatctcaaatctttaactttgcatacccaaaataggaagaaagaagagtcaagtcactaaaataactttcacagtctttgattcgaagatctttgtcgccgagagatatccactctgatttgagttctggtaaaaagtttccagcttttgatttttgtttctctcaattgaatttctcttgcttgctctgtttaaaaggattaggattaaatcgaatctctctctgttatgtttttttgtagattattttggattttaggactcaaagattacagatttcttatcaatcattctctgttattgttatagaactattctctggaggaggttgaggtctgaaatcatggaacaacttggttagagtgtggaattttagctgatttgatctttgattcatctgtgatcataataact

SEQ ID NO: 3179 - DNA, 1294 bp, Arabidopsis thaliana
gaaatgtaccacttgtgttgtctatgtaaaccgctgtatgtgtagtagaggattctatagcttgttctcagacattaaccaaggttgtaataaagcggtttcattgtgacttgtttggcataacaaagtatttggttttgttgtttttctgtgcgttgattaatgaaagatgtgactcattgacgtgaacatttatgccaaattttgccattgttgttcttgactatggtagacacataccaaaaagttaggttacctgagtttctggtaagtatagttgctatattgcatttataatgtacataggcttctcacacattatcaaactttggtaagtttgtctctattttttttaccgctctatcttttagccttgctcatcggatatatatgtccgatgacgcttatcttgattgtgtaagcgtatgaccctttttttgttttgtgcggtatctaatgcttatcttgattgtgtaagcgtatgaccttctatttgttttgtgcggtattcaattcaacatgttgaatttgaaaataatagtaagagaagtacaaattgcaaattatactaaattgttataagattgcaattcaattttagcatttagagtgcttattgaaattagaaaagtataggatccgcgtgtttatcatatgggcgggctaggatcaaataggtcgaatcacgaaatcaaataataactaatcaggtcttaacaatgtttttacgatagatttagtcttaaccattcattttgtttggtatgtaattaaaagctaatcaagggcatattctctctctattcgattgtattctctagagaaacgattttcatatatttcctaatcaaaatagcatatttgaattattaatttgtttccctcaataaggttacgaatatgatgcattaattttggatttaaaaaatcttgcttgctcacgaagaaatcagactcaatttttatcgtcatacaatgttttccaaaatatgtgtacatgttcttgcagatgagtctattagtgagggttacttaaacaaaatgttgtatttttggaaaaaaaagtttatttttagatattggttctagattttacatccaatttttgttttaatcataattttagaaattctattatattttttatggtcaaactaaaattagaaatctattaatgatttacatcattccgtaaagcactataaattgtcctaaggcctaaatacattttcgcactcaagtcaaacaaaactcttctattttcctctgtcttcaaaaccacagagatctcttc

SEQ ID NO: 3180 - DNA, 803 bp, Arabidopsis thaliana
taggctggctacaaattctttactctttttttgtattttccaacagatttgtcaaagagggtcttttttttctccaaataatcctttgaataatcatcattcactttcttaacttctttggttattatttacctttatacattttgttcatacttactatgcatcaatatcaacaaggttgatttttccatcgaattccaccacaccaaaaggaaccaagaaaccataccaaaacttctttggttatttatctgaaactaattcaaaaagatctgatcagtaaacctttgttctattgaatctcacattaagagaaacccttttaacttgagaaggcatacagatatagagcatcacaaaatccccgaaacaaaaccgaaccagtcataaccaagaagggggaaagctactagatgaagctagtaggtggaagtttgagtcatttggcctattactacgcactagttatgatcttttctctgatacattgaatactttattaaaaaccattacataaccaatgtaaaagcaaatatttaaacgttaaacagtccaattcagctttgaaaaatcctcccagaagaagaagactagtcaatattggttgcgatggccttgtagaggcattattatctgttagataatattaaacattaatgagaaagtagaaatgcttctgtataaataccttcattacttgtgtcttatttcatcaccttcaccttcaacatcaaacatcacatttcttcctcttttctctcttttttctcagtcttcaaagagtttcttagtaacccaaatca

SEQ ID NO: 3181 - DNA, 2000 bp, Arabidopsis thaliana
ggttcttagtacatttaatagaaaaatgattatttacagctttattagaggctattgattgatttagtaatgaactaataatgcaagtcaacagatctaaaattggaaagattattggcaatggaggcaggacaacgaaaatcaagcatattaaactctttaagattcgtataattccaccggcctaaccaaatctctaagcaattgttgtttatgtattataatatagttcaccatctatttaagcttaaacgagtgtctaatacatagacgtatatgacaattaattaatgatccgatccaaacgacccttggcgtatttggtaaggtagcagtgatgtgcttaattattaaccaacgatgtactgagtttctagaattagtaagaaccataagagttttaaaaagtgtaaaacgtaaaacatcaacacatgtcattccagttaacatacatatatctatatatatgttaacgtgtttgcataatttttttaattagagaaaaacagcacactatgcaaaagatcgttcatatatctaacgtgtgatttaatcgatctaacaactttttattcccttttatattaccaaaatatttatttccattgatcatatatttgaagtagcaaaaattggtaaaattttagttaaaaatgagggagatgaaaactgatatattatgtaaatctcaagtttttgtaatgcataagaaaaatgttatcaccattgcaactatccatggtagcaaccgtatatctcagcatatgatacaaaaaaaaaacaagaagaagctcatattcaaatttcttacgttcaaacgaataacttgattgctaaacaacaaatctagatagcattggattcatcagtaagagttaaaatcgtacagcattgtgaatcataaaatgttgtacaagattgtgaaataacaaataatattgtaaatttatcaaaaaaaaaggggattgtggatcaatgaatatgatggagaatgttcatagaagaggtaaataatagagggacccaaaataacattgttgaaatggaatataatcataaatgagtcacatcttcaaaatctgatcaaatcacttggaaaaaaaaagatcaagtcacatgcaaccagtaaccacaatcatattttggccggtctatcaccatacacattgtttacagctcacacttgtccctccttatatttgttcgtatccatttgttttcttctctctctactctaatctcatctttatgtttatccctttttgaattttgaagctactctgtcctttgggtccaccctccaccacctctaatttcaatcacgttaaaccggccatattactttaaaccgaccgttttctactaataggaaaatccgacccaaatttttgactaattataagacataccgccgctataccatgatattgtcaaagaaaaagtttctaaccaataaccactatagactaaaagatttcaaataatttgattgatactgcattgaacattctacaattctacttatattgtgtagttcaaataatgagaacatatcggaaagactagccgctattagattatgaatgcgtatgaatacattatacattatagtatatatatatatatatacacatatattaaaatgtattactatataataatttgtcttagtatagtactcaaagaaatagagttttcttacgtagatgtcatatattttagtcattttaggcaccttcctaactcaaatcacgaatagaacttatgtagcaaaatgtaaacacatgaaatcatttattaattcgggtccaacgtaacccaccacaccacagaaactcattaaatagtatttttttataaaacttaagttatatgcatggatacatgaacgatactcctatataaagagaacagcattcaaaaggtcttatcatcttcttcactaaacaaaaaaaaacccttcaaaacatttccttattctttcttcttcatctacaaca

SEQ ID NO: 3182 - DNA, 2000 bp, Arabidopsis thaliana
aattttttgataattctgaactttagaccaaatgcatatggacgagctatattctggaccaaaaaacaaatggtctaattgggcatatgaccagttttgtccacggataatatgggcttgaccatatggacaacgggctgcccatgggcatgaattgagtcaatagacatgtcttcatttaattgtatttttataattttaattacaattacaactaaataatttttaaataatatattttacatttataagtttttacttttctgaaaattttaaattttaatgaattatttcttattaaattatttacgattttaaaggaaagatagtattccacaattttctggaatacgcaatttttaaattttacggttttgacgggaaaaatacaattctccgattttacgattttgacggaaaaacgtaattctgcaaattttccaccaaaatcgtgattttattatattggcgagaacacaattttacggttttgacgggaaaacgcaattctctgattttacggttttggcgggaaaacacaattttccagccaaaatcgtgattttattatattggcgaaaaacacaattttacagttttagtgagaaaacacaattctccgattttacggttttagcggttaaatcgttatttttttgtatcggtgaaaaaaataattttacgattttaccgttttggcgaaaaaagcaattccataattttttcgtcaaaatcgtgattttattgtattggtaagaaaaacacaattttaccattttgtcgaaaaaagacaagtcttcgatttctacaatttttacggaaaaatgcaatttctcaatttttctttaaatttatgatttttgatttatcaataataacaataataaaataggctaaccatgggcttgccatatggacatggtctttattgggcatggacatttttcggaccaaaccgtccaacttggcccataaaaaaactgtccgtacggacacgcccaatggtctttggacggaccatttgacacatctagaaacaaccgtcagcagtagccattcgttaagagtttcagaattccgatatatacattttgatacaacctacacaaaaacaaagacaaagagagaaaatccaactatgaggaggattatcttgttgatagtgccatcaaaaacaagagttagttattcacctgaaggtttggctaaacaaagtatattatctcttttcatatacctgtcaattacatcttgacgctgcattgtcaacaatagagacctcctatgtcctttgtattcactcttggctttcttaagtactctagtagattcatctacaaatgtaaacatggttgtcttcgccgcgaggtcgtttgcatgttcttcttttacttgtttcgtttcagttcgttcttgatcctgcaagatcgggcgtcttctcattgcggcgttagttaattaaagtattttgtgcaaaaaaaatttccgtccaattttgcaactttatactctatgtccaaaaaaaacaaaataattatatgaaatttaaaataatacgtaatatagtcaatttttacaattttacatattgtaaacgtaaaaacatttgtttttgaaattttttaaaaaataaatagttaaactactcatatcaagaattttgatttgatatattatttatcaaaatttaaaagtttaataatatcaaaaaaaattatattgtgtatttttttaattttatataattattctgcattcttttaacgtgaaatgtaaagttgcagccccagggagtattttagagttttttcgaagataattgtaatcttaacttattatttcaagggtattttgggagattgactatttttttttgggttctgtcttgaagacaaagaaagctttcttctataatacatctttctctacagatcacacagaagcaaaaattccatctccgatttcggaagagagttgttctcttctctgagaagaagaag

SEQ ID NO: 3183 - DNA, 2000 bp, Arabidopsis thaliana
atatacatgtagtttgaaaactacataggatacctttgaaaaatcatggtatttgtaatattttccatttagaacaaatatatggattatattaaaacgagtttaaatgtaaaaacaaacctaacacaagaatggagaagataagtagaacggctaccgagacttgagagacatttttcatcttaaaatagataaacgaggatgatttttgaagattacaaagaaacgaaaacatgtatttatatatgtaaagttaaagttacatgtatcacacattcaaatatgtctaatttaagtaataaagtaccgatttaaaaggatcatgttttacacaattccggatatgtaatattgaaggaaaaatctaaaataggtttctaattaaagatatatatttattccaaaaatggaagtcaaaatcaaaaaataatttaacatatatcatttagctatgtaatttaatagaatttgggttgtacataactacatatgttcaagtatgaagaaatagatataaaatcaagcatgaaagacaacacaaatgttaaatgagcaaaaccaagaaggcaagaacaaatatagggccttcgtggaaaccttttgtgcgacatatggaaacccattaggctagcgatgtagttggcccaagaaaccggctttgactcagaagatatagttattgattttcggcttcgtcaatcaacaacactgtaattgtaatgacaatagttggtgccgacaaaaaataataatgacaatagttgggcttaggtttataagttcatttttctaaaagttaattggtgaaaatcaattgcaaacaatatattactctcttttcttagtagtcttctatataagattctgtttgatcatgagataaaaataaaaataaatactctttttaatctgtgggtaaaaggtaaaagagacatgttatggttggatctgacggcccacgtgtcgctcgcactccgatctcttttcacttttggtcccagtaaggctgtccgtatggagacatcttcccatgcctttggacatttgtgaaaacaagatattattattagaacaactgaacaagatattgcaagtgttacttttatttaatttcactgtggtaagataaaatttgaaaatttacttgttgctctgatcttgatgcaagtaacctcaagttttgcccattcttggagaatgtaaatataacttcgatccccaaaatgtgcctcctgtcatgttggaataactggtcagattttcaaaaggtgaccatttgtctgtccataatcatcaatcccttatattctattccacttcttaaagtttttgttctattgttaaaacgagttggtttggtttggatcatttgaaatgaatgggtgaatgcatgaattctaagagtttgtcatgatacttaggcttcacataaaattctacatatggttaagaagaaattaggtattctgaatttgacgatatttcaataattaccaatttgttaccttgtgataatttcacgaagctcgaggctagaatactttattttataggtcccacttcaatgactcatcatccttatctagatttgtgtcacattccatctagcacttttttttatttgcacaccctccccactccttttcttttgtgatcctaaaattaagttcaaaaattattttaattttggaatcttcagattataagaagaaaaaaaacattgaatcttacataaatacttaagtagatttgggattaccggattagtagtgacaaaattaactaagaaatattattcaataataaaacaaccagtaaaataaagtcaccaaactttttaaatggcgtggccggtagtgaaaaaacaagaaaaaaattaataatgtaaataaaaatcaagatattttgataaggtgtctataaaagtcatatgccaccaccaaaagtgtttcactgtctacaaaatcattgaagatctacccaaaaaaaaaaaaaaagag

SEQ ID NO: 3184 - DNA, 889 bp, Arabidopsis thaliana
aatgtgtttgtgtctataaatttgtttgtagtttgttgagattggagttttcggaaatagctcgtcatattatgatttctttgtgtgtggaaaaggtttttttctttttatggattttgtttctatgtttatcagtttatgttcgacaaaatggcacttatctatgtaaacaaacaactgaccctaattggaaaactgattgttgtcatagagttttctcagtttcttctattaagaaaaacttaaccgttggttaaaacgtaattatcaacaaagacttctcttttggtctgtgacgttgattccaacgataagaacaaaacctaatctttgttttcttttgtcaacaatagtactatcacctttgttcttaactatttttttgggaacttaaaattgacaacaccggaattaaaatgtttaatactatcaaaattatatgaaactaagctgtcttttagctatagtttaattcatttctgacctctaaaataatattatccggagattattgtagtttcgtaacgtggttgatgaaactactaggtgttttcttaattagaccacgattttaacattacgttacactaatactctattgcatttttggtagttttcataacaatgattccatgcggcttagtcaaaccgaaatcatattatttgtaaattcaattctgatataatttttctattttgtaccaaacgtaaaccgaaacataaccgaaaccgaaccaaaacttcatttgcgtaatgtagtttcctacgttgttgtatctataaatagtttgtttgtccagcatccatttcataattcctcatttcccggatctctcccatctaaaaataacccgacccatttacgcgacccaaaccggatcaacccgca

SEQ ID NO: 3185 - DNA, 353 bp, Arabidopsis thaliana
agaactactacagaactcaaaaattcaatttttccaaattggtcttataagcaaaatactaaattacatacggactaaaacgtataatgttaagaaatcgaggactattatgttaataacagaacatggttttacccaatttggtcttaatgtacaattcaaattataaacgggctaaacattaataacggttaaacatttggggctattatgtaaacaataaaagttatagactaaaagtaaacgcttttcttgttctttcttcgttccaaaaagtcgcaactcttcttcatcttcttcctctgacgatcattttcagaagaatctgattccgatcaaaattgcagaagaag

SEQ ID NO: 3186 - DNA, 2000 bp, Arabidopsis thaliana
atcgcttaagttgaggaggaagagagtcatagcttggtttaagtactggaaggatactgttagtgtagcttgagaaattctttgatgcaatggctcgttcaagaccttacactgttctgcaatccttttcccaattccttctagttcttggttgattatatttccaaaaggaaatctagagatcagctcccaacattcttcatttggtagattttttcatcctttgctactgtggagacaatttcacttgatgtggttagaacaatcttgcttccttcctcaagaaactttcccattctgaatctcagaccaaaaatcatccagagcaacaggtaaaagtcttctgtttgccaaaagaatctctaagagacgggtgacgtgtcgttgtgtgagtgggtgaagggaaaatatataaagagaaaataaaaatcgactcccgtgtttctctctctctttcacgcgtttctcttcaaaggctacaccggaggcgatttggagtttaatcggaaccactcggacgagtctccgatgtagaaacgaggaagattacttcaattgagattaagaggcatagagagagagatttgtgtattcgatcgaatcaagcttgggtttgttagtaatggcgagaatagctatagttttagatctactgaagaaatctcaatccaagcacagtcttcactcatcttccttctcttccgccgccactgctccctttgcgtctaggtttctattcgggtatgtattctctctctctctctgatttgcatttgtttgactttcactggatcgtggtggatataattattggattgattactagttttctgattttgttcgagaaattagggtttagaaattcataattgatcatcttctattgctcagttgaataagaaaggttgcagatttatagtttttatttgattggaatgtgtcacactaattcaaggctatgtcagttactagtaaaggtgaatattttgcgatccagtttgaaatgtagtttatcaatgaatagttttacaagctctgtttttattctaaatagatcttttgataggtttcattcatgtgtcttttcgatactctcggtgattagcacttcatagaggactagttggcatgatttgttgtgttacgacattgactacacgtttcagttataacctattatcaatgactcagattgtttatgttacagttctttcgagcctcgagtttcgtatcgtggtgttgctgctggaatagacgatgattaccttggtgctatacggaaaatgtctgcggatggaaacttctaaagggtaacatcatctttaatatgatttcatttaaagaaaatgtcatgctttatttattaattacactactaaatgatataatttagtgattatgtagaatgtttaatttcttgttgatatataagaatagtaatatcaccaatcaaaatgaagttgcatcaaaaaagggccagagagaaagagctttgtgagcagccaaaaaccaaagtgggcaagtcttctttcttagtcgtcgttactaaaacacaaattgtttattcggcatttgtgtttaattaagttctttaattaatgattaaagatcttaaatttgtgttattaatggctaaagttaaacgattcaacaacggcatccaaaatctttaaatttttccgattcttccgttgcaagtcaacgttttccttcgcttcctcctaccttcttcttcttcttcacaaaaatctgaactttaaatttgaatttgcccatatttttagacccacatttattcatatagatttgatctgagtttgtattatctcaaagttttatccttttgttgaatcttgatctttcgattagtccccaccaagcaccaagtgatcgatcttttgtctcactgaacttggttatgcttgaaatttgatctgacaactaaaagtttcctgctttggaggtttttgattttgtatcatccagtttataacgagact

SEQ ID NO: 3187 - DNA, 2000 bp, Arabidopsis thaliana
caaataattggttacagtaacagaattatatattgagagcctttttcaccaaataacgtgatagtttgtgtgtttattactgtattatgtaggcactgataatgatacaaatgatttcatatatgaattttgatgaaaagcatggctattgggatttgggaaaacatttctcatcacagccgtagtttttttttttatataaataagaggcattttatataaaattttttactacacattagtttctaaaatactacattgtaatctgaataagatgaaagtgaatgactaattcacaattgttttggcttaaaaaaaacactcatttgaagatcccttaagagttgagagaaagatataaggaactctcattagcattcataatgtataatgttttcaagatattttaggcagtgctttttttgcttcaatcataacatatcaaaactaaatgttaaagattgttgtaataactattatgataagaaaagttgtaatgaactttttgccaataaacaatatataagatcgtcggcttagtaacctcacgaggatggaatgtgctttaggtacatcaacaaacatgtaggaggactgtttcgctaaaagcatttagaaaacaaaaatcaatacaatcaacccataaaatgcatttaaaaaaaaaacgaattggacaattacatttccttcattgggcacatgtcttcctgtaatttattgtgatttacataccaaaagaaagatatatttttctatttaaaagaaatttaaactgctaagatttgttgcctttttttatttatttgcttttacctatttatagcagtaaactcttttcagaaaaaatatccctacaaagaatttgtcctcatattccttttatatgctaactgctaagtaagaaattatattttggaagatatgtctaattaagctctaggttcgatttacatataatttctaaatgttaaaagagttggtaaaaatatattaaatactgatataagtaaaaacaatttatttttattttcttacatcagaattataaactaaaaaattgctcataaatataacacatgtgatttatcaacattacaactaacatcgaatttttaattgcgataacaacaaagaaacttagaaatatgaaaaaccacttatacaaacccatgaaaaatatacattatatatttcttaatttctatatttttgcgttattattaccttttttattttaaaattatataaaaaaatgggaaataaaaaataccttgttttgagcgaaaaatgcaagtgaagcaggctggcttgaatcacgttttattataaagacaaatgctctcacactcttggggacactttcacatctcatcctctcactctctctctcctttggattcttcaggtactctctctacctctctttctctctctgtctcagtcgctgacttatcatttcctgtcgttagatctctcagtacttggttcatagttgtttcatagcacgcactagtgaactatgtgggttttttaattttaatcatctcagtcttggagaatttcaaacaaagtttcaaactttgctcaccaacttttatttatttattttggtggtagaaaacagactttgatggctttgtaggaatactagatgtgtagatctaaagattataaccattttctgtgttcttgttctttcagaacataacttcatgtctttttgtctctctgttcactagctctctgtttccatggactccacactatcttcttcttacagatttatttcatacacatacactgatacacatgtgtgtatacgtatgtgtttatgtgtgcttattatactctttttggattcaagaaactaatctttagtatttttgacattctggtagatttatgctcacttcttaggccttgttgacttttacagtgatggattttgaaactctggttgatttgattttctttttggtttgatgcagtgaggagaggaa

SEQ ID NO: 3188 - DNA, 2000 bp, Arabidopsis thaliana
ttaataaaaagaggggttgaaaacgaaattagaggaagtttagggtacaaaaaagtgtcagagagggatggtgtggacctctctgcaaagaaaaattattaaatgcaatttgtcaatgtagcatatggctcgatgcattatgtgaattctatactcatctcttctctgacactctccgcttgttgtcgctggtatttatatctttcatgtttctattattttcttggtacaaataaaagttgacagatcgatatgtatatcttaatatttagattaatcatgttttggttgattaattgtaatctacatttataatatgctaatggtggctctaattggatttataaaacgttttattttgcaacttcttttgctgttggggtaacttggtattgttttgtgttttttgttcacttgtttgcttagttttgttttacgtatgcatgttttcctttatgggctttttagttttgggcttatctttttagacatttaatctgggcttcaaagatcgagttcttatgttaccaatttcaagaagcctatattgcatggaccaaagttttgggctaaacaaacacacaggctttgataacagtactaaaatcacaagaagcccatgcttgaatcaagttttgaccatattagactagtgttagttataagcttgttagatggtttatcaagttgttaattaataattagttagctagattgagcttattaaagaatcaccttgtatataaagcagtgtacattataagctttattcttttatcctcttgttattgctcttgtgttcttggagaagcttcaatattgttgaaattgtcatatggtagaatcagattttttaacaaattaaatgtaaaaaaaaacaagatgctataaaatgtaaaaaaaaaacaacaaccaagtttatcttctccaagaattgtatttaaaaatccaagacccgaaacaataacttattttgcctatactgtagactggatttggagatagtaaatgccctatgctcgagggaacgttaaagagccacacgattttgaaaattgctgagatgagaggataagtaagttgagcagaggagtccaaattagagaagggaagagacatgtttgctctttacccaaaattggaccacaccaatctcttttcttctccattcatatcttctttacaaaaatatctcatcaaaaagaggttccttttggatagtatgatctttgggagcttctaacagcttttacctttcaagattataattcttactacgttgtacattatagttatcaggatcgaaaccttgaggatagtttaaaacaatgattttatttctcttaatgctaaactattatgtaaatttagtaccatgcacaccaattttttcgaattatatatcctcaaaaaattattcacaacgcatctttaattagtttgtactacgaattgttgcaatttaaaaagcacaaaaaaattctatatataacgtcaatcccgttgctttcacaagagtttacaaagtcattgtcgtacagcgcttcattggtaatgatgttcaataaccttcctttgctaaacgattttgacatgaatttcattctctcttgataaaggtgacttcctaactttggataaaactctaaaagtttgaatgcaacagggtgattagttttacacttgtgccagtagaataaaactttcttaagcattttttacatcttattgaaaacgaaccatttatcaccattctccgaaactgacaaaaatctctgacatgaagccccatcaagccatgtggggtttttcccacgtacgtacacccaaagttcacatgcatgcaatgctaaaaaaataagatgcctctagattgcttcaagaccatcctcacgttaaccatatcaatatcttctcagtctctatataaaccagactgcctctctttctgcctcataacttcaacaaaagctcttatctataaaacattctaaagaaaa

SEQ ID NO: 3189 - DNA, 2000 bp, Arabidopsis thaliana
taaatgacatgagatggttaacaatcgtaaaaccaacaaacggaagattagtagtgcggatctttttgtatcaatgtaactcgaagaccaattattgtcgtgcgtatatataaggttggcctcaacaggatccaattggtgtttagtgtctatttctttcttttttaataaggttggcctggcctcaattattgtttttttttatttctaatattacatttatcaatttttggtgttttttcggtgaaacacaaatgaaaaaactttaaatagatcaaggtaatgtgggtggtggaaagggcaagagcatgtggataatgtagagttgttgggggacaatattttaatgaattccgagtaaattaataatgtctttaatatgtatgctccattattgatgctttacgctgtcatcgacatccattgcctcaacaaacaatggttgataatgatgatatttgttttatttattatttatctgattttttagtaaatttgatctagtttgtatccttggttgtcaaattcaccacatgtatttacttgtttgtagaatacttagttcaatataaattggctgattttgctctcgttgtgaattacaacttgtaacttaacaagtacaaaatgcacaaaagatggttctcaaaaaacagattcacaaaagatgattacaagaagatgaaagatacacaaaaataaacaagaagcacagcttcgtcccaacaataattaagtaatttggggggaaaaacattttgggccatggttaacactagggaaaaaaaattggggccttacattttctcataataatgggcttttcatcaattttcttaaatattaatgggcctttggcccgataacagctaccctatccatttggtccgggcactctagaatactctcttcgctcttctctttctctcgtgtactctgttttatccaacttataacaatttgaagcggacttgatatgggctcagtttcggtaaaccaaacccgtattgcccgttaagcccatagacaaacaattcaagttgactttgactgaagtcaacacttaaagatctgtaggctcgccagcccagtctctatactattttagatcaaagctgaaaattcatctcgtgtcaataaagaaaaattacgaggaagcggatagatttgcttttttacttacgcatcatagaagaaatttgttaaactgctaagtgagttttgagaaacaaaattttaaataatccaaaatggctaattcaatggaccgattatgttaactttgattagtcaatgatcgaaattcaatatttatccaaatgagagcgactcttatctactaggctgctattttctacaaacaaacaaaaacaatcacaattagccgcctctcctcattagtcattatctgtatcgcgatggggaagatacgcaatgcttagttataaaccgtccgatcagatgactttgaccagtgaccttccgttcaaagaatatcgacggttcttagacacatttttcaccggagtctcaccctcacaggtcatcttaatttctcgtaaaagagcatattacattgatattccaaattataccacttcataatttatttttattttccaaataaaattaatttattaaaacttcagcactccaattctgtagagaaattttaagaggagaaacccaattttcttttattttgtaacgaatctcttttaaaaaaatctaacaacagaattatatattttcattattctatcgaatccaacgaaatttcaatatacagatatctatatacaaatatttaacctacatgtgtgtatcatatggtttaagcacgttacctgtaacgtatgtaattaaatcaattgcgtagaatcacaagaaaaacattattatataattaactattgatcctataattttattattttcatatatatatagatatatagatagatgcattagaccaccaagaaaacaaagacttatcgatc

SEQ ID NO: 3190 - DNA, 2000 bp, Arabidopsis thaliana
ctaggcatgggaaaaccattgagagagcagtcaccgcggcctttgcggtaccttcgagccaggagagtgtctctaattaatgtgctcctgtcgatttgcttaaagacagaggcaaatctgttatggagactgtttgtacttgtcaaactatgggccatcagtcgaccgcagccattgttagacacaattaactatgtgcgccatctattatggagactgtttccacttgtcaaactttagcactatgcctttaaagctttaacaaatgttgaatgactgagaaaccgacaaactttagtctactacatcttatctatatactaattacgcaacaaaaaaataaaaaaaaattggataatgttttaaaacataacatattttactcttcttctatgacagatgaattactacattccaaaataaacaagtaaaaactcttgtttcgtggataagcatgcactaggcagtcaattcatttggagtctcaccaaaccaagtaccccatgggccctggtggcaaaaatggtcactaatcatgatatttcaagagttgtcataatgggccttaattcgctactgggcctcaagtgtgagccttcgtgttattgtcttttctagcttccagttgtgttagtgtgtttgtgcctttgtgttatggcccttatggcactccatattgtcacttgaatcactaatgtaaagtttattcattttcaaataagtcgctttaaatagaagcactagatttcatgatcaatcattatcaaatttcttataaaaaaaatcataaagcctgaaattcatttcatgtaagaatcagaatgaatgggtaaaggtgtttttggttgagagtaggtagaagcgtagagctaactctaaccccttctttagtttggtatgattgaatattagttcatataaatataattggtgaaattttgatgtgtccttggtcctttagaagcaaactgtaataatgcgaccgtatgatttggataaatctaatgtgggacaattcatgatgtgtcgtatgctcattggtaggttgaaagagagttgagcacgttcgtgtaagatttttcgattcttatgtcgtaaagatgaagaaaactctttaaaattacaactataaaaacaaagacaaagacactcttgacaaaattaaaccatattaatttgataagggatttgagaaaaaggaatgaaatggtgccgtaacactaagtcgcacgttcttgacgagagtcgtcccaatccaatgattaatatttggcaatttcatgccctccctccccatagtttggtcgtttattatgctttactcttagttttttttcttaaaaattataatctttatttatttgctgtcttttttttttataattgtcaattaggttaacaactatggtcaaattagaaaacattagtttttgttaaaagaaaattaaaaaaaaaatccatgtttattagtgaattaggtttttattttggtggtagtttagctaatctcataaaacagatagtaatttcataatgtaaaaagatatttctactatacagaaaaggaaaagaaaaaaaaaaactcattacaacggataatttctcaatttgtattcaaattcaaaattaaaagtgctcaaaattagtattatttaaaagaaatactaaagtggggtgagtgtaaatgataaggtgttgtttggtgtagcaaatagctggcataaggttggtattgaaaagctcatctcagaatcatcaacggcccaaaacacattgcaaattaaagaaaaagcaaagattttcctcattcttttgccattattatctctcatcgatttggcttgctacttttgaatttacccgtgttctactacgattcgggattagggttttttcttgagttagaaaagattgtttcttgattcttgggaatggctgggatttgaggaagaagaagtgcaaaagggttctttttttgagtttgtgaatttgctgcggag

SEQ ID NO: 3191 - DNA, 1496 bp, Arabidopsis thaliana
tagagatctaaatcaacatttgatcctctttctttaagtatttttatgattaaaagattcaaataaacccattttgtgtttcttttaagacaagaaacaaacctgagaatcagatggagaggcaaaacgtatatgaattccagagctgtcctcttcagaaatcttgagttttatcttatggttagagatatgaagacatgaacacaggcaattaaggatgatccagcaaatatgggaggagatgttttatagatgtggaattttcttttttgtatgggaatctaaaataagtcgttgtggcttgtgacgggtgaagaagaataatcttttttctttaataaggagaatcaaggaaaaaagaaataaatataaagattttgttttggtgattttgtgtttcttttggtgtgtatgagatttgtatgattgtattaccatacaaaggtggcgtttgcgtttcaggtgaacaaaatggactgactattctttgttcaaaataaggattgattcaactaatgttctttgatctttagcatgttgtttttttcgtctttttgttttctttcattatagaaatcaattataaacatacatcaatattattttaaattaggttaggaccgttaggtgatgtaatttgtccatgttgatatagtttatttttttcttttgataaaaatgttgttgatatattaacttgttttatcaaactacatagttattagttagcacttagcatgtaattaagaatgtgaattggtgatttttaacaaaagaatggtatttgcatacacgcatatgcatgttaatttgacacatcaaccagatggtgattatattagattaggtattaccgatcaaacactaaatcttggttgttttgtagtttcatggtaacaaatagattgttgttttgtagtttttgatggcaacactaagttttcagtaactaatttgctaattcaaactttttggcgttttaatttattagtcgctaattaagaatttaagaattaagattgatctaatctaccacttaattacggaaaacgaatatcatactaacatagtaacatttgattgttataattggtcactgatcattaccgatgactgctaaacaaacaacaaaacatattgttgatcactatcccccatcattactactgaatagtgaatactatattactatcgccaatcgttattactgatcgcgtagagaggctagaagaactagttttctaccgtttggaaatttgtataaaggaatcttctagaaagatagcccatttacaggcccaataaaacgtgtacatacccattaggttgatttcactcaggtctcgtaaataaattaaataaataaaaaatgaaccaatcaatattgactaatctcagagcacacaccagtcttcgggtctctcctcctcgcggctcgaaacgcaagcttcacgcttgaaaatctccgttcgttttctacctcgtttagatcggag

SEQ ID NO: 3192 - DNA, 1086 bp, Arabidopsis thaliana
caaaaaaaaaaaatgtgatgaaaattcatgatctttgttaattaacttctcatgtacaacactatagcagtgctaataataataaattagcgaaaatcttaattattttggtaaattttagttgcataccattctttttactgatcatgataaattacttcttcatttcagcaaaaatataaaaactataatcactttggcttattctttcgttagatttagttattatagtattgtttgattcaattcaagtaaaaactatttgagttataggcaaacttagtcacaccaaccgcaaccttcacaatttgtcttaacaagttagatcatatttcgtggaaataatgtctagcttaacatctaatttgtcgaatatatcttaatgtcactgttatgttaattcatcctccatctttatactttgtcaccaaaacgaatcgtcttgtcacatatgacatatgacagtaaaaacaatgtaataatttcctacacatcacgtttttgaaaaaaaacatccttcatcaaccgctggtcaatcttgaaagcatggtaaattcattcaaattacgtcaaatgattcgttctacaaaactctcagccgtcggatcatacgacttttgactaaaccacttaaacgacgacgcttcgacgggattggaaaacatcggcgccacatgatgatgatacgaacaaccgcgttattttatatgtgccgtaggtacaacgctgagttaggcccacccaaaaaaaagtttgacattatttaaaacgaacgaatctgaaagaataaagcagcagagtccactaatcaaacgaaccagaatttacccgcaccctatttattgtggtcgcgaccacacaacattttcaacttcttcttctcttccgtttcaccaccctttcttctcctaaattcgaagaaccaaaaccaaaaacgtgaattcggagttatgattttggatcttcttcccgtctttatatataattttctgggttatgtttttcttcttcttaattcatctgaccattggattggttttcgattgcagagtcttcaattggaatttggatcgtgggattttggaa

SEQ ID NO: 3193 - DNA, 2000 bp, Arabidopsis thaliana
atgcccgcatgccggctggaatagatagagatcgaagagtccgttaggtcacagtcacacgtgaaggaggtacgagggaagtgacacgtcggatgtagcactaaatctaagacataagataacacaaagtacaaagggagaagagtggccatttccatgccagcttgtctcactcccattcttgcttttgttttttctttttcatgtcgtccactttctcatttccaatactagaaacaaaaacgagcattattgatcttttaaattgttacaaaatagtatatgggttaccttgtcgttttctcctaattatttcggtaattaatagtttaactatgccacaccataaacgatagaaaagtgggaaagctagctaatataataaactggtgtggcctccttaaaaaaacaaaaaggtaacttatgtgattacttttaaaaagtttccagagtgtaatactttctctaagtttttttcattaatattatcaaaatcctgaaatcttaaaattaggttgagaaatgttcctataactttaggaaaataaaataaaatctaatttaatgttatagtgattcttactaattgttttgttaagcaaattcaattacggataactgatccacagaggagaaacctagtttacaaacgtttgtcaatttgcccaaaaaaaaaggccgaatagtctatttaagaatataacctatatgagactaaaaaaacagaaaatttactaaatctttttgataaactatactaaacttgaaaagcatggggaagttctccaatcataaatattagtaaccctttatgatttctcgtttttgtcctgcaaactattattatatacagaacaatatggatttgattggtttcaatagacgatccttgtatattacatagaatagttttctagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaactcatctcacaccaaaacacaaagctctcatcttcttttagtttccaaactcacccccacaactttcatttctatcaaccaaacccaa

SEQ ID NO: 3194 - DNA, 2000 bp, Arabidopsis thaliana
agacttacaagcataaaaaggaaaccctaaaaggacaggtcctataagtacaagaatggaaaggaatgaaaggaaatgcgcaattcccgctgacacagagaaaggacagcagtacaaccattgacctcgcctcgtcttcaagacctcacctcgtcttcaagacctcgcctcgtcttcaagacctcacctcgtcttcaagacttcgcctcatcttcaagacctcacctcgtctccaagacctcgccttgtctacacatcgccgatctcatcctgtttcgatcattccgtcacaataccacgtcccttagtcaagaaattctcgtctagtcatcggcctgttaaccgagacggattctttaactcttcctagagaaacatcgtacttgtgtgatccctacatcaacactcatgactcttgtttgtaattgaattgaaaattagatacaaacacattaactagagcttgttttgatacagagcttttagctaactctgttaactcactaacggtcttcaataaatccggaaccgaatccggtttaatccctaattcatgtgtaccgagtcttcttcaataaacacataccacaaccctccgcacaaacgagagactcttctatgtttatagtttttgattatttgttttcttcggacctaacatttcaaaaacatgttgtttttttttttgaataccagaaggttttgtaccgaacttcataatctttccaggcccgaaaccacaacatgtaatattagtttcgtcccaagtgtcactcgaaccggcgacctctaaatttcacctaggataattatcaattgagctaactacacttggtcaagaacatgtttaagtgtgtttctacaaaaaagaaaatttaaacagttgtccaaagaaaaaagaagcaaaaatctccaaaaatcattgatcaaaatgttcagcaccattcaccaattgggcattgccaagcttgaaggcggccaatcaaaactgtattcccaagactgtctaagtagttctgtttttttcattctttttattcttaatgttacatcttttgtaaaacagttttttgttgaatataattttacattcatacaaaaaaaaaaacttttctgcaatttcaagtaatttgggcaaccaatgcaagcaaattgtgtcactaacttactataacgacacattgtattctataaaatgaaaaagcatgtggttatgaaaatttgatttgtgttaagaaaatcatgtggttaaaaaattgatctgtgaccacttaggtgtaatattattcgatcgttcggataagtaacacatgattagtactagagaaaaggacaatataatgctcttaaacattttaataatagtgttaaatgtttatctgcagattttgttttaataacaaaatacaactattggatgctctcattacgcaatatgacaaaaactctttagatgtcaaatttttaacattattatacaagaatgatgacataaactcgtcttcatacttcaacatcgttcagtgtgcaccacatgcaaagtagggtagtctctatatatcctaatctagaatacagccttgtcttcttcactaataattcgtttaaacgcaaaggtacgacttttttttttttgttcttgttcgttctgatttagtcttactatcatttcttgattttggtatcaaatttatctagttttcactgttctttactaaatttttattttgtctcttatctactttagagtttagaagttccatattaaaaattttagttatgaaacaatataaccaaaaaattgccaagattgttcttgaatcttacttgtgcattgtaaatagagtctgttagcaaactttgaccattgagtattttgtgctttgtgtctagattcttgaatcttattctatggttattggacttcataaatccattttgttctttagtagttggtacccaaatattgatttttcaatagtttcagaaaacagaccaac

SEQ ID NO: 3195 - DNA, 2000 bp, Arabidopsis thaliana
ctagcgggttgtgtgccggttacagataatttacggaaaagaggtattaattgtgattcagggtgtgtctgatgtggtaacgtagaggaaacaattaatcatgtacttttccaatgtcaccctgcgcgacagatatgggccctttcacagattccttcggcggcaggaatatttccatatgcctctatttatgcgaatttggattatttattttggaggattatttcggattttgattctttttcatacccatggataatttggtatatttggaaggcaacgaatgaaaagatttttgacaatgtcgataaagatcccttaaaggtattatgtttcgcaaaaagtgaggcacagtcatggaagtcagctcaaattgagttgcatgttgaaaatcatgaaactcctaatttcggatctaggagtagagcgagggatatctatcctgatatcaatttcttgggatatcgttgttacgtggatgggtcatggaaaaaagacgattttttctctgggacaggatggtactgtacatcagcaattggagagacgccaacaatgggagcagcaaaccttagacgaagtctatccccactacatgccgaagtggaagctcttctatgggcgatgaagtgcatgattggcgccgacaatcaagatgttgtgtttctcacagactgttcggatctggtgaagatgatgtcttccccaaccgaatgaccggctttctcagtgtatttggaggaattgcagagtgacaagaaaaaattttcaagtttttttttatctttaatttctcgtagtgcaaatgtcaaagcggataatttggcgcgtaaagttcgtgtccaaccgcatcatatcacttatgtaaacaaaattcttcaggaatggctcttttgagctctaattaattttggatgacaaaaaaaaaaaaaaaatatttttacagttattaccataatttcgaaaaaacaatatgtattaaatttgggattaatgtggatttttggaattaaaagtgtggtaaagaaagaaaaagaaaaaggcaaaacaagattggtcgggaggaaattgaatcacgaccggatctaatttacttggccttaaaaattgacagactcttctttaaacgtcttttctcaaaactttgtctccctcctctatattcttcgtcttcgacctcgtcgtctggcagtaattcaatctctctctctctctctctactgtaataaatctaaggaaacaaaaaacgttacgaaagaaaaagcattaaaaagaaaagctttagagagaaaaaaaacacagctcacaacctcttttcaattattcaatttagctttttttctcttcttcttcttcatcttccctcgtcttctttgccagttcttcttcatctttcgtcgttttcttagtgccacccaaagatcttcgtgcaggttcgtacttctttctacctcgatcgattttgactaaatgtatggatcatctgatttccgatttgatcgtggttgttccttgctctgtttcatgatctgtgaatctgagtttctcgatctggctgcgtctttttcggaaaagtcgagaattttttcctgctgggtcttctgaatcacatttgatcaattcctggaaatcgcaaagttttgagtttttctaatttctaaaggttgatcgagccaaaatcctttacgtgtctgtgtctgactctctgtagacctttcctgtttcttgatcactagctagctttcgagattggatttaaaattttctagatgaatctcaaattataattacagaattgaccaatgctttgcttgagaaacagtccaagaagaaatgcttgagatccttcatctccaagtaaatgggaggatttggttgattatctgctcattttcttaactttgttccgtatttttttttttgactcaacaggttcattggcgtttgtagtacataaattttccctgacacacagaaaaagaggatttgactgttataca

SEQ ID NO: 3196 - DNA, 1432 bp, Arabidopsis thaliana
gatgtgttcatcttcttggtgatgtggtttgtgttttatgagaggtttaataaaagtggaactaaatgtacctcttaatgtaatgttgccacctctgtgttctctttccttttgtagtttaataagtatctttatggctttgtgaggctttcaattttaaggaaatgatcttttcccctagttctactacttgaatgatttaactagcttaagaaaattaattatgaatgaaaggtcggattagcgcgcgagacgggagacctagtcgatggaatctatcttattgattgcatatcgactctcaataatggataggtactgaagtatgaaataattgatgataccttcaaactagtttgcggtttaggttggaacatggtctgataacaaaagaacttccacaactataaaatctaggttggcttcttttactcggccttttgattcataaccaaagattcttggttttgtgaccaagaccattcgaatattggaagaagtgactgatctagcaagaaacactctaccagtaaaacaaagtagagagaggtaccctaagaataaaatcttgattttcatgaagctttttgagagaagcctctcagcttatttatggataataaagtgcatcatcagacgatacactgatttttttttaacatctctaccaaatttgacaaaagtgaaagaaaaaaggtttattggtctttcggggccaatgatggatagtataaattaaagtatagacactataatgaaagttggtttcgataattagatcactaatttttgtttaaggcatctaataattgcgttgataaagtaatgttatctgtcagaacataaattacaaaaataagagggctcattcgatcacgttttataaatactttcttgtacccaccaacctaattttaatcggctaacttaggttttccattgcctgatcattttttttttataaccaaaacaaaacaaagtgtaatcaagtctcgtaactattttattaaaatgtgttgattcaaaaaagtgagaatcattttggcatcttattacaacaaagtggggaatatctttaatcaaatatacttacaacaagtggtctctctctttattaggcttattaaaaatgaataaataacattgttaaaaaacacacacatgtaattcataatttgatgggacgttggaaatttcgtgctgagaaaagtcaaatatgacgtgaaacgttgccgccactagctagccgccacctataccgacacgtataaataataatatactaataagtgcgactgcgtttagcctactaccgcaaacgcagctaaccagatccctttttctctctcttttctttccctctataaaatcgcgtcctgctatagtgagtttagaaagaaactgatagtagaaaaaaaaagagagaagaaaa

SEQ ID NO: 3197 - DNA, 2000 bp, Arabidopsis thaliana
actgattggatcagctgatagaattttattaaacaaaaaaagactatttgtatattgatttcatttttagttcccgagaagagtagaacaaatgctaaaatgtatcatgcggcccaataaccaacaaaactagttgaaagatggatcaatggtttttacatgaagaaagcccaaaccatacactaataatctaatattctattaaaaggacttgctgttattcggcccaatagccaacaaaactaattgaaagatggatcaggggctatggaatacctcagaataaaaagtgttattcattgcagaggaccccttaagcggacatggttgggtccttgttcgacaagacttagtcctccatcttggcctcaagagtgctcgacgaagtttatcaccgcttcatgcggaattttattccttgctatgggcaatagaatgcatgatctctattagcgatacttctggcgcttttgcttccgactgttcagacctgatttctatcattaacaatcaagaagattggccgacattcgcagcggaattgacatcctatcgctccttagtttatttttctccttcttttcgtattagatttcttcctcgtagttctaatactcgagcagattgtttagctaagaaaactcgggctcgtaatagccttttctcccatgtaagcacatcggttcctgaatgattctttctagcggagagtctctttccgataacttaatataaatggtgtttgatgaaaaaaacaaattatcgtaatgatcctaaaaaggagttagaaaatattaatatcttatctacatctagatgataattgtttttatgatccttattagatagtgtttaaatttaattatccactaatttaagcataaactatatattctatcaccgtttaaccaatccatataaatctcttttaaagcttctagaaatgagtctcacacatcagaaattagctattttcttattttattacaagaagagaaaaaaacaaacaaacaaacatgtgttactctcattttgccacatgcattataacgtataggtaggtgaatcacctaacttgtttcagcttatgtaattaactttaccaatatattaatttattgttgataagtatattttaaattaagatatgggaccagaaaaataacaaaagtttctattaaaaaatgcttgcatttaaaagagaagaatgtataaaatctttatcaaaaaaaagagtatatcatagattcataataataaaaaaaatttgataaatgactttttatttaaaaacttaagatattacaagctattactctctttgtttatttttaattgattttctaacaaaacacacatattaagaaaacatattaaaactgattataaatgtatcgatttttgtgatttatatttttctataattctaaatcaatgatatttaattatttgtgttgaactttaaaatttatcattaataactaataattagtgcatagaaaatctaaaaatcaatctttttgaaacaattttttttctaaaaaatcaattaaaaagaacagagagaatattgttttaataataaatgttttattggtaatccaatattaaaataattatatggattaaatttaattataaattttaaaaaatttgaacaaaaaattatttagtgaattgattccaacatgtggaaaaaaggaaacagataattaaaaaaattgattggttctgccaaaattgactaccttcaaatcagagatgattttaaaaataaattcatccaattaaacttgccacatcatcaacttggaccagaatattcgcagtcaccaaaaacaaaccaatgtgtccaggttcaatgaatctggaatcacctggttcttcgtatttttgttatataatgccacgcttctcacaaatcatcttgaattgaaaataaaaaacgaagaatcaaaacaaatcttagagaaaacaaaaatccaatttttgctgtgaag

SEQ ID NO: 3198 - DNA, 2000 bp, Arabidopsis thaliana
ttatccataatgttttatatgttcacaattaggaatttgggttgaatagttgaaaacatgaaataagattccggtggctatgaagtatgaataatcattatttggtcaaacataaatttcttttttcaaacgaagaaaaaaatgtcaaagaaaaaacaaatacaggttatcctattatattatttgggaagtacattttaaatgtaaccttaatttttgtaagtaattacataggtatgccattagaaataaaattttaaagagtaaattattttatctctttgaggattaaaaagtcaaatactaatttaattaattaaatttaattaaaaaacgaaatacattattaattttcaaaaataataaccaatcaaaatcaacataaaagatttgatatctaaattttaattaatttaatttaattagaaaaacgaaatacattattaattcccaaaaaagtaaccaattaaaatcaacaaattagatttgatatctaaattataatattaattttttcttaattactatagttcacttctcatctttatatgattctatttttgccgaaaaataatatcatcattatagaaaaataattagagttttttcgcatatgccataatttaaatttttaaaaacgaatataaattgttcaatacatgaaaaaatattataacgggtgaaaaatagatttaagaaaactttctactgagtaacatgtcataatttgaaatatttatattcaattttatacatattatattgaaaatttataatcttatatactacaataagtaataacatattagatgtgattcaatttttaatacaagctgaaaaatcctagaattgacgggtttagatcgatattaatacaagatggtatactacaggtgaaactcttaaattaaaaatcaagctacaagtgtataatcttaaacactaaacaatatagataatatcaacaaaatatatacaactcacagtttactatacatttaaaatcaaataaaataatatcatatacttttaaatcatctttacaataaaagtttttagttgaactaaaatataagcctacctgcggtatactgcaagttaatatctagattaaaaggcttattgaatctaaagacaagtcatcaaagatttcctaaactgaagcaaaatatactgaatattcaaatatctatctgttacaatggttcagacccatattataaaaggaccaaaatgattctaattacgaatgagcaggaagcttgatttatcaggcgtccaaaattaaaatagttatctgattttactcggattttttattttaaagaattgaaactttaaaatgtttcaagaaatcattctaaaaaatattcaattattttttatttaataaaaatataggcggttaatatctaattattattatttaagtaaaatattaaaaaggtagagaatcacaaaatagggcccaagcccaaaatccaacctcatccgaatctcaccttctctcccaccagccaccactctcccctatataacgaaccttcctccttcatgcatttctcaccatctctctcttctttcacgtctctcttccctgaaactttcccgagaaaattctcaatcctctattttctcgagaaaattctcattctcattttctttcagggaaaagttttgttgttgaatacagatttggaaacttcatttgtttttttccgtttttaaccaaaatttttaaaaaagctttcttctgaacgttaatcgtggagagtttcgggtcgggtcgggtcgtaaaaggcgggtttcacggtggtgatagattcacctcctgcttccttctgagggggttagccccgaggctcttcgcctcggcgggtttcaaattcccccaaatctaacaaactcacagattcattttctccattttttttgtttgttgaaaatttgaatccacaaattttgaattcatttgtaaccgttcgttgaagaagaagaag

SEQ ID NO: 3199 - DNA, 1966 bp, Arabidopsis thaliana
tgatgttcattgctgactctttcgtcctccatcatttgtgcttttcttcttcttgtggtttgtctttaagacttgttatatttcttacaatatgtttgttatgttctctggtgtgtgttttgttttttttggtattactttcatatttttttggtcgaagaggacttgtattcgacaatgtcgcttcaattttgttgtttccttagaaactaaataaatattggtttatattggagtaaaatgtgtttgtactttgtagttaatcgttgaaagttttgccacttattgagctttgtctgcgagagttgactcggaagaatatttgcacattgttcatagagaatcacatgatatctcttctctggtggattaggaaccaaacgcatcttgtaaaagtttccaggttggagattctgatttctgagtgacacctaacgattccatatttaaagctttatgtttttgtatgtctctcattgcgattggtattttttgtttaagtaaatatgcataaatccattcgtagaggcattccttacagtactagtgaccacatattaaccttttaggtacgcacaccgaagttggctacataacttgggtgagtattccaatctgtaatgtgaatagtttaccatatcacatatagctctgataccataaaaaactatatgtgaataatattaaaaatcttatacacaaaattttcttttaaatggttagtctaattgtaatttaaaaatatcgaaataataagttgcaattttttttttttttttttgggtctttgaaaagaaaatataatgtcaaatactttaatttttccaagtaaatcgaaacataagattgatatttttcttttatataagaaaattaaattagatttaatattattaaatgagtgtttcatattatatttttcagaaaaagagtttttattaattaaccaaataccaataatttacttaaaaacttgtattgaatccaaatgtttcccaaaaaaaaaatatttaattgggattgacaaaaatagcaccaacaaaattttttcttccaaaaataacaactttttgaaaaatttcacaagtagctttcaaaattttaattaaatattaaatataaataattaattttatttaaataaataaaaataaaaattttccgctaaaaatttttcgtcaaattttctgccaaaacaattcggtaataaattttcccgcaaaaaaaattttccgtcaaatttttcttgtaaaaaaacttgaggaagctaactacgacattcgtgaggatttcacggaattcaggaaagattttacaaaaaaaattttcgtaaaattcttcctgaatttcgaaaaagaaaaattcgggaattcaggaaaaattctacaaaattcaggaagggttacaaaagaaaaaaattataaatttcgtgaaacctttcctgaattgcttaaaatctttcctatattttgtaaaaaaaattctgaatttttttttgtaggtaaaatgtgggcggcgtaattatttttggtggaaaaattttgacggaaattattttgtagaaaaatattgttgaaaatttttggtatgaatttttgtatttttttaaatgttagttgtaataattaaaaattaaataattatttgagtgttatttatgttcacaaaacttttgaatggtatttttatcaaaaaaaactttaaaattatgttaattatgaaaattctctatttaatttttttcacccaaataaataaatacataaaaatgtccaaatatttgtgtgtttctcttttaattattgtttcccatttaaagtaaaaaaatctggtagcagcgttacaattcgcgagaaagacaaaacacaagtttcttcttcttgggattggctatttccagaaatccaagtcaataatcaaagtccaaacaaaaaaatcctctcccaatctccgcttcactcttctc

SEQ ID NO: 3200 - DNA, 769 bp, Arabidopsis thaliana
caatatgaagaatgtcattgaaacaattacgtataggccagagtcgcaaattggcgcagaagagttgttttttcttggtcatctcagatttgtgaccaatgtagtttctccacaaaatccaaagttttgaaccttaacaataatttcaatgcagataacagaaactataaacaagagaattctaaaaatcaaatctttctcaccaagtgaacatctttcaactacaacaacattcccacaaaatttgaaagcttttcttaattccactacaattttttgatcaacttcaaacaacgatctcgctggattttctctttttcttactcttcttcctctcttccgaacccatctctcgatgactcttcctcttcttcttagagcttagcttcgtctcctttgatttaatctccctatggatgctcttcaattcaataaaggcaccggaagctcgtcgaaggtacgcgctaacatcttgagaggctccattctcagaagaaacgaatccggagagaagagtagccgcctttgatagagagattggctttgcactgttaactcttccggtgaccgtcttcatcggaacaacaagctcaaggaagatggtcacaaattagggcaagttgaaaaataaataaacctttttatacatagaattgaaaatgggcctagtggaaaaagcccaataagaaaaaatgtcatcggtgtctctcttataaaggtaaagcgcagtgtcactcacagagtcaacaactctctctgaattaagacg

SEQ ID NO: 3201 - DNA, 2000 bp, Arabidopsis thaliana
gtatatatatatatatgaaagtgtggtttgttcaatcaacaattgatttaggttccacaattaattaacaaaaaggtgataatttcgttatcccaaaaaaaataaaaataagcttcaatcaaatgtaaaccgaactatatctgaaagtagtggtcataaaaataattgtagactattttagtcccataaccacgtttccctttttaataaggtttccttctcctagaagttactaagaatcctattcaaattcttctaaatctcgtaattaaatcatgatgcatgcatatgcatcgatgttttctacatcagcagtggaagcttctatgagattttgagcatctgagattctagagtatgagaagaataaaattcaccggcgagtcatgaagatgacatgtgaggcaaatttcagataaaatggttcaggtaaatggacattcaaagaagaagtgaaaatgggattaattaagccatcgagtgaaaaagcatgtagttaaattccgttgagaatctgatatttgatcttactgcaggagggagtcttcgaacaatgaatatctgattctgccggataaattattgaatcgagttaaactcacgagtgaataaacgtgaatgactttggcacacaaccgtgactcgaactccgatgaatatttgtcagcgatgagatactaagccacgtggcattatataaatttcaacagtatagcatatatagctaaaagaaaataatacagttataacttataagaaggaaatgttccgatgcagttacgagaatcttttggcgtattataaaattacatgctaggagcatgattggctgatacaagtcttaatgcggtaatcgttaaaataataaactaaagtggtgattaaaaatgaaaaaatccttcaaattattttgaatttttacaattgtggaaccatgttacagagcatggtatttcaatttttatcgtactactactactacggtattgtttccatttttttaataataacacaaaaggggttaaatcatgataaataacaaaaatgaaggaccaacactttgaagagaagattattgcctaatgtgtattttcttgaattttcaaattttcattttgaaactttttgattgaaaataattggttctgttcgtatgagttcctgagattatttattaattaatatatatactaaaaaattaggagcaagatggcaaaagaaagaagcatatggtggggggtgttaatggggaggggaccacgtggcggttactgggaacgctgcaaactaaacgatcggtgtgagcgggaaagccgctttgtggggtccatcatccatctagtaggacccacactcaatgggttccagcgttcagacacacacaatatctgattttccctttaactttttttgttcaagttaaaactaaagtttttttaaaaaaagactttttttttattttcctataataaactgcaactctataaaatcagaccataccacaacctcagcctctgtctctctcaaagcctacacactcattctcactctgtttctacaaccctaaatctcttttcatttacagacagaaatgggtaaattgtttagagttccttagattaatgcatacaaacgtttataatctcttacataatccttatcttgttttctgttatttcagttagattcatagaagaaaacacaaaacttgtagaaaaagaaaccgggaacaaatcaaacaacgatgtaacaacaacgaagaagaaagctcttcaagatatcattatcaacaatggagtaggattgatcaattcatgggttgattcaatgagagcttgttcccctactcatcttaaatctttgttgaaacaaagctcttggctcgtacgtctatatatcatccattgatccaagctctagtttctacttacatcttttttttcttgaaataataaacggtgtgtataaattcgcagacggaacatccatcagctttggat

SEQ ID NO: 3202 - DNA, 2000 bp, Arabidopsis thaliana
caaaaaattgattatatccgaaaaaataattactttttggattaaaaatttttatcgaaaatcgttatcgtgagagttagatttaggtcttatttgaatctacttttgattaattagtatatataaatgggtcaaaatgatttgagagctgctttgaagatattagtgacaaagagtaaatgggtaacacatgcgaatggtcacaaattctgcagtggagaaatcactcatgttcaagggtccacattgttcatcttacacattaccaaagtctgcaaaaactagggtttgttcctttcacatgcctatgtctgttagatgaactacctctcgtgaaaagaaaaaaaatatattcctctacactaaacacaagaaagaagaaaccaacaaacacttgtatttaccacaaacaattttcaaagatttcatttacgtataagtcaattttccaagtccaaagtttaggatagatacgtaatcaaataaataatagacaatgtatgttataaaagtaggaactagtacttctctatcaagtaactaactatacaagctcatcaagttttttttttctttaatgtaatttgtttatagtttatcaagttttagttcttatatatactcaaatatgtacgtaaagaaaaaataattcgaatgtactggatttaatcattgggatggtaaagtttcgaatggaacactactgtacccatatctctatatccctttttatgtacctgcaaccccacacacacatatatatatatagtatgggcattttagttccaatccggctagagattcattctgattatgtataatatttataatgtttctagtatttagaaatttgatatttctgtgtaaaatttcttacacaatattttttcttatcattagattttgtaagcaaatacaaaccttaactagctagcttaatacattatttttgagttgtgtagaagaattccgaaattccacatatgtaaatgcctaaaataattaaaaagaaatagatatttagatcattcgctcggatacagattggatacgaatatctgaattttcttaagtgtttgatttgtaccaatcgttagtatttactcatacacgcatggatggacacagacaacactaggaacttgtacaaatgagagtacttgccaattcttttagtcagttttataatataattgtttataattaaaatgagttatgttttgtgtggtgcatgtatataatatttaatacatgtatgtgtgcatatatttatgtatgtcaatgcaacaaagatttgggcttataaatgaatgaagaaaatgttggtgggatatggacaaaaacaaattggagaaacaatgaaataattcgaacccatgacgttacaactagtcaaaagtccccacatgatcttatcaaacgtaggtccatggatgagttgttttcgatatcataaatttctcacgaattttgttatatggcctttaagtgtaaaatgacaaaacttgccaaacaaatcatagacccaatgcaatttagatatcattggtgaatggttatagtaagtttaatagctttcaattcaaaatcaattgaaatgaatggcttgacttatgttacttagttattattattaatttcatgatatttcttatgtgagattcgtaacatgtttcttcaaaataattcatctttcatctcatcttgtatgatatcatgatgagtgagatatgatttgttttcaagtcttataaagcctattaggcccagaaccacgaatacttttcagagaagaaaacgcccattagtaatagtataggcccattaagtattagaataacaaaaattcagattttttttgttggtcacgaaaatttagctttttaatttaataaaagaaaaatgggaaaagaggacaagtcacgtcacgagacaaattagcatagcacgcaaagaagaagaagaagaagaagctccaagaatctgtcgcagaaatcgcc

SEQ ID NO: 3203 - DNA, 509 bp, Arabidopsis thaliana
tgtttttaaatcaataaaactgattctaatacactcatttggtaaaaccaaaaaaatctcataagaaacttacaggatattttgtgtaaaccggatagataaactaaaccggtaaggtaaaattaagaaaccggtctggttaaagatggaaaaggagaggcactgagaagagccgagtcatcgaccgaccgaatcatctctcttcttcttcttctcctcctcttagaagtgggcggtggagacttccattacctacaaatatcagattcctcttttcttcgctcgattccatttcaaaatctgttcttctatctcctgttcctgaagaagacgatttctgggtttgtctaaagtttggaacttttttcctgtggagacttcgattacctacagatatcagattcctcgattcaaaatcaaactttgttcttctgggtctcttctcctgttgctgaggaagaagattagtgggcttaagctttattttgtgggtgtgtatgcaaaatcaa

SEQ ID NO: 3204 - DNA, 2000 bp, Arabidopsis thaliana
aaaatttatttatcaaatttcattcctttttaatcagttaattataccgatttttttttttaaacgtgaatatattaattagtattaacatagttttacataataaaagcaaaagtgggaagggaaaatccgttttataccataaaaacaaaagtgcgtaggaaaaatccacaaaggtaataattttttcttcaaaatatccttattaaataaataaaaacaatttaatcgaaaatctattattgtgttttacgaattaatgaaagataacaaaaaaaaaaaaaactatttccgaagattatgaatcataatgataaatcgtctgatgattatgatttattatgatcaaaaatctatttttggacctaatacataatcttttcacattgttgttcactttaagaattgtaaatataaaacacatcaatatgttactgtaatattttggctgttataattgcttaaaatatagttattaagtacaagtgtacaactaaaatcatagtaataatttatatttctattactataaatgtaaaaatattacaaacacactaatatagtattataaatacatacacatctgtatatatatttttctgaatgcaaatttattaataaaataaagtacatatgtacaaatgttaagtggaaataggcaaagctagagaaacagagcaaccaacgaaacatcattagagaagccgtccctatgagaattaacgctattggatatacatcatagtttctcaattctcataacattatttttctacaatttacattatttactgttagaagtttgtgtgtatacgtatgtgtgtgagttttttttaaattataaattcgttggttccaccgcgttggttttgttagatcccttcagattgattaggttaatttagccctattaggtttagtttggtgttctttttgactttaggtttttgataggtagcttggaagggtttagttagagattttgactacgaattctttagcaagagatgaaaagtctcaactaccaataactaatcttttcatttaacatattctcatagaccccatgtgcatgtatatacgtaataagctaagatatttttaaccgttacagaatttgactaacgatactgaacgattagggtaagtatttttttgacatgtataaattaatacttattaacggcatcattatatgttattatgttaagttccgaaatagaggcaaggttcaattaggtgggtgggagtgactcagtaaaccattgtggctctagttgtatataactttttcttcactatataatttcactaaaattttgttgatttatgacatggctatacaattttgttgatttatctaagagttgtatagccatgtgatatatatacatttataaacaaggttacattatttagttttgaaatttatttatgtgatatacactaacaaacattttctttatttgatgacattctcacataatttaatagatgaggataacaaaatcttcaacgcaattgctcaaatgggggaagtctcatcctacaatgctggtttcaaagtcaaagaagttagcggttgcatttccaattttttttgttgctcaatcaattgaaactttacccatagcatttccttgtaaggcattgttgtatttaagtttttctttttataaaagtatataagtttaaaaaaaaaaatcaaatcccttagaaatacaaaaattattgataaagttttttttttcgtttctaaatgattcaaaactattccagtcttcttataagttagaagtattatattacttagactcaaattccgcaatgatcgaataacattctctaaaatatataaaccgtatcctataaaaaacaaacaaaattaatgctattacaattcgaactatttatgttgttcccttatataaagaaactcttcctttcataccaaaaaaaaaaaaaaaatccattttcatttctcctcttaaaaaaccgcc

SEQ ID NO: 3205 - DNA, 1871 bp, Arabidopsis thaliana
gctgaagatgagcaagagcgttccaagaaagactatgacgaagaaaacaaatcagaaatatactaagtatgagttgtttcaaagaacgtagtaatggtttataataatattaacaatagaataaaataaatagtaatggtttaagaaaatattaataatagtgagcaaaagctaagcaaaatataagcaaaacataataacatagtcaaaataatatggaaatgacaagtatataaattatatgttaaaagttaagaaattgacttggaggtttgtgttgggattttcccttaacttaaataaaggttttaaatgtgaacaaaaaaagtttgaagttttagttgggaaaatgttttgatttggaggtttgttttggaattttttcacttacctaaaaagattttggttattattaacataaaattctactaataacaattgatatgcttcttcgtgttaaaaacaaaaaaaaaacaattgatatgcttcttctttttttgtgcacccaataaatatgaattaaataagcatttttaatagatttatctcttgatagggtatccatctaaacaaatacaaaaaagaatacatttaaccaaaatgcttatctaatgtatatttaaatgtaaaactttattgtatttgttaatttagcaaaagataaaatgtctaattgctaaatcatatttacaaaatataatatctgttaattaaatcatgattcagttgtttgggctgttaattttgttttaatccgtctttgggcttgacccttctgtatttgcctattgggctttatgaatgttatgaatgaaaatgaatagtcacaaaacaaaagaaaaaaaacagaatttgagtcggtacacaactgttaacgaggtgtacttggtggaatcatagacacgtgtcttgacactcttaaggcctcttcaccaccaaattacttccctaacaaaagaattattattattgtgaagccccaaaagatcgaacattctaattcaatggcctacttgctgaccaagcaaaaaggaccggctccgttttcacctaattccgagcttcacaacgtgccttccattggttgaatattcaactggtttaaccaaaccgaagttacacatacgatttgagtcggtacacaaatattacgagacgtactttgtggacagtttgacacgtgtatcgccactctttatccctcttcaccagtcaccactcaccaccaacttaaaaataaaataaaaagagcatatattgtggagccccttacatgatcgaaaattctcgttcaaaagcattcgttaagaccgtgtgttgtgtgtcgttttttgtcgacgaaaattagaccggctctgtttttattggctcgtttcgattgaaagcgtggctataattggtttaaccaaaccgaagtcgacgtctcggtttgttcggttaagattaagccttgtagaacattccaaaacgccgcgtcaaagcttttagggtttgattctgctgtgtggctacccactcaagtctccagtgttcctttgtggctctggtttgccctattcttctcttccccctctctctctctctctctctcttgttttctttttccctcttctccaaggaatctggaaaaaattaaaccttttttctaaatccctggaaatcagaaaacttcctattgagaaaccatagattcgatccaagcctttgattgtatcaaaatctctgcttcaccaagaatttgggttgatacagaagaaaaaagttaaatggttgaggcagagcgcgcggagaatagttggattgcttcggaaacgtctccgtcgtcgtctccggtggtaatagaaagcagtgatttttcgataactgatgga

SEQ ID NO: 3206 - DNA, 2000 bp, Arabidopsis thaliana
atataggttgatatctataattttctggttttattaatttgaaacaatatcacaaaattgttgatatctaatcatccaaattcaaacttgtaaactaaaagaaagttgccaaaaaaataagtaagaagagttgaaaagaaaagacgaaaaaaaacacagaggtatcccaataagacgagtgccttgaaagtacaaacaatcgaagtttaataggaaataataggggacaagtggacaactaatattgttgactattaagttttccttaatatagttcgagaatttaaagtatggtttatataatactctcaatcatgtttggaccgaaacacgaagaagaagccgacgttggtgtgccgtccacgacccgcatgaccctccttgacgttgaacttgtacacttattatatagttatatacaaaaatgatttatgacatatataaagtaaattcaacataaaatcctattaaaaatgttaaatagtttaatgacgttagctaaaccctatcccgttctctcggttagccaagaccaagaggaccgaaaaaatgtaatccatttggatttggtgaacgaaacttatatatttgatcgttgctttgtaaagtaatatattcattttatacatcatatgtttgttttggtaacagaactgtagtatattataacaaaataatatttttgacccgtttcagattctgcaactaaaaagtatattattgctaaacctgaaccataataaactaagttatatgatttaaaatatgtttcgaatttaaccgatacgttgtcttattcgagtggatattaatgtcgccaaacgtatgccaattctgtagccttatggtgcgcaataaatcactttggtcctctcttatctcgaagaacataaattgcataccttatcttcttatttactcattctcacgaaaacatcttatcgtttcaaaagcatatagtttactaatcgtctcatatttttctaattgtataaattaacatggacgtacaaacaatatctaataagatttttttgtttgtttttaagttttcctattataaaatttagaatcctaatatctttttgtaatttgataaggacaacatataaattattaatatttgacattcaacaagtcacaaatgaataatgattgattattcttatattgatttggattgttccactaacatgaacaaattgtttaaaaatggatgaaatatttgagaaagtttgtatggctaaacttatttttttttaaactaatcatatatattatcgtcgaaatttcaaatttcctattataaaattataatcctaatttattttgtaattccataaagaacacacatagataactagaacctaacatacaataagccaaaaaatgattgtatatttaagttatctgattgtgaaatgttccactaactcgaacaaataaaatatccgagaaagtctcttcttatcatttatattaaagttgtgttcttaaatcaataaatcaaagataaggacatcacacttgtgatattacccaaactattgatatttttctttttgcttatctccccaaattcaactttacgtgtgtataaaaacaggtaaatcaataaaccaatgaggtgtgatcatctgagaatgttctcccgatttagcaatctactacactaaatatcaaccgttggatcaaaaaaccaatacccttgagaacactaacatccaacggttctttcttatgtataaatgtagaaacaactgttgtgtgtaaacggaatgaaaaaaaaacagaagcagagagagaaaagagaagacagagtcaattcaatttctgaaaaaaagttcaaatttttctaataaattttgatttcccattagtcagaaacatcttctttctcgtgcccggagctcaatttttcaaatttcattgaaaaatcgaagctttcctggaaaatttttgcattctctattacatcgtcttcacctaattttccatta

SEQ ID NO: 3207 - DNA, 1461 bp, Arabidopsis thaliana
atttgagaaattcgattgtttatttgatgtttcatgcaaattatttatcattgtattttgctttacccaaattatattttgggatttgtatgacatttggaacttctaatatttcttaattcatttatttattactctttcttttgtattgtgtaatttttaccttcttataaataaatcgttttttctcttacacatctaaaccatgcttaaatttgaatttccgttacgtcagcttggactcgaaaaccagtaacattattaggccaaagttataaagaatgaaaactattggcatgagattgtaaatattgaaaagattgatgcgtgagattgcaaacaaccatcagaaaaagattatatgatcgttaaaagaatagttgaaagtctccaaatcatgatggaaaagagacaagtgaagatggtataatttcttaaaaaaggaaacatctttggcaaagtctatttacttccttttgcgttaagacgtgccgtagttcctatggtacgggagaggactactcgccataggaaatctatggtaaaattggtcatttttcatattaagctcttcaaatggacaaaaggctagagggtatatatagcaaaatatagctgatttagtttattgagtaataaacttctccaatagtataatcttaagctgcatatttggattacgcatagagcttctaaactatctagtaagtatatatgccattaattaacaatgagactttgctttttctttttcgtcaaactcactgggactttcttaatcacaaagttgtggagcaaaatacatcacaaggaaagagccaacttgtatcgtcttcttttttttgggcgcgatatatatatatatatatatatatatatatatatatatatatatatatatatatatgcgactgagtcacgagaagtcgtatttataattggtctataaagaaacgtcaaatattatacctaaaatattaaaaattaacattattctttgcatcatccaggggcggacccacggtatagtttgtggggacagttgtcaccagtaatatataaagaattaaaggttttagcttatacattatagttaaagtagcaaaatggtagagactgcccctactaaatgctgaagatagcaggttcgattctcatctagttacattttgcacctactaaatttcttggctgggtccgccactggcatcatctagttattcttataacatttaaaaataatggttctttgccgttttctttagtcgttggaataataaatttctggagactaacaatgactgttatctgcgctcacgcggttctactaaaaccgaccttctttggttcttcccttacatgactatatatcttcgtttgcaaatatcaatccatatatcatacacatctacataccattttcatctacattttcaaagaaaaatcataatctgttcgaat

SEQ ID NO: 3208 - DNA, 2000 bp, Arabidopsis thaliana
atgtcatgccaatctctctctatatgttttctaatcaatatactagattactagacaagttgttttctaataagatctctcacatatgagccaatttgagccaaaacatgatatgatggataaagcttatttgggtattgaaagtatagagactgtcaatgagaaagtagtcatttgggcccaagtacagagatttaaaccttatcaggaaaagcccaatccagtacaaacttgaagaaaaagattgatctccttgtaagttgcaactggtaaagaataggacctttgttcaaggtctactgtattgagatactgaattagtataaacggccacttaaaactactttgtatttgtttaggcccaaaacattggactatcatgttgagaaaataaacacgaacgcaacagaagtttcctacttattatatagcccaacaaatattgatctctttgcttccaatgaatctttgttaaggcccaaaaaatacaaagccgaaactacttccatcttgtactatttttaagtttattttttggaaattttaccatgtatgattcagatcgttggtttaaatttttacaactagaaaatagtatatactctattagcctattatgatattaattaatgggcaatatttcgattagtttacgtgtagagtgtagtgataatgtatttaggttttgaccggcaataatgcatttgtaagaaaagtctttggacaataatagctttggtcaagtcaatgtagaacagaagactaatttctcttgacaaaatattaaaccttaaaaacaaatcctgtcagaccaaaaggtgatacgattgtaacttacaaatgatactatatatttttatagttaacagtctagtatttaaaattttgaaatattgatgatcattgattggttcatataagtaatccattaggttttcatgttggtcaatacagatgtacatgttttcaggattaatataggttccgtcctatgaatttatccgaccatgcataagagtaactctttaatctactattacaagttttcaggatttgaaagctctatacaagtttaactttatgtgtatattagttaacgtttgtaaccacagattcataatatttaccgtcgaactcttagccataaaattcggactaaaagactcgattcaaaaaggtatcgatgagatggaaagttgttgaacttattgtataaaagcttagagaggatattgataagtcgtcttttgcttttgtatctacagctatgacgtatattgtttaatccaaatcaaagtgttttaaagatattttggtttctggtggaggtggtatactaaagattcacatatagatagagatatttatgaatacattgatatgaaaatcatatacaatatgctaaagaacaataaatggtacacatatggattggttggatatggttggcacttggcagttaggtcattttcgttgctttactaaactttaataaacagtctgtaacatttacatttatatacgccaatgccaaaaaattctttattttatgcaatggcacattttctgcttttcctttacaggcaaaaactctttctttcctaaagatgcattatttttccatttgataaaataaaaaaaacttgacggtacaaaaatacacagaagacaatcgaattaagtaatgactaagtattaagattaggtgaaatggtgtaattaaaccgatgggaataatataattattatttaaatacagaaacagagcttgctttaccaaataccaccgaaacccactaagaatacagcaaatcgtctcttcgccattaaaacaccttcctttgcaaacaaagcttcaaactttctcttaaaacacccccaaatcagcaaagatagggttaatcgaagaacctcaccgtaagtccactgaggattcaagttcttgctttggtttaaggaagaagaacagcaaaaacctcaaggagaagaagaagtcaaag

SEQ ID NO: 3209 - DNA, 2000 bp, Arabidopsis thaliana
tccaactttttcaataaaatccattaattaatatccgtcgtatattgaatctacacctttttcatagttttgacaacgaaattagcagtaacaaatcctttcacatctcacaaaaacataatcagacaaaagaaaggattaaacaaaatcagacaaaggagttaacatgcaataactcggaaatttgaggcgtaaggaggagcaaactaccggcgacgaaagagaaaaggagaatagccggagccgagaagtaactgtgtagcgatttatagggtttaggaagatttataggccaaagacgaggcaacgttagcaaatggagagacagggcccatttatacacgtattatgttgggcctacatccacatgtcagtaatcgagtgggtgattctgacatctgtgatcttgacgctttaacactctgtctgttcttttcgtataagaaagtgacatatatatagagaggaacaattcatctaaattaaataatttattattgaaaattttaacttaatatagtttttttgtataatgttgtttcctttagtcttcattttttcttaagttatttccattttaaaaaacataccaatatgttatattctttgcttaaattgctttaacctgtatctagaaaatgtaatcttccatattgttaatttcataaataaaataaatttttttgcaagttattggaaaacgaagttaaaaattaatgctgcaccaagtttgtgaaattttaaaattacttgtagttggagtgggtgtagatgtttatgtgtagaaataggcatgcacacacaatttaatatagtcctagttacttatacaaaaaattcactgctgacgtgatcagtaatgcactcatatatgcatatatcactccacgtcaatggcacttgcccgtgcaaatgcctttattgtgccagaatcttcgaccggtcaaattgcgtgtgtgtgtatatatcgaaatatatgttatcaaaagagtttgaactttgaacccatatctaatacctgagtaaagttttagcattctattcaaagataacatgtagtacatactaaacaaactatatgtatcggttgttatcaggaataataagaattgtataatgcaatatataattaagtggtacttatgattaatacatacacatggatggtagatcgggatttgaaaaaccaattaaaatctagctttgaaaaggactcgagattctaaacgccgtaccaagaaagttcagattattatttcatgatgaatcattgagtcaaacacttaagcatcatatttttaatttcatagtttatacgttatccacatatataatattaattccgtcgacgacagtatttatatcagaattaggacaaactacatgtatatatttagtcaatcttgaaatttaaaaaaatgcctttgctaagaataaaaattatggttaggtgaagttctcacgtaaaactattcaatcctcacgcgattgaggagtgactgaccaaagtttatttctataggggcaatttaataactattgtaaactttcaacgtaaaaattaattactttgaagttatggggcaatatcatcaatagtaataaatataagcccttactcgtaaaatacaaaaggtttatttgttttctgaattgagagcgtgtaactactaccatcgtcgtctccgcgagttcttctctgcgtttaagccatagataacaaaccaaactaaaaaaaaaaagtttctccttttatcattccttctcttcccttgtataggtgtgatcctcttcaaggggatttctctggcgggtcatacattcgcaccgatcaaagtcggattggtctttcttaacgcaatcttgacccgattcaaaaaatttctggtatcctttttaagaaatgaaattaattgattccttgtcttccaaacgagtaaatcgactaattgattagattttgttcattagggtttgttagtgaatagataagaagataa

SEQ ID NO: 3210 - DNA, 1064 bp, Arabidopsis thaliana
ggctatactctacagatataagtgttaaagtgtgtatgtataggtatgtgtgtgtctatacgagaatcagagggttcggtgaagagtgaagactctaaagaaggaggaggagaagaaagaagataagtagatgcaaggttttgtctcttttctagttaataagagtaaacagtcttctagagtacagttttattaattgtttattaacttagaaagcttgtagttgtaattatgtgttaaagctaatctttttataaagtagccgtaaattactactgtttttacattgtgattttattttgttataatacttaatgtaataatataagatagagaagtactttcgaaagactccaaatctcggtgcaaccgttcacgtgacggatctgatgagtgatgaattttttaaaaatgaaaaatccaatgtaacgtgtatacatatggctatacataatcaaatactttgttgtcaatgattgacttatttggtgacaactatggtttcgtgcaacgtgataactatcactttttggccgtgttaatttttaaaaaaattagaatgaaatttatcaggttacggcctgtcaaagttagcaataacctaatatctgtttgcatgccagaatacggttatgtagaaagaaaattaaattatcatatttcacaattctttatcaactgtataaagcaattaataataaattaattagataccacatgtgtcatatttgttctaatgtttagaaaataaaagtacaagtcttttatgtccacatctccaacaatacttctgaccaaattccatatattattagtaagcttccaaaataaataataatcacatttaagaagaatctgttatttaatcacactaactgagataccgcaccaccgacactgtagtcaccgacaatgctgtggatgctacctgggcctcaattataagcccattataaaattgggcctacactaaaactattgtgtacagagagatatttgataatttgctgactgatacaagtctcacttccaacggccgatttattaaaaaaaaactccgacaa

SEQ ID NO: 3211 - DNA, 1459 bp, Arabidopsis thaliana
tttgggcgttagagtggacatggactggttttaaaccagccatttttatagccaatctttggtgatcttgtatgttgttatgttgaggagaaagatctaaaggttttgctttacaacttttggtttccatgattggggaaaaaagaaacaataaagttgaaaatttagatgatatgaacaataatgttaaagccactacacttttcatcaaaagaagtaaagaacactactcatattaatatctttcccgtatgcatgaaatgaaactttttcaccattgttactctagtctttgttcaattgttgtaaaatcagttcaaatactcaaattcttcttacttctgtgacaaaataaaacactcgttctcattgagtagtaaaattcgaaagtaatgttgttgaaatcttaaaaaaaatcatcaaattatttttcatgattctatcgttctgaatttgtaaccaatcaaaagctcatttatgtatgaaaatattaaaataatttatttgtgaagataaaaattggagtaatgtattaattgaaggagggtaaaaaagtcgcacgtaatatacgggaaaaggcgtgcgaaaggactaaacacaaaaagtctctggattgaattggtttggctctctgctcgaacgattctctctgataacccgattgtcaactccacagcccacaggtcagattatttccgatttagggttaatcgagttctcgtttttcgaaatcgatcaaatttatatttaatttaatttgcgcgagaatcgatggtgattgatttgttgttgatccagacagagacagagttcgttgccttgcctccgtgttgttttgttcataccgcgtgaaaagctttcatcatcaattcatcatcataaagaggtgtcgtgtgagcacacgcaatctcccaatctctcttctctctctctctctccaatctccatatctttgtcctctataatccggagaagtagctctaccatcgaaatctcccaacttgcttccttgtgagtttctctctcacttcataaattatggtttttgcttcagtagaacgtagaaatttggtattttgattgttgggtttcaatgatttagggtaaagattcattgggttttctccatttctagctttagtgattatgatcatgatttcatatcatcctctctctcggtttttgttcatcaatgtcttctggttcttgagataacctcctaagctttttggtttaatgattcctcttttctatcttctatgatcacctgcatttctcttgttttggttagatgttaatctccttagtgtgatttattaacttggtactattgattttgatatcagctaggaagctttttgctttttgttttcgtctttgcgcgtgtcccattctcttctccaaagttccctataatagtgaaagctcatcaagttatttagctctcagtttctgaaag

SEQ ID NO: 3212 - DNA, 2000 bp, Arabidopsis thaliana
cgatcctctctataagaacaaagaacttgaaagatttagggtttttttctgtttggaagaagaagaaggagcgtgcagaaattttgatttctcatgaaagaagagatgcgtgagccgacccttaaccgttctcgattaaccggagacagaagatggagatcaaatcacgaaacaagatgctttcctccgatcaaatcttacggatagatattgagatgaagaatgaagttattgagatcatcagcttatgtcaatatcggaaggatcatcggcgattctctctataagaacatagaacttgaaaaaattagggttttttctgtttggaagaagaaaaaggagcgtgcataaatttttgatttcttaatgaaagaagagatgacggttatctttcgactgatttcctttttttgttctttctgactaggttaacgttgtttccttttattcaattctgatgtaaaacaattgaaacgttattaagaaagtttaataacggtcatatttctcgtaataatttatcaaaaggtaaattatttatttgagtgactaaaccactttatgatacagaacttttgaaacagaggatatactctccaatggcgaggacagagctcaagctattattacaagtacctcacgctatgaagctttctaataagagttgcttgttccaaggcataagaaatctcaatgagctttgatgcgatgatcaagacgagaagaaagcttcattacaatcccttatctcttaccttcgggctttgaggccactagttgtcaaaaaccgccttcaggtatgaactcggacgcagttttcattgcctcgtccagtagatcataacccacccacaatagcatcaaggatagtaacagcatctaaaactgtccttcaaaacagagaagaaactaatgaaactatctgttgattctagaccggaaccattcttgaagcagtcctcgtaatttctttgattcgtaatagcgcagtgacataatacggtttcgaattgttttctcgatggcgatggcaagctggaggcatgtacgatagtgctggttgtatttcctctgattgcgttcgagccataagtacgaatatagtccatattgttacttggaatgcaagccgaaggagaatgtatgtgttccctggccctcatatggctgcgaaatcaagcagaagagtgtctcgtgatagagagagcgagattggtgatatattgagctaatgggaaaggaacagttaattcatggtgaaggagaacaaggagctaactcatgcattggctaggctacaaaaggattatgataatgaaaccaagattgacgataagtttgtctgcaaagttggtcagctaagctatgcctttgcgcaagttgagctcaagagagagaagaagctgataaggcacttgatgaggagaagaggcatgtagagtatcttaaggcagaggtttttaaatcagggaagatggttacaaaaactatgatatgaaataatataatctttcaccctaaaaaaaacaaagaattttatatcattgatccgtcatctttcttttttggtcgacatcgaaccttcatctctagatataatattctttttattaattgagttgttgccaaacaaaattgaattgaatctatacggggaaaaaaagaaagaacgaaaaagccaatgagaagctgacgaaaaaccgcgttggttaaattacatataaatgggttttgtgaattcaaataaagacgaagacaaaaagtttgagactttatctctactttgacccgaccagcgaaagtgtaaattgaaagatagatagaaagaaagagccaactttaaaagcttagcggttgatttcgaaatctcgtcgccggcgcgtggagtcttttcgtcggacaacaacaagagaaaagagatttgtggtgttcttctgcttagaattgttgttttccatctccggcagtgagatttggtggagaattttgatttgtgatcg

SEQ ID NO: 3213 - DNA, 554 bp, Arabidopsis thaliana
gtgatttagttaaaacggcaagtcgttttgttgtaggtcgtttctctcttttaagattggacgcctcgccgtttcttttattttctagcttattgtagttgtccatgcttgcttaactaggctcagtgagaggctagacttgccaaacttgaagagtctttatttatttaagaattttagatgttctaatgtattaatcctttttcgtaaacctttcctgttaaacaagaggtttatgttgcatgttaaaaaagaggtttaggttatattagcaatttagcattcgattcgttggttagtaactaagtaatataaataccacaagaacaagaaatactaatgaaaacttggaatgttcaaagtctccttatctacttatgcaacgttagacaaagctatcaaacaatgccacgtcacctcacaaaacatctagggtaaccaatcacatgcagataactctctcgctttattttctcttcaaatcttatcaaaaatcccataatgttttcatttctttacaagtgatcaacaaaacaccccaaaaagtaaagaaa

SEQ ID NO: 3214 - DNA, 1861 bp, Arabidopsis thaliana
tcagtttctgatgagaaatgtttgaatcttggcatgtataatggtttgtgtaatgattaaaggtaaacgaacaagtaatagtcaataagtaaaataaaaattaaaaacgctagactttgattgtgttatcactaaaataaatgaagataagtgggacttcggttgtggatcactcacgagtgaacaagagatcttgtatttggaaaaactagataattgatgggaagcttcataaaaataattatctaaataaataaaatttataatatatctcgtgaagaacgagagagagatggagatatcttcgaaacgagtgaagacaaattttattattttgatttttttgtttgtttaaagagaagatatgatatgagagcatattccttaggcaaactatgctagttcccaaattcacccactacacaaacacaatgaggtctactagaaatataatagttatgacagctaatgactcgtggttctcgtggttgttgtcctaacgatgaagatatatagcttagcaccacaacaagtgttgagcataagtccatatttgttaactccaactccaaagtgatcaaagagagaaagagatagagaatcgccatggcaaagatgtcagcactttctatcttcgccatctttatcatcctcgttctggttatctttggtaaatttatttctcacatatttattcaactttatgattcacaggatccaaagagtatttctttcggtgatagcaataagtttcattatatgtgattttttatatgcttaaatctgtatgtacatatatttgtgcagaaatacctgagatagaagcacatgatagcgagtgtctgaaagaatatgggggtgatgttgggtttggcttctgtgcgcctaagatatttccgacgatttgttatagaaattgccaaaaggacaagggggctaatggtggaaaatgcctctggggagagggcggtaaagtgaaatgcttatgcgacttctgcagcaatgaatcttttaatcagtttataagtcttacttgaaacttgcatgtgtcgtcgtttgtgtaataagcaaggctaatgatccaagaaataatgtaacaatgaataagtaaaataaagaaccgctaggctttgctagtcttactactattattaaataaggatacttcaatctcgttaagatcgatctcgtagaagatcaatccctttctctcttttagccatctgaaaacaaatcaagtactgcagatttgatttgacggatagaagtatataacgttgtattgataaatgataaacccaaaacaactaggtataatgcgataatttaaataaacgtataaacgacatatgagtttgtgataagtgttggatgagcaaccaaaaataaatcaagatccattaagagatttcatcgtaaagataagtgtttttttttttttttgatgcaattttatctcttactatacattacctaattatggcgtcggcttcaactttgtgttgaaactgtaaacccaaacaaaaaaaaacaaaaaaatatgaggttagatgcgacttcgctttccgtaattatgatctttattgttacagatgaacaagacatttttattataaaatacagaaatgacgaagaaattaatggtatttatcatatagtagatagtaaattagtgtgttctgtcgtaaaaaaatattaaataatgtgttccaaatgatcataaatcatgtacgacaaaaagaaagtcataaagcgtccgattaatttatggctaaatccaacggttagaaattaacttcaatttggtgacgtgtgaacaacaagatcaatagattctcggtgagaagaaaataaaagaaaa

SEQ ID NO: 3215 - DNA, 533 bp, Arabidopsis thaliana
tttatcgaatcctccttggatctcttcctctctcaccctatcgacggaatcaggaagagtttcagaattggctttgtttggaaactaggataaagctatccattacacgaataaacaaacgtctatcaatttccttctttcgattttatccccagaagttatcaaagatgcaaaagagaccactttagttctaacttgtattaaattagaaaattcagactattttcgtaattttgttagaaatttgagactatcttcgtaattttctcacaaaatttcttagtttggacgttctgccgttttaatgtataacaaacgacacgtagttctatcttagattgaaaatccggcaagatttggttgctttaacgaaagtatctatctcccgtcatcttgcttcctcgttaaaggaagcaaaagagtttgatcccgtcgtcgagctttcgaactttcgatcttcagcttttctcaggtgacagacgtcgttgtgattcaaatctttttccggtgaacttaatttcggaggctattcg

SEQ ID NO: 3216 - DNA, 335 bp, Arabidopsis thaliana
ctcaaatctgtattcccctctccgatttccacaaaccctaggaagccatctgagccacgattcactatgggaccagacgaaaaacagagattcaacttttttttactttactttgtaaatctatatgttttattagttctctgatttctgttttgtttcgacacaagttagttagtatttaatgtaattgggccataaataaatgggcctacataataatattgggcctaagtaaatggacctgggccgagttccgtctctttctggaagcttaagaaaacaagtttaggtctggacctctagaattaattgtttagagagagaaagagcgagag

SEQ ID NO: 3217 - DNA, 1464 bp, Arabidopsis thaliana
cttgttttctcgaaagagtttgctacgtatacaaaatttaaagatatgcgaaaacaaagtagtgatggtgaaatgtggctacaaagagaggaatccttaatagtgagaatttgaagtgaaattaatgtttgttactttaaataaagatatctttacttgttatgtcggtactattttcagttaaaaatattaacatacagaaaaaaccatattcataaacttttttgactaagtaagtagtataatactagtattgaaagttttttttgtaaccagtattgaagcattttttaaattgtaaatttatttcttatagtgcacattcatttcgaattacatgaacttacaacaattttgagatatttttgaaatcctgatgaatgatgattatgacacacagtttgtaacactaacaaatattcatttttattattatgtataactattgaaattccttaagtcacatctaatatatattatagattaaaagtatagcattagatgttgaaaaaaaaagatttaactgtagtaataagcaagaagacagtgagccgcccttcaagcacggcgatgcatgtggcagattgattcttaggaattgactcaactttttcggtcttcgttgactatatattcaaaaattgtaaaatttaactcaaacaaaaatgtacctcttgttacatgtattttgttcctctaaacagtatgaaaaaaaaactaagttttctttttaatacgaatgattgcacctaaaattgatagacgactaagtctatactgttacattagatggaaacatggtttgaattatcgctgctaggtgtccaactcgaactttgtacagttgtactaggattctaatgatttgctatgcatataaaatacattgtggcgcaaaaattacgctagtcgcatatttcttttttggtttgtttgtttgattgcataattatgatttgatgtcaaaagttgtataatcagaatttgagaacaataatatgacaaagaaaaacattcttttttctcagttagatgtagatacaagctttgtccaaaaaaaaaaaaagatatagataataaaaataatatcaaaggttgccttctggctacgaagactatgaatttagacttacaattccttggctaaaaactgttttaaatctaaattaataccatatgtcaataaaatatatcacgacttcaattactaagttagaacttagaagtggtgatcgagttccagcaagctccagcacgaattgaagaatacaatttgtgcatatatatattttacattatggttaaatattataatgtaacaaaaatcaactcttcgaactcgagtcaacgtaaattttggctataaattagtcaacattccatgtcttgcattcgaacatcttagccttaatcattttcatcttactctttaaagcgtaacgattaattaacgggaagatttat

SEQ ID NO: 3218 - DNA, 2000 bp, Arabidopsis thaliana
aaattgatgactctcgtactatacgagattcttacaacttttgttgacatatatcgagtcaagctaagtcgtaaacttggaattatcttatttgtcatgagaatttgaatatctgtgtacgtacacgtgacttgacttctttgaagatctatgtgattaagttcaattttaaaaaagtacttaaaaaatttttgtcgaagcttttgataactttcttttgatagtgaactaacaccaaaattcccaaatattattcttttagaacccactgtaatatattatatatatgatgattaacctcatcaactttatgaatagaatggaaaaatgtataaagtgacattaaaattaggagttttgaaaggggcatttagagggccctcgctaaattagatcgattttaagagaccctttaattaggacagaccatacagcacataccgctgtgctaccctcctcttcccacttgtccatatggaccccttttgccttcatttctgtcaattattttccaattataagcttttagtattttgtctttaaaaaaaaaaccttttagtataatagtttttttttttgagttttctactcagttattacattacgagatcaacattggcattatgcttaaatagtattagatgatgctagtcattttttttaccaaataacaccttttttgttggagtcggcaaagaaaaacttcgccaaaaaatgtaactaaaaagcagtattaggagtttaaatacaaatattaacttcaaatcttccacatatacactcaataccctttattcttgaaaaatcgactaaactaaatcatgcacccaagttagatctgttatctgtattgccatacttgaatttggagaagagatagctagactctagtcactgtatattccgtgctcaacaattggaattgactctttaaccatgaaaaacgatcgacttgactctctctctctatatatatattttttttttttttttttaatgactatccctatccatacataaattataatatataataacttacacttgtattatattttcatttttgataaaatggttagaatgtttcggttgatatctttgttttgggataaaatttgggttaactatgatcagtgtaatggatccttcgattgttcccgcgaaggttagttaaattagttttttcttcttcttcttccatttgtttattattttgagatttttgtcttttatacttggtgagatcaatatcgtcgggtcaagtgacgtcatggcgtctatatgtctacatcacctatcttgacgtggcgcttttgttgatgccctgatggctaactagccgacggcggcttccactttttttttttacttatcctcatattttccatcacgtgattgttcagcgcgtgcaacacacgcccgggactcagaaaaaattaaaacagtcattatttatccgatttgacgacaaccattgaatgttcaaatggtatagatatctctatgttgtcaattatttaaatactggttaaggggttattcaagtagatatactataataacaaaaatatgactatcatcagtttagtcttgtttataaaagttaatactaaaaactccacattgtgtccgaccgtatatatatatttttggtccaacagaatgttcaatcaaaaagagtaacaaatcacacttgtcatctaagtaaaagatgtcatggagacacgatgaacttaaacgcgcgtgggctaaacgcgccgtcggctatcagcggatgaggacttttttcaatgccattaatttttttgtttgtttcttctctcttcccttaattctcagtaacttcttctcctttctcattaacttccactctccttcctaaaagtaaaaacgatacataaaaaaaagtgttcattgtatatatatttaaaaattggactaaaacaagagagagctcacacatctaaatttttctccatattacaaaagaactaaagaag

SEQ ID NO: 3219 - DNA, 2000 bp, Arabidopsis thaliana
attgtgttgatcttttcaactcctaagaaaatttaatggggttttatagtaatcgtatgcaaatctatgttgaattttatgcgaacaacccataaaatttaatcataagaagtttggatttgaaacttcaaactacattttaaagtttttctttttgtcgatgttcaaatgttaaatatataaatcaaaccaaagtaattatgaaaaatgatatggaaactgaaatttatggacaatgccaacccaactttaaagacaaaaacagagaggtgaagttaaaaacagatcacatcttaggacggtgaaacgttgtccactgaccgaagtaataaggttccatacttcgacgttaggtagatagttaacgaaagtgatccccgcaacaatggccttagaaacattttatatatattatttagaaataagaaaacagttttagtctaatgattaaaattgtatgaattgtattacagagtttcaaaatctaaagttcaattttatatttatatatggttggaaattacaaaatatggaccttcgtagtttatatcgggcttcattagagatatgggaagtcaatttcttgaaagagagatcgaagtttagctccacacaacaatctcacatgagacgctctaataagatttcttacatttagctgttgatctgcaacaatttttttttaggtcaaaacgacttgtcaaatggtgttatttcaggagtgcacatttgtaatacgttgaaaaaactgtaactcaatttcattcgtatctcctatatattccacacatccatttaagctttgatcatcgctataaattataaatttttacaacacccatttaaactttgatcgtcgatgtaaattataaattttttcacttctataaaagataatgataattagtatttgaaacgctataattgtttataaaagtagaagatatatatatatatatatatatatatatatatatatatatatttagaaaaataagttaattatttgaaaggacaaaagtaaatcacaaattcaaaaagagattcaattaccttcgaatgcatagcggagataatcgaacgaattcctcataatatattgaagaaaatatcatcaacatgtcgtcaattttataacatgattttgttacttgttataacatgagattgtcagaatcagaagtgttcctgaacttgtaaatgccacaaagccaataacaatttacaactgattttagttatttagtgttgttacttgaatatttttcattttgttatttagtcgaattattcttcatctaactaaacaaatttaactcgaaattaaaccaaaatgtcaacccctaattgtgattaagatggaaaattagcaaatttagtgagactaatttttttattttttttgataaaatagtgagactaataatgatattattttatatatatctttaatgatgtagattagttttgtctatgattacatttttctaatgatattctaatgtaatttcttacgcttgtcaatgttaccgtttatgatgtactttccaaataatagtatagaataaaatcacattagcaaatgatgaatttcgaataagtgactgagaaaaaaagaaattgagagataaaaaaaacatgaatcagtgaaaaacaagctacattacacgcaaacaattttttcttagggcatggattttactcccttgttaattggtggatttactccatcaacacgcattttgttaatgaaattaacccttttcccatcatatccacgcaaatcgtcaaacttatgggcctactttctgttttcaaatagaacagattcaaaatctgtcaataagtccggcccagtaacagacccaaaaagggtcatcgttcgtcaagtcatgacgccgttcttgacttgcttcatttgaccagacttgcttcgtctccaatttttcccctgaagaaagcaaagagcatcatcggcgctgaagaagaagaagaagaaa

SEQ ID NO: 3220 - DNA, 763 bp, Arabidopsis thaliana
attttaaattcattaaaaactaaaagaaagagagttcaacataagtcgccgacatacaatccagaacgagaaaactaaaccgacacgcaagttgaaagattgatgaaaacgggacgcaatctggtttgataagagaagaacaaaaaagtcaaaataattaaaaaatatctctcgacctctcttttctctctattgattctatcgctctgcgcatttgtatcttgctctgtctccgataccaaaaggtaattcaaaggaattttagggtttaccgttgatttcttcgattcgattttttgggacgtgttttgaggattcttctatctctgggtttacgctgattgatttcgagagctgtagctagggttatctgctactctttgttgcaaattttgtttttgttattcctttttgaggtgaacattgttcttctctttgcgtgattctgttggcatttgtcttgttatattcttcgtttgattatatgctcttctccgaagactggacttttgttattcggtcgattcgattatgatgttttttgaggttttgatagggcttcgttatttaaagatgttcctagctgcttgctattgatatccgtggagtgctattgttctaactgaaacccatcttgtaactttccaggtttttgtattctattgaagattataaactaaagggaggagctttgagaatttgattgttgatatccaaggatttgcaagctagttttttttttacgacgttatacttttcgatt

SEQ ID NO: 3221 - DNA, 2000 bp, Arabidopsis thaliana
aaatttatttacttctctatcacaaaattgaaaccgtaagcattgctaaatttttataaaattgacaacaagtcaagaaaaatgacatgcatgctccatagaagaaggttcgatatttggggtagttatcttaactttcaagatcgatactaaccaattgaatattgtattgttaactgtgcaaaatattttagtacgactttgcgagtcagtttagtctgttaaaaattattttgtttgggtcataaaaactatctatatctttgcatgaaacagcactacagtctacatcagatttataatttaaaaagacgcggtagtattttaaaacattttgtttcgtttattcatttattgtgaaagttgacatcgattacatcaaacaataatcttttctagatcattttcctaacgaatctattcagtgaaccatgtgacacaatttacattggttggtagtaatataagaatttcacatgtggtatattataaaataattttagtttcacataattttaatcaaagaaatttaatttgatatgtttaatattaataatgttaaaaatataaaataaatattaaagcttagagttaataatattttaaacttttactatagttgacacttttaaaaatctaatataaactatacctggtaaaactaaatagtttaactaaaaaatgaatcaaacaatataagagatattcaaagcagtttaacaatatctagtcttagatttactcatgcggattccagaataatttggatactagttctctgtttcagttcagagttattgcattttcataaataaagcgaatatgaatttagttttatcaatctagtagattttcagttttttatttatcaaacaattatttcagtttcttttttcaggttttatcaatctagtagattttcagttttttgtttatcaaacaattatttcagtttcttttttcagtttatgttcgataacaatgttttagatatacgataatcaagtagttcgaattaccttgacatttctagattgaattttccaaacaaagtttacatatatatatatatatatatatatagcggattgctcattgccattggttgtgaaatcaagaattaatgtggatggtaagatgtaaacttcttacaaaaagtctatttaggagaacgaaaacgtgtgaaggtcttgttttcctaaggtttcgttttgggtctcttttattttgtaccttgtaattctcttggccctttagccaactaagcacattttgggattgaatatatatttaaaaaaatatatatatatatatatatattaagaaaattacttttgaaatttgtattttgattagtgttgctaattatggtttaagcatgagagtccatccaattcgacccgagtcctatatacagtatggttcagcaaaagggtttgggcctggccatagttttttatggcaacaagctatatgaaaccatatataataaatacaatttcgtattttgatacagtcagtatgagactagaaaaactagccactaggccactgaccaaaaaataaaataagaaaaaaactaatctttatctcaccatatttttagatctttgaaattccaaaaacataattagagtttctctttccttagtttcttgtgtagtttgtatgtttcagtagggtttttttccttattttatgtaaataaatggaataagattcagttttctgttatgggacatccctcgttaattcttgttttggttctttttgataacccaaagtttatataggtttttttttaatttatcttcttacgtccattaatttgtttttgttttgttatgtatttggctaaacgcgtgtgtgcgtgtgtgtcctactgagtcgtctcttttgagtcaacttgaaatatcaaccaatcagcaaaccaaaatcttataacatcatcttcttcatctttccgacaaaaataccaaattcttgaaaacaaaaaaaaa

SEQ ID NO: 3222 - DNA, 2000 bp, Arabidopsis thaliana
gtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctatggagtcatcttcttcactccttcatcactcttacctctcttaccttaatccaaaatttggaaaaagacctttggtttcttatccattaatgcagagttcgcgaaaatgcaaacaaactcgcatttgttctaacaagatgtatgttcccggtatgtaacaatatgacatattcatcacaaaatgtggtttttattcatacagaattgttctatatagattaatgcctatttttctaatgttttttttgttatataattgaattaggctttggagaagcttcaccggaggctaaggcagcgaagcatcttcatgacttctttacttacgttgcagtgaggatagtgtctgctcagcttgaggttgatttgacgatttatttgattttttaatttaggtgttttgattaataataagtatgatctatatattaattaatgacagagttataatcctgaggcttatatggagttgagagaatttttagatacaaactctgtaagtgacggtgataaattctgcgccactctcatgcgtcgctcttcacgtcacatgaacttaggtaccaaaaataacacctttatatcaataatttggttataaaattctagtatgcgttttctttttgtgaaacttgttagttggaattttaattctaggttcttaaagttatacattatacttttttaacaaatttggttttcttctagtaatttagacgaaatctctttactttttccaaacattcttttcgtacattggaagttgaaacttctcactaaaataactagttatgggagttcggtttatatattcggtttcagttatatccattcgcttatcgtttttttttttgttttaaagtttagtatcccttcggttaatttgaaagttcggttcggtttcgattatttcggttttaaaatttagtatccatccggttattttgctttaaatatttttggatatttcggttattttcggatatttttggatattttcggatattttgagatattttttttattatttttgaatatttttactattttatatatattctcaagtatttttaattatctagtctagaaataactaatacttttgtaaatatatatttatattttagatatttttggttactcaaaatatttcggttggtatccattcggtttcagttatttcgattataaaattttgtatccattcaattagtttctggttatcggttctgtttacttcggttttggtttggtacatctggttcgggtaatttgctcaggcacaaaactaacagtataacacaactaatctgtgcaattcttgtaaagaaaaactacttcaaaaattgcgtgacgaaatacaattccaccaatttgcggattactaacgaaatcactttgtagatccataagtttcgtatatcttttaggtatacatatacttgatatgagataagtaaactaaaaactttgctttttttttttggtatcatggcca

SEQ ID NO: 3223 - DNA, 1150 bp, Arabidopsis thaliana
tggttagtaagtgtatatatatactatactgttttttaatagttatttacacatttataaaaaatatatcattgaaagatggagagtgattaagaaatgtaaatatgacattgtatcaaacatttgtaataagtgactcaactgtagtatttgtctacattcaataataattcactatatagttttataatttatttccattgaagttaagttttaattgatgaacctaaaaaaacagttaatgagagagaagaaaggtggaaaaagaattgatcaaccactcaagaagtcatatttcatgtgcatgtacataactttgagtagataacaaactaacacccattattaaatgttaatcactgttaaatcaattggaatctgttgagaatataggaaaagcaaaagaaaaatatttgatgatatgcatcagatcgtttaaaactcgtaaacaacattatttcactaattaataatcatcatcattcagtcactacttatttttaaataatataaatacaacggggaaaactccgagagaaagcagaaaaaaaaaagaaaaaaaaatcagaggaagaagaagactagaatcgtcttcattagtctcgtcttcgttcacacgtctgaatcgtcaatagaactttgatagatccatttcaactagacttctctttactcacttctgaatctcccccaaaaaaaagaaagaatctagctctgaatttctcgattcagtttccagaccaagcttcgcatcagacagaacaaagtgtttcggatttggtgtttgctccggagaaagcgaagagagttgagaattttttgtataatttctgagattatatacatgtgatgtcgggatattcgtcttctgctggcctccgaggatttgcaggtaaagtttccgattctcggatttcatagagctaagttttggttctgcttcgtattcttagggttaaggttttattcatttggatgttagcttcggatctgatatatatttgatctctggtagcttaattttactaatctactgatttagagttgttgaatctaagacttcaaattttgttgcactagagttatgttttggatctacagaagttgggttttgtatatttacagtgttttagaagacataaagaggata

SEQ ID NO: 3224 - DNA, 2000 bp, Arabidopsis thaliana
tccatggaatatagtttaatatgtgtaaatgagagagacatggaagagaattgtaatgagttgctgtccagtatcttgcgtcgtgatattatttgctcttaatgtcaaccacaacgtgcctagagattatatatttgtagttttatacgtgttttataggacaaatggtggaatgattcaatggagatgcaaagttacttgtcaattggaactaaataatgcaatttaactaagatataaagaaaacatcaaacaaagtttagtggggagcttctcaatctaaagaaagtaagctcagaaagacagaaaccattgaatattcaaaacaaaaaaacaatccacagcttagcattttgttgaccgactcatataaaactaaaatgttgcgacgggctttctcgaccagacttagttaaaatccgccacgatcagtgttgctgattcagcatgtgggccggcccatggttatctgttagtaaagcttccacgtaatctaagaaaacaaaaaatgagccgcatggattaagaagataatgtacactttcaaatatatgatgaattattttcaattttgtgacaataaaataggttattatcaattctgagacagtttaaatgttacgataccttttatctgtatcttagataaacatgattcaacagatttaatatttcaatagcaaattttatttatgagaggttttaataagagcacaatggtttgtcagcattaagaagacaagctcattaagaggcaagagtaagaccaaagatatcattagccaggaatcatgatttaatgttcgttctttgaacttgactctttttttttttttaatgcattgaataagcattattgaactgcgattttcggttaaatagtacatgaatcatgaaataatgacaatggttatccaataagcaagattttggtttgattatatataaattaaaatagagacatgcaattagagaacgggcagaccaagtagtagaatattatgtcgctgcatttagttttgctgacgatgtctttgaataagggacaccaacatttgatttaatcaaataccatgcatagaaatgtcacataccaagttatagtaaatgttagtcaaacctttgatatttcgtttgtttgaagttgcaacttgcatgcaagtcataactcgaaagtcttttttttttgtttttttgggcacaactaagtcgaaagtctagaaaactgaatgtcatggataagttgatgcattccacagctatttaatttttcaaaactaactgagataaaaacatatttttgaagcaagttataacaaaacttaaactaattacacatttcgtgaactttgacaaaagtaatttgtagtagtaaatatcattaaacatacccatctccaaaaatcgaaatagtaactacaatctatactaaaaaaaactgtgtgatcaggcaaaaccagtatttgaataattccagagtaattttaagtcgagccgaccttaatctttaaagaaaaagaaagaaacatattttcgataatcaatcaaataaacaaactcaagtcacttgccgatgaaagtggtggaaatttcccataaataaacaaaggaacaaacaaacaactcctccatttccattactttactctttctatttcttaatataaacggacgattttaccctccatctctcgccgttttcacactatgagctttccacatccctttacgaagtgacgatattacccctaaaagcgaccttcctcgaagaaaccacataccaacaatctgagagattaatcgcaatttcccagacacgggaccttccctcattaatcttagctggcttccatggatgttccttctcagaaatcccaatttctcttcctttatattctcattcactcctcattctcctcctcaaatcaataacaacgataaaaaaacaaaccttccttaaccagaaccaaatttcagatttttaaacaacataagctcta

SEQ ID NO: 3225 - DNA, 2000 bp, Arabidopsis thaliana
ataaaaccaaaaatgttatgtggtatgtataatgttactatatataaaattaaacaataaaatataaatgtattagagaatgatacaatgtgcaaaacttttatatataaaaaataattcttaaattttaaaaattactactttaaaaaaaaaatcacgggacgggtaaaaaaattaaagaacgggttttattttggaattaggttatatggtggatgtatttgaatcaatatttataaaattttaaaatattattaatatgctgtttaagtagggattaaaacttcagttttttaacaattatctcatggattcgtagtatagcgttacctaataataattataaactgtaaaataaaaatattttataaaaataaaatttgcaagttttaatatatattattttttaaaaataaatcgtctcgcggtataccgcgggttaaaatctagttttatctattgtggacaacaaacaaactattttatctataatttaaacaaaatccttccaagaagaagtgaatcttaaaatacgttataaaattctttaatgacgaatgataatattaattaaaaagaacgacaaaaaaaaggtctaaatggtgttgaattgttgatatattttccctacagtgttgatgatattttttttatgatattgttttggtcacactgttgataattacgatgtaataattccataaatttctttgtataaaatgatatcattaactttgttggggtctattgagatttgagaatgatacggcaagtggatggtgaagttgactgtctctgccaaacatattagtttttcaccaaagtagggactaatgatcataattctatcagattaatttaattattttgtcgaattcttttttttccccaaaactaagatcttggatcaaccacgttgctttaatatccatccaccataaaaaaatctaaaacacgtcaaataataaggtggttccatttgtatgtcgattacacacatgatctaaaattctgatacaaatttgcaagtataactctcttttaagacacaagatcgaatcatgtttgactcttttctatgtaataaaaatgaaattaactccgacgtaaaaagataaaggtaactccgtaaagagaaataaatgacggccgttattatagttagacggagggatgtaataataacggaaagcatgagaccagctggttaattttctaaggtaagagataactgtaagaaacaacaaatgtcaatcaaaattactatgtgatcattaattgtcccttaattaatttaaaagaaaaaattaaagaaagaaagattgatttgtagggtttacatataaaaatgaaaatcggaacaaaattctcttgtcttcttcatcctcctcctcctcctttctctctgcaaaccctaatttcctttctcctaaactctctcatcttcctctttctctctcttttcttcctaaatgataaggtaacttcaaaactacgacaattcaacactctaaaggacacgccaaggtaaaaccgaatttgcttgttctgttgttcatcgtgttatactctctttttttaaaatttgttttatacatgtgatttatgattcttcttctttcaatgctgtgtgattcctattattcatcgatcaccttatgatcgagtaattcagctcttcttgtcaaaaatttctgcttttaaattatgtaatttttgggatgcttatttgatttatgggtttgaaggatcgattcatgttattgcttaaaatatcgatctttattgaaaacggaattggttttttggactcttgtaatctgaaatgattcagctgctgactcctcgtgatgtattttactctgatttgttgttccatagtgttatcatcgagctgatctcatccataattcgaattccgatccattttaatccgatattaagacacaacaacttcgtgttcttgtttctcagatttaggtttttagcttgattcaaaa

SEQ ID NO: 3226 - DNA, 2000 bp, Arabidopsis thaliana
tctttttttttatattgtttttgactaaagactgtgatttcgtctggtttctagcttgactgttaaaagcaaattaaaaaaaaaaatcctaatatttgttattaatatggtcgtaaaatggtaattagaaagttttgttatgggcgtgttcaaaaaaaacacagctttgttatgggctcaatttttttaataacactggtatttttatgccatggactgagaaaaaaagaatccagagtcattgacaatttctttaaacaagcccaatattttttttgttatccgttccatagtaaaaaaaaaacaacaacatacaattaccttcttaatcattattaacctcacaggccaaaattcaatttactcaatttagattttatcatggataaagtaaataaatgccaataaaccctcgaacggtgtcagacgtaatcgttcgcctgaatgagtttcgtcaacgtaatgtttacgatgtatttttggaaagtccatataataatacgtctcttttatgacctcacatcaaatatcttcttctttctttcttgatcttttcttttcttgtggtatctggtcgtcatcgatatcttttgtgttgttcctttattcaatcgtagttaagttttaaactaatcaatcaatcagatatctctgcttcaataattggcaaagctcctatgtttttctttatctttttttttagtaaactataatgtttgaatctattagatttattttgtagactaacatacaatttttcatgctaactgacagaacatacaatttgtctatgaaacaatactgtttgtgaaaggaaacaaataatttattaagaaaatccaagaaacaagaattatggacagtgatgacatattgacatgcttcagtatttgatatgacaaataaaactactatgtagccgttagatttttcaacacggaaacaatagtccaatcgataaatattataaaactttttgtaaactaagccttgaatgaagaacatgtaaaaggccgtattttagcggttcattattaatgttatcattcaacaaaccaaccttataataacacatcaacattatgttttaataataaatgaatcacatgcggatcttcgcaaatcgcaatgaagagaaaataagaaatgcaccttacaaagaagaagcataaaatgaggtgtcttttggtgcgttttatttcagaaatacattttaaaaaaacaacaacttaactaaaccatttatatccaaaacaaaaaaaattgatatgttaaaaacattttttaaaatttgataaaatattatactcatatctcattattttctcaccattcaagcattattcttgatctctaattcaacactaaccgcatttgttctgactgtgttttcttgcacatataatacttaaactgtatcgccttattcaattttatgtgtcctacattacccgatttgctgtcttcattcaaaatcttaatttattcatgaaaaaaataaccaaaaacatacattaaacttgtaaatgaaatgataataaaatcaacgtgaatcgcatgtgtaaaattttaacatttattgattctcaatcctatacaaaccaaaattgatttagagaattccatgaatggagtagctgattgtaaatcaagaagccgatgaaaaagagtgtaaagtgtaaactaagaacttaatatagtaattaattaagggattttgaacaaaaattactaactaaaatttagatattaagtggacataattctctctttttactttctaaatattaccttttatgtacgagtacgacagaaggtttgacaagtcaaaaaacaagttgtactgtactacgttaacatcgatactcttatctccacagaaaccgaaatttcattttaaataagaatctcaaataaatgccattaaataccaagcaaccaatttcttgcaattttcctctcctcccaaccaaaacacaagagccaagaacaaagaaacc

SEQ ID NO: 3227 - DNA, 203 bp, Arabidopsis thaliana
aacgatttttgctcattcccattcgtcaaaaaagtcaaaagaatcaaaacgctgaaactttttctctgtacaaagaaaaaaaaagaaaacattaaacgacgacgtcgtgttttagtttcaccaaaacgcatcgttttatttatatcggacgaaccagtagaattgtagaaagtagaagagagaattcactacatcggcggcga

SEQ ID NO: 3228 - DNA, 1122 bp, Arabidopsis thaliana
ggtaatcttgctaaaccacagacaaccaacatttatctatacgccaccagaataatcaaactactttgttgtctcccttgttctgttctgatgacaaaaataaaaatgtattcataaattaaaccataataattggtcatacatgtgttttccagagagaaatattggttacaagtcaacacctaaaatttgattgctgcatgatatgctgaattatcaatgaccagaattgtatctgctttttctcttttccatttcgtatgaattttatgtgaataagggccacaaagcatatagcgtttcgataaaattcaacggaaaagctaagaagaagcaaacacacatagctatattacagaaaatgattgcatagaaaacatgcaaacctatagagaaagatagaacctgaagcaatggccgtaaaaactcgaaaagaattgttggagaagaaatgctataaagagagagagagaaggaacgaggagaactaagcagagagaatcagagtcagagagatgcgaatgactcacgaatctttttccttaactctctctgttccacggcatattctcttcatcaatattcttactcagttaccagtcccggttttatccggtttatataccggtttgattttgatccgaaccaagaacgtatctcagagtcagcgtcatgcatggtttatactttataggtctgggccaaatatgggctaagaccaacgtgtagtgtgtgtcgcatattcattcttatgaaatgtgtcctctttggttatggtgaaaagaaaacatttaaatattgttcttagttaataaaataattttcgcttccttagtttaccaacaacaaaattacgcttcctgttacttgttaaatgaaaataaatactgttcttaccaaacacaaaaatgaaaatacatattgtataatacacttagacaatacttaaaatatgaattaacaacacgtgttatgcttatcaagaaactgctacgcataaggcacctaccttgcctacctctatttttgttttcttctcttggttttctactctatgctttttgttatggtaaagataaacaacagaaaagtcagcgtgagagactggattatcttagagcc

SEQ ID NO: 3229 - DNA, 886 bp, Arabidopsis thaliana
aacatcaaattgctttcaccagtgaagaggtttagctacacatcataacatatctcagtctattagagaaaacaaaaccaagctattcaaatttacaatctttgaagaacacaaacacactaatcaccgagaagttgaaaatgagagtgacactttaacaatcatagtagcaaaacatagaatcaacgaaattaaaaccatattatatataaaaatcgtaactttattcccaaatttcatatatgctagattgtgaagaaccatttttttcaattcgattttgaaataaaaaagatccgtgaaaataaaattgcgagttattgtttgagaattgaaagagaagaaaacccagaaccgaaaatagacttaaccctaccttaaaatgaagaaacaaatgtcggattcaaggttcttcttcctcgtctacgtgaagtccaggttaagaacagttaatagaatcaagagacatggagtatttaattaagctgtgttgggccacatttattaagctgttttgggccttcggcccatacctcaatttcgattgggtttgttgatataacatatacatatgttttttttattttttgttgtgtcagtttcgaacagtgtttgttttgtcattctccctcaacaacaatgcccgtcaagtggtaagctttgatccaatttcgttttccaaaatctcgatttttttcgtttctgttctgattactcttccgattcttgtatttgggttttgtttttttctagggttttacattggcaaccaaaccaaggatcaacagtaagcagccaaatcctaaacgaagcaacacaatgtgtagagagcatcaatggtgtgaaagaaggaagatggaaagcaacactcaactattacaaaccc

SEQ ID NO: 3230 - DNA, 498 bp, Arabidopsis thaliana
atgaataaaccaagtgatatagcgcgatttaaaaatgtctttaaaactaaaggtaaccatgtagctagttagtctctagggtcctagaggtctacgagtgtgcatgcatggatttggtgcgttttttctttttcatcttcattttgttttttgaaacagggaaccataaacgaatatatatctaattcttgtttgatatatagtttggtcgaggcttcatgtcaagatttgctcattcgtagttagttgatctctagagaaattcaaaacacatggtgccactaaaaacacaaaatgcaaatacttagctagagaacttaatgatatgttttgtcttgatttttgcagggaacgcaactaacggaagagaacgagcgacttggcatgcaagtacgtggatatatatatagtcttgattattttgaattttgtatgtttgttatcagtttaatgttaaatttggaatatttttttttggttacgtgtagatatgtaaca

SEQ ID NO: 3231 - DNA, 2000 bp, Arabidopsis thaliana
atagtatattagttaatattaagccgtattacacatttttttttttcacctaacgtttatatatatatataatattttttagttacagaaaatcctcaccactttaaattacgatgcaataagatcaatctaaatggataacttgtaaagaaaagaaaatgatacagtattcgtggttcggaataagtcaagtatgattcgaacatcgtacaatattggtatttgacaataatccttggagaaaaaacaaataaaaagtttctgcagaaaagtttaattttcataaaaatacaaaaagaaaaacgttgattggttgagaaaaatacgcacacttatttagttcttcttgaccaataaaataaaataaaatctcctaaaagtcaagtttcctcaatcgggcaaaacacggcggacgcgctttcttcaatcaaaaactcgtctgctaataagtctcttttcgtcttcagcttcttccgctttttctgattgcttctctgatctcttatctctaattctaatccatagtaaactcgatttcatcatcttctgctcacaacacttactgttgttgttgttgttgttattgttcttctcgattcactcgatcgatgttgttcaaaatgcgttcttttgtggcttttgtgctccttctgagctggttcggttcgtgttgttctctcaaggaccaaggtagagactttttttccgtttcacttactcgtttttgtctctttggtagtgtagaaacagaatccagttccctgattcacatcctctgtttcgcttttacgttttcagctgtagattttctcaaaagtgaagatagtttaaagaaagatctatcgtcagatgaagattccacgtatttgtaagtagcagcttcaggtttctgagatttctattgggtctttagattagaaacactcttgtcacttgtgctgattcaatttctcagtttcctaagaacaactcttaaagtttcgattttactactttttattctctactctcaatctatcttgactttgaaagattttttggtataacaacaacatatatgtagtcaagatctacaaatttctctaatcatttcatagcttcattctctctatgtatgtatggtagaagaaactgttgttacttgtaaccgacacttctaaacttgctatatttagagcatgttgtgcaatggcttaatttcttcttctaccttttcttaggaaagcttttggatttcacaggaaaacacttgtccgtaacccttacaaagacttgccttcaagaaaagaccgcaaaaaccgtgttgtggctgcaactacaacaccatcatcatccccagaacctgctccaaaacatgtttcaactaaagcttcaacagtttcagagccacaaaagagatcatctacacaagatgtttcaccttctccatctgcgccacttgcaaactctcccattccaagaaactctcattcttctgttcctttagttgttggctgcgtaggcggtgctttttttcttctccttgtagctaccggtctctactttttcacaagtaaggccgggaaaactgtgaatccttggcgtactggtcttagtggacaacttcagaaagtattcgttactggtaatttcctttcttgaattgttttggcaagtgcacttacttggagtagtaaccaaatttgtctcatttggtttcatcaatgtgtggtttttgatactcaggtattcctgtactcaaaagatctgagattgaagctgcatgtgaagattttagtaatgtcattggatcttgtcccattgggaagttgttcaaaggaacattatcaagtggagtggagattgctgttgcttcttttgctactactactgccaaagactggaaggacagtacagaaattcacttcaggaagaaggtattgttttccccatttttgttttcttataacaacaacatatagtcgacttagcgcgttctgttttcacgatttcagatcgaa

SEQ ID NO: 3232 - DNA, 2000 bp, Arabidopsis thaliana
cttggtcgaacataagaaaaagttaaaactattataaaaaaaaaatagattttgttacattgtgataagagggagtaaaaagaaaataaaaatcacttatatttttaaatgcgattataccaatactaatacatatcagattataccaatactaatatataccagatctaatcaaaagtttgcaaataaatatgtttgggggagaatagtattaggatgcagctcggtgtttaaagatatggaaatcgtaagtgatttaaacaaatatgtcttcaattcatgttaaaaaaaataatagtcatcatcttccaaacattaataatagaaaaatattaattcaaatgagtgaaactcagtactactcatgagtcatgacctacatgagtgaaacactctagaaacaatcatgcccgggaaggaaataaattattcaaaacactgattttatcttaacttatattttaaaaatgaattagtatgtaagaaaaaataatttgagtaaaatttttattctttaatcaaatttttattctttaatcttccttagatgataaatttgttggaatgtagtagaacatatatatgctgaacgttttttttttgttttttggctaaaggtttttttttcgtcaagctaaagggtttaatgacgtaaacttgaacagtataacaatatacatactaaatatttaactatatttaaaataataaaaacaattttgtttttttcaagttaaatcaccagttgaattcacaactgttgattcaatttcaacacactgaaattaatacatatgatcagtataaattaggctgattagcccaaattctgtgtcacttactctactataaactacatcctttattaactacattacgtaccaaaagagaaagaaatgtaagagagccaataattagaacaccggctctgactagaccaaaaaagtatttcgtctaaaagctttttaaccgaccatgaaaactaaattgttttgtcccagtcttttggttttgatatccggacaacttcctcatataccaaaatactaaaagcttgaaaagtcaaccaataataaagtaacgtggaaaatatgaaattcgttgcaaagataacgtgatctctctacgaagataagtttattctctttttttttgtcggcaccctatattttattcaaacggaattgaaaaaacaggcactggtagttattttaaattaataaatttgataaactaaaatatggagtatataatatataaattataaacaagatacatcactgaaagaaagaaaaaaagaggttcgtactttccttgattttttggaatgtcaggttcatcatcccgatcaagaaacaattatacagatttaggccataccaaaatttgatacatgcacggagaattggagatattcaatccaagtccagatacatgaatactagctaaaaatgtaacaatagaaaactacaaaaacagtattaaatcgcagttaaatatgacattttcatcaaggacataactaaaaatatagaaaatttcttctatatacaatataatggatatctaaatattatatatttattttaaaactttatataaaacactgatgtaacatttctcgtcggatctttgttctctgatattttatccattcacaagaaaaaaaatactatattttatttttctttatcgacaaaaagaacctttttaatcttatgataaaaatgaaagacttcataaagagacgtgataaaaaaaagaagaaaatggagcgtgtgtgtacgcgtgtgtatctactatgtatagaaactttagaaaattaggaagaatcattcaacttgaagtagaatagtctcaaagagccatggttgactgatcaaccatcgccttcttcatccttttctttattttctacattagtcatttaattcattcattatatatacttctctctaatttcttaatcatctcttcttatagtttttaccctaaagaaa

SEQ ID NO: 3233 - DNA, 1418 bp, Arabidopsis thaliana
gaaaacaaactaggaaggctttggaattcatacatgggatgcgatgggagagacaaatgattttgtaggttggatttgagaacacaaatgaatttaagcaatgcttgtggacaacatttatttgtcgttagaaggaagcagtgtggttacagaggatgatgtttaatacataataatatgcaagccttctcttacacggtacttgcggatacacacaaaatgtacaaagtgggggcttttgaagcaatcctccgcaattatagtgactcaaaccttaaaatgcttttggtcattaactttgtactttttttggtatccaattatagcgactcaatcaatctgagactatccaacgcaattttagtatccaatgcacaacgacgtatgctttatctaccaaatcttatatgattttggaatgtttatcaaaatgcgttgattgcttatttatcttttctaaattctggccaatagttaaaattgtcacatcgtgttagtgaagagatctctctttgaaatgctcgaagttttgtttcgagcaagaaaaatattttttgtcgttgttatgggttctttgttttctactaaaatcccttcagacagaagaaaaaaacataaattaaatcccagcgaagcatatgtaataatgtaacaacaataaaatgtaataaaataaaaaagtaacaacaggctgtcaaaatgataaacaaataacaacggaggaagagtaaagtggggaagaagatcaatgggcccacacacaattcccaattctttgaccaatagttgacttttcttcctcgagtctttttaactcgcttcacctgttaccatctaccttcttacattattattacttactctcttaatcacttttgattaacaaaactaatttaccattgagggttttcttcttccttcttcttcatcctctttgctgctatgattgagctccatggatctgcaatcatagttcttcgatttaggattcgtttagatcgcggtttttgagctcggttggtgaagacatatgcttgaaaacgtactttaagctccaacttcgtctatttacaatattcctttattactttcatattcttctttcaaagtctttaagggttattttgcagtctttctatttgacttttgcgcttttattgaattgattttatatggtgacattttggacttggtcttctgttcaagattcctaggtcatctagcttcagtttttggtctatatttagaaactatgatttcgattgagatcttattggtcagattcacactttgtgtcagcaattctcagaaatatctaaagtggtgacttttgattgtttttgtgtgttgttgattctgggctctaattctctttctttgattttggtctggccaacagagaagtcttgtactgaagc

SEQ ID NO: 3234 - DNA, 1173 bp, Arabidopsis thaliana
tgccctgttttgagattctacacgagattttggaaatgagttaacaagttaggacgttgggccatttaggatcgtgtttcgagtttttttttggttgagagatatgaaatgagatgagaagtggtattgagtctttgcctatttatataggtgtgtcgtgtctgtttgcatattgtgaaaggactttttaaaatcgtgtttaggtcattcgtatactcaaaacaatagttagtgtgtgaacttcaagattaaaaaaaggtgattgtgacgatcaacattcatgaactagcttttaaagcaaagtagtaattagggttaattttctagttagtataaagtaatgtactgtaatgaagagtatttattcgaggaagactaagtagttcttaattaacttttactgagtagtaacatttaatggtttgaatagtactaattaatataggtaaagaattacatggacaggcaagaatataaacgagattatgactgtatctccgtcatcaagactcatgctgactcatgaaccatttctcaaaacaaaattgcttttaaaagtaagtaaggttagtttttttttttttttttaaattctatactaaagaatggttaaaaaaataaaattcaatagtcttgattagtcataaattcatggtatgaaaattgggaatcttattcttaaaaagttataattaaattcattgagtttgtgtgagattgtgacaatataaaaatatcaaataatactctaagtccatgctatatatatattttctctttgtgtttaaaattgaatcttgttcagaaatgagcactttgggtagatcattttgaacttaaatgtatgatatatatttgttcgaaaaatatggattccagttaattttttgagtgaatatggattgaaacgttttaagaaggatgattgtgttactctaatttttgtaacaataaacgttattatatttttacagttactccccataactttgtaaaaagtaaagaaaagccccaaacagagagaaacgaccacgtaagagtggtttggatcactaaactcgaatcgtcatcttcatcgatcgatatgcgacacatcatcttcatcgtcatgttctgtcttgcaaagttcaaacctttttacaaatcagacaaaacccaacaattaatgaaaca

SEQ ID NO: 3235 - DNA, 2000 bp, Arabidopsis thaliana
gacttttgtaaatttttgaaatccctttaaaatctattgtaaattacccttttaaaatcccttgtaaatcttataaaacccctataaaatcccttgtaaatcttttaaaactcttttaaaatcccttgtaaatctatttcccgccaaaaaaaaaaaattggcgggaaaaatatgtttgaaaacaaattttggcgggaaatttattttggaatatttttggcgaaaaaatattaatttttcattttgttaacctaaaacaatttccaaataagggtaaaatggtcattaaaaatttaaagagggtagaaataaaattggataaaacaaaagggtaaagttgaaaaagggcatcatgaaaagggcattagaaaaaaaaattcttaaagggataataattaatatattaaactattaagttgattaactgattttttttgtgttaatatattatcaaaacaaaacttgtttttttttttttttttttttcatccaaaacaaaacttgttttatttattgatttttgtaaataactgtttttcttagcttttattacttcttatgttggatgttcgtgtttggtctgagaattacctccttaagcacaagttgttcctttataaatgagctccatttaggcataatgatgtgaaccctttagtttttgttggtgtagactcaaattagagagaggagtcgctgagattgataagctagcaaacagaatcttccatatcgacaagcttgggaatcaacctgaattgtgatagaagagagaaaacattttctaggaaactaaattgtctcttttgaatttgaaatactttatttggagcttgtttgcttagcgcatatctcgaatttgattatatctcgcaagataattatgtgacgtttttgaattatgtaaacatctcaataagtgatataggaaaatttaacttacaaacagaaaaataagcgattttttcaatacattctaatagttgaatacattaattagaattaggagggatacaataatagataactacaattcattcgtcatgttctaaaaatagagagcaataagtacgacggacagtaccgtcactacttggcgtcatggtagataggtagtggatctgctagatatatgagaacggaaagaaccagaagctattagaggcgggaggagatatgtggggatgatttcagtgcaattccacgacgcaccatttccactttcgtaacacctaaacgaccgcttcggccgtataaaatcgcaaatgtttggtctcagtgtatttttccaatttccaaatacatcaattcaaattatataatatctagtggcaattataagtatatcatatattttcaaaattaattaaaaagattactaaattatgtttgactacaactattataatagttaaaaacataaacaaaaacaaagaaactattttaataaaaaaatcaagtaaacattaaaacataagcaaaaaataatgttaaagaaattattaattattaatttactaataattaatacctctataaattaattgttagaggtttaacgtaatttataaggaaaactaaagaagactttaacccataaagaaaaaaacaaagactgaattgaaggcccatatttagaagaagagaaagaagacccaaatatgatataaaatccagcccatttatatatttttattttgtttctggaaggaaaataagaaaatggcaaaaacgaaataatctgaaaaagtaaggtcttttaccaaaaaggatattttttttataaacagagcataaagttttcacttttcttctgctcctttctcgtctctgtcttcttcgtcctcattcgttttaaagcatcaaaatttcatcaacccaaaatagattaaaaaaatctgtagctttcgcatgtaaatctctctttgaaggttcctaactcgttaatcgtaactcacagtgactcgttcgagtcaaagtctctgtctttagctcaaacc

SEQ ID NO: 3236 - DNA, 410 bp, Arabidopsis thaliana
tttctgcccgtaaaattcaaagacgagagctaaaagcgatctcaatcgattaaaattaaataacagagagaccacgagagcagagaagacgcaagaagaagagtgaagaaaggtgtcgtagtcggatcactgagacgtggcggctccagagagtacttctccgcaattagctgacgacggcgggagagtgaggaagaagatattaatgggcctgttacgatattaatgggcctttagtagtaaacaagaatacggaacgatgttaaacactctattgtttccaactactaaaaacgacgcgagtttctattttataactaaaaaacgagaatcaaagtctctgtttcaaatttgggtcttttgcttcttcttgctcacttgaggaaacacagtaaaaacctaaaaagaga

SEQ ID NO: 3237 - DNA, 2000 bp, Arabidopsis thaliana
atcactgacctataccttattgaccaatcccaatcgttagtacaatgccgtccaagaaagagagcttgcaatcgcatgttttagatgtatgctattaaccctaaatcctcaatttctcgatctcaatcttgctatgtggtgggtgatacatcaatggtaattgatatattattcttttatatatttgtggttttgttaaagaaggtatcaaatctgatgctctgaaaaagtgtgatttttttactggattttagtctatgtaagtatgtattatggacagagtttaaacttgaatccgaaccatttaagaccggaaaaatttcatgctattctcaaactaaaagaaacgattaaccataattagatctattaaaagtggatacatcaatcaaataataatatgggctgtgataatatagttgtatcaatactcgggacaaaaatgcaacacgctacaatggtagattcaattataccgtatgaatgaaaacattgcatgtgggctacttcttacgaagagacatgttcacttccaaaactagtactagtcaaatgattcgacataacctgaataccaaatgctatatcaaaaatggcaaatattcaactaataactaaaaagaacaatacttttaattttcttattaaaaaagttctagataataaccttttgagatttgattttcgaagatattaataacggcagattactaaatgcaaaattacaagaaaaaaatttatattatgtgattttctagtaaatgtcgattctaccgtagttgactacgtgttggcgatgaatcttctgagcgaattttcgggaaagtttgacaacatcatctatgtcatcaatcaccatcccccgcttcactgaggcatgatcaatgctctcatggtagcatacaaagtcaaacataagtcatactcatcacccacaattctacaacaatatgcttatcataggacattaaaatcaaggacgaggaaactacaagagctaaagacatcgcggacaaaaccatataagtagtggttaatacaacaaccgttcactcatacgattagcactataataacacctcggtcatatacactaatcaaaaataccaatccactaatcctagacctatgactcaaataccatctgcccatgtccaagtccaacatcccatcctctaatggcatacttggaccaatatccatcaagccaaattggtgcacacactcaatctcaaaacacaccaacgtacattcctaattaactcatgcaatcaacactatgtcaccccaaaacccaaaccaaacgacgtgaaaaaacatgtaacacacgaaccaaatcacattttactcttgttaacattaacgaatcaactacacctacaaaaatctaatgtaacaagcatgggttaaaaaaaacaatactgcagcgatcattactcttgttttggtcggaactaaaagttgatgtttcatttcatgtattgtattgtctcctttgaaaaccaaagcattgaccaaaagcagtacgtaccggcaaaaaaaaaaaaaaaaaaaaccggaaacttacttagccggtataccactgccaaaaaaggaccaacaacaatatgttaaaattttattataaagttattatacacatttatagttacagagagagaaaaacaactttattataaataatgatcatcctctaaaattgggtctgaaatgttccctcacacgtctccttctatcttcttctccactttaaaaaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgag

SEQ ID NO: 3238 - DNA, 1755 bp, Arabidopsis thaliana
tgtttcagatcagatccttccaaatgtgaaaattttgattctggttttaaggttttcggagatttggtgaaattggatgagcacggtggaaattaggcgcacgttagcttttccagtaaaattcgtctccagcgcacgttagcttttgtgaacgtcttttttttttggaagtttttttttccaacatcaaagaggccaatgatttaaaggtggaagtagtgatggtactacatatgtataaacatggagtgatgcaacaactcaagtataagaccatcatcgcgaagattaaagacctgaggaaattcactatattttgttcttctagagagctcgaacttaaaagatatattatactctatgtttactcgggggataacgtcaatatggtgtcaatgtagacatcaaagagtttgaagatcaagtacaagactcctcaattaagtatcttgttggatcactgaatattgttataccttctagttttctaggtaagagattgtttagtcgaatacagattttattgatgaagaaaagaaagtgattatgtattgtgggagatgcgaggatttcacggagaacatgatgtacattattggaaggcatggttgcagaaaattcgattattgtacaaaccaattgaaatattgtccctggtttctcttcagttattatgtctctggtttctcttcagttattatgttctaagtgattatgttccaagtttagttattttaaatccaccaatgtaacttttacccaccaacacttattttgtatcaacttgtttatgtcttgtgcatatagtagataagtgtagaagaatctaaaataagaccatacaaggattaggatccctcattcataaaacatctaaaatgttccaactcaatttggggttttacgtctgcgtttgcgtttgcgtttgcgtttgtgaacgcctttattcgattttggaaaagaaaaaatgttctgttctattttgttctctctgctagtcacagtcaaatgagtcagctaccttatattcgattttgagcgtccttaaattccttcactgtgagaaaaaacacagagaaagagagagaaacaatggaaacggaaggaagaagacgagaagtggttgtttcatctctccaattcgcttgctccgacgatatctccaccaatgtcgccgccgctgagcggttcgtctctctctcttcctccctccctctctctaattatcaatctctcccatcttcctcctccttcaaatttccatatgcgtataagcttctcgagcaatttattgtgatcacggacctttggaatcgaactattcaatttcaagctctgatatagattcccccgttcgaatccgatttcagtatctgagaatggaattgtttacattttacgcagattagtcagagaagctcacgctaaaggagctaatatcattcttattcaggtcattgttgctcttcgaaattgtttctcagatttataagtgtttttgattgatctagtatccaatcgtcttagctagtcttatgtagtttagtttctgtataacaggaactttttgaaggatattacttctgtcaagcacaaagagaagacttctttaagcgagccaagccttacaagaaccatcctaccattgcaaggtgtgacattgcttatccgatttctaacgcagtaaagtggaatctcgatgtatctatgtactatctagtgttttaatggttggatggtttaatttaacacagg

SEQ ID NO: 3239 - DNA, 536 bp, Arabidopsis thaliana
agagtgtagattactttcattttcacacagtgctatttcttttatgtagtttgttagttctccttgcttatggtcgggaatccaaaagtttggatcaaagggttaagaagagaataagtgttatgaatgtatcatataaataaaaatgttctatggaacgtttgatgttcttataagcaattcgaactgttttgttcttgacttagctggttttccctttcatatcttaatttcaccaatgcttagaaaaaacaactctgatcgaatgatttataaacaactctgctctttaatggtgatcattgtaaattcaaacttgtgtattgtttgtactaatttgttctgatagaaactattttgggttaaatgggaaacgggtcaaagcatagggggctagtgttgtaatttagtagattggggaggagtttcaaatctgaacgctgaagataaatcacaagggaggtgcttcgtcctcgaagcttttagaacttagccaagcagctgttgtttcttagttgactccctctccgacgaaa

SEQ ID NO: 3240 - DNA, 866 bp, Arabidopsis thaliana
ccttttttctcgcttctggtaagaccacacaatttcaacttcttttgcttaaaactgtacagaaaccaaaatccttattttgaagaatcttagcggagaaaaagtaacaaactctcaaaattttgatgggatgatgatgtgttgaaatttctctagtttctttcctctgggggaaaaacaaaggcaaataatatttgtattcaacatattgggtctaatatgtgaatctatccctcatttatccgacactatttgtctgtactttctacctttgcttcacccttcaacaatcttggcaatcgcaataacatgacttgctctgataccacttgtagtacatttagctttgattgttggagctctcgagttaaatcacaagggtatatatatctagtgtggtactttagaccgcaaatagagaatagaccgtaagtcaacgaacttacatgtattgtttatatattgatcagtgttaattacatgattaatctgagtttaagacgactaatcaaattaaaaagctactaaaaatatgaagcggtccgattggatttattaaaaaagaaaagaaaacgaaagactggtataataaaaccggaaaattcaggtgaaatcaacaaaccggtttcttttgtgatttgaatgaacttaaacccttgttgatatcaaaagaagaaaccctagtctctccgactctccgtagacgacgaagttatcttcttcaattcatcgtctcttctctgctctgctttgctctagatcacaaattaaaagacttcattagtcttcctgtctccaccattaccttcttcctttttaactcagccacgacgagcagactattgttctgttttccttgtataaaa

SEQ ID NO: 3241 - DNA, 952 bp, Arabidopsis thaliana
tgtaagtcagactatcacctgatcaaatcaacgaatccaaacaatgagtatcgaaattcgtaaaactcggaagaatcgagcagcttctatcttatgagctctcgcgtaaaccctaagtctctctggaatggctcgttagagaagaactatgcttttcttcaggaactgtagcaaaaaggttcaactgtaaaaaataaatactatcagataaaaaaaagtacttatacggaagaagattacccctcgatcaagaattccattgtgggctcagcccataataaattgggctattcattgggccatagtattctactatggtctctatataaaacaccttgtctttggcaaacatctctatatataatcaacactttaaaatttattttatttgggcgatatagccaatcacaaaataaaggactccaaaaacatctattttatcggatttacatttgatcaatttaaattcgaagcaactaattcgatcggatttaaattcgaacaacataataatagcaacatttatataaatacgttacatgtcttagtcgacatgttcttttatggtaaagttagcaatattagtcgaactcaaacatataccttcacataatgaaagaggaaataacatttaattgtttttataattaataatataaatgggagaatctgaattacttgagcgataataaaagaagaaaaggaaaagaaatggagaagggaagaggcaagatggcaaagctgtgatttaaaacaccgtcacctccccgtcaacggagacaaacaaagatcgtgttttctcgaaccttccacgagatatactaagccaaagaagaagaagagacctgagacgaacaagaaatccagaaattaccaattccttttttttgtttaatcgaattcaggaaaagtgaagaaacgaaagagagaagacaaagaagaagaaggtgag

SEQ ID NO: 3242 - DNA, 2000 bp, Arabidopsis thaliana
gaaaaacattaattcatatattaatgttttatattccgtgagaaaatttcaatgttttggaaaattagaacaaattagaacaaattctcgaaagataaattgaaggcattatgatattttcgtacgttctttttacggaaagttctttaacggcatccaaaacgctttcgtacgtggccgagtgctcgcggcgcaataatccttgagaatcataaggtatattccctggaatgtaccttttttgtttttcttataaaaaaactatctggtgcattttgtttttatggagtaatttatccaattaaagtccagtgtgggacactaaacattacaaattttatgtctttagcttagttatcatctgtttttttttaattagaaaagagtagttttctggtgtgagtgttatgtggaagacaaatatgtgacgtggattctaataatgtattgtcgtgatgtggttctttttgcattatttcgttttgattatgtaatagacatatatttaaatggtgcgattatgcaccgaagaaaaacattcgtctccatttttctttatacgaaatttgaccccaaaaaaaaggtaaaacacggcgtccgtgttattatgtagtatcatgtatgacagaaatggcaactacagtagatagtttggaccgaattttattttcacacaattaaatagttatttcaaggcagtaacaaattggtggaaaaaaaaaaaaaaaaggcagtaacaaatattaaaaccgaatattggctaaaattatacatttcaaaacaatattatgaaattgtttaacaaaacaaaatgtgaaaggaacatagaagtaattaatgtactcagattacgatcccatagaacttaaataaaggtgcgtttatgaatgccagatgactcagattagtgattgttcttcccacttagcagagtaattgctctttgtcctttggaatctctctctctctttttatttctctgtgtttcgcttggaatctatattttcgctatttcctggaatgatgatatatatgtatgttagtatgtagtagtcaatatttttgtatattgtgaataagtgactttttcaaggtaaatataggtcagaaacttcaaattcaaaatattaaatattataatattggtgaaaatatatagtcaaaaaatgattttaggttcggttgataatttattcaatgagagtgatttacccgaataagatgattgtgtgtgagcaaaaagattccacaatgatgccaatttaagcttcaacaagtgctttcctattaacaagaacaatttatgtaatatcatttttttcgtttgttttgcaaaactgcaaagtcattttattttgtttactttaataatccttgaaaatgttataacagttatttcctcaaattagaccatcatactattattattgttattatcaaccgttgataaaaatggtagtagcatgtacaactaagatagaccgttacaaaattcgtgtattgttaattattatatagtttccgtatgttgctgttttcagctcaacttgagtaaatataaaatattaaactgtttattctaatattggattcttttgtgtagtggcaacttatttttttctaagctttttttttttacagattacggatttcagtatgaaattgtagatccaatcaactattttcacatatgctaaaaggtatctaaaaagtaaaaacacttaacagattataaacaaaaaagcttttaagataaatgtcacaaattctttaaaaataaacaaataaacagctattgacaaacaaaaaataaaaataaaaaaggagtccttgctgggtccatctcctttgcgttctttttcgtctgttgaattttgaacagagtcacaagtctctctccatataaacctccccaaggtcgacgctacgtaacgaccatctccattactcgactctcctcacctaaagattcaaccttttctctgtttcccaattcagag

SEQ ID NO: 3243 - DNA, 779 bp, Arabidopsis thaliana
taataatatgatgcttttggtttgaacttgcaatctgattctgaaaaaagcttgtgtgatgttgttgtgtaggatggtggtatggtcttgttcgccacttggaatcctgtgatggagatcataaccattgccattgccatcttagtggtgagttctcatcttcatcttcatcttctgtggttaaaaaatggagtcttggttggttgttttaaaattggctgtcatattctatgcattactcattgtctcagctcataaagtccattaaattcccaaaacatagttgaaaagggtgaacattgaagagagccaattcaagcaatgccttttcttgttaagattggtcccaaaacgacaaatgatgatgataatgtgatgatatgtcttgattttccttgacattttgataaatgtgtgtcttcagttgatgttgaaacctccacttatgtcctcatcgttggaatttgcattactaatgggtgtggggctcaacaatgattctgtctctttatcactccaaaaaaatctcttatttttatcattttgctggcacattgcatgaccacataaaagtagaaatcacatcgaaatagataatttttgggatttctctctgcccacttgcatcttgatttaacctttgtctactgataatgtgttaaacgagtttttgcattcacatgttgtactaaattgtcaagtgttgatgaatggtaaaaacagagacggtagtgttggaattcaaccagtacacagtcggatcaaggtggagaagaacg

SEQ ID NO: 3244 - DNA, 1672 bp, Arabidopsis thaliana
atgttattacgatgatttgtgcttagttgacagaatgagtcatatatcttgtgaaaattgggatagtcaaaactcttttgtcaaattaacggataatagttaatagtggtgtttaatctgagtatttgtttgagtttctgatttatgaatctagtatatgtcaattggtacaatcaaagaaccacattatatatcactcacaccatttttttaaaagattgaatcaagaacacacattgttaagagaacacttaaacaaaactagtggctctcctctctttctcttaatatgtgttcggtcttaacacgtgataggtagagagtattaattagacagggtatatactagttaattggagatactttcaaccaatccgctgtagcacacatgtttatttcaatgatgaaatctgggttcaaacccggcagcggaatagtttttttctttcattttggtaaaggaccgatccaaatataccttaacaagttgactttgcaagaaaaaaccattggagaagagcagagttttgatctttgatgagctttgtgttgaatgcgattcatgaaggaatttcttggctgcaagtttctttcatcaagatttgtgcgtctagttatggtatgaagctaataccaatattttgcatatcattttgtagttgaaagaaatcttataacagaaattttgagttcattcttcaagatttagataagtcttcaacttgttgagaattctatgacaaacactcatggtattcactttggagattaaatcaagaacacacgttttacgagtttttcgagatcgatatgatcctagtacatttcagcaagaacaacaccttgtaatttaccatcagtggagtttttgagttatagaaaaaaaggagaaaacaaaaagactagatatacaagagctttggagctcaagggctttataacaatatggttttcagttagaataataatcgtcacctccttacaacgacattgcttcattctagctaaagcacacatccttacgttgtcctgtaaaaatgcttcaaaccagaacattccaacaaaaatagagtctcgtctcttcttacggttagtacacagtaattgtttctattaattcaatggagttatgttcaacatatccactataccacatttggattcaaacccttatagtagaatatgttttttttttttttccaagtgcattcaacttgtccaaataataataatgtaaaaaaacaatttttaaattttttaaaatatatggatagtaaaaaaagagatctgagaatttacctttttttatggtagctgaaaagtaaaagtaaaatatactccatagttatactaattattttcgatatccattgtaatttagtacatataaccggtccggttgactcacttggttcaaaaggaaaaatcaaaaatccacaatccgtgactaacataataacccaatctacaaccgtcgattcattaataatcaaggatccatatatctcataaacctttctcacggatcgttatctttgaccgtccgatcaaacaataaaacgaacggtcacgattcattttctaacccaaacaatcttctttataaataaaaaataaattcttctctactcatcagaaaactcaaatcttaaaactttctggaaaaacaaaa

SEQ ID NO: 3245 - DNA, 746 bp, Arabidopsis thaliana
tgtacatgtctacatgattacatctaatttcagtttttgatatagaaccttggttagtgctttcagacattttaagctgcttgatgattttttttaaagtttgatgcaattaaccagtatatatgttttgtctacgccgcagaggcttaatcatattgtttctcttctacgtattcaattgaagagtcaaagactcaagaggcacaaagttatgtatatggaaggcactaaatcttcaggtactattatttagttttcggcatgttatcaaacttctcacgacttggtaatggagtcatcaatgacaatatgtattagtgtactcaacttttgattctgaattttgattagttaaaaatattctgttcttttctcactgagaattttggagtattcaaatcaaagtttccatactttggagatagaatgttgcaagacacagactaaatcatatatttacataaacatttgttcccttataaatatacagaattcaacatttcttttcagagaaaaataatgaacgtcagaataaatattcagtgatattaatttcgtgatattaaataatttaatcacctgttgggctatctgggccgaacaattgtgggccttgagaaactctattaacttttccgtttttaatccaatctgtccaagacgggcgggtcaaatatcttttgacacctctaaaaattgttcacggggaaagcaaacagaagaacgtaaaccagtcaagtctgtaa

SEQ ID NO: 3246 - DNA, 2000 bp, Arabidopsis thaliana
aacggctgtacatgttctacattcaccttgattatgttgttgctgatgttactttaatatgtttcttgttatttattaggacgagcacagctgttgctccagtggctggttctccaaagttgccatctgaaataactggcaaaactgttgaggaggtagatagatcttttccctcttctacatttatccttttagccatgttatatatataatattcaaaaatgctggttatttgtagattatcaaggagtggaatactgagctacaagagcgcacagggagattccggaaacaggcaaatgcaatagcagagtgggataagcggatcttgcaaaaccgtgatgttcttttgagacttgaggtgaaaaaactttgtcatattatggagtctctgttaaaatttctttccgttatgaatctttcttcagagacattgttctgagctgacctctgagtttgtatgtttagctcatacaggcctctactctataattagctcattctttttgtgtacttgaccaacaaacagattgaagttgcaaaagtggttgaaacccaatctagcttggaacgacagctggaattaatcgagactcatcagcaagaggtatgcaataaaactattacatctctatgttaatctttaaatgaggtttctgattgtaacttgcagcgggaaatcatgtgtgccttatctgtgggaaatcaatatatctcttgttcatcatctctctcagtcgcactctttttttatctgacatggagattgtctaccttctacctcgcttaattcgaaattgggcaagtcaaataccaaagccactgtgctaatcatttggattctctgtttctgtttaaggttgacaaggctttgcaaagcatggaggaagaggctgagcgtatatataatgacgagcggaaatcacttctggacgatgaagcagcatcaactagagatgcaatgtgagaactatttgcatcattacctttctgcttcatattattctgatgaataatgaaagaaaacccacagacacggaaacaaatatgatttgatctatgcttagaagaattagctctatcatgcgcatcccatcctgattctatgctttcttacaatatactttgttttttcatcccaggtatgaacagtctgagctagtagaaagagaactggagcatatgactgaacaaatcagatcgattatacaatccgtaaatgcaaaccaggtaacgcagtaacttatcatatactattcgtttgcttttgctgggaacatacatcataaacatgtttgtgtggaaacagggtggagaacttgaagcgatagatgggatgagtccacttgatgtagttgtcagaatcttgaacaatcaactcagttccttaatgtggattgatgagaaagtaagttttttaaatttgtcttctacgcattgttacaataactacaattgtgttttaacttgcaacatttatttgaacattgaacaggcagaggaattctcttctcggattcaaaaaatcgcattgcaaggttcgggtggagatcgtgaattgatggctccaaagcactggatgtcttgataagaattacaaaaaccacataatctcaggaaatggattatcttcttgtagttttcgtgttattttttctatgaaaaagaagagaggtctgattttaccataaatatttgtatcattgaacactattgattgactggtagtttgttgttgttatcccaagtttcttctaattactttttcatcacaatgtacaccgcctaaagagggtaaaacgacgacgtggcgtctatctttcggatttgttttcttaatcatgagaagactttctcacatggatatagacgagtcacgacgactcacgcgtatcgaaacaaaacgttgttgttagagagaaaattccagttcttggattccggcgacctcattggtgaaagatcttcagagattattatatttctcttgaccggtttcg

SEQ ID NO: 3247 - DNA, 2000 bp, Arabidopsis thaliana
ctgaacttgctttcaaatttgttaagattctcatagtttttttttacttcaaacctttccaaagccttaaggaattgatgcataagatcatggacctttttgtcagcataagtgcacattgcatttaaaattatgaggttgattagtgtcctccattattcggtgatggttgatgatatatggtagtgaatgacgatatactagtctgttggtgatatggtatcgatcgatctgatccattagctaaacagaaggatttatttcaccaacattaatgacctgcatattttctacaaagctataccgttcacgtcaacaccatgtcacaagataaacatagttttttgtttgttagttactaataattgaaaggatgtcgttgaatagtcttctgagttcttaattacgtttcaatacaaaagccatgtatcttcactagttttgatattctattattctgagttcttaattatgtttcaatacaatttgttcaatgtataggtattctaaaaaactagaacaccacgtacatgaaatctaaccagtctagtgtcagtatcaacaactttgttttcgttcacctaatatgctcatgttaaacaattggagattctaattgcaaatcaagataatcattatctaaaaaaaccaagaattttgaaatatatgttatattattgttatagtcagttgtgtttttatctttctgttatataaaaaataggtgacatttgtccatatgcgttgctactgatgtttactaactatatgatatcgagttgaataagtattccaataactttgtttttaagtttcgaagctaagatatatatctatagaggaataactaaccggagcattgactacctaattctgctcatggttgtgcacctgccccggcccacccccacaaattgctacctaagttcgttagtgtatataacttacgaaattaaaaataaaatagcttcatctatattatataatttgttatactttttttataatttaggggaaaaacccccaaaaaaaaccatcgtctaatttaaatttgtccatttaataccaatttattgaactctcacataaccacctgactacgacaatatattcgtaacaattaaaaaagaaattgtatatatagtaaacaccatatggttaagttttaactacagctagtgattccgttacggtcgttaattcagatatctaattttgccaaaatttaaaaaacaaaagtttttaaaagacataaaaattaacttagatattttcggacaaatttcataattcagatattaaacggggaaatttaaattagaccgtgttttttgggttttttcctaatcatttataagtgattttttctgtcttgttatttcttatattattagtttattacatgcataataaaattattcatgacaatataaacacttggatagcaaatactttcatgaaatactcaagtctcaacaactgacaattctcctaacaattataagtatccacgagagactttttacctagatcacgttcttgatagatagctttattctaatttagtgatcattactgaaatttgctacatatttaaatattttaatatatatagaaattatagtatattattttttaaagacatttttttattttatattaccaaaatttgaattttcaaaaaaaatccttataaggagatatataatgagaattaagaaaagttgaccaaaaaataaattaataaccatataaatgtatattatataaaagtttctttcaaagaaaaaaacaaaaacaataatatatagaagttgtgcaggtaaagagatgtacaacactttttattaaaggtcaagtaacaactcaaacaagtgaaaaaaaaagaaaacaatttcactttttttggaatgtgtgtctctcttccatttccatatattatataaacaccaaatgagatctcatttttctaataaataagaagaaagaagagagaaaca

SEQ ID NO: 3248 - DNA, 845 bp, Arabidopsis thaliana
ctcgagaagcagagcagagagaaagagattccgagagagagagagaaggagggagagaaggagcttagtggtctcattaccattaccagctccatacgaaccgaaacgacgccgttcgctcaacccttttctctgcaatctctcttcctcccacgagtttctcagcttttctcggatcatctaattaagagaggagatcttgtctcacggtgggattgatttttctcttcacgaagatcgtgttccagggtaaagttttgatttttattcatcttactcattttggttaaagtagcttctgttctcagcgattttctctgtctcgtgtttatgtttattgtagttcaggaaatgttcttactgttctgtttgattatatgattattgcaccaaatctggctagaaaaagtcaatacctttttcccttctttctagaatttgggaacactgtttactagatttttgtctttgttccaaaagtttgttcattcatgtcatttacgggttataactgcaccaccattgctatggaacgcataacctacctagaaaatcttccttgcttttcaaaataaagaaagggagaagatttgattcttttatgaactctgagctgtcctgaagagaacccaatatttgagcttatctgtttacatttaaagaggaagtgacaatagaaacgctggtccatcgtgatttgtcttacttgtttagctcttgtcttgtctttactacatggtgcctttttctggcatttaccatccacaaaatcatgatttgtgtctaaatcttagattttgtctttttttttgtgtgtgtgtatgtacagcaattaactgcagaaa

SEQ ID NO: 3249 - DNA, 2000 bp, Arabidopsis thaliana
taccctcatttcaaatgcacacatatttttatttcccttaaaggggttggagattttatcaaagcctttttttaaaaatatacatttcaaaaattgcaatataaaaataaaaattatcaaaagataaatgagatgattgaaaagttgtatatattttactaacctgtatcaaatatttgcgatgcaagaactggtgtcttaggtgaagcaaactacaagggatctgattggggaggatgcaagtatgaaattttattttctaaatctagtgcaaagaggaaaaatttctttattatccaaagaattattttttcaattaaatctttttcattacataataaagaaaaaagctgtatattctatttcgtcatagtcattcgtatttatagaaaatataaaccgcgtgacaattcttatgtcaaagttgtgtatttgtttctatgataatactatgatcatttcatcattattttggtataaataaattgtatctaattttttttcaaactttgttaatttcataaataatagaataagtgcgaccagaaaacataaatgaatcaagtaattggataaaactataaaaattttatagaaaatataaaacgcgtgacaattctcatgtcaaagttgcatatttgtttctatggtagtattcttatgatcatttcttcattattttggtaaacaaattgtatctaaaagatagttaaaaatttattaatttcataaataataaaataaatgcgatcagaagacatgaataaattaagtaattgaataaaaattggaaaatagtgttgacagtttttgtttgtgagtcttattcaacgcataaaatatacaataaagaaagttaggaacttatttattttagatcctttttttaggtaattttaaaacttcaaagtaaattatgactcaaataattatttatcaagtaaaaggttattggtaaacattttgttataaaactttagagcatctttatccatatagtttttcaaatagtaaagaaattcactatcaactttttcccaactgtaaaagattcatgtacaggaccatcaattaatggagattctttcagttcttcactgtttcaatctttaactaatcgtcgtgatgaatacaaaatagatacattcagaaaagcaaacacaaatgacggaaacaaattgaaaacaaatacatttaaaagttgcatatttcgttgattgttgattaacattgcttgtcttatcgtactaactacaagtttacaacatcggagtggtttttaattgcttaagatctctaaaacgatttcaataatggtagactgatcttcatttcgatttcatgataacaccgaatgttaggctttatatcctctaaatatcgacatgcattgtgaattgagaccgtaccccgactaatcttgtgacttaatggtcataatggtcgtacaccaattattcacaccggttaacagtaaccggaaccacaatatggaattgaaaagcaattcaactcaaattccagatctttttcttttgtcaaaattgtacaactttctgtttatacattgtgccaaaaataaaataaaaaacaacgaattatagtttgacacgtgtaaatcagaagacaagtcttatgaactttgccatattccggtgacttgctccaaagtctcatatgcgtttaccgatcttctcgattctccaattccaaaccctaacattttgattagtccttctgggtttccacagccttgaggtttgatttttttattttcgatctttcttgattcatttttgttttcggtagcgagaaaatatctgaatcggaaaaaacatatgaatctgagttttgttctttggtttgaaagttcttcaaatataatttagctgacaaactatagatgaggatgaaaaaatccttcctttttgatttttaatcattttgctgatcaattgttccgacctgtgttcttcaaaaaaaacagagattcggaacca

SEQ ID NO: 3250 - DNA, 2000 bp, Arabidopsis thaliana
ctaatcttattgctaataacttttgtgtatttataaggaggagacccactcttatagttttacattaatgacttctatgatcagtttagataaatatttttcctcaaccggactaaatgtattcttctatatatatataattaggataaacattttatgtaagaaatctaaatattgtttagttgaatgtaagaaagttttttggtgtaaatgttaagaaatgaatgtaagaaagttttcttccctattcatttttttgtcttaactttggtgatttcatgatatttatttcatttaagaataggaaatcgcttgtgaaattggaagcaaattaagaaaatacatgatagagcttttaaaagtgtggatgacctttcaatacatatttgcttggaggcgatggtgaaaaactgaaaatgacatcagatacacgcttgtgaaccatctttaaagtattgatggactcttcactatgaaagctctctttaaaattaattttctttgtacatgtctctaagcaatgtcaaattaattagaggtccaaattcaaaaaaatgtcgtattgaatcattccattactaaattggttcaatgtcagatttaaacagcctagggataatttagtgagatatgagattctactttcaacatatactaatcctaaatctctagcaactttttatataagctataaatatcatgaaaatgtattttaatcgtttcataatttatgcagtcacactaatggaaaaaaggccaattattattattttcttcagactataaatgaaaacataaattaaaatgcagattagtttaaaattttaataagtaagtaaaatgcttatagccttatacaaaatcatatttggaagtttctaacattgttgcaatttgttatcacaaatcacagtaatatttgtatactaattagtaattacaactatacacaaatttaaatgggtaatcatatatttgtgtccagtggattgaacaaatatgctcggcccatgcggaagtaatgccaattttgggtgagtaaagcccatgcgaaattttcacataagaaatgcatgctttttgttttcaacgacatgagttgcatgctttttatcattgcttatatagttgcaagtttgcaactccttgatattttttttatgtagacactactaccaccaaaaacttttggtctgcttattcttgtttactatgtaaaaaaaataaatgaattgtttatttactccgatttgatggagtctggtttatgaggttttatagcctttacagaaaattgatagttacaaaaatatttttcaaaaataaaagggtaaaaccgtcatttcaagttgttattgttttgggggactggatttgaaatgaaatatagaaccggaaaacaaggtgagccgaagtcgaagcctttggacccgtttttatatttactcctcccattcccttctccttcaatccttccttcctcctcctcccttcttcttcttcccctctttcattttccagccactacaaacttttctatctctactttttttcctctcgatttcaggtactttttgagaccctttgttgtgattttcgaacacacaccccaattacgtttgatttttgatcccgcatcgatttcaattcatccgtttctgagtttcttttggatctgggtgtcttgagctaatcttttcgatctgttgtttatcgattttactcatgcgtatgttcattacaccatttgttatttgtttaatcaaccaaaagactcatgtttttcaaatgtctttaatataatttttctgattgaattttataatatttacatgattctggatccagaatatccttcttcttcttccattttgtcctgtattgatttgtctttgaaaaaggattgttctttgtatctgtattggtgaaaaaggattgttatttgttgataaaaatttgatctttaaacaatgtttggttttgcataaaggtagaagaaa

SEQ ID NO: 3251 - DNA, 2000 bp, Arabidopsis thaliana
acatattaatcaatttgatatttgtttaatggtctgattagtgacaattataagtctaatattgcgaatcttttgcagtgagtattccacgtgatatagataagtttcccttaatggataacctttgcatcaaacaattagaaaacaaatggaagagtatcaatcaagtagatctcgaagcagtggaccctaacacgatactggaacatggaccaaaccttaaaatatcgtccaaattgcttattttctggaaggttacaagtgcacaacactctaataatatatgccccgcataacaatttttaaaactatttcatcttagacctcggatattttgaaggaagcacattttcttgaaaatcactaggtgacttgtgtttctttctttggagcatgtcaatttactcccatcagctggagagccaaaagttaaaattaatgttcgaaatttatttcataaaagctacgtacgttgcatccttccatgatctagaaaaaatgggggacaataaccaaatttattcactcttgtcaggtcatggggagtagtctacgaccttgaaagtcacgtgacaagtaatatatactgtaccgtccaaatattttcttactgtaatgtcttatgtttcatatcgctagacccttaatattagtgtggactaattcatataattgcaaataaaatagtatgattctacgattcttcaaaatgatctaatagttacagtctggtcaaaatgatctaaatctttataaacaaataacagctacggaataattaacacaatttttggtgataaactttgagttatgatagaaattttttttttttcaatttttaatgtgtatcttaatttcttcaattaatgtatccctatgttttatgtgactatataacttttggttagtgatactccaaaaatgttgttttaggttttgacacacatattaataatttgttttattttttactttacaaaatttcttattggttaaaacataaatcactgcaaataaaactttaattttgtttgtagtcaaaattagcttttaaaaatgtaaattgatatttattctaattatttttttaatgttctgacaattaatttaaaacggaaagcgtaataaagtagatgttggggctgattggtaacggctgttacttttgaactctaaatatttcggatgttacgactttgactgtaaaaattttggttgtaaaaattttgacgatagaaactttaactgttaaagtctgattggtacaaaaaaatcacaattatttttattattatttaatattttttataaatattatttatgctaaaaaatcaatttatttggtaaaatagtaactaaaataaatttattttaaaaaaatacaaaattcattttacaaattcactattttaaatatttaaattggatctgaaaagaacagaaaaaataaaattcgaattaatcaatcgattttttaatgataaaatataaataaatttgaaaagagttttgaaattttatggataaagaaaaaatatttttattttgttttattattctcttttaaagttaaagactttaggaaaaaaacaaaagaaaaaaagtaaatggagagaaaaaagcttttaaaactttaaaaattaataaagttttaaaagtgtgattgattaaaaaataaatttgaaaatttttaaatatttttaaagctttgaaaacattttttttttttttggggggacaaatatgaagaaaaaaaaaaaaaaaaaaagacgaacatgaaggggaaaaaaacaaaagacgaacaaaaattggagattttttcttacacgtgtcatcatctgcagatttgcgcttattaattgtttaccgtacggtattgtggatagggtcaagattttcataactttaccgtagttaatatttgacccaaccatggttaaaataaagcagtttatatcacagacacacacctctctctcttctagactcactaaacaaaa

SEQ ID NO: 3252 - DNA, 805 bp, Arabidopsis thaliana
acgaacctcatgatcattgcctctagtagctcttgccccccgcaatttgtgataggattatgtttggggaaatcgtttgtggagcctctctgagtctgtgactatataatgtatatagggcttataatatatagacaatgttgaagaatagcatgttcttgttggttatagagactagacatgaagtatactgatagatagattaatcaattcgaaacaatttttctttgtgtgataatttcgatgtgtaattgaatgtatacatgagtaaaacaaatataggggtgtatgcttatttgtatattccttgttgaagaaaaccttgttatcttcaaacatgaaaccgagaaacataagtaaagattttactgtttgttatatgtgtttattgtatttgatcaaacaatatttgaaatattgaaaactttctataaatatcaaacgttagtttggcattctgcgttagcgttttgttgtagtggtgattttgggagtgtttaaaaaccaaaagctaaagaacgaagaatcactgaattaaccggtttgtttccggttaaaatgtggattaaaacttttcggtcaaagaaaaccgggaaaaagaagtagtaaatgggaaagtctctaagtcgttggtcaacgtcgtgaacatgtgcttgactaatattaattaatggctgttttatttccaaattccaatttctggctgaaaagtacatgaattatgcttaaaactgtgttttacttaatatataatgacgaggaaacaacaaaaaggaagaagcgaagaacgaagtagacgaagacg

SEQ ID NO: 3253 - DNA, 2000 bp, Arabidopsis thaliana
tccatgagagtttcttcttcatgtctcaggtgaggaggttggcgaaaggaaggttaggaaaagtgaagataaatttgattttgttacaaaagtcaaaaacatttgcctatataacttaaatatggagcccattatcattattcgtagttagtagagcttgttcacgtttatgttacgatcttgtattgatagaagaatgttttcacttgtcttcgactgaatcagtgttgccttctctcaggttatatctttcgtctatgctttcgtcaaagcaaaaaatccctaaattagatgaattttatgccttgactcaaggcataaattcatcaaatgtggtatatagagcgtatttagcttcatatatactattgagtttccagagtcgtacgagcgctatcaagtatcagaagcgaataaaaataaaatatccttacgaaaaaaaaaatcgtctacaaaaaataaacatcattgtcatgtaagaaaaagaaaattgacaaactaaatattagttcttaaacagttgttgacccttcctctccactaaatcgttaaccaagctttcaaaatcaatgtctctaaccaattctctttcgattgataatatagccaactcactcaatctttcttgtgacatagtcgaccgaagatacgatttgatcaacttcagctttgaaaaacttctttaagcagatgcaaccgaaactggaatcgtcaacattgttcctataaagcaatggtaccttcaatatgagacaaaaattatatattaaatctgctttgaaagcaaagtgaaatttttgtctccaattataaagtaacataactattctaatgagcttttgctatttggatctaatgttatcatattattacctctacaacgttcatccttttctagcgcttgttgttgttcatcttttgcatgcggatcatatatgcgtgtaatctggtcgttgtcaaatttttattaattagcatttcaagccattgccattgtcaacgaatattcagtatttattagaaaaatcaacagaaatttaatatctatttagttttgttgaaatttaaagatataaatcaatatttactataaatttaattttagtaatatttttccgatttagattttgttattcccgtttttttatattgatcagttttagcgttttttagcggtgaacagtagactcaactcggattggactagacgggcgatcccggtagaacaggtccgaacgcccggtctggttcccaaacactgcaattaccgcatcttgtgttgtggaccggaccgactatgactgaatattgcattcattttgatcctaaaaatgtcaatcaatgctcatttatttattatatattttggaaaaaagtgagaaaaaactgaaacggtgcgacgttattaaatcttttaaatccccccaccaaagcatctgcttcttcctcttgtctctctctctctctctctctctttcatcttcaaactctacaaacccagaaaccaccacacagtaattaatgtctctttctttcttcccatgtgatctttaacagacttttcttcttattctccatctctgaagttgtggggattcatcaagacttccttatctgtttcttttataaaacaagagagagataccacttttggtgttctttatttgcaactctttcaggcaaacactctttgtctcttttcttatcttattattgtttctattttttgttgataatactttcgattttttttggctctctgttctttctagatcgtttggttttattgtctataatattcattttgacaatctatgtattgatatgagaacattacttcttagtctctttagtttttttttttgtttttgacccttaagcttgatttgttgtttttagcttctggtgatttgtttgatcaaagaaagcttataagtttttttttctttttcaggttaaagaaatcgataggctctgttcttgattgtggtggaagagac

SEQ ID NO: 3254 - DNA, 2000 bp, Arabidopsis thaliana
tacataagatgtccagaactgatcggttacatacttgtaccgatcattataaaaaatgtttcttagtttaggattccgactcattgcatataaattcttaacactttgtaatcgtataggcagattgttttgtttttttttctgtgattatctagtttttctatataaaattttataaacaaaatgatcgtttgaagaattagagcatatttgtcatttgttattttgactaatccatctccattcaaattgtccaattatgtttagtcaaatgagtttgaaaattttgcctaatttaatcatccaaatgagcaaaagaataaagccacacattacttactaataatattaaagcccacattaaaataatttctcacgtaaaaaacaaatacttacacaaacctatataatctagactctacttcacttgtttgccctaaaccatctatcatctctctttcaattcatctacaccttatttttatatttctcaaatacttttcgagaaaattatataccctttttaatatacgacgaatgaaatcgcaggaagataatcttctacttgttcttctactcgaggggataaaaaattacggacttaagagatgggataagatactagcatcacttcttctatcccagcgaagtatcgctaaatgtaaaaaaaaattctaatctttcgttaaacgaaaggtaaattattttctcgaaaaaatttgtgtatagaattaaaggttttctttagtcaatagctaatcaatcttatcatttattttctactagtttcttatttgcacaatacatttgagaaaattatgttatgttttcaagagttttgggtttttgtagagtattagataaaatcaatattttctctcttgagactagtttcttctttgcaccatacatttgtgttctttttcattttctcaaagctgtttgttttaccgaattttctcttgggttgtggagaatattttttttttttagtttttataacaccttatcttatataaaaacaaaagagtttgtttttacaagggatgatggatgatgaatctatagatggtcgtagtaccacactctctatggactcaagttgtggagaatctttttttttttagtttttataacaccttatttgatatagaaacaaatgattttgttcttacaagagatgatggatgatgaatctatagatggtcgtaccacattctctatgcaccctatgaatcaagttgtggaatcaatcaaagttggccacatatagttatgaaatgattttgtgataaaaacacaaattaatttctatgtgaatcacaaagaaaatatatatatatatatataattcccatttgaagtttaagcacagaccttagaaaaatatgtaaacaaagccgatgtctatagtccaataaaaacaaatttcgccgggaaaaggaatataaaaaatttgtcacatttaccaaaaaataataggagagtttatatagtttcaacgtacaattaatgatctaggttatcgagttttaatttccatttctcctaattttgctgacttgagctacatattattgagcattcttgttctttcagggtttatagagagattggctgataattactgtttgttatctgagtccccaaacgatttactgatatcaacaacgtattgatgatgtattgttttagaaacacatatatgtaaaaaaaaaattcttgattagagtgatatcaacaacttgagacatggacaggtaacaggttgatccacaattctatctttacgtcataataataacaaaaaattcgtaaaaagatgagttttgttaattacttctcttattataatcaaagttttgatttttattttccaataagtcgccgggaaaagtaaaataaaaagccgtcacgtctccgataaataatagagtatcgttagataggtagcttcaacgtaaggaatctaaattggttcagctcaaaaaacgaaaacg

SEQ ID NO: 3255 - DNA, 2000 bp, Arabidopsis thaliana
tttttcaaattttattttagaaaaagtttcatgaaatattttgcgttaactgctactatagtaaattcgtgattgttacttaatggtctaatttatcctttaaaaaaccaaaacaaatcatttttgtgtgattagttgttgtagctaagacattgtcattttattttcagtataagttactaaattcgtttatatatataattaaattgcaaagtatgctacagtatgacatataatgagtgcagaaaaataaaagatgatgccataatactatagtgaatgagaaaagcctgcggatattcatgcctaataaaagtctttaactccttatggataagatatatatgggaatacaaaacatttaatttatatttattttttatcttacgttccactgacggattataaataaattttttaggaaaaactttatatttgtttgtgtgtgcaaactttatattacatatattagtcatcaaatgcttctatatattgtgaccaattcacaaataatgatataaatatatatatattcccatcagtttttcttggtataaatacaattaattcaattcaaacttatgacctgttctgtcaagaaaacgaatctagtaatttatgactgaaccaagaagagaatgtttctcaccgtacagaagaaatcaatgcgtgatgagtactgagtagctgttagcagtcacctctaattgtatgaatttattttgttgaaatatgttcgttaatcgttagtacttgttgaaagtcactacgtacgtatatatgtagataaaaaaaaaaaaaaaattcttttaggattattgttacacgtataatgtaaagttataacataagttcttaacaactctttgcatagtaccgattcggacttcgatttcgaaagccatgcatgagaaaaccaaaaaatggagccaaaacttagatccggttcaattcgagtaggttatgtcaaagacgtaaacatctacaataggagctccatataagtagaatacaaccaatgccacgctgtaacataaacaaagacagcgagaatctgttaaagatctctcaggttccaaaacaaaactacaagaccccattatgatgttactgacatttaactaaagccttgtgctagttgatccttaaggaagatgtcctgtcgtgatgctcagttttatttcaaattcatatatacgtgtgtgtgtgtgtgtggtgatcatgattaataggttagagacagagagacaaaagttgtgggctttaacaaaccccagtaaagaacaataagtaattttgtcacgtaggctctgtttttggctcttcaacacccaaagtacctgttttttgaagatgtgagacataaattattacttatgatctcaagtcaataaactcatcaaatctgaactacccacaatccaaacattgaacactagctacctttacatatagagttaattaaccatccatctattgagaaaacgagtaaaatatgtattcggttgttgttcttggtaagaaaagattatgagcttacgatccgaaatttcttggttgtgataagttattaatgggagatagagagaggtgatatgcccatatggcataccacatgtggtgggggattcgaagatttgatctggaccgtctatcacaagaaagaaagatgaaaatattttgtttttgggtttggacagatgggagaaaaagaaagtgtccccacaaatgtccccaagaagatgggacacacttttgcctcaaagttgctgttactgctaccgacaagcttagctttttttcctttgtccttaattcagaaaacagtttcttctctctctaccagtatctatctttattctcctttaacttgtataaaacactcagcttcctcgaagcctctcatcttcatcatcagcagcttctctatatctctcctctctttcaaggataataaccaaaagcttttctttttatcttctcctgcaattcttgaagaa

SEQ ID NO: 3256 - DNA, 292 bp, Arabidopsis thaliana
tttctttttctcttcccagataatcccaacaacaacaatccacagtacgagaacgaatctcccccaaaacctaaaataaacaattctcaacgaagcttatgttttttatccgattccggttcagttacaattacaattgaaccggatgaccggctgcaaaatttatcctgatttgtttcggttcgatccggtttgagtaaaccgaaatagataaatcactagtccagacataaatgatgatgatgatacagctagtgttccggaggagaaggacgatcgatctaaggagacg

SEQ ID NO: 3257 - DNA, 2000 bp, Arabidopsis thaliana
agccagtggatcgtcacgcgatgtcaatatcgacttgaacctttccacttgtgagtcagcataatccatcatgtacaacaatttctccgacatcttcatcaacctttcgtgcctcaacctcaaaatctcattatctgcgctagtcatatttttttatacgagaaattacagagaaaaatatagaatgacgacttatcaaatttgaatgtgctctttaaagttttttattcaggcactacccgttcaatgttcatataggacgtaagagaaaaaaacggaaaaaaaaaagaaagtaaaatttaacattaacataattttagaaaagggaaaattcacatatacggtataaatttgtaatagaccgtcctatttaaggccgtacatgttcttaattttttctaaatcaacggttctgaactattaggaatttaggaaatcatttccatatatccaattatctatatatgtaatgtatatactatgtaggtttcatcgcggcccttttggatttgagtttccagaataaggcccattttcaaattaagatttcagatcaagaccccttttccaacccgttgtgtaggcccaaataaatttcatttgactgaacatcaaaacttcaaaatatcttcttctacaaaattggcattcgtaattatcttcttgaaaacaaaacaaaatatatgcaccaattttcatttgtcacacgttgtaggcttcgaatcgtatgcattttataattttacttataaacaaaagtgacatcagaaatagtatctcctatattataaaaatgaataaccaaccatcttcccactgctttcccaagtcttctttgtattccttacaccaaacaaaaaaaaaaagtcttcttatttcccagttgagcaatttccctcccttttgctatttaatttgttcttttagtaatattatcaatgtgtttatctgacttttattctcctccatggataaaataaagatatcccacttgaggaagaaaatatcttggaagagttaaccataaatcagaaaaagatatggaagagaacagctgtgtatctttgagaccaagtcttgagaagcagttagacaacatggacggtgctggttgcattcaaaaatctttctatacataaaacggaatatgccaaaagtcatcaatatatcgtaaaaaccatatgcttctatttataaattttacatttcataaactttaggttagtttatgtttccatatcactcatgactcaacacatatgctaatattcgggtaatttatagtaaaaatgaaatttttaaaggtaaaacctgtatttttgtttttttctgtaaaagaataaggctttattgaccacaattagaggatacttttctttttcggttttggcatttggtgatactcttatttattttcttaatgttgacattactaacttttttggagcgtagaaaaaaaattgacggacaccaaccaatgacagaacatacagaaaatatctaaggtaacacgtggtctgtcttgcatttcatgattacttacgagggacagcactaagtttcctcctttctaattaccataactaaccattttcttaattgcccaataatggtccctctttaccaattctgatataccacccaaaattaacatcaaacccaatatttaaagtcccacacgtgagaacgactgacgtcggcacgctttagccacgtaatttcggtctccaaaaattcaatattaatccgcgaaaattcactaaatataaaacaaacccataatataaggaggataaggaaggagtcgaagataagcggagagagagagagagacagagagagattcaaaaatccgattccagatccattcctgggcaaacaaaggttggtgtttctctaatctcaaagcttttttcaaattcggaaaaagcaaatcgtgggaagagattcatcttctctctgtgcgttcatcggatctcggagcttttggttcgtcgtca

SEQ ID NO: 3258 - DNA, 2000 bp, Arabidopsis thaliana
aatcatgaattgtataaatttccagatttgttggtggagccttgtaggccatcaaaagcttttgatttttgaacaaataatggcccatatatcgaccgacgaatatttgtactcccatgaatacaacaatctagtttcaagtaaaaagtgttcaaaatatttcagatttttgtatcgtagttttaaaagactaaaccaattgtataattacatttctattttccagctgcttggccggctgatatggcaatttttagcaacatttatataggagcgtattgtatatttttgttcacctgtggctatcttgtattcattttgatagaaagactaactttgtaccattcaaataatgattcggttatcatttcgccatcaaataatcgatttatacctaatactgcgaagatagagacattttaacaatactatttacgatagttcggtagaatatagtaatctatgcattgatgacatcgtcggctctaatcagcttttataatgcttattaacatcattatggcatattcataatttaatcgaagtaacctagtttattttaatgcatttagatcaattagatgggggaaaaactatgtgatctttcaaatgttgtttgttcaaagcagaatgatttatgtgttacgaattcgccagaataattttaatttagccaaccaaaaaaaacataatttgtaaactttttccacgttttaaactatttgtgaaatgtctccaaaatgaaagaaaaaggttatgccaccgacaatattttctaccttgtacaaagaaacaaattgtttattcaaagttggtttggaaaagatactgatccaacggtcacggatttgaataacattgtttagttaatacaaccaaattattcttatgctatgtgtacctacttagaagcttacacagaaaaaaaaaaaaaaaaaaaaacttctaaactttggttttcttttttttcccatcatttataatattcacgtgttacataataatttggatgtatataataaatgatccaataattaacaaaataaatctgatcatccaatcataataaagttgcgcatactaaacaatattttattttcctaaacacaacttctttgatatatggattggtcgataagaataataagatatgggttttaatagaagacaatcaatcttcaggggctttcttgaaattacagcgtggtaaaaaacaatgacatcaatctggacccgatcacgaggacccggatccgtatcgataaacagtgtagctttcactaccccattttcccagaaacacctctcaaaaatttctcaagaacttgtataaatatctcagtttcgttcacgcagtgtcttttttatttttgtatttcttttttcattgttcaccaactcctcttgaaggtgggacagagtccagctccaccaccaccatagccatcgcgtcgttttctccgggacccacttatttcgtgacgtttctctctttgtatatacatacaattgttttcagtctcaatttgctgtccacattttaacacaactctatctcaggggtggtgtctgaatctcgtctctctcattcctatttatcccaatctaatctatcacaaacccttccacattgcttttgtcagtctgtaaaattctctttgaatcagtgaatcactcacttaaatccaaaacagtttttttttctttctttctttatttgcttgttgtggaatcaatagctgtctccgggaaaattcgttttttttctccttcgggatctctttttttttttttttggttttatttaataattatccccgagccaacatttattgtcgattcggtttatttcgtctccttcgtcttccactcttactagtgcatgctctgaatctgtatgtaatgggagttcaacagtctggatccattatcctagccgggtcgggtcaaggtctttgagtaagagagacaattcgttttgattcggtgtagaagacatc

SEQ ID NO: 3259 - DNA, 2000 bp, Arabidopsis thaliana
ttatttctcattgacaattgtgtttttaactaaaattaacaccaaaaaaaaaacagtgttttaactaaaggatgtggtttgttgtttatgttaaccacaacaataaattctgaagagaaaaagtttgcaatagagactgaaccaggtttacaataaaattccttaatggaagggaaataaatcaagaaaacaaaacaaatattgcatggataagaaaaacacgacacttgtctatgcaacttgtttctttagttgcatgagatcactttaatgttaaagtcctcccaaacagtattggattcttcgttataaaaagacctcagggtgattagagccttgtccttgtgaatttgaatcatatactccaacatgtatacacgtacacacaaatacgtattcatatatggcactggaataatcaatatattcaattctgagaatagtagaatagcactggcctaaaaaaaaagcattagttaaatttcagcatattcttgtatccatgccatgataatggttactttgttgttttattgtctattatttctattatatatgaactttcaatttgaattttagatatattggcagtacaaatacaaaaattactttaaccactatagctcctccgagcattcgtcactgatcagtgagtgtgtgtttatatatgcgatattaaattaaataagtttttcttcacactgtgtgtgtgtgtgtgtttgtgtgcgtggtaacaataaagttctgcgtagacgacacgtatccaatattaatggagttccgaaagaaagatcttctggcaaaaccatcatatatagagacaacagtttattttatcttttaaacaaaaatacgatcacattttttttacctaaattgctaataaaaagtacatagaaaatggtttacaaatatcagccattaacatatatagttcaatattacccgacaaacaaaaacatagtttatttatgattctatctcaaaagaatttaagacgtcaaaagaggtaattagtaacatcattttattggagatattttgcaatgaaaactgccatgaatagaaagaggaggaatcagtaggtctagattaagtgaatgttctacttcatttttgttttagtcaaaaagatagtttcactaaatttattttaaagccattaagtggagggcttgattccttccatcacctttatcttgccctcaactttttttttttggatttacttgcatccttctccattaaacaaaccaaacccaaatatagtgtgtattttatttaataattatgaccagataaatgtggtagactaaaagtttattttacgtgaaacaatctatgtcattctttaactatctagaagaatttagtgttcattaacatgtaaatgtgaacgaataatataatgtgagtaatcgatatgcaatcaatccttaaactttgttaccactataccttgtagagaataatagaacaaaatcaattctcatatgttaattggtattggaaaccccatttcaaaatcaacttgcatattaagtaaagggaaaacaaacatgattgattagtctttattccaccactatattactagctttataaattcttggaattaatatcatctttagtgccctaaaaacaaagaaataaagctagttttctctagaggagaagaaaacaatgttatttcctaagaagagcataaagaaaactacaacatgaagtcattttctaataataaagagggcccaaattcttctttcttctcacccaattggacccttcctcaatcccttctcctctcctctctttaaattccgctaatacccttctcactttcactcttatatttcataaaaacctttttttatatctcctctacctcaaagtttgagagaaagaaagagagagaatggtgggttcttgaagcttctcacattattttcttcatcgttcaagaaatcaatatttgatgatgtttccttttatagaaatat

SEQ ID NO: 3260 - DNA, 2000 bp, Arabidopsis thaliana
aaaaacgactataaaaaggacccacagtgattatgaaaatcagattgacgaaaagtttgtgtgtctgattccaatcatattgatccaattcattcatcatattcgatggttgtcaaagcatatagctggattaagtggggcacaacactgaaaacgtttctcaaccgtatgatgtcatttcagcctttggttttctcaacgtttaatcggtgaccgtcaatttcttttcaatctctataatcatttcttcttttggcgtgtcactgggaccttcactgtcaatgctgaattaatctcctttaaggatttgaaggcaagaaaaatcttgttgcaactaataaaaggaatcgattttgatgctcattaatcgacctttatgaccaaaatgggtctatatgaaataattatatgatttgacaagtaaccatttgatttacaaattattcaacgatttagcattacaaaaacatctaaccatgcttaatgtatgatgttattcattttaaaaagtcgaatgaaacccatgtttatctcaatgcatgatttaataattttattatacatgcacataattctacatttttaattaattttattagtttaataataataattaattttctttttttacacttgttataggtgagaaatgaaagttatcataatacaaaacatcagtttttataaaaccaaataaaactcaaaaatcattcagacaaataagtttatggacttatggtatatgatgatactctctcaacatcctcattaacatcatcactattaagttaacaaaaagaaaaagaaaacatcattataagttattaataagtttaaatagtagtattttatattctggtacaatgtactgtttttggtcattaagtggttcaacgacaaaagtaaaactcatgcggtcgacccatgcgttagaagaagaaaatctgaaaagaagtttgaattctttaattttttcataaaaagaagtttgaattcaattcaaccgtttttgtttagttcttctttaattaactttatcactaatgtttaaaagtaaaaggtttttaaagtgtgcaacaagcgtgactctttggcctttagagtcatcaagaagggtaatcattttttttactctttctcgacaatagcaatcaaattatcattcccacttttaataatctcataaaataaagtcaatcatagttaaaatttgataaattccatggaaatgataaaaatttgattttactattgttggatgtgcaattgttcatggtaacttactaatttatatgctttattagttgcagatagtgatatatatcgaaaaatgaaagatctaattccaataattgtcaaagaggatttctaaatttctgtttgactaggtcatatattctcacgactcaacgatctaaccaatcacctacaacagaaaatttggttgaaataaaacgaaaagtgataagtccaaatgtttaaaacaaaaaaaaagtaaacaaaaggcaaaataagataactacgattagattttgttctcgccttatgaatatcctaaaaattatctattagtgatagtttgataatcatctttgactgagaaaattgatgtcacataaacattaatatagtatcaacattaatcattaatgatgcgactataattattattttatcacaatttcttagatttgataatttgtttaggtttgagagagttatatagagggggacaaagaagcaaagtttgtgattataaaattatttccattgaactaaagttttcaatagtttattcttgactttaataataataactattttgcccccagctagtcacatactcatgattgcaaaatctctctctctctctgcctctctatatattaacctttcttcttcctttactttctcatcttctatctctcaaaagaaaagcagacaactttatttgcaaaaacagagtttttttttcttatcttgagaaagttcaacagaag

SEQ ID NO: 3261 - DNA, 2000 bp, Arabidopsis thaliana
ccagtagctgattaggtattagaaaaactacctagagttcataaatatgattccatacgacattaatatatcattgtgcttaattataaagaaaaacaaaacaactcgagaagaaaaaacactagaatttaaagtaggcgtcaaaaacagaggagagtaagtatactatgaatatgatcatcgaaatcttcagcacctggtcgagttcatcgtagataccgcttcctcaaaccaaaccatatgattctttgttagttgcttggtaaactaaaaaaataaaagactcatttggtgcaaacttcatatttgatctacagcttgagtcatcatgtttcgttactcatctacaacccatcattcttgttgcataagattgcttgatattgtatatcacatcaaatctcttaatttgtttcttgttaaaatatatgatttttagtaagtgttagtcagcaatcctacgattattggcaggttagtcaccaatcaaagcatgatcacttgttgtctacttccatttgattaccccaattcatgtttattgacttactaataataccaagcacgtattcagactaaaattatcttagaaccaacttcagtggatgaagataaaagttggggaaagtgcagactcaaatattaaaggaatctcaattctcagttttaacttttacttgtatgtttggtaatgcttttacctttggttgcatgctgcaaaagtgatttactctgtcccaagactgaacttcaacttgtgtatatgattcaattagacaaagggagaggaaagtagtgagtttttgtccagctcactgacaatgtatcgatatgatgtctttagactttgctttttcgtgtaactactcaatttatgcaatgatgaatcagtttttgtcttgtacctgcgtttaataaaaagaagaagagttttacaaaaaacaagagtattttctagtcatagacctagttagtctctaactaatggagatgccctaatgtcccacgatccggagaaacatgtaaaatccgttttcatcgtcattatcgtagttattcagttaacatgagctatatatttaactcttaagattaggtaaatgtatgtttcctttcttatggagtaaaagatcaattgacatgtatgtcatcttcttgttgctcaggtatatatatattactcttctctttgtaatcatctaaatgtaaaactcttaaacttcgatttgtgactcgaaatgtctaaatgtgatgttataatatggggaaaaaaaactcgtaataaaagcatcagaagaaaacagagcatgttgtgatcacaggattcaggagtcttaatttctacatatagtcattatagttaaaaggcaattttcatatcgtctaactaattaatatataattaagattagtttaagcttaatttgaggtggaaagatctgttaagaaaaagagtaaatttgccttgtgatatccagaaaagaacagaggaccaagacatttgaagattccttccaactatcaactgtcttaatctttgaatagtaagcaagtaagtgtcactcactattattaattaacaaaagcaaattggtttcctcactagcgaacaagatatcaataaaagacgagaagaccgagacctgtagttgtcctcactaacgaacaagatatcaagaaaagacgagaagaccgagacctatagactatagttgtcactgtttaaccgaagcaaacgtggatgttaggatactatacaggaataagcagcagcgtacttaaacgtcctcttcactggttacgttggttgtgtagttgaattttagtcttcttgcaatttctgggaaaatgggaaggggcctgcgaaaatgagtgagagagaacatctcgtatacagttgtttcttataagaacaaggagattagcgaaaaaaactcaaaagaggaacagagttagagagagagagagagagagaaataaagagagaagagaggtagaag

SEQ ID NO: 3262 - DNA, 836 bp, Arabidopsis thaliana
ccggttctgttctgactaatactctaatagtatacaagtagagaagatcaaatatccggtgtagccaaacacttgttgaagtttatttgccggtttttgcaataataacaaaacgtccaatatctgtaatccccgacgtaacataataccaaaaatcttcagtttcttcagagagaagttgttcgtgttcgagttattgtagagccagcatacgggctgttgctttgttgagtttgcttctcttaacgaagcagagaaggcgttggaaacgaagaagggtgaaactttttacagtcgtaagattattcttgacgtggctgagatggctccagaccctttccgactcaagtacaaccttgtaaagaagctttgttaccaagactttcaacaagaaagaccggaaagacagcagataaaatccctgttctgcggtaagaagactatcatctcttctgacgactgatagaagctcctttggtgttttttagttgtgatatctattccagttacgaagaccttcaatgcaagtatgcaactgtgctttgttacttcgttttttcttttcttcttgttaagtttttgtcttaattaaattaaaatatgcttaatttttagttatttacctaaataattaaaatatgcgaattgaactgatttggtaaataaataattaaaatcacaatcaatacatagtatgattcatgtggacatgtggttggacaggttggtgaacctaattatgctttaatttctcaacactttgttcaataattggttttttttttttttaatgaattttggggtcaaattcatttcaactgattcaatcaattctc

SEQ ID NO: 3263 - DNA, 2000 bp, Arabidopsis thaliana
agaatattcagatgtttggtctatggaatatagtctattcttcatgtttaaaactattatttgataagaaaatatgtactaatatgtttttgcatacaaatgttgatcagttcgtagcatttgaattaatacattctcaatcactttcaagcattattatgtaataaatgattcatgtcgaaaagtaatagtatcactgtccattacatttggcatatatatttttttgtcaaagccttacatttggcatattgacgaagcagttttgtattcacttatattttgacatcgctttcacaaaaataaatagctatatatgattattatccattaattgtctcttttcttttgctgacacaattggttgtaaatgcaatgccaatatccatagcatttgtgtggtgaatctttttctaagcctaatagtaaataaatctcaatacaagaacccatttacgaacaaatcaaaccaagttgtgatgggttagtacttagtagcccgtttgaaatgtagaatttttgatgagattttacgttttatatagatttttctcagaaaacaaaaaattcttgcatcttgcattttggtcatttgtaaatatttttttagtcttaaaaaagacccaaattcttattaatttcaaaattttcggtctctaatacctccggttttaaaaaaaaacatatcagttgaaggatgagtttggtgaaggctatattgtccattgattttggagatatatgtattatggtcatgattattacgatttttatataaaagaatattaaaaatggtggggttggtgaagaaatgaagatttatcgtcaaatatttcaatttttacttggactattgcttcggttatatcgtcaacatgggcccactcttccaccaaagcccaatcaatatatctctcgctatcttcaccaacccactcttcttctcttaccaaacccatttcctttatttccaaccctacccctttatttctcaagctttacacttttagcccataactttctttttatccaaatggatttgactggtctccaaagttgaattaaatggttgtagaaataaaataaaattatacgggttcaattgttcaattgttcatataccgttgacgttcaattgttcatatacgggttccgtggtcgttggtaatatatatgtcttttatggaaccaaaatagaccaaatcaacaacaaatgaagaaattgttagagtatgatacactcatatatacccaaatatagcatatatttataatataacttttggctatgtcattttacatgatttttttggcttatctattaaaagtatcatacaaactgtttttacttcttttttttcttagaatatatatgcccaaaatggaaaagaacatatgccaaggttgattttatcgcttatatggtaaaaattggaaaaacatacaaatcattactttatttaattaaatcatgtgaagaaacatattcaattacggtaatacgttatcaaaacatttttttttacattaattgttacattttttttttttgcaaatattcttaaataaccattctttttttatttactataattaacataaaaataaataaaatataacatttcaacaaagaaatttgcttatgaaaaatacaaaatccagttaatttttcagaaaaatacaaatttgcttataaatatattaccactagtttatgtgattttaaaagaaagaaatgcagcttaccaaacgcaacgtgaaaatttgagaaacccatactcaaaaaagattaaatgacaaaatcaccctcagcaaaatcatgaaacaacaacactaacattttcaccaaccccaccgtctactccggtgaattgtctatatgaactcctccgatacaactcctgtttccttcaggccaaagcctaaaattcacacaaccaaaaaaaccaaccttttttttccacctaaatctttgaatatcacaatatttactatttaca

SEQ ID NO: 3264 - DNA, 1188 bp, Arabidopsis thaliana
atctctacctctgtctctctatctctatctgatctttttcaaaaatcagagattgacattgatgacccttcaaatgcagaggtttggtatatttatgatttaatgccacgtttaacgataagtattaatttaacgagtaatttacttttattatttttgaatctaataatgccgttttaaaatgctataagttagtattaatttagaatttgtctcatagaggccattgttatcttcagtgacagtatattattgtgttgtgtggacccaaaagccaaaaaggattgttttatttaatgttgcaaccagttattatcatagggtatttatcgtataatcgtggctgttgcgtggacgttactaaaccactgtatataatatgtatttgcatatggataaataattaaatcatctctcaaatttataaaaatttgcattatgagaattcacagaactaaaactcgtagaatgaaaactgcatactagaaaatcagataataatttttttaaaaaaaaatcagataataaaataaataactgcatacatttgattggtaaattttttataatcgcattaaaataatattttaccatatatgtgttacaaatcagagtataaaatatacaaaacaatatattggtagagactagagagactcaatgtaaatgctttagttacgtttatatttcgcttatgaaaatttgttctttgtggagaaaaaaaaaagttcttttttgacgaaaatttgcttactggataatactgatctattaattactgggccaagacacttgaggcccatcaactcctagatcggtggaaacctcaaatctcacagttaacgtaattaggttggtccaggtggttaagcaaacccagtgataatccacaaatcatatacgtacacgtgccaatccagtcgttaagtaacacgtgttaaattaacattggttgttatacaatagagaagccacatgagttcgatgaaaacaatgtaaacatgtggatttgattgcacaacaacaatacacataatttaattcgatttcgacaatttcatttaattcttcgatttctccgcttgtcactgtttcgtatcgccattttctgtttgcatacacttgtatatatttatattaacagtccaaaattcttcgaaattgtcccgagctttgagcatataaaaa

SEQ ID NO: 3265 - DNA, 574 bp, Arabidopsis thaliana
tgaagtcttttttccgggtcttgttaaaagcaacaagatgaaaagaaaaagttggggatgtttacgcattgattcttctatgcacaaaatgtaaatttgatgtggcgtgaaatggctaaagcaagcaaaagaaaggcaaagccagatacatctagaagacaagacgatgagtctgtattgcctatttttcaacgtgactctgttgacaatgattctaaatcgacgaaaaaagaaaaagaaaaaaacaattttgctacaagaaagatggtttggtttggtattaaagcagcaaattgtgcgactgttgaaatgtgcagacttttgttttttttaatcttttagaagagtaaactgtacagggaaagagaaagagtctgtttcctccatttaaacgagacactctttgtactcgagatcactttttaaattacttctgagcactgatactttttgattgatcaactaaacccaaattatcttcgcttctggataaagggtatttatgtcaattaactttgttcttataagatgatgatgcgaagacactgagagaagctaagacaaagcgcagaaa

SEQ ID NO: 3266 - DNA, 1020 bp, Arabidopsis thaliana
attagatcttagctctagctagctagtgattgcaataatttccatcaaataatgtcgtacttgtttttgatctatcaggttttttagatgatttggatttaggattgtggaataaatattatgatcgaataaaagtttctcttgtttaaatattttatcttgagatggtttttgttctgacctttatattattaagcaacgacactacaatttgttttctctgttgtgttaagaaataagtttcacagttttctctttaacaatagccacaattttgtttatgtcaacattaaccacattttatagtatctgtcgtgctcttagctaaggcgaagcatacttcaaaagattaaattactttctcattacacataatatttatgattttaaaagtattatcagcattctcctcatatagtactaaaattcttttttaatttggatagtgtaatatttttgtgattaccaaataatagatgttttagcatgattcataacaagaaaaacatctcagaatgatttactaatctataaatttcagaaagtgtggcaagagggttaggtaacgacccgacccgaccgcccggatcggacccgtttaagacaaaaaagacccacccggttagagcgttctagaacacttgggcaataaaaagagaggagtcatgtgttttagtctatctaactctctctctactgcaatttttagggttttatcctccgaaagtctcaacctttttcttatcctcaacaaggtatcatcactcactctcttctctttagctacccactccctctctcttcactgtctattcgtattatagaaatcctttacaacgagaattgaatacaaaggtttgaactttgggcggataaagtaatctagttcgctcaatagtggttgggttttactcttattttggtgaatctgggagaaatcttcatttttgcccatttgtttatctgtctctctcagtttcatactaattgagagtttgtgtgttttgacggataggagaa

SEQ ID NO: 3267 - DNA, 2000 bp, Arabidopsis thaliana
accaaaaaaagaagaagaagagttatagataaactcattagatatgcgattttggaaatacaatagatataaaatgaagaaaaccaaaaccaaaaccatagctatatttttttaagaatatccaatggcaatagctagtatcagaattcttagattaacgcacatattattagcttcacattgcatgatatcattcgttacaattactatttgattaatctaagaatataattaatatctaatggcaagagctaagaattagaattcttagattaacgcctatattatttagcttcacattgcttgttatcacatggtacattagattaattgacgccatggtatactcgtttccagtactattagactaacttctatcatagtttttattttgacttttgtctttgttagttttttttttgtaattgttttatgcaattattttaccaatcaatgtttttttttaccaactctagtctactactatgtttagtagtctatattagtcagtaaagaaataaactatacatattaatttttcaatgttttttgtatgcatttttattgggtaaaaaaatagttcaattggtaaattttgtatgcatttttttcaacaaactaaaaatagtatcattggattttcttaaagatatctaaatgatactattttgatacaatatttttttaacatcatcttgaatttgaataatactaatctgctactaaaaaattagtaaaatattggcaaatcatatatttgttctaaaagtcatttataattgaaaagattcttataatttgatttaaaattactgacaagttacaacatgctatcaaaaactagaaaatttatcgaaattagatttcaaacatatattattgcatttttttcctcattttcaacgtttaagtataaattaattataaacaatgggtgcatttatttgactactactactatttaaaaatataaataggtctcacgagtctaccactcctcgggatcagactaggctacatccattgaaccatagtaaaattaccgtggaaaaaacagtacagctgtaacttcctatataaacacaaagatccatgtgcccataaacatttactactagtctactactatcgtattttttttccttcgtctatgactacactaggttgtttaattttggaatcaaattaattagtagacgacgacttcaaacaataattatttaacatacacgttttgaacaactgtatgcaataattaaaaaatcaacaagaccaatcaaaatcattaacaaatgctgtaaaaaaaaccattaacaaatgtcatttaacatgtttctaagaatatttaatgaaaaaagtatagatcaaagctctagtgctctagatttttcattaaaaatctattaatattttcagttttttttttaaatgttttcagatattttaaaactctattaatatttccagattttttgttaactcttgaacaagtactattaatatttcctttaattacatacgtacatagtaataatagatttctcctataaaatgcttttctttttttacttcagctcctatataaaatactcggataaatagatcctaatcaataaataaatagattcagtttttcttttgatttagtcgtgtacaatgacgatcacaacaaaaaagcccataaatataatttactcaaagtgattaagggtaaaattgtcattatctgatacgtgttttagttgaaaaattgctatcttccaccttcttctatctctctacgaaaataatatttttgagttttgtttttactttttgtttttttttttaaaatttttttttcttcaaaaattcctccattgttattacataaaggaaaaaagaaaggtctctgagattttcaaatcaccatcatcatcatcgttgaagaagacgaagaagataccttcctctttatcttctccgatttctcaaccttcccgtctgcttgtcgtaaagaa

SEQ ID NO: 3268 - DNA, 2000 bp, Arabidopsis thaliana
gaaggatcaaaagcctttgatctcaatttctgtatagtttttattagcctagtgctttatatatgtttgatacttctgtttggcaatatcaatcatagtagaaaagatatggacttcatttgaggtttttggtggattgtgtctatatgtgaaatcatgggatctcaagatttgtctgcattcagtttccaagtcaaacatcgtaactactgtttgattttccctcatgcttgcagttttcatggatatctcaagatttgtcttcttgcactttccaagtcaaacataaagtaactactgattgatattccctcgtgtattaccctctttcaaatgacacaattgggcccaagtagaggaatttcatagtgaattcaaaagattaactgtattccaccgtcgtattttgataacatttagttattccttttcttttttttcttctgcaacagtttttttttaatacatttagtgttggtttggttcaatgaaatattatatgttacttctttttttggaaataaattattcattctttctactataaaaggaattgttcatgcttttttgatacaatagtataccatttcaaaagataccatagaccagttattacatgaatcgccaaaacaacactaaaatcagaaaatcagtatattttggtatagtctccaacatacaatcataaaacctctgtgaaatttaaaatctatatttgacatttcaaagtttaacaacatagttctaaataattacctaaattttaagtcaaatgtgaattatattttactcttcgatatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaataccctaatcacattttgtaacaataatacaattatacattaaaactctccgacg

SEQ ID NO: 3269 - DNA, 965 bp, Arabidopsis thaliana
tgcaaaagcacctggtaagtttagccacaccacctgtaggtctccaaaatcaggactttcgatctcctcgaacccaaacacctgacaattatacatatataatccattggtttcagaacaaaccacgaagatgaagataacactaacttaatcaaaaggattaaaggcatccaaaagtggacactctcaatagaaactagaaacgagataagtgacaagagaaagagacaaagccacaatagcaacacaaatctctaaataaaaagccaaattacaaaccatagattctaatccagatgggtaatcgactcagtgcgtttgtttttttgggtcgaaattggtagtaacaacacaaacccagaacagagaatacgaagagagataagaaaaagaaaagtgtaagaaattgaaaacgtcgattaggtgtcgttacctctttgtaaaactgggcgaggcgtgtgatgtctgatgattctctggctatatggccaagactcgccatgtttggttccaagcggacaaagctaatcaagaagaacaactcagaaacaaaaatggtcgacaaaaaagagattagtaaaagtacgtggcatcggctccttataacacatctttaatcaaaccataaggttgaaccgatcggtttgactatcagtgaaactaaaaccaactttaaaaaaaagaattattatacgtaattgcagttactccaagaaaaattaatctgttgcttaatctgaatatccgaccaatcagaaatgttcggaccccgaccaaacaatgtatccggtttaaaacatccggtccggtattaaacccttattgctccgtaatctctcacctccaccaattcctcattcttccaatcgcacttcctttaccagatcagacgtcaatttcaactcttcagtgaagagatttctttcaccgaattttctactccgatcgatcaattgaagattgaa

SEQ ID NO: 3270 - DNA, 2000 bp, Arabidopsis thaliana
gatttggcagacaaaataacatggtattttagagagagcgcgcacaagtgtgtttttttaaaacaaatgaaaacatcataattacgtacctgattgacccttgtgtatatattcacgattagaaattgtagattaccaaaacactcgcacaaaatggttctatatatagacaatatatgattcttatcacatgttttgaatgaaaaaaaaagaattaagatggattttttttttgtaaagaacaattgtactttgaaagagtcttatccaatcattaaaaaaaatgtcgaatccattatttattgatgtattctgaaagcatatattcttccaaaggggcaaataaaagagatgtcgacaaagattggatacataagatattaataatttataaatgcaatggcatatatatatgatataatttgagctctaaatgccgaaatttgaaaaggagaatgtgtgtaatggttcttacaaataaaggagaccacaatgcttctttgtgttatgcttttttcccatcttttattcttttgttcttttgtggggttaactctaccactactcattttctcgctcttttttcacttattttccatatatttctaatttctaaattaattttactaatcttgaaatacaaaaaactattagacttagcttactaatttactacaccaccaacatacacactacgcaacatatgctaatatgtattaaaatgaaaagaacaaaaaatgagaaccggtattacaatttatcgtagtgtatgactagttatgagatgagaaggttcttgaaaaaagaattactaaccaaataatgtagattaattatttgcaaataaagaaaagcaagaatatatagcaaaatcatgagtttacggttcggctctataaaatcttctacaaccatccacgataaacttgatacatgaaatgtcttcttccattaaaacatgagttccacatataaaatggtttacaagtaactctcgaacatatgtgcatggtaaagcaaatatataataccattattttttctgtcttaattaagcaaaattaaacatatatataatatatgatccctacatgttcacttttaaagttcacaatttcaagagtttgaatatctttaatttgaattattaccaaacgcattagacagactaaacagagacataataatcaatcaacttctttttgtcttttttttttttttttttttgggcttccagtcttcataatcaaaagtaactgaagaccagtcttaaagctggaacatttgaactaaacatatacgactgctcctatcgctctagaaattttaattaacaattattcatagttacttaattacaaagacaacaataaaggtgaacgaataaattaaaggaaaattatgaaaatagtttaatttgtatgaaacttttcatccgcataccaaatgtcatatactcttatcttacatttttctcttgggacatatttttggagcgaacactttcgcatgtacgataaggttcagtggtctgagcttcgactacgttaaaatgatgattagggtttactaatttggaattaggagttacatttaaggttaaaagtttatgagtttcaagtttcaacgaagctttaaagtttaaacgatggttaaagttttatgattatggtgggctatgttatagttctttcaatttcgttgggccaaatgggctaaacgattaacgaccctatgaatgggcctgaaaaaatgaaagccacgtgtcagacccccacaatggactttgactcggtgcggctgccggagagaataattaattatcaactccgatgaaaagaaaacaaatacaaagttccaacaaaaatcgaaattcacaatttctcttcttctaaatccatggagtgatgatgatgatagatagattgaatccaaacacaaaccggatccgagattaaaaacaatccggattgtttatatttactttagatcggagaaag

SEQ ID NO: 3271 - DNA, 277 bp, Arabidopsis thaliana
cttcaatggcggctaaaagggatgaatttgccaggaagggagaagccctaaccctaaccctaatttgtgctctactcttctgatttaggacgcgagagccgatatgaatatatatactaattttatttttaaaaatggaaataatcttatctgattttgttttttggggtgttatagtgtgtggagaggtgcatggtaatgactgtggacctaaataaaataaaacgcagtaggcagaaacgcatcagtcatcaccacatgcgacacaccaacacca

SEQ ID NO: 3272 - DNA, 2000 bp, Arabidopsis thaliana
taatccatgatttagaacatattttgttttctcataaaatatcttagaaaataatatttgaaaaaataagtagccatcaagaaaaaggaacaaacataagtaaaaagaggaaacgatagaagtttcatgttggagagaaagaggagggagatggtgatgaatttttccgttcgaaactacgacgacctaattaaaatatgacgtatatatagccaacattcatatgtaatgacatattttcgagtctccgatatattacattctgtgttattaatttatcctagatatatagtactatacattgacatcaaaccaagaatactaattataacataaaattaagagcaactggttatgattggtttacatccagatgtacataaattcaggagtcctctggttaaaggacaagtagattcctttttcaccggcgaaccatgtagcatttgcattatttttctgagaggtgttcatacttgacttgtaagctataaacgaacggtgatgcgcccaatggtaaccctggtgtagattgcatataaattgtgtctcatggaagaaagcatctttgaaacgccaagtttgtggtggatcattgtgacgcaagtacatggtcttaaaatcgtcgtcccctgaataacaatggagcttcagggttgcgttttttggtaacctgtttactatcattaatacgtttctcccatgcgtatctccaatgtaaaacactaaaacaatgagaacaattgtgagacgtttcattttgtttttctggggatgttaattagattgtttttatttttttgtttatttatttatttataaagattgcgattttgatgtatttatatatacaaatttgatcagtatatgttttttgaggttgtgctttaaattctgtcttctctttattttttgaggttatgcgttaaaattaggaatggctcgagtggtcatcatgtagaaatggcttgagtggttaaaattagaagtggctcgagtgttctacttgcaatttttgtggaggaattgttaataaatatttcaaccataaacttaataaaatggttaaaaaaatttcgtctattcctaggtttatagtaacctttcttttcgtactttggcgaaacattccctttgttatatcattatatcttttaattctaacattcttttcttcgtttttagttggatgctttattaatagatgaattttaaaaatatcatagatttaatcactgatgcccaatacaaatttgtcaacatgatatagtttgccaaacctaaagaagaaacatagataaaggttacattagaaggggggcactatagtggcactagttcactaggtcattcctttcacccaagttcgaaacctcaccttttaagcggttacatattcatctctcaagtgggcctcgagattaaaattaaaaaggttacgttgatattgatgggtttagacattaatagtaggtattaattcgataagttatgaaaagacagtaaaactggttaagtagccgacttaatttggccttttgtatctccacttggttggttggttggttggttggtcagcaaaacacctaagtgagagctctctagaatattcttaagtgataagaattgaagaaggcggcattacttacttactagaaagaaatgagaacaagtcttcttagccgacttccacaaacacgtgtaccaagtcaaaccaaatgtgcccaaaccaaacttagatactttcacttttcatctctagtccacacaacattatatataattaaaataaatatatcaaattaaagtgattatcgacttcttcactcttcttcaactctttctcatctctcgacacgcaacttccttcctcttcagactcctctgactttactatatataacacacacactttcatttcttgtttcttcaaatcaaatcttttcatttacaattatctttcttctcaatttagaacttagtagctagtcttcaagata

SEQ ID NO: 3273 - DNA, 643 bp, Arabidopsis thaliana
ctatgtgtctacctaagctacgaggaatcgttttcacaacccattcttgatgcgtcaagtccagaaacttgaccttggaagagctaagaaaattctgaagctgatgcagtatttggctccctggcaaatgagcgtagttatttgttatgatcattgtttactaaggaaccaatcttgatatgtacttgtaactttacattcaaacttccaaattaaattctaattgtttgttccctttgcaattctcttgatttgaaatgagaattttttccttttatctatttcttttgtcaaaaaacaaaactaaatttcgtcgaaattaaatttctataagaagcccaataaagcgaggcctaaattaggcccaaaatactattggaggcgaaaaagaaagtccggctggattttcctccaagccaccgtcgactttacttagtactccctctctctcccctcctccttcccagatttcgtctccgttctgaaaaaaactccaaattctactctgaaaccctaagtttccgatgtcggtaagtttgataattcccagttaattttaatttcggagacctcagctctattagtcttacgcatcaatggtttaatagtgactgaacgataaaattgattgatatttgtggcg

SEQ ID NO: 3274 - DNA, 478 bp, Arabidopsis thaliana
aagctgaactatctctttcttaatttcctttctatgtattatagcttttcctaaacatacattgggacaagaaactttatgttgaacaatattgttataagattcatatgttttgctcttaatcttccatatatggtcttatggttatgatcttgaataggtgtattattttgtcatgtaaatttaacacaaaatcagcaaaaataaaaagagagtttggaaaattggagtagacttcatgaagtcgtaaatctctgactaagcccacgtaacacatacattttaccaaacacatgactcgtgataattctttctgcctacttatgctttgggtagggtttctaacccgaatccgatataacccgacccgaaacacgtgggctataaaaacccgacccaacagatctcatcatctccattctccacattttccaaggcttcagtttcacttcatcacactctctgcaaaaaaacaaaa

SEQ ID NO: 3275 - DNA, 1514 bp, Arabidopsis thaliana
cttggacttccagttgactactcgccgtgatgttcagggttagtttcatcaatgctcttcttatatgtctctctcagtcgttactctgttaaaagccatataataaatcgtagacttggtgagttatttggtcggattttatagattaactctctcattcatccatatgtagctcgtgtatttatgatttttatgattttttgtcattgcatattttcaaacttgttagtaattttggaatgttgatttgataaaactgattccaactccacgaatcctggtttatcaaaactgtgattgtatcatcgtacacacatcaaataaaaacttttactttgaacattttcaaatgctaactttttccgacaaattaattacatggtttgtgaaagattcccaactcttaacgtttttgttctcgctgtcgcaggttttcttatcaaggaaggttacgttgacccgaataagttcattagcatagacatctttcctcacgaaaggcaaatatgaccaatgttgacattttacatactcggtaaaatatttgttagttgagattattgcaatttttggcagaaaatattaccacactttgttgacatacaaataagttcaggtttggtccatacaccacattctcactagccaacatgcaaattcaactaaccacattcaatatcatcaaacatccttgaaattttaacataaatttggcgagtatgcggaagaactagtgcattacaactttattgtaccgcaattggctgattggtttcataaatattgaatcataacttagagattttttcacatttggtgagcatccggaaaaactagtaaaaaaatgaattagaatagtaaaacaaatcgtactagaaattttacagacagttaaaaacacgtataattttagccagtgttaatttttcttatttgcattttaaacaacaaagacaaaatacattatgtgcaactcctttattttacttttttgtatacaagataaataaattaatttgaatatacactaaaaaatcaaacagaaaaaagaagaagaagtaaaatagtaattatttaaaagacaacagaagaagtaaaaaaagtaaaaagattgcaaaacagtcggaaggttgaatggctgagattaatcgaacgcttcaatggcaattatttccggccatcactttcttctctacttctttctttctctctctagttgttgttctctctctctctcgcatcctccaattcatcgtcctcacgttcccttttgtttattcatcttccttccttcttcacatttctgattttctctatttggggggtttgtttccacattatacatatctagggttttgagatggttaattgaaagataatggtcgaagtttcggaggaattggcttcacattgtgggtgtttctggcttcctcaggtttaaatctgaggttgatctcttttgttttttggtaaattgtgacatattttggctcgaagaagaagaagaagaggca

SEQ ID NO: 3276 - DNA, 353 bp, Arabidopsis thaliana
gccagctgctactgaaactgaagtgtcagtgattgttaatcacgttcttcatctaccattgtagttttgagaaaaagatgtaaaataaaaattcaagcatggataatgatagtagagtagctcaccaacccctacatgaactttgagacagcgattacgaccaatactcaatcattgctagaaagacaaaactacccctacataaaaaaacatattacaataataacatttcaccaaccacaaattcttttatatggaaacactgatcatcatgctctgtttcaggctcaaacgttactttccaaaacaatcttttcagttttagataaaaatttgatattaacttctgattc

SEQ ID NO: 3277 - DNA, 1551 bp, Arabidopsis thaliana
taatgagttaagaatagagaatgaagaggatctgctgaatgagtgaagtagtgagagagtgagagtgagagtgagagtgagagtgagagtgaattgaatttcaggtgttgaaaatacggggtgggttttgcaattataagatagtagggttggttaatggtaaaaataaagagtatagggtttagtttgaaatttcccgttaaattttggtcgagggtctatggggaactggtagatttgtagacaaaacgacgtctcggagattggaatttcggatcgtgtctctctctgtttctttgtttcaatccgatttcgaatcaagccctttacttgtgcaccttcaagatttcgtttttccaggtcagtttcttcatcaagccaacctttttttctagggtttttcttcctttgttttttttctgggagttttctccttcacagtcctaagaagctacttgttaactctgtctttttgcttttgaagttaaacctagttgactttctcaagcttaaagagttcagcttttttttttttttaattggtgattttgttcttaattttgagctaccaaaatcatcgaattaaatgttaatctcttgaattctgtttcggtggtagtttcttggtttgaaatcatagctgcagcttcatgccgaattctcactggttctagatttagagtttagctttttttttttactttactcggatatgaatactgagtaaggaattgagtcaactcggatgtgaatactgaatagtttttgttctagctagagttgcaaaactaagagattcagctactgaagctactttagtgtcattcaaactgaattgaaatgatgtgtgtgagtgtgactgtacctaatttttcaaactcaggcattttcgactgtgccaacaccttaagtctcactgattttgactttgatccgcgagctaagcttaaggtctgaatgagtttctcagactttgtagattgtgcaagctacatgtctgattgggtttgatgaattgctttaaaggttgtgtttttgatgggctatttttgtcagtctgttagctacaaacagattgttcttatatatttgactttgtgacttatggtagtcagcagaatttcccttaggacactttgaataagtaaaggactctttagcattctttagctggcttgtttaactgaaacaaactagagaacctttttcttgactttataggacataattgaaaactatgttagcaaaagagatggtatgtaatgctgtttttttttgtgctcattcagcgcagccaatgctccgggtgaccaacatttgttcctgattcatttcctattgattcgtattggtaggtgttgatctttcttttatattctatcacctaattttgttctttctgtctttttttctttttcttaatttccttccgaatcctggcagtctgtgcacacaagagaaatttcaagaagttgttactaaaagagaggccacaagtggatattgtctttgttatcaagtgttagtacagaaaagtggtgagaaagtaat

SEQ ID NO: 3278 - DNA, 301 bp, Arabidopsis thaliana
ttcttctcccccgactctctctctctcacggcggctccggctgtttaaggaaataaagaataacgtcgtcgtttgaattgattactattaaaaagcccaacatataaattgggcttattacagcccagttaaagatatatgatattctcgtaggtcccacacgaaggcggaaactccaacggtggctgctttgggttaggtgaatcactcactgaagagtgaaaagctctagcacaaaccaaacaccaaatctcatttcttcttcttcttctttttccacattttctgattagcagatcaa

SEQ ID NO: 3279 - DNA, 2000 bp, Arabidopsis thaliana
ttataaaaatcatgatgttctaattgattatataaataaaatgctttacatatgcatgtagttcacattttttttttttggtttgcaattgtttcttaaataaataaataaaaaacctaatttaaaacaaatcagaagaaaaaaaaattgcaaaccaaagtaatccaaataagctagtattttaatcggattgtgagtactttctccacttctccttcgaggccacgcttatatattaatttgtacaatatgggtaacctaacttggttggaaaatagaaagtgccaaaaaaaacaaaatatgtatggctaaaaccaataaaacgtcccacgtcgactttcaagttaagtccctcaacaatattatttctgtttgacgaatcacattccaccaccaccatgattaccaatcttcttctcccacccgtttctaattcaggccattcacaatatttgatacagaataatgaaacttaatgttgaactattccgccattttactgtttcaattaattaaatatttatctaaacgaggtgctgttagtaaaaaaagttccaatatttttctagctaattctataaaaagacactttgtactgtaagagcagagacgataaaaacagaaaatgtaacgataatttgttacgtcctgtaatgaattgtttaaattcgagtaatgatatttatgcattttctacatatatgctactagtaatcaataaaagcatagtattatcaaaactagaatgcggtggaaataaatagatagaaatcattggataaataagtcccaacacaatctggccagatcaagagaaccgaacctaaaacaagaaagtggagatcacaatccgaaaccctaaataataatacaagaaaggggaatataaaaagaaattagaagaaattaattaaaaacccaatgtgtagtgtgaggaagttgaagattggtaggcaagctgacatgttacccatatctaccttcttcaagcaaagcatggagtgggagacaattcatgtggtctcttatttaattaaagttgcctcttaattactctctattgacaacttattatgatactcctacttagataagttaaatgtatcatttgattataatctaatttattttaaggaagtcttcagttctgttagttatatttaacgcttcagtggtatattacaagaatatctgtactcgagtaaatattttaaaatatcaatcacagaacattggatctttgaatgtgggcatgggaggatatagaatcgtttcgtcatgtgctagtaattgtattgttgacttgaattgaatttgtggatatatatcccgattaacaaattgaaacaaacatgtaaagcaatgtataaatggtaaaagatagaagtaagtttatcaggaaatgcaaaccatcaattcggatataggagtttaaaagtctaatcgaaagttttggagagactaaaatctattacacccaaaaaaaaattgcgttgaaccgttttttttttttttttgggtttttaaaactaatttaattttcataccacgtcataaaaattatattctcagagtataaatttgtatactatgaataaacatactgaaaatttatgaagtgggaataatagttgcaagtggggtgcgcatttggtcaacctttgtaagtaagaaaatacaaaggagagagaattgtgctatcataattttccacattctttttttcgaaaattccatataaaaaagtaagcaaaataaatacattccttgattaattctaattattagccacccacccacccacccatcaaaaattaaaaataaaaattaaaaagacaaaataaaaactctcttccccttcttaagaagaagccatcttggtttcatttcgtcccataatcttccaaacttcaccagaagaaattcttaacaaacaattttcttcataatattaattctcaagatcttaaagattatattaatacgaagagaaaattcaa

SEQ ID NO: 3280 - DNA, 467 bp, Arabidopsis thaliana
ttatatttgatgcattcacatataccaaacttgtagtctcattatatcttcagagtattcctaatctgtcaccaaaggagataactaaacttctatgtgcttatgctttttgtgtgaagtctaactagagtttgatcaattgcatcatcttgatttgttattaaaagttttatagtctatggatgttacagcttaattaactaattatcctacatagttcatttgagagaaagatataatttgtgattgttgaaacttgaaacttgaagtcttgaagaaacagaaagaaagacttgaagtcatggtctcattcctaacgcccaaaacaacaaagattaataatgtgcaaaagatgtattgggcctaaaaggcctggcccattagctggattccgtaagaaaaaaaaaaaaagtgaaaaggaaaagaagaaatcgtcgttgttgtggagaaggagaagaaggataagg

SEQ ID NO: 3281 - DNA, 1517 bp, Arabidopsis thaliana
gtggctgggcaagataactctcgagacctacatttcacagtttcacatctggttaaggttagtgggatctacaaatcgaagcatatgttattataaagaaacttcacaatgtggttagtgaagcctttatggttaacatatgttagtataacaataattctcaatgtggtgcagatcgagtgtgccaaatgggcagccaaagttgctattatcaatcatcccagaatacccaatgctcaacttcatgctcaccacggccatctacgtcttggtaaaaaagcatcggtaaaaccattctatgcttttatcgttttattacttcttacactttttttttccttcttcattcaggtatctgttcgacttttcgagctaaccaatacattaaaatcagttttcatacccacgaaagacgacaaacggctgctccacaacgtgattgctatggctgcgatatcattttgtttatatattatcggtcttattcttctcttgatcccacattaacttttgtactagtccctgatcccttattgtccagttgcaccattatcaaaaaggatgacgactctgaacaaatgtttccattacagaagagacgtcacaaacctgagaaacacaaagttaaagttagttgcacagagaaaaaagcttttactactatatcaaacgtgcaaacacatataatactactatatacagttaaaaagattgattctatagagaaggacatgcggtactagaaaagtttgcagtttaaggaaaccttaccagatgcgactgttatatatagtacattatctgtttaatctactgtaaagtcagcagaagagttgatgatctgagcgaaagcaaaagcagtaagtacctgcgaccgcattgactacaaaataaatgcggtaattagttttgtaattcgttgactttcttatttactcattttaaaaccgatttggaatatatactatatttaaaagtcatatagagtataactttaataacatgacacgaataacatttgtttttaatgaaataaatctatatcaaataatatttattggatttactaccaataaaactccattcattataacaccattttatattttaaacactcttgaataaaacaataatattctaatttccaaaaatttaattatttttttaaaccagagacataatatctatcatattatggatacgattccataaatgacgaaatgatacattctaaccaaaaaaaaaaaaatcatttctctttgcaactttttggaagagttaattatctttttatgtcatttatcatattttcccaataattgttgttgaaaaaatggattgtcataatcaaatacagcaggattgagaaagacaaaataaataccaaaccggaataatccaaatttcgagaaaccctaaaaccctctctctcgtgtctcactctcttctgcagcagtctccagttacagagccgacacaggcaaaacttagaagaagaagaagaagaagaagcaaaa

SEQ ID NO: 3282 - DNA, 1198 bp, Arabidopsis thaliana
atatatatctgttatgcctatgtatatgtaaaccaaattaaaccggaaaataatgagcttaaatgtactaaaaacgtaagtaaactgaagataactaactacactcttctttctttaatacaaagaaaaatagattgcaagtctttttttaatcccactttgagaagccaaattaattatccatattcattcattagttttatagtaataatctaaggaacaaatgatttatgatatagtatcgtccacgtctggtagattcggatgagactcgtattttcctgattgggaaaaagaatatgaaatccatatgcaacgacaacacgtatgggcagttgttgttcccaaatttgatgtatacaaatgactactagctacagaaattcatatactactaataagaacattcacatgtcactatgtcaggtcataattaacctctattttccactatataaaatttatttgcaccaacaacaaaaaaaggtaccaaatgaaatactctgccaaattcatcttctgttaaaaatggcgtgtttcgcatggtcataattggagtgaggaaaaaaaaaaaaaaaaacagaatgtcacaaaaaaaaatcatctcttttccagttttcctttgttattcctaacttgtctgtaataactaccgaatcttcttcttcttcttattaatgttcaacaaaattcgacatttttgggtctaatccagctcaaaagtttacgtttttatttgtgtgtgtcggtctgtaagagttagttcgatttcttatccaagtaaaggggtttcattggctaaaattgacaatcggggcgggccctagaagaaaatatgaactgtcaattgtagcagacggttcgtgattcatcgttttcatggccgattcgatttccgatttccccatgagggtttgtcgttgatattaacgcctcccctggatttccataatttgccttgtttagttcgtgttatgatggatctttgaaagctattcccttttttttgggtgtcgaaatcgagaatctgagagttgttgtcacttgaagaatctggattctggaaggctgttgttggtgtgttaaatgttggattggaagatgaatccagggccgtagctaggagacgaagggtttgttgtatatttgcgtttgaaaaatctcggtttttgttgctttagagattgttggagaaaat

SEQ ID NO: 3283 - DNA, 1249 bp, Arabidopsis thaliana
tttttgaagaaaaaaacacgaacgatatgtaattaagtaagttgcttttaatttggatctatgttccgacacagatacggacgacgtaattattcctataaatagaaacgtttgtgttccaaaggaaacaaaaggagagaaaaagtgaagtgctacgtggaagagaagacgcggcgagactagaaataatgggctttacggagatgacacgttgatgcttactcagtcaacttgctacagttattaacgagctgcttgacacgactccgattaatcttaatccattttctgtttcccccaagaaatcaagataattacccacatttgggattttttataaaactgttttccgtgttaggtcttttcaatatcagttagatagtactattatttatctatttgaaatctaagtgcaatatttcggataaatatgttttaaagttaaaagttttatatttattcacatcataagaaaaatataggtgttattagaagaagagatttataaatcgatcacacataataactgggaagagaaggtagcttcgaggattagttggtttacttgtcgacaaagtcatatctaccatgtaataattaggtctttttcaagttttgagtttggagacatttatttgagtttgactttggtcttattatatgcttgggctattgtacacgtttgactcatgctgattagagtatgtatagttaaatataataattaaaatgttagaatctggtgtggattagactttcgcgacattgttgaaaatttgtgaatgcatctatctaaaagttggtttagtggagtttctatgtgcacaactgaagtacatcactatatttggacaatattgaattatatttgaatttattgtcttgaagaataatttgcaacattacataccaaatgttggctctcttacggagagcgtataagcgccacttgacgtgggcttatatgggcccggttaagggtaaatgtttagtggccacaattctgaaacagcttcccttcttcggcccatactggagtacaaaagtaacgcaattaagaaaaagcgttacaggattaatccaaaacggcatcgttagaagaagagagcacacatagcgaaaaccctagtacctttatttgagccaacactttcatttctctccttctccaccagttttcccccaatcgctcctccttaaaccctaacatttttgcttcccctgtttcgattctcgagagttatcagag

SEQ ID NO: 3284 - DNA, 1969 bp, Arabidopsis thaliana
tgattttttaaggttactttaccacacagtaaaaacagccagccatacatggcatactcgctagtgcagcaacactgaagctcttcggtttggcataatctatcttcttacatacctcaaataacaaaagaatttgtaaatactatcagttgtcttgtaatatctgagtctattcaatgatccattagcttttgtctgagcattgtattaccgtatcttttagtaagagaacaaagaagactccttttcaagtgttggatgttgaattcatcgaccacttcactgggttaaaccaaagtaaaccgggactctaccgcgagatatccaaaacaggcccgttaatggccattattaagcccagatgtccattaaggcggcgctgagattataagaaggtgaaactttcttattataaaaacccttgacgagtttttgaacgaagaggaggaaagcagaaactctaagaagaaagaatggcgttgaagtttctgaacaagaaggggtggcatacgggaagtatccgcaacgttgagaaagtatggaaagctgaacagaagcacgaagccgagcaggaaaagattgaggagcgttctgaatttcgcgctatccaagaacaggccggtcttgttccgtaagttttctaattctatacctatagccctctcctaaattagattttgattggtacatatatttgaaattagggttagcaacagagtttgatgattggaagtatattctaatggcggcgttagttaattagttttaaaacctttgaagtgaatcatgaatgatgattgcaattgagctaatgatcaaaactcgaatattttatcgaaatagcgtctgtggtaagatgagtggttttaaccttagttttgttgtttcttcttgtaggaggaggccagagagattggagttcttgtatgatccagaactagcagtagcgaaacagaatgttagtagttcaagacatggtgttttgtttcagaatcaagatcagcgagcgagagctacgattcctggtgcgttgtttgatgatgatgataagagacactctgccaatgattcttggcgcaaattccactccgaccctttgcttctcatcaggcagaaagagcaggaaatctggaagttcctttctttatttctttactccattcatgtgtcctgcttgtgtttcttctgtaaacggttacggttttagattgtattggatttcgtttctgctgctaacctgttgtggattgtgtttcttctttaacagttgaaaagaaaagcgagaggatagagatggagtgttgaacgaggacaagatacaacatcggcgtagattgtttaaatacatcgcaagttatcttcttcaggtgttttttttttgagtaggattaggaatcttcttcaggagttgaatgtatagaaaacacagttttttttctttttaatacaaagacaatctttaattgctctctacttcataaagttgtgatgatttttaggtggtatacaagcattactctctggtgaaacacacaagctttttggtttaaaataataattgaatttgtcaattgtctacaacgtctcgaaaatcaataaatctttgccattgtttgatccggaagaaacgaatgtctttgacttctgagtatttgggagtttcacagacaaatttcaacaagcagtcagaatttcattggacttaaagccaatctaaaccggatccaattagcttagatttgcggtttagcacaaccattgacaacaagcccatgaggcccaaatataacatctaaatcacacgttttaaacacggacggctctgattccatctcacattatttcgcttatacgacggcgacggagcaaaataatttagaaccctcgacgagttttcgattgaacgaaacaaaaaagaaggtaaccagattttgaagcgagaggaggagaaacaaaaagaagagcaatc

SEQ ID NO: 3285 - DNA, 2000 bp, Arabidopsis thaliana
tttaccatggttttgtcttactttggttttagttaaataagacaagttttatcaccaaagatggagtttatgaattttcttagtctggctctacgtaatccgataaaaacaaatgttgcttttcacgcatcgaattcgctgacctaagatgcttcgcagagattctgtccagatttttgtatattctttaaatagggggagtcggggagaaaataatgataattatcccaagttcttaattcagtcccttgtttaatcagtgtcttcccatgaaaactcgggcctccccaacattattattctcataatcactttacaaaagtttaaaatagtgaatgtggattaattaatagtataaagaggaagtgtgtgtggaggagagattggttgaagttttgatgtgaatgtctttcaaggcaacaaacattcacgttggaggccatttccaaaggagtcttggtcctaattagggtttcacgtcattctcacttctatagtgtattatcctaacattacccactctctctctttttttttttttttttcattcttatttttaattacctaaccaactttggtttttcgttttttcattttgtgttagaataaagtcaaatatagggcgctagatgtttttcaacatgtataataatataaacggatgatatatttttaattgtttagggtgtagaaaatgtgacaattattagttttatattacacaaatatatggtttcaaatctatatatatatatatatatatataattctagacatccattaaaatacatatgttaggattagattcatatatcttataataattttattttgtgttggctttttctctttttgttgtaaaatctctttttgttttctctgttgaacgcttctttcattttagatcgactatattgttttgttgattatttttttaattataaatcgttagcccaaaattgtgttaacgtgtttttgttcttctattatatctataaataagttgtatgaaagcatggaacgaaactttttgttggttttctcacttccttaagtaagcgattctcaaacttctgagatcatcaaatgagttcttttgtaacttctaaacatactcgatcatcatgaactgtataaccatgcatgtgtagatcttcctcttcttcaaaagtttctaattacacaacctaataaatatctttccttgtaaccaccaatctcactttcctcgacttttgtaatttaaaaaagagagaagattaagacatcgagagactcgaataaataaaaaaaagagaggttagtaatggtacgactgtcgtgtgtatgtgttaaagaaataagagaagagtcaaaaggacaacgtggggaaacttctcaatatgcatcggacgccaacctatcacgcgcctttgcggtgctcacttctacatcttcttcttctcctaacttactatattgccctcaacattctcatggtcaaaacgtcattaccaacgtcttttttagccgttaatatgtacatatcccgtcctaagaatccaaattaaggatccatatacactgtacttttgaactatttaaattgcataagattcaaacaagacttaacttaaaatgacatctattttgaagatttttttttctaaaatgataattattttataacgaaaagaatacaactttgtggtgagaagaacaagaaaaactaagaataggtgttttcatatttaggttaaataataaaacatttaaagttaagacattaattataacacacaaaaaattaaagttggaattaaatgaacacatgtgaacaccaacctcgctctctctagaaagccttcaaaaccctattataaatacacacctctcaaactctctccctttaactctaagtttttctttcttctttctctgctctcaaagctcaagagaactctatccttattaacttacaaggataactaaaaccggtgtaatcacgatcatagtagaag

SEQ ID NO: 3286 - DNA, 2000 bp, Arabidopsis thaliana
aaatactacttctagaatttgccacgacaagcttcatttatgtagggctctctatagagtctacacgataactgtcacatgcatggctgaccaatttactatgcacctacccatttttttaatttaatggcgtttctctagtatctttttttttttggaaaatttagttgaagcttagttcgagtgtctaatttgccgatctctcactcgatgaaaaggaaatggatgttattattttcgactacaccgagcttccctaatcggaaactgaatctccaactccttaatttgtttaactagaccaaattaactttattatcatgtcaattttatagagcaaacaaaaaaaaatggtttttctagagcatatataatttttattactttgattttaacttgaagacaacttcactacatcactacaaatatataaaatattttaattatatgttttgagagttcttacataatatctaggttacaatattataatcaactaattctataaaaatactttagatttttttttatgtttaaagaggtggaaaatggttttagagaatttgtagactttttaaggagccggagatgttgatattttagagaaaactctagaatttggattattgtcccaataattaaacttgatgtaaaagaaagtttaaatttagacaactaatctgttcgtttgttcgcctcttgcagttgcggcaaacgttaccgcaggttgttgttcgtttcattattctaaatttagtaacatggtttttgtggctacgtttagttttacaaaattcggaagaaattggaaatatgtatccgttggttacaacttcaaaaatatacatcctctatatactaataatgaacaaatttcatccactcataccattcatgcacaaatttcaggtcgatgtccagatttccaaatggaataaaaaggaagagaaaggaagccatacgaggagaaatgaaacacaagtaacatcaaacccttacatacgagagaagccgaagaagacatagttgattcgtcgtcgtggagcaaaacaaaaccttaacgtttccatcgatgttcttggcaagagatgcatgagagaaagtctaaaattcccaaaacaccacttctgttttaaaagttacacctatgggtgtcaaaatggttacccaacccaactctactcattaccaaatgagtttacagtggcatcttcaactcatctctagtttttatctttatactctatttttgtatctatttcttcttttaacaaatagatatctctatttttgaggaaccagtggagtaaaaatagatatttatatattttttttttatatttagaaaaaaagtagagacaaccactggagatggtcattataagttgactcaatttatctaagaaatgagttcagacaacccatgaactcatttaatttaatgggttaaattgttgaatgggttgatccattaatataataaataaaacaataattcataataatatgatcatcattactattatttggtggaatttgcgaatttacatttctggccgggaaattacggatttacgtttttagcgaaaaattgtagatttcgtttttggtttaaatttgtgaatttttttgacggattaattgcgaatttaagtttttgacgagaaaattacgaatttttgttttttggcggaaaaattgtaaattttatagatgaagttgaattgagttgatacatgaatcttgtaccattttgacactcttacttaccacaaaaataaaaatattttatgaaataacactatacatcgatcaggactatattgtgcctagaatggcgattatagatatgggcttcagcccaataaatataatcatccactacgatgcaccatactgaacttccgtacaaccaaacacatcgagagcttctctctattcatttccctaaaccctagcaaaaacctctctctctctctcaattcacttctcctccttca

SEQ ID NO: 3287 - DNA, 1136 bp, Arabidopsis thaliana
atcagaagagcttctagttttgttttgtcgctcttaagctaacacggtccagatttcttttgttgaagtactcatgactcctttttaattggatggtacggtggagatgagccaccaccacattatttagtttcctttctacttttgttttggaaaatcttagtttctctacattacgtaaccaaaatcccactatatagttcacgtttgctcaatggtttttcattcgaagctctcctccgtgaaagtggctctgttttgctctgttttaaggttcaaattactctgttttttcagttcctaaacatgttttaaattagctaaactgtctcaaactcttgttattatttttcttttttgttgattaattaatttaacattcaaaaaaaaaaatcccactacagtatatatgaaatataaaagtagtaagttaaaagaaaattccaatacagtaacttcaacatgtaacataatctgtgtaaatttttaagtattatttattttgctaaatgtttttttgtcatcattgttttgctaagtgtttattattaactttttatggaccaggtttctatttttaaagtatcatatattcttaccaatagggttttgtcatcctctcattggttcacccagatttgttttttaattttttaatttttttgacagcaatttgttttttaaatttaaattgtagagtttgtaaatatattatattatactaaatttaatcattattaaaaatttaactcttattttagtcatttattagctttttcaactcaacatttaattattattatatatatatatattttttctgtttcttattaattgatttttttttttataaatatttatgtattatttattagtcattattgatgaattttaaagtttaaaacaaataattgaatattattggtttagaattataaaaaatataactcataaaagttactacatttataatatatttttttaatctctgtgtttataatatagttggcaattagatttatggtcaacatcaaactctcgaatcaaagtcagcttcttcgagaatgaaattggaattttaaagtccaacttttaaaatttatctttctgctttcacagagacgacgagagaaaca

SEQ ID NO: 3288 - DNA, 2000 bp, Arabidopsis thaliana
gattgaaaatgggaacttatatataatcggaacatgaaatattagttcaatattctttgtacatttataaaaccataaatttgtgtaggaaatgaatccaaactttcttttttagtatttcatgtattgaaaaatgatattttagaacaaacttagagaaaatcattgcttaaaactgagttttttttttatatcagcttacatataaattaaaaaaccataatctttttaatcaatcaataatgaattgtgttattattttaaaattttaatatcaaaataatgagaaacaagaacttaattaggaaggacaaaacaaggtttgctacaaatgcatttgcgggtgaatcctttgcaacgaccgtcagtgaaaccttcgctaatgcatacttggcgacaattcctccatttcagacacatacccttccagtccaagctctttgcttcacacatttgttgtccttcaaccatctctatatctataatataatacattatcattattcaataaataattgaataataatataattataatcatataaacaatcaataattgacttattcttcaatatcatcaaatattaaattattcaagtagatgcgtaaaaccccatgcattaaatattaaaatataagcgtatattatatgttttagtaactttttaatattgtgagtttgtgagaaactagatttgcatacctggtgaagcaagaagaatggttaagaagaaaagtgttggaattaactgcatagaggtagtagagctcttcattttatttcctactaactagttaagcgatatgaatacgtggggagaattgttgatattgaaaattagcgtgagaatgtcgcatttatagtaaacatgtgcacaaagcttttttggtatatcaacgtatgcatacgataatgaagaacaataggaatatgtggaaaagaatctgatcttgacgaaaaatatctgcaaatacacatacgagaatattttgttgtttatatatatctctagtactgtactgtactggttaaagatatatgctaatgattttttctttctttaaccactatgaatagacaatctaccataagagaagagattgaatcaacatagttaaagtgggccgaggggactgatacaatgaacgtatagactatagagtgttaagaaaattacaaagtggtagtaatatcatagatgaatttagactaatgtgaagctagacagatatgcaaaaaaccattcctccataagttcttccaaaaaaaattcctttataatgatatatttgtagtttagattttggtgtgttttgacttttgagtttatatctttatccaataaaacaaagttacgtacaaaattgatcaaagccagtcacacagcctaaaattaactttagattacattatcactaacttgcttagataggaaaccatcgttttaatcaatcaatcataaatttggttatctataaagttttaacataatatcaatatacagagaaataaaaaatttagtacaaatgtttggagtttggttgttacataattcgcagattgtaaaatttaatagtttattacattaaacaatgatgtaagcacagttaataaattattattctaatgacatatccgatccagatgcaatctgaatttcactcggaccagtaaatttaccaattgaggtcggtttgattgcctataaccggtaaccggcgagaccgacagatatcatcagaaaagacgaaagagtttcatgttttttttttttttgtttaggcttttagccaaactctctctagtctctctctctctctctacttgagagtgccgtctccattttctcaacgtagtcgtttattttgaacaaagactctctccgtttaccaaaggtcatctcttttcttcctccttctctcacttttgattatattttctgacttcctcctcctttctcagaaattctctttcgatcttctctacagtgttgttaacg

SEQ ID NO: 3289 - DNA, 180 bp, Arabidopsis thaliana
tgttgagagattctagagctctccggtcaaaagagcggcgaggaaacaaaacatcgaaaagttaaaaagggcttttgggctttatgatgtagcccactgggctttgttcaaagaaacactcgttggaggaataaacatcgtgccgtttttttaacatggataaaacgtcaaccactttgt

SEQ ID NO: 3290 - DNA, 1007 bp, Arabidopsis thaliana
ttgttataaaacctaaaaatattatgttttgagtatactatgagcaaatgcattattctgtgtattgtggttttgctaccaaaatcacacataagaaatccaatttttttctttctttctatgaaatcgcatgatctcttttccaaattcaactaatttttcggcttaggagttttttttcattcaacacgaaagaagcatccacaaagatggatttacagtttagtagaatgagaatccatccacaaagatgatcccacccaaccaggagatacaagagctgacggtggttaccaaacaagagatctccgttctaaatactgttctaaatacgtcctcatcgtcatctcagttggtcccaaggtaaaaagtactattaacgtaatgactacagttgcaaaatacagcttacttaatttttctcaaaatctggctaagaatggtctaatgggagtccagaatgttgctatggatttactagaattatctcatctgtaccatgttagttgttgctgatttacaggaagcttcaccattgttgcaacagagtacataataacaatcacagcagcaacagatggtcccattgcaacaacaacaattgttcagttattttttctctaatttagtaggtaatttttagtgtatcccaaatattcatatccatatccattattcttgtttgtcccttttatccgaaatggaccgacctaaacctaaacatcgataaaaagaagagtcaaattgtttggtcgaaatgaatctggttcattcagctttcgaatggataaaagcaaaacgacacgtagttcaaacgtatttttctaaatttcattttttgtttgaaaagcaagttactgagggaaaacggagccacgtcgaacaatatcttgacacctcacaataaacgacacgacgtgtacactttcgtcaccatgtagatttctctttttgttttccccctcaaattctcactttactcaaaagattcctcggatcatcagaaa

SEQ ID NO: 3291 - DNA, 1612 bp, Arabidopsis thaliana
aaataaggaagatccaaagaattctcataaggtctaactcaagccattgtacagaacagattcaggtatggcttcgttggagggaaaccaacaaaagttttcctctttcattgtttaattggtatgtaagttccatcatcatcatagttattgagcattagaataagatgacatggcatgtgagtctttagtgctaaaggagaaggatataatgaacgattgagatatttttgggaaaagcataaagaggaaatggaattggaacaatcagaaagaagtatagaagaagaaggagaagaagaagagaatatggttctgtttgttaccaaaagcttttctttttagtttttactaaccattgactacatacatacattaatacatagatgaagaaagatcttggtcggcataaaatgtatgacttaacagagagagcccacacttgtgtagcttacgtggcaggtcaattagagatgatcacatagagtcactgcccgtactgccctaaggattcgtagtaacaactacgggcagcttcacactcttctctttcatctctcatctctctcttctcctatatctgagattctgaacaactcttctttgatcacaaatctcacactttttccattaatgaacagagctcatttcttctagtccttttctctttctttcttcctttttccgctaattacagagcttttctttggtacgttcttcttcttcttgtatctgtttattttgtttcttagattattgttttgtatgttgtcaaatattgaagtagaggacaacctctaaacttggttgtttcctctgtttttcatgattctttctatgattgctctgttttgtcttttttttttctcgtcaataacttcaaaacgaagattgctccatatttgataaatggacaagaaagttgtctgaaaattttgctttagttattattattgcagatctaacggttttcataactgttaaatacagagtgaagaaagaatggagttgaaagaacaaggtatgagtatgaggttgtctctggttctcggtaacgctttagtgctaaactgcgccgctttggctttaacggctactatgctctcttctttgctagagctcttctctcaggcaagctttttctattttcaacttttttttttttccttcttaacaaacgtttacaagtattcgcggtcgcacaaaacaacaactttataaaaatagatttttttctacacaaaagtttcacacaaatttttttggctacaaaactaaatcttgaccgacttgaagcgttacttcatcagaatgggtggttggaaaaatatataaaattaaaaagttttggttaaatattgtgagggtatgtatataataatagctattagttgaggacggttgcttttaatggggaatattaagatagatttttaaaatctaaattataaattgtaggtccaaaaaaaatcaaaaaggtatattccatatattatgcttccaagtttttcaaatttaatgtctagaagaagcccatgtcctaatttagtatgtcggcccaatttgtaaaatcatgttaacttggtaaaagattgtttctggtagtgataaa

SEQ ID NO: 3292 - DNA, 2000 bp, Arabidopsis thaliana
ttgtaatagctatcaagagcttatagagttgtatattattcgtaacaatgtacataggaagactttaaggagataggaagactttaaggagaatgatctcgatggacatgtacacatatatgttatacctaaagactaaaatagagaatctagaaaaacataattggctccacatgagattattgatatttattaattggctccacatgagatgattaattattgctaattggttgatgtttgacatgttcaccgaaatgagagaatccgcggttggtgacggtggaggcaatataattatttccaaactttggaaaatcgatctatctttagttttttttcttttctttttcatatagactctgattctactacagaacttgtaaatttttatattatgattatcattcataagaatgtacaaaatttatatagagttcaagaaaggaggatctcaaaaagaaaatctcgatggatttgtacatatctctaaagatggagtctatatgattataaaaagataatacatttcatccaaccattagcaaagtggtctacattaggatatgaagaagtggtctacattagaaaactattattatccgcgagatattttgttttaggttgtaaaaagaaaagggcagatattttcgtttgtaacgaacgaagcggcagatattttgaagcaaccactgtcccacgtcagcaaaatgtctcttagcgcaaatggatatttgcgaaaccaatggctaattttttaattagttgtttattcgaatttatcctatcaacattttatattttagataatgatacttaatttctcttggactaatctcattatccaaattcaaatgatatttaatgaaagttaagtaactgttttattaatatttttttgttgtttttttctctttaattcgagttgacaaaaataatattagagatgttacaaaattatccagataccatggtttgtaccatctgcattggaagaaaatgaggaaaaaaactcataatttgaccataaaaattagcttaacatgtttgcatttcattttcatttttcatattacttgtactttttagttaaatagtggcaattgtgacaaaaatgacacgtgaagtaaactatatcatgttgagaccgcatcttcagactcttcttcattctatccattttataacttaacctacataatttgtgacgagtatattgcgtgcttgaccaactaatgttaaatacattttctcgagaatctcttatgtttgagctgacgaagttgtctcatctccaataattcactgataaggaaggatgtacttaaccttaaaactctgaaatttgtaagcatccatcattctttaataaaatttgttacaaaatccgtatgaagccaatttgatccatcatccatatatatgtatattctagaaaatgtaagaccaaaccctagagaggctcacacgaattctggtctttctttacaaaaaaaaaaaacaaaaaaatattcatgtgatcataccacttgctaaagaggcctcgtgtaaatctgatcttaatttaacttataaaaaatctacaagtcaaaaaaaaaacaacgaaataatgacataaaagacaagaaaccaaaactaccaaaataaaaaagagcatccattatctatatatcatcagaagttgacaaaagaaaagatcatttttatttttatttaacacaacctcccttctccttgagctccaaaaaaaaatatctggctgatatttgtcggagatattattagcgacccagatgacgtggcaatactatgacacgtgtaaaagcgacgccatgtggaccttttgtctctctctttttttccttttcatctccttcttctctcattcctctctctcttaaagctctcttctttggctctttcgaagaagaaccatttttatttcctaagagagacgacgcagttcttttctaaagcaccggagaggaggagaagcaacg

SEQ ID NO: 3293 - DNA, 2000 bp, Arabidopsis thaliana
agtatatatttattcatgttgtagcttttcaatattattaaccatgtttgttttcattattttatttttacataagtaacatattttcatgccattaaaattttacaacataagataattttattttataatattcaaatttccaatttccaatttcctctttagtcttaagtcttaacatgtcaatttttgtattaaaaaaaaaacatgtcaattttttgtacaaaaaaaataaaaccatgtcaatttaggaggaaaaaaaactggaaaagcctgacaaagaaaaaaaagctggaaatatcaaaaataaaatgataacgtcgcctgagagattcgaactctcgcggggaaaccccatgtacttagcaggcacacgccttaaccactcggccaaagcgactttattgatcatgaatcaatctaaaatatatatatatataaacctatcgttttgaatttttttttttggcaaacagcttttgatactattatatatatatatatatatattatccccacatatctttagctatgtctttttcgaaggaaattttgaagtattaaattaagtgacgatttacacacatatggagtaattaaatcgttttagcatatcttgtaatgttgtctctcttatccaactattctaaagaaagtggtgactagaaaatatagattatatactatgtgaccaactttttagtatatctttataaaaacgcataagatatgtcatatgtgtttcctctaaaacttgttaaagaaatgaaaaatctgttggtagatgtgaatagttatggactagtttggctttaaaaagaaaattgggcccatgtatttctattcatgcattggacatgtacaatgtacaaatatattcatgattgcaaacatgtagtatatatgctgactatacgattgttatttattcaaaagttaagaaaatgcacaagatacacatggacgaaatcgaaactaattgtacaataaaataataattattagtattacgaagggaaaagggaaatggtccgtactagttgtccgaacccgaagaagccccaatcgctgatgcaactgtctaggagccgccacgctgcgaagaagctctagggtttgttcgtcttcttcctcggtttcatcaggttttcatcttctcgattctgatttcggcttctgttttagctttattcggcttattgtgatttaatttgagctgatttggcattattgctgtgtagttaggggtcagggttttaatctgatcgcgtctaggttatgattcttttgatgatttcgatctttagaaagtcaattgatttgtttcttcgtatgtagctcgtttagctgacagatctgcatagtgtcttatcagttactagatctttgtgctatctctcactctgatttctggattttgattccttttttttttttgttagctgacatacaagtgtgagtgatgtgtgtctttgctttgtttccattttagtttagtttctcaaaatggaaatgatgaatattgggggttttcagaacctaagttgtagaaatggtctttttttgttatcacagaactcaaaaggtacttggtaggagcgagaagaaagtttctggagaattgctgaattgtttctttcaatggttttgtttctaaggtactatccgagtccaatgtttctgagagttctggtagcttgttaatttgttatactgaatactaggattgattttggcaaagcatgtgatgtttgttgcaagttcaagcagatgtgtttctttttataaatttagaagaagtttacttccgcagccatctatgattctcaaagttcttagctttgcgtttgattcttttttctagaaaccattggttagctttggataatgagtccttttctgcccatgatgtatttttctcagatggtaatcaagattgttgacggtgctctgaagatctgttgacctgctcagagtttgcttaaaaagtttgagaaaaa

SEQ ID NO: 3294 - DNA, 2000 bp, Arabidopsis thaliana
gggtcctgatccacaacaccattgactgatctttaccgatatatatatactttaccgaagatcgaagcacacatataactgtgactgatccatgcaagtcaatttaaatatcgtcatttacatgcttttcttttctttttcataaatcttccctacacttttgttgtatcaagattttggtattcttgtaccttccttatctttaaacatcaaggttttactctctatgttttcttgtgtctccaatgagttaccttttttgtaacagcgattggctatttcccctgtctttatcgtttaagttttaccttttcatttgtagggaaaccaacaagatagaccctagagggtttttaaaagaatgattgaaatctgcacttcaaaatacatatatgactcaacgattattaaaaaaaaaaaattgcatgcttttcagctgatattatatataaattggttggactatatatgaaattttaaaaacagtttgatgcactctttcaaaaataaagttttgccgacatcaactacatgttggaaattttgagaggttaaaattataaactataaactcgacaaattaacattattctccacaaaaagattattctctacaattcttctctacacgcgcagatatagattcattgatattatagtttctcttgacttcatttgaatcattgaatgttgcactttattatcaagcaataatattctatagccttgacattctcattttggtcttggaacgttctgccaccagttgaaaagattagtgtttggtgacatatgacgacaagattggtaagtatataaaccttttgttgaaaaatgaattaaaaaatctgccaattgacttgtttcaccaaattgattttgggcttagtactcttcttttcatggcaacaggataaacactattttttgtgtttgcaatgttttaagacctttgacccaaaccaaccaattggatcgataaaattgggacctagttactattctgatatggatatattgctaaaacatacaatatcgaatctcgcggtgagttgtcatgaattacatgttatctggtcggataatgataaaaaaaaaatgtttttccaaaatatattaatttaattagagcttttaatgttaaacatttactatatagttttgcttcactttgcagaattaaaaaagaaagaaaaaaaattggaaaactttttaatattatttgtagaattaggaaaatttttttaactgtgtcacatccagaaaatgggcctaacaaccctttgaaataaattagaagacaggggctatataatatgggcctcgttcacttttcttccacgccaacattcatcccacaacaacaaaacaatcgtcacttttataattcattccaaaagaattttaatatatattcacacaaacatataacatctaaataaataaatcgaatctctttcttttttaactcatataaaaatcgatctttattttacgtgaagaaattattctctgattttatatgataaaaatagaaaaattagattcaatatctacattacttattctggaatggtcatagtcttaagtcttaaatgcatgtaaataaatatatgaatagcgattgtctaccaaaaaaaaaagaaaaaaaagtaaaacgatacggcagatgcacctaacaacaacgcgtctctctctttctctcttctacttaagaaaattcagaaaagacaactcacaagtcaaaagtcaccgagtcacatctcctaactgaaaaaaactcgccgccggagccaccatgtgcgacggagattgccgtcctctcggtttcctcttaggtcttcctttcgccttcctttctctccttctctccatcatcggtgtcattatctggatcgtcgggtcagtttatctcatctctgatttttttgattttgaatttggaatcatcaatttagcttctggttgaaatttgttttgtttggcagattgttgttatc

SEQ ID NO: 3295 - DNA, 917 bp, Arabidopsis thaliana
tgtatagtagttgattacgagaatatcagtccctaattataacgattaaaagtaagattttttatttttcttctttccttttggtataatcgtatcatcctttttgcttagtgaatttgaataaatggtgttgtttttggttaccaaatatcggagaacataattgaaggtgtcgaggaaaaaaatcgaggttatgacgagtttacaacttctaaagacagtgaaagatattcgaagtttttttggacatatatgttgggttctacaaaaaaattataaaatatttctttgagatagttagaccgcttacaaaaatgttatgtatggaggtcaattttgatttcatggatgagtgcaaaaaatcaattttaaaaaatgattgtttgacaaatatccattcaaaatatactaactaagggattagatcacgatattaatgacatattcttgttttccattttttcctttaacacacacaaaccaaaaaaaaaattaaaaaaaaattttaaaaaaatagtcatttttcctctttttatatctaaaaacaagaaagaaaaccaattaaaaagaagtgacagagattgaagtgtgaagccatctgacgtgggacttatcttacgttctcttctaatctctacaggtcatctttctcggtggcacctttattcaccaagcaaaacaccgcttctttcgatcatctatctctttcccattttcttttcttgacttttttttctctctcttcttgttctattataaacaaaaaatgtgtaataattattcatcaatcctcagaataatacaaataggggagtaggtatctatcttgtcaccctctctctctctctcttgttaccaagatgagcttctacaaaagaagctttcactctttccttggccaaaccaacaccaaaggg

SEQ ID NO: 3296 - DNA, 2000 bp, Arabidopsis thaliana
tttgtttactattctttttcttctccattttgttatatcttgaattttatttaaaattcagtcacaaaaacgaattaattacttagatgttatagaaaagtatgaatattactagaatatcatacatcttttaaaagttactcatatattttgagtatttgtgtaattataattaacacctttgattagctaatattatttaatttgtttttaattaagaaataaataaaaaataattcacatcaataatccacgttaaaaccgaaaataattaaaatctttcaatttcccaatatttttagaaaatataattggaaccaattgtaaaaatgtaagaatatttaactaataagagatgtactcgacgagttaaaaatttcataataaaaatttataatttaaaaacaaggtaaaaataaaaatagtatttttgtgagataaatcatatatatgaaagttgaccaattctctccatatgattgacacatcatcactttaacatttgccatgtgtccactgaataattaatgtaagctcttcaacttttaatttatagattaatgatatatttattatttaattttacatatttaattgtactaatactaaatttattttgttattaaatgtttttcaataaaataatttgattggttttctcatactcaaaagatttttttctgtaatcttaactcaaattatgagtgtatagtagtcatggattaattaatagtttgaatagtttgcatattgttatatatctatataataaatcgccgagggtgaagagtatgtaagaagtttaatcatcaaattcttaggtttcgagaatcccaatattaccctctatttaattagtttaagacgaacattgtttatgaattgtgtgtataatgcattgttgagaatgttgttagaaaaaatatattttaatactaagaataattacttattatataagtaaatgattagataattaaaaattatatttaaattaaacgatacaaaaaatttgaaaataccgcagcatagcgcgggtgattaactagtgttactaataaatatagaagaacggttttataaaatatgttttggaacacataaaatataggaatgggccgaatggccttgtgtgtggagaaaacatttgttactatagtgacgaaaaagaaaatactcccgtgaagaaatttaacagcttgtgttacttacttacttgtttagcactttggttctccattcaaatatctgaaccaataataatagaccaaaaaagaaccaaaatcctttttgtacctgctttgtctgttttataatgtccatggctaagcccaatttttgtcgggaaggcccattatcaatatatattaatttgaaggaaaaaactaaaaagggatttaaaaaagagagaaccaaatcgaatttctaaaacactcaatggatcctagaatccttgaaccgaactatccaacaccgcagagaacaacacaaagcgaatcaaatacccaggaattaagagcgaaccggagaaaaccagcatcaaatgtcaaaacctttctttttctttattttactacctcttgtgctctatttccagctcgagcaggcaatttgtattggtcatcatataggtttgaattttaatgaattggtcaaccctgaagtcaacgagatatttcgttttgtgaattgtggttaaacaaaattttgattttgagattaaaattgtagtagaagtttaggaaatagtgtagacttacttcttcatggcgaaaaaggtatgacaaaaaccataagaaccatcgtgccgtctttggcttgagatattacactacatgccgttttgtgtacaaaaaaagcaatgttacaattccgacgaatctgtgtgtcttgagagcagagagagtccaaagcatcactatcgtgcttctttcggcaaccgtgtctgagacagtgagactccgaggaaaactgaaggggaaatagatagagcgagagac

SEQ ID NO: 3297 - DNA, 2000 bp, Arabidopsis thaliana
tatataaaccaataagaaaaaagttgcaatccaaaatccaaatcttttgacttctttctactgccatatcgatcaggtttctttatttaattcttccatgtgattaatatagcttatgattttaggccttcattataccggaaccgaaaatatgcaatttagttggaaagaaagatttaaatttacaatagtagatatttttgtcgttaactgttaaactgttagagtcttaatacatttcataatatcatcgtaatttatgcgagtgtaatagtaaatgaattttatagagttggaaccaaaaaaatcttattgatcaacaaatacaaaaaaaaatcgtagaattctttgaaatttaaggacaagtttcacgtcaataatgagcaccattacttgcacactttcatttctcccacatgtacatgcacatctaagagttttgttattagaaactttaaaactgaagcacctaacatatgagtgtgttcgaaaaaactggcatcaatagttttgatatttggaggagaatatagagtgttaatgtagtttgtggatgaaaaaagtaaataaaagaaaaagatataccaatgaaggattatcataattgtatggtaaacgaaccctagctagagttgaagcttatgtattaccgagcgagaatttagtatctcacatcttcatgaacttttatcaatgcatagccaaatgcaatgagctaacaaacatatgatggagcaagcgtcacaattcaaagcaaaaatttaatcattttttcgagctattttttttgttcttataaataagccatttgactttcttctcaaactaatctacttaaatattttatttgaaatctaaaatttgtatgatagtataagattttagctgagtttattttccttacttctccttatgagaagtttaatcgccaccctcaccatagatcaacttcatgtggcatcctaaaaagagcaagcatatattagaaaaattaagctaaaaaagcaatttaaaactttgaaaatctacggttggattaagcacgcactagtgtggaattgcagcattagggtgcattagggtgatgctttgataaccatcttcaaagtagcagtgtgccttcactagattcgcgtggtcagtatagtgagcccacatactattcaattaatcttttggtgacaatcgattcaatttctgaagaaactaaaatttactctaaagaccaaaaacaaaaaaacgaaaaccattttaaaaactacaaacattcaaggtcttcaatttttagttctcttataatttagtgaatctacttttttttgggttggttctaatagcaacatctaaaactaaaatctcaaatccaaaaactaaattaaaaaacaacatacattcatgtagccttaccgccttaataagctatgaatgggcgttcgggtattcgattcggttccagttcggttctagtttggttccgattctttcggttctcgagtttaggagctttgtaggaaccaaaacaattttgctatgttcggttccggttttaaagtttagaatccattaggatattttatttcggatattttcgaatatttttcggatattttaatattttaatattatttttaagagtatattttggattttttcggatacctgaaatattttggttcggtttagttcgattctaattattataattctacaatttagatccattcgagtattttactattttggttcggattcgagttcggttctttttactttggttccaattcgattctttcggttcgatttattatgtccacgcctagaatatcttgataataataccatttacacaaaccgcgttaagaaagaaaaacacgcgtaagaaatttacatttccttttaaattaaattgcgttaatttctcacttccctttacttcttcttcttcaccatcacaaacatcttcgtctcttgaagattccaaaaaaaacaaatcaaaagct

SEQ ID NO: 3298 - DNA, 2000 bp, Arabidopsis thaliana
taaaaaattacactagctaatgaatgaataaaatgatagatgatacttatgtttgattcttgattttgattttcatcggatgccataattgagacaatagggttacaatatattgattaaggttttctaataaaaataagatatatcacagattagattattttaattatagtgattagagtttgggtggaagccacaattatttaatttaattaaaaaagatttatttttaacctaaccgctatcgcccgcaaccgcaaacgcttgcgggaaggagcttttgaaaacggacaattttgagcggtccaaagcgatgtctagcggtttttatgattggtgtcaatcgctaacaaccgctaacaatcgctaccaaccgtaaacgctgtgtttgcgggtggtagagggagaaccaatcaagccttaagttctggttttctaccttttttgtgtcaaaggttttcatatttatgatattttaaaaattatgtgtaaaacaataaattgtgctaagcccaaaagagaataattgcagaaacacgatattaaaaatacaaaaaaaaaaaaagagaaagaccacccatgcctattagaggaacaaccaacccataggaaaagatccatcggagccaaaaaagtcaaacgcgaagatgaaaaccacaaaatctgatgtccacactcatgacggatccaggtctaaatccgtcgtgtgtggcagatctacagtaaaaagaggtgaggcatttaaatccgttggcatatctacaatgaaaggaggtgggacatgtgtcccacacttattcttaataagtatttgattgatcaaattttcatataaattttttttaattcatttgaaaagattactccatataaagatctaaaatttaatttttctccattttttgagcttaattgccggctgatcccttgtttctcaaggaacaatgctgagtcgaatcccatatctgtctacggtggtgtggtgtctcctccaatgatgtagcggtagctcttatttgtcggtagaggtctctttgagcatgatgctagttgaggacgttggtggttgtttggagatccccttggctcaactgatgagttagaatatgcggttacaacgaagattgtcggagaaacggtgagttttgtagttctatttggtggtcaacgactaatcctgtcatgagggactatgagccaataagcctctggatccaccgtaatggtttctatcagaccggattgatgagattttgactcgaaagtttcttagattttctggtggtggcttgagacgttaaatcccagtttatcaggttgcttaaaataagattccaaagtatgatcaactctccaacaaccggctctacattgttagatcccattttaagaaacctgataaactgggatctaacaatgcagagccggttgttggagagttggtcataccttgaaaagtgtggcgggtctagtgcatcggtggcgtgatcgaccgaggaaatttgaatctcctatcgtagatcgcatgcctgagatgcacaaagctgttctctttgaatccgccaaaaactatgtctgactcttttgccttcagtcatcaccgaattccgattctcgagccgtcgtcgtcatgaattttttcttttaccttatttggtaactgttgtcttgaatattgacccgaaaatccaaatctgattagattttaataaaaattaaaaatatatattattctaaagtttttactaaattgatattaataagtcagagataataatggtagaatctgattgtgaagttttaaagtcatcatggtcgaataaaaaacactttcgtgtagttgtaatcattcattaactaaactcgtaagaaatataacacttataaacttacaaatccacgataagaattttctgttttggggcctaaaaaatccacgagaagacaaaaaagggtaatttgaaaattttcagatagaaacagtcccgtcaccggcgacg

SEQ ID NO: 3299 - DNA, 2000 bp, Arabidopsis thaliana
tttgcccagataaaaagataaaagagagagaagaagaaataaatgtgggatttttatttaaaaaagaattaaatacgagattgatcagattggtggaacaaagctgtataaatttgttagttgttaactagagagataattttttacgaaatagcgtaaagctgtacagaatttgatgttacttttttgattggtaactatcaaagcggtatgccctatattaaaattgtattaaaattgtatgaagttatcattcaaattcctagtttaacttttggtctatgggaattagatccctaagttttacatcaacatatcatttgatcatggcagtgtacacaatagatttttcatatacttttgatcaattgtcaaaaaatttaataataaaatttaaaaataaatgaaaaatggttgacacacttggaccattacaaaaatgaggagctcaagaatcccaagtggttttcactttattctttacaaatttgtaccgccataggacaacttatgtttaattataaatattagcagatcaatttttttttagttgaatcgtgttgggacaaacatgtaatatgattttgagacaaactgttttgaattaatgacacaatttcatggtaagtaacatgccttattatataatctatgaaaaatatttggattatattcacctcctttattttatccaattagaatctgacacctaataataagaaaaagaacttaatttaattataaatttaatttgccactaaaacgaaattatttatctgtttgggtttattagaaaaggtgagagtttagattttatgattaaacaatataaatattagtttgaatttatatttaaattttacaattaaacgaggttaaatgtttgggtttagaaagtacgattatgatttagattttatgattaaataaggttaaatattagtttgggtttataaatagatttaaattttacaattaaacgagggtttagtttttttacgattaaatgagtttaaatgacggtttgagtttacaaagaaaaattaaagtttagatattggaattaaacgagttctatatcgggttggatttacaaaaaagtggattttaatgattgaattttttttttaatcagataacatgacaaattcaaattggttattaaagagggagtaaatgaattaggttcacctaaaggtgaacccaaaaattattcataatctattagatgattttatatttttcttttctttctctccctccattttgtttgaaattatggatttgattgctaacttgtataatagtaaaattggtgaattgacgatttttaaatgcaattcaacaagtattttatcaataaaaattatataatgttaaacaggtaaaaaacgcataactacgagtccctctgccgtagctattaaagcaaattagtatgtatgtaatagctattgaagtaattaagtaaacactacgagtccgacgttgtgatacaaacaatcccataactaaaatgtacttaggtctaagccagtaagttcatgtatataacttagaaagtggtcaatttgagcaattctcctcttttccttttgtactctaagaatcaatttgattttggtgatacaaaattaagtatttcattttcagttgtatattgacagaaataaaaaataaatcaattttatattattttatcttaacaagctcacttcagggccggtattgggctgagtaaggagtccaatgaaatatgtgcttcgacccttagattatttattgtttacaaatagacccctttattttgtaaaatagtaataagctctcttttttccctgtcgacgatttctctctctctcattaggctcgaaccctctttcactctttgtgtctgttaccaaactctacccctctctcttatccgctctattcagagaatcttttcttcaatggactttctctgaacactcaaatcgaacagagagtttaataaataa

SEQ ID NO: 3300 - DNA, 1802 bp, Arabidopsis thaliana
atcaagaaaaccaatcttagagaggaagattgagagtgttcagaacttcaatgttgatgcaatttttatacaatattatgttacttgtaggaaaaaaaagttgtctatgcaattcacataagaaatgtaaacaagagatggtgtgttttcatctttgttctttttttcttttacgttggtatactctttgaattttcgcaagtattttttaaaatttctatttctagtaaccaacatttcattattctattgcattacataaaaaataccaattcaatactctctacgtttttattgtttttgagattaatgtctagatactctggatcttttccactttactttgttcttgcaagaattatacttttagttcaagttagtggatgtacactatagagtaggtgagaagaagaggacacaaacaagattacagaagtcttagtcattcatatgaaaaatctcacgcttacgctttccatcagtttcttagttgtacatcaaatctcaaaaaaagagatgttgacactggaacgtaagccccgttcagtttggtcagaagaaagacccaagtgaataactgttttgtaacgaacggccatattatcattcgtcggagagaaggctccaaacacgtgtctcagccatattatatcattcgtccgagagaaggctccacacacgtgtctcagccatatgtctatccgacgtaaagattctctcgttgccgaggttccgcatctctacggaaaagtgacccgcggacttatctgggcctgaactttgacaagtttatagtccaatcacttcgtacagtgacgagttgaacttaccaaagttcagatgtatatataaatacactagatatcctcataatcgtcgatgtgggatgaagttacgtttgcaagctagaatctcaccaaatcggtattccttgggccttgacggtgcaataagaagaatcgattcttaaaaattgggactctaaaattggcgggttgagccaagcccgtgcaatagtgcaacgcatgggcgactcgcgaaagcccagatagcaagctatcttagtgagctatctccctcaaaaaatagagttaatatcgtgtgggccgatggcccacatatcagatattaaactgataagaacagatactacacttgatcttagccaaaaggccgagaaaggtatgaattgttcgtacggctcagcttctattttatacccaaagctatgactaaagctcttctaaactatcgatgtgggacaattcaaaaagaacctcttgaacaaaaacgcctatgaaagacaaaacatcataagttgtcgtcgtgccttaaagcactgaattcaatctgggtagctttaatcttttgaatttcttctctctttctctacgaataaaatatattcatcattctaaaaaaaatcacagtcaaatttagtaaacacttcaaagtttatagcttagattattatttagctacggacatgaatacaatgccaaaatgagaattcttattggttgttgtttgatgtaacaatatagagcaggtacagagaggataagcaaaaacacaagataacaaataaatctttgctcattatatgtcctcagcaataaacctaaattctctgtctttatatgtgaattccacaattaattatgctttaacattttttttatcttgtattcttcattataatcagctacttcaaagtcttaaccacttcttgaagtgtttcactgtggagatttatataaactgcagaccctttttgtttagtaaacagtcacagagcaaaa

SEQ ID NO: 3301 - DNA, 908 bp, Arabidopsis thaliana
tattaatcctaggcttttaattattaggcttctataatgtacaaaatccgactaggattgttactcattattatagccataggttggactttgctttaaagtttgggtttttagaaattaaactacttaaagtttgaaccaaaaaaaaacaaaggaaaactacctgaaaacttttgttttcttgcttcacaagactctacagacttcaaatttcatatataaaaggataattcaaatggttccggatgaaaatttccttttgttgatgttttcagtatagttatagtctcttacttagtaagttaggtttatggtttttatttaattatcaaattcgtcacaactttgctttcttagatccaaaaattcgtctagctatagttcaaattggttaaagctgctgattctcagagtttttttctaaattcctatgtcaggattaggaaatagcttcaagtagtagtttttgttcgtctggcatgtaatttctgattgaattgttatttgttggtatgttgtagatcaaagcggataaggtgtattcgatatgtagacgaactttcacggtttttaattggcgatatggagactctattttcacctttttagtggaccaggttagacaaatatacaagagcctcttaaagaaaaaaataaaaatagtattgggcaacttataggcccattatgtatattaacaggccagtttctcataggcttttgatactttcatggactcgaaaatttagggtttcagagacgaccacgttaccaccgtcatgaaaccgccagtgaccgtaacatattcacctctcgcatcttcttcttcttcacggagaagcaatcgaagagaatcaatcaactagacaaaaatcggaagaagaaacacaaaccgaggttttagaaac

SEQ ID NO: 3302 - DNA, 2000 bp, Arabidopsis thaliana
acaatatacgttacttttttgtggagtgttagtttcttaaatataatatttttgtagattataagcccaaatttctctaaaatttacatacttctatctaataatagagttacatacttctatctaaaaagtataatagagtcacatacttctatctaatatgtaacaatataacataacacgtaatttgttttattatgaaataaaaatcatgtaattataaaataaaaatacatgtgataaaattgtctagtgattaatcaatggttcctacacaatgttctaaatattttagtaaattttactagctaatagatggaaacttatcgcatgttacaggagtagttcatcgtggccttagtaagttattgataaagttgtccattttatgtgttgttgtcaaattgtttttgttttttgtatttttttttgaataagttgttatcaaattataatgtctaatactactatagaaatttatcacttttatcctctctttttgttatgtctttttcctttcaaaattgcataccattttgtattcttttctcaccaaacttattcaaactaaatttccaaacatattatagagaactatcaaaatacaaatagttacataaacaacataagtacaaacaaaatcacgagaaaaagtgaaattatattacaaaatgctatatttttttctcacactctatattaatgtcaaatatgagtaatttcaatcaaaagccatttttcttttgcataattcatgtttatttttttatttttttcatcttgcataattcatgtttaaaaggatatatacatgggtctactacattcacctgacattacgttttatgtgtttgtcttctgaaaataatcatcaaaatatttcaggacttgtttacgttttcaggagaaaaaaaataactgtacccttttcaatatagaaataacatttgtagaaatcgtggattttccttaataaacaatccaaaacacgaccaccgttgtctcctcgactcggtaacacccgatcgccgacttgaaaattagaagaaaaatgaaaagaataataaaaaaaaaaaaggaatgattattgaagctgtcatatatgtcgaccctatcacagtcaatccaatagcctatattcgccaactgatatatccaacggctcacaaattttcacaaacttttcaaaaaagtataaataaaagaggctgtctgacagccatgtcacgttatactttttccgtatgatcgaaatgattcgtctttgtcgaatttaattatttccaaaattgatgactctaaagaaaaaaaaatagtttttcagataaacccgcctatataaatagttcaacactcggtttatttcttctcccctctttgaattgcctcgtcgtcttcagcttcatcggccgttgcatttcccggcgataagagagagaaagaggagaaagagtgagccagatcttcatcgtcgtggttcttgtttcttcctcgatctctcgatcttctgcttttgcttttccgattaaggtaattaaaacctccgatctacttgttcttgtgttggatctcgattacgatttctaagttacttcaaaagttgtttccgatttgattttgattggaatttagatcggtcaaactattggaaatttttgatcctggctccgattagctcaacgattcatgtttgacttgatcttgcgttgtatttgaaatcgatccggatcctttcgcttcttctgtcaataggaatctgaaatttgaaatgttagttgaagtttgacttcagattctgttgatttattgactgtaacattttgtcttccgatgagtatggattcgttgaaatctgctttcattatgattctattgatagatacatcatacattgaattgaatctactcatgaatgaaaagcctggtttgattaagcaagtgttttcggttttctcgatcaagattcagatctttatgtttttgattgcagatcgtagacc

SEQ ID NO: 3303 - DNA, 2000 bp, Arabidopsis thaliana
ttgtacctagctctagttgtaaataataatatcaaactaagtaacaagagcaacttgttgacactaaagggaccccaagttaccctcaatcaaaaattgtggatcagttcatcatcgaagtaacgtgttaattatcgtcatatgctccacaacatcgactccccaccatacccactcaataatgtcaattcagctctctctttttgtatttttataaagaatgtatttaaattttcaacccataatttatagattcatgatcatctattaataattcattaaatacttttctgcatattgatttatttaaaagccgtacgcaagctcaaatcggataagactaaaataatatcacccagttaagttaactaacttattttattttgaatagtagtattaattacttttgttcaactactccaatactgtttatatcctttcgacggtattagttattttcatgtttcacgcatttttgtaattgcaaatacagacacctttgttgtaacacatgttgattaattttccgaaactatatacttttgaagacaaaaatttaaaacaaagaaacctcagatctacagttccacctcgtgtctgacacgagtttctatgcgataagatcgaacatgtatatcagcagactttactatagatgaactcatattagtaataagatccaaatacggaaataaacaacttggaaagtgaatggaagttttaagagaaaaatcatttctagaattattttttagatcatttctttttttggagcatccattagagttttgtttttagactttatgatttatttttcttttgttatcagcacaataattgattttcaaaagatattgtatcttttttttatctcttgagaagcacagcacaacaacgagcaatgctgacttgtcggggtcagcgattattattagtcaccgaacgaatttttcttgggttggagccaaaacctagcaaaaaaatatctaagtgggggcactacattattgttttaacaccaaggaaaagtaaacaacaatggcccatttttactgtatcgagaaattgatctcgaaaggacaaatgtacccttccacttcgggaatccattattgtgcataacacacgctgtttcactatatatactttcacataggatctcaacactctcactaaaccaaaatcctcaaaagcctatttgggggatcatcaaccttctatcatcaccatggatccttacaaggtatcttcgatcatattcttcttactttttctttgtttttgtgtggtgtatgtgtatcttaattagaattaggttcaactatatatgctcgttttctaaactattttttaattggattgatgttcttaaatcttaagggtcaaaatactttttatgctcaaaaacttacttaaattctgtgatcgcttgaacctaagttgatgatgttgatttctgttttggctggctatctttaattaaaacgtttaaccactgcgtgagaaagacacgccacatgtggtttttgttgtttttttccttagattagaagttattttgttgttgtttttttttttattattattacacacatgtgttctaaaaatcggacgttcaaatgatataatcgattgtttagacgtccgaccgtatattattttagtgatatcagccaaatcagattaagtaatcatcaacaaaatgattgatcagatctactaaacacctgagtaatcaaatctacacgtttgattaatcaaattaaataaccgatcagttagatctatacatatgataaatctttttttacaacattcggttaatcaaaccattgtcggtcgatctatcaatacaagtgtatttttttttcacatacaaaaaaattatctcaccgacgaaaaaaaaataaaaaattattatgtagatccatcgaacaaaaggcttgaatatacggaagtcacttaaaagtgtaataatcgaataaatattagtggataaa

SEQ ID NO: 3304 - DNA, 2000 bp, Arabidopsis thaliana
aaaaatatatagatataagagttgtacgtttagaaaatacaaaacattaaatcatatttatttttaatctacaaaacaaattaatttttatttttaaaaaatataattatgcggtacaccgcgggttaaaatctagtatatattcaaaagccttcaaattgaacacgagctttgttcttgtatctagggctggaaaaatagtctgactcgaagatccaaactaaacccggctcaaaatattcgatattaattcgatttcgtatattaaaactatctgaatgggatctagaaacttgaaattctgagtgtccaatataattctgattcgaatttacccaaaaaaatcctaacatgttcaatctttagtattttaaattgttttgatagttttattaccgatatttttggttaattatgatacttttaaacaaattttaaatatttttaccggatttttcgagtaatcggataaatagtttcaattatttaggtagttttaaccaaactcaaaacatgattataaatctaaaatattaaaatctttaaaatatctaaaataactaaaatatctgaactatttagttatattttatcaatccactactgcgataatatctcgtgtacttcgagaactctcactaatccacagaaatattgttttatataacagtagtcattagtcaatagctagacatgcatggtttggtacacgtacttggaaaaagcataaaataaacaattataaccaaatcgaaatctgatatacattcaattttaaacaaaaaaaaaaatggaaatctgatactgtaaaattgaatatgtgtgtattattattggttccacgacgagtctactttcagtattttattaccaaagcaaaccaaaacggatctcaaaaaatggatactgaaaaatggagtcaaggtattaagtgatcctttgtccaaaaaaaaaaaaaaaaaaaaggtattaagtgatccacttttgttcttagtggttctgtccctgccttttgctcttgtatctagagctgaaataaaattcggacctgaacatcctaaccgaattcagattaatttttttgattagaattctaatccgaattttaaaagtattcgaacggattttagaaccggaacttcgaatatccaaaaagcccggatttaaaacagattccgaatatatactcgaaaaaatctgaatattcctaagatattaactctttttacctggttttatggatactattgattaattaaaatacttttaatagtataacttttaaccgggattttcgagtaattcgaattattttacatagtttaaataattatacgtagttttaaccgaatcttaactataattataaatctatatcaattattttttaatcaaaataattaaaataccaatcaatataactaaaacacttaaaataaacaattttaaaaaacaatttttattatatctatcaaattatattaaaaaattcaagcaaataatttttttagattatccaaacttcgaatacaaaaatctgaatagaaccagaatttgatctgatatattttgagttatggtagaaatcttaatcagaaaactaaaaaatccttacaatacctaaacgctcagacctataaattttgatttatctacatttcggtgttggtgatatactgacaccgagtcgttaacagcaataatattttgtgtactttgagatcgctcacaaatccacagaaatattgttttataatagacgtacttggaagatgcataaaatagacaatacaaccaaatcaaatttgatactttacacattcaaagtcaaacaaaaacagtgaaattgaatgtgtacatgtattattattgcttccacgaggagtccacgttcggtattttatatttgttactaaactcgatcaataagtaatcaaaagtgtctctgtttatataaatggaaagcgttaccaaaacaaaacaaaaccagatctcaaaaa

SEQ ID NO: 3305 - DNA, 1915 bp, Arabidopsis thaliana
tcttttaacggattgttgttttagtggatttgtatgtaggaatacttgttagataaagatgatgagatgaaggttatggtgagcaagaagactacgtatatataaggtgtgatgggatttaaagtggcaacgtcaaagagttaagacttttgagcagctgtcttttaactccaagtactttcattttctatattgtgtagttaccaaaccaaaccagtctctgtactgcatctggttagtttcggtttaggcagtgcctcatacatcaaaggagggaagagacactgatatttcaaatagtttgggttaaattaggccatgccatatacaaatagttggaagggaaactaattttaaccgaatggattacggtttagtttggtttaggccatgcccatatatccggtttcggtttgacttacactgttctagttttggtaccaatttcaagtttgattgtgtcttcttattttccgatacttttcgtatatatcgaagaaaatgtaactggtgataaaccgaaataaaacttgaatcactttttggatacagcttggtcagattaaaccaaatgggacatctctaaaattgaggcacgtataggttggaaacgagtcaaaaccagctggtttcatactctaaaactaaaacataatggtttcaaatactaattgataaaacagtattttctacaagtttctcgagagtttaaaatgttataatttctccacgtaatcgacctttcatttctcgatttaaaatgtggtagaccgaaaaaagggtaagattaaatataggaataagacaaaagagaagaagaagaagtgatatgaaagacattagtctcatcaacagttcgagttcaagtagagatcgagagcattaatcacaagctgcacgcttcatggttagtattgtttcctcttcaccaggtaatttccatggcataatcaatttggtcctactctatcatatacttggtacttgtacacctattttatttccaatttgtggctacaaatttctgtgccacaaaaattcgtttttttttcaatagaaattttaatctgaaaatgagttccctttttttttggttgagtttctatattggttatttcattgcatttataaattattttctttgagaatgttaaagttattacatagttacgttacgtataccgtccactttgcatgcttcttccacgtattgtttggggcttattttagctatcaaaagaggaaacccaaaactctttactctctcgtcaatctctttcaattgtgtgtacaattctttgggcttattgtgaatatagctcgagcaactcaaactattcaaactcatggaccatgtcaacaactgccctgaattatcatttgtgtaaaaggcaaaaacctatgcagcatacaataaataaacacattaactttttcttgtttttcaaattttctccaagataagcccattgggcctacagctagttttgggaaaaaaaacagaaaaacgaaaaggaaaaaagctatcaatgagtcactgacggtgaacggtggaccgactcaaagccaatgagaacgcaagaaaatgttgagccaatgaccgacttttgattatggactaagccatcgaaccgaacattctcgaacctttttaaacggctttccttatttgttaaaggaaaaggaaaagtaggagaaaagaatcattcctggaccgtcagatccaactccaaaagatcgtgcggttacatagcgagccatcgaaccttctcgaaactcgagtacaagactctatatagacttctccttcgacctgatattttggaaaaaagaaaacaaacctagccgcaattcacaattcctctttcacaatctttctttcgattttttagcttaatcctgagtagcgttaaca

SEQ ID NO: 3306 - DNA, 688 bp, Arabidopsis thaliana
ttttgcacgaattaaaaagttttggtaatgaaattagattcggatttaggaaacaaattgttgtacatattttagcatttatatattcattgattggttggctacttgcttgtagattcttaatctttttctattttaaggttctcagatctttaaattaaattacttctgaaatctgaaccttataataatcattaatctatgagaaaattgataataatcgcaagaaaccaaacataattggtcagatttaagatctatgaccatttacttgcacgaagtcacggacctgagatctcacaacaagatcaacgaaagagaagaagccacgtcattgtcgatatcgtgacgcttgtacattggtgcggaacagtgtgtcttcggtttagacaatttttctcttcttaaaattactttttactgctggtaaaatggagtaaataactaaataaattttataacggcctaggtcaaaattatcaagacactgtataaacattaaaattcttgccaaatccctataaactatgacgacgtaatacccaattagagatagccacgtggatgtatgaccaatttaggagcattcagttttcgtgttttgcagtgataaatatctctgagagctaaccccggagagcttacagaattcaagctaaacattgttagagagaaagagagagcgata

SEQ ID NO: 3307 - DNA, 2000 bp, Arabidopsis thaliana
gtcttacaaatgtccttccaagcaactcttgcacctcttgcagacgaagtagtatttttccacaaaaaagcagagcagagattgtcaattttcttataaaaaccctttggtagaacaaagacttgactccagaagttcactttcccataaacaacagatactattaaccggattttcccagcataagagagaaacttggttgtccaggagttaagctgctcggtaatcttttgaataaaaggttgaagtgtggcaagagaaagcttagtcgggttcagcggcaagccaagataccgagagggaaaaacacctattcgaatcccaatcaagtcagcaataacagcagcttcagaatccccataacctccaaaaaacagctcagactttgaagggttcatgtccaaaccggaaaaggaatggaaagtttgcagtataccactaataccaaggagagagtgctgagaaccatctgagaaaaccaataaatcatctgcgaaagctagatgagttaggcgaggagtgatacacaaaggatgagcagaaaacttgccctccaacagcccactgtccaacattctggataacacctccattaccaaaataaagagataaggagagatacaatcaccttgccttaaacatgcctttatgtgaagatgaacatattgactgatcttgcacctttccattttcaacatgcctttatgtgaagatgaacaaacatgagctgaaaacaaagaaggtgaagcacaaccaaagtgacatagcatactttagagctagatagaagacgtgggatttagagctcttcaagagtcaaggcaaatacatttggactgggatgaggcagcatcacaagccttcccaaccattactgaatcacttcgacattcgaaattctgactcaaaacatatgacaccctgaagatgaccattatagcgatccactaaaattttgtacaactagccgacggaggaggaggcgaggaacgtaacactggtggactgatattgtgtttttgttcttttttttttttttttccaaaacaccatttttttttgtaaatatactgttggtcaaaacaaatattaaagattaaagcactttgaccaaaacaaaatataaactaagaaatatttgaaacgttaccctgtagacagttgactacaaaaacccgtcaatggccaataacattccagatttccggcgccaaataggtggcatgatctacggccgataacgcagtcgtatacttccataattatattattcattttagcaattacaatcaacggctcacaatttcaatctcgatgatctaacggtcctacagtccccgagtgtatagaatagtgcgttacacttgattctttctagtgtgaccctatttctggagccaataaaaggctcgtgtcaaaactcgcctcttccccacaaagagaattctctcatttcttcttcttcgctcagctccgacaacgaagggcgaagaatctcgctccctcaatttcgcattgccatcgattttcttaggtaattctggttactctgagatctctatcgctttaaatctcgttgtttatctctgttcttcatttgattctattgatctgcttcacagtcttatatatcatcaacaaggtaaaatgattcgtttcgtcttgatgatctcatggtttctctgcgtaatcctagattgaatgtagtgtagatctcgtgtggagtgtgaatgtatcgagatcctggattattcggctctgttactcttattttccgccattaagttacactgttgtatggatctgtttaacctaaattttctgcgtctgaatgtgttcatggtttagtttctgattgcatcgtttctacatgtagcctctcttatgcttaatggtggataagtgttctattccactggagatgcacaattgcttttactgcactttatagcatattccatttcttacactacgggttgtttaattttgtagaggttaaa

SEQ ID NO: 3308 - DNA, 561 bp, Arabidopsis thaliana
ctccgagactcaaaattgctacaaatttcttctcctttcgctcgtcaagtgcataaaaatcccaaaatggtagtcttctccctaaattcgggttaccgacaataaaatctccgattgattctcaagatcttagagaatcaaatcgaaaaccttctcaatcgaagtcgagaaactaggattcttactttttcctaatttggggatttttgtgtgtgtgtaagtgtgtgactgaagcaggagcctgtagtttcgaaattcgaacgattttgaaattagatgtggcggacttctggaattatcataacgttatcaatcaataaagtatttaaacatatgggctaactttgggcctacaattcggcccaaatgtttaaataatcttgccacgtggctttaaggcggacaaaaatgacacgtggttttatatgagtggctacaaccatatccaagttatctaaagtacagataaggcgctctgtgtcggagaatgaaaccaaccaatcatataagcataaccaataatcatcggcttcaattttcgtcttgagaaagaaaaacaaa

SEQ ID NO: 3309 - DNA, 1048 bp, Arabidopsis thaliana
tataactgaatattgtatatagattttgattatgttttcagtgttactgtttgatttgctgtaatattggtttcactttttctttcatatccttttgtattgtgtattagggtttattctgtgtcttgcacggacgtttgtggattttattgttatatttgtcaatgcttatttaatatgtaaaattatgtaataaactaaaattatttatggtaaaccaaatagcttttttgtgtttagtagggattctagatctttctcaaagttttgaatttaaagatctcttggttcaaatccattgtggaaaggtttatgataaatgttggtaaagttatagccgtatgagaggctattgagagctattagccattaatcaaactaatgaaaatcaatttacaataaccaaaaactgaacaaatgatttttttttctaagttaacaaaaactaaaatgaaaaatatgtaacaaaatcttataatattccctgtcattccttagatattaatgaggaatcttatgacattccaaaaatgtatatttaataatctttataaatttaaaattattatttaaatcaaaaaatcaaagtggtgcagcggaagcgtgatgggcccataacccacaggtcacaggatcgaaacctgtctttgatataatcttttttttttggcagatatattttatacaaaaataaacaaccaaatgtaatgttaacttctacttgcatagccacacaaatataatttggtttgtatgtcattggtgatgtaaactgaaattgaagataatagaatctcataaccacacaaaaaatgaatgaacgcaaatcaaagcctctcaacacatctctttgcctcggtctctctctcgcccaattgcccatcaccagagcttaatcatatcttcttcagttactgccacgtgtcactctgaccgtgaacagcctttatctcttccaagtccacttgtgttcttgattattttgtcttcaccattctctctactcaaagctcttcttcttcgatcaaaaaacctcgagcttctaaca

SEQ ID NO: 3310 - DNA, 1073 bp, Arabidopsis thaliana
aacaacaagtcagcattctcttacttcctttatatatattaatcttgttgagattctggattttaggcttgtgtctttggtaacatatgtggtttccggttagttatggaattgtcggtcaatctcgaggcaagaagagagagtatgtatatatgtaaatgttgaaccactaatcacttaatgattatttagttaattacgttggatctcatattgagaatactattttgcatatatatttttctgaaaaaaacaacaaaaagaaaggtcaacattacaagagtaaaattgcatatgaagagagtgataatgaaagttcaagtgtttgtttctgaattcttgacatgtatataatcaccatataactgtttccaaattgtagatggtaatgcaaaaatctgatgaggagggagatggttctgtttccagcaactagatttagttataacataaggggattgattattgttattgttattgatccttcttctcctgttgaattggattgagagttagttggtcaaaaggtgttatgggttttagaaaattaataaaaacaggtgggctttgtctgtacatgtccttaaattatttgttttgggagtagtttaatatcgaatgatacgtttacacgtaaaaagtcttttcttttgagtcgtcgtctcaggaaagatgagattcgtttctaggagaggttgactttttcaatccacacttataactctagaatcttatgtcattgatgacgacctcctctacacttttggatttgtatgtttacaaaggaaggaaggattaccttagaacagtttatgtgatgtttgtgtctttctatttttattcaatgaaatttctttacatgtacatagattagctatattgacatgaatctaactgatttttttgtttgcaaaataacaaattagtgaggggaattttgtttcagtcaataaatccgtgatttctatatgttagatggataacaatgcaataaataaaggggacccaataaaaaaaaaggaaagagagacgtgcctgtgggtagtgggtggtggtgagaagattctggaaaa

SEQ ID NO: 3311 - DNA, 1482 bp, Arabidopsis thaliana
gtcgccaaatttgaatgtgtgttgattgaaaaagatttgtttgggtggtttttaaaagggttttggaggtgaaaaaataaggactaagtaagaaaggtggaggagtagtgtgagaataaagtggtgaaggtagattttgagttgatgaaccaactgattttgtttttttctttttaattattgtttttggtttatgtttgattcaaacctacttcaactactctttcctcgtgttggtatcgtaagttgtaaccgtttcttgtccgtaaacttgaaattttggtaatattaaaccttgccgtttatgagctcatattatagcgtaaaaccaaaaaaataaactttacctcaatacggaatatttccttgtagtgaattaaataaatttagacctctatcaaacacttgtagtgattttcctcctgcatgtattcttcacttgctatttcgttactttggcttctcttactaaaaatatctaaaatcatatgtaaattgaaaaatactattcatgccgaaacaaaataaattaaaggaaatatttttgttttcttctaaaatttgcatgctcgtttgtaatttgttttttctcatgagctcagattgggtcaaatatgtttaattatgggccaatttcaagcccaatgcaccaaaggtggaattgctcggactggaagaaattcaggcagatgatcgagtggtatactggtaaatgaccaccaaaagtactgtttaagccgttggacactgaagagcagtttttgtaggtcagaggctttttctgactgaaacagagtaacgtgtctaaaacagaggtagttaatattttgatcaaaatgtgatttgaaatccacactaaatcggccggttatactggtaaacccacaatttgaagactaattcggtctgattataagccagtgtttttttttttacctgcttaaacccgatttagcggtttagcggatcaaattaattttggttgaaaacttcttctactttttattttattttttatacagtaaaaaagtaatagagtaaaataaactgaaatatcctttcttcaatcctttttttttttttttttgagcaaaaaaaaaaaatactgaactatccattgaaccatttttgtgtgaaccagaaattctacggatgttttgagcccataaaaaataatcaaaagacaacaaaatagttacataactaacctacgtggtcaaaaatcagccgattgctccaccaaatgggcgccacagataaataaatacccaaacccgtaactttatcctcatctcatcatcaccgtccatttctcaatccaacggtgtacatccctcggaaatctccaacaatatctaatccactaaatcaaaaacagatttaaacaaaagaagatttcacaaactcaaaacacagagaacagagagagagagagagactccattgttgaagtgtgttcactgaactcctcctcaaacaaca

SEQ ID NO: 3312 - DNA, 2000 bp, Arabidopsis thaliana
ccaggagagggatgtggtatacaatttaactatatatttacaaaaatttgtttgtatactgttgcatacatttttatatatcattttgttaagttattaaaagaatgttgaagagaaaaaagaagaagataatgaatgcattttttcttaatctattgattaagtttataatattaacttagcgatacatgcttataataatttatacaattacatctaaactgttaagacttttggggggggggggtaaatcatactaaagtttaattggggcttaattagtttaaaatggtttaaaaaattcaatcgctcatttgattactaatcggacaaaggaattcacgaagcaagcatgaatattatataacttgagaccattttttcaaaaatttgtaacatttatggaaatgcacgcatggcagtaaaaaaaaaagcattcaaagaatgaaaagagagggcttagaacttccgaagaatctggaagtgtcatatacattgatgctcgagttaactaagggacccaaatgttatgggagtgtgtggctatgtgccatgctctgttgaactttctggtgatgtttttggttagagtataactattagataactccaaagactcataaattgtggcaattacgtggaagatgtgagccaacgcttgcgtgccagactgccggtccaatgttttgcaataccatcatttaggtgatgataattgataaatgataattaggtgagataaccatcatttgatcaaatatatgataaaatgaagtgaatgactattaaatttaatggaagaaaatatatttttaataattaagtctttttcagtgtttttctaaaaattggtatatcttcaaagtatttgttttttcaaatttttacaaccaatggttcaattttcttacaaattatttaaaacatatataaatatttatatttgcatatgtttttttgacatttttagagattaatatttcaggatatttttgacccactcaattcaattatcttagaaagttaaacgagtgttttttttatcactgtttaatgtttatacagaaaaggttttttctaattaaaataaattattagtccatctgttctccattatgtaacatgattaagaagtaattttttctcattcattagatttttttgtttccaagtttctatgctttatttaattcaatttgatgttttatgattcctaatattctgcattattttttcttattggttgaattatttctagttgatataaatgattttcttaatgaaatatatataactatgtaattcttaaatgttgtgctttcaagtagaaaatctcatattaaaattgaggaacttttagatttttggggataatgtagacgttttgtgtatatttttttgaaccatttttattattttaatggaaaaaaaaaacacagatttcaaacactcgagagtcaagagtctcagacccacccagcttctggtttcgtttcgccgtcgcgcacggctgaacatatctgctatatcggagattagtgaaggttaatgctaatatattggatgatactgaaaatcgaagctttagtctaatttttgtactccaattgcttcaggttagttactattgattaaaggtttcataatttggggctaatctctctgcaaggtgacgagaaaatccactatccccttcccaagatttgttctctgaagatataaagtctcaatctttggataagaaagttcaaatggaaaattggaaacttttcttcagttgaatgaatgatttagctgaagaaaccaaagctagaatggggcaaagttcattgtcatggggtccctagaatattcgaatctatgatccttttggtgtaaagtattagtcaagttgagagatattttttacattttgtggtcactaatcatgtattggagttgattgcttctaaactcactttaacttgtgagagagtttctaagatatcaaataatctatc

SEQ ID NO: 3313 - DNA, 521 bp, Arabidopsis thaliana
agcctttcctgtttctgtatcataatattactgaggctgatcacttttcaatttcaaaggcaaatgttgcaaacgatgtgttaacgttttgggggtgggtttgtaataaattcataatttgagccctatattataaaactgattattgttcaaacactttgtatataaaccaatttaagggtctgagagatttgagaaccaaaattgttagaatcgaaccgaaactatgcacctctcaattcggttatgtcaattatcgaaccggactcgaagtacgatattttttttcacgcccaatagcaaccacagtaatcgcaaatgaagataacgttatctatccaatgagccattaggaagctcagaagctgccacgtaagattcatatctcacatctccaatctctgaacatcactaacctcaaatctctcttctcaaataccattcttctcagcaacttcacacatttcgaaagagaatctcagaaagatcaatctagagagaccaaaaagagatcggaagag

SEQ ID NO: 3314 - DNA, 1693 bp, Arabidopsis thaliana
aaaggagataaagaggaagatgatggtaattttcccttacgatataaggtctgaaatatgtgtatctcctatgaatgtaattaccattttaccgtttgatgcgttgtgttgattgaggtaaattctttagttactatagtagcaagagagagtggttgttcggccatttctttatgttttttactctgttcttctctggtctgtaatataccaatatcgtctcttagcttttgggattttttttcggcgaagtggatggactatttagacaaaaaaaaatcatagctatgaattattagtagcgactctcttcggtctgaatcttagaatctggtccttctgattatcattgcgtataacaaagtatagatgtttcgatatggccgtgaactttatgaatttttttttttgcaaacaccatgactcgagagagataaaacttcgttaaattcttctgttgagcaaaataagaactttttttcatttgcaaactccatgagtcaaaactcaaaagagattaaagtaatttttttggaaagatttaatgtgagtccatagtttttactttttaacctaacaaattctctgacccgttatagtttcatgcttgacatggaagttgtatggtggttggtggagactacgttcaatgtgtccaagaataagcaactagtgccgactctatcgcggtcgataaataaaccatggttttgtttttttaatcccgatgtaatctcttttactaattaccctacggtgaaattcatgagtaataaacttctggtatctgttcacaaaaaaaaaaaaaaaaaaaaaactcttggtgtctttattaattggtaggcttgaagcccattgttaaggtaacgcaagaaggctttgatccctatagaaaaaaataaaagcataaaaaggtaagttgttcaaagaccataaagattcgaagccaaggggggatatacggtgacgtgtaaatgtgacccacataatactctctccttcatcttcagaccttaaacacctaatccccatctgtccaattagaatctcccacgtgtcaattcaaatatccaaatcccaaaaaaataagcaaataaccaccaagcaacgtctccctccatgccctgttagttttatcacttcatcggcaactccactcctctcccaaactctattctccaaattatcttttagccaaaaaaatcaaacaaaattaccataagtttattacttcatgaagtaaataagatatgatctttggttttttaatggctataaatgttttcttatcctcttatcttatcaacaacatcttaacatagagactaatcaacattacaaacaattttacttcaagaaaccaaaacatgagccaatcatcacacaaccacattaaaccaaaacaaaacaaaataaaactccttttcttctctgcaaattgccatctgtttttcctatagacccattgtcctcctctcatttctctctttccccatttaatcttattttcaaaaaaaaaaaaaatcacatctctatatcaccacacaaaaaaccataaaatcaaaaatcgttacccacatttctttcattctatcctaaatcctcatcactcaacctgagctcacaaagctaaacaaaaaaaaaagagcttaggcggagaagaagaggagaccaaaacaccaaacaaacaaca

SEQ ID NO: 3315 - DNA, 1745 bp, Arabidopsis thaliana
gtgcgacaagtgaaccgtgtgatgctgatgactagattatataaatctcctattgttatcaataagttattatctaattgaacctccagttataaatcatatattgtcgaatccttgatcatttatacgattaaattaataaatatatggttggttatgacttaactttccattgtatctcattctattcactccaatgtacgggttatacctttcgacaagtactgaaccgtgatgttggtgactaatacaaacctcctatcattattattatttatcataagttatctagttgacgcttttataaataaagatttgtcgaatcagggaaacctattttcctgaggttaattatactcgtaaacgaatatataaatggttggtttttctaaaccttcttatgaatttcgttttgtatcgtcttcattttattaatttagtccaatggattgcgttaacttttcttactttctcttccactttactttaacaccttgtattcatatatttctcaatcgagtaacttcacgcattcgtcaaaaccagtttaattaagttactttgtcgatcgtcaaaagcacttggaccacatcgcattatatctcaaacatgctaatagcgtatctaatcttagtttacagaatttcaccatagacttattccatccaacaaagaatctgtatacactttattaaaaatttcttttgaaaaaataatctttccattaatgcaacattattgtgaatattaatccactttgatagcatttcacatttaactttaatccaatgttatttcattataaatttttttaaaagtttacatatagatatatttagaaattaaaaaaaaatctatcattctttgttgagattaataactaatttgacaatctaaaaaaaactataaatatatagtatttctatatcttcatgatttcatcaaagataatttattatgtataaatttaaattatctttcaaaatccatcattttttgggtcatctaattgatacatcaaatccatcaaaatttaataaataaaattggtgagattttccttgcattgatcattccatatttatttttttcaagttagaatttgtcctctctatataacaacatcatctgtaaacaagtgaaacaaacaaatatattcgtatcaacgacaagcaaaaacagacgtagggggaagttctcacgttgatataactatgatcctcctggatgatttacctttggatcttctcgacatgattctcttcagatcagaaccccaagctatggcaatgatacgatgtacaaacaaatctttcaaatcgtatttaactgacccaagatttggacctcagtatccttcgtgggtcagacccactttgattaacatttggagctctaacaaatctctcatcttctgccaacctttggtctattcatgtgattatatgtcactaggaaacaaagcagagttcattaacgatcgatgttacattttcggctcatgctccggccttctcctactatacattggtcacttcttcatcgtaaatcccttgacaaagaaatttcgaatcgtggatcactctgggtcgaagcttctgcctcacatagttggtggtgtcgaaaaggctgatccttatgaccccgatggtccccttgttcgtacagagagagcgatgtgcgtcggtttcgtggtagatcaatgttgaatcaccaagatattcaagatcgtctgcatacttgag

SEQ ID NO: 3316 - DNA, 1512 bp, Arabidopsis thaliana
cattattgttaccttttttgttttgaggtaaaattagtcaagaaacgaagttaatgtgttattctaaacatgtgtaaccactagctattattagacttaaatttaatagatcacgatagttatattttcttctacgcatgtaaattataacccaaaaatttccttctttagacctaaaagtcacaattgttccaaacactaaaatgtggatcagtgatcaaatgaagtgaaccttcaggatagtttagtcttcgatcatcaaagattgtataaaggagtgacttagctgtatttgtaggtatcaaaattgaaaacctcacgcaatgattaaaggtctcaagtatctttattcgtcagagttgtataagacacaaatctcactagattgttttcccattgtctttgccgaaacctaacaatgaacaactagttctattaggattggttcaagaatgtcacatagtataagtttttcttagctgaaaaattctagataacttggaataaattctagatagtcttttttttttgctacatttgaagataaatatctatgaaaatgttcaaattcatgattatattattgcgattaaataattgaatatgactatacaaaataattcactagtaaatcaaagccatactaagtttggattctttgtggtaactgccattgccaagtcacgttttgaaggtgttctcatggtcaatttacacttaaaattgaacctgaaaactaaggccaaccggaaacttgttgaattgtgtgaagtgagaaaatgataatcgtgtataacttataaagtcacatgataaagagaaagcaaccagctttttgtctgccataacagttctttaaaatatagccacaattatactacttaatttagagtaactaatcccaaatattacttatctaagtaataattagaaaagtattcgatatttattatcaattgcgttttaacttgctatataaatacaaagtttaatttttatataacccactaactttttcattttggtatatgataaaaatactctatcccgtgactattccacttgttgttactttttagttttttttttacatagccattatcattgtggactccacaacatccgcaaactcaattatttacttttctatacgtttatttgtttttttctgatacaaaatttggtgcatgaatgacttctcgaaacggtagatggactccacaacatctgcgtgtcttgtcaccttacgttacggaccacaatttacacctatgaaagtgtcggtaaagcaaataaaatcgagaaactcacaccactcttattcaaatccaaagtgaatactccaaaaataaagtaaatgatatttatccaaaaatatctaacaaacgcgtaaaatgtgaattatcttgaacgttttaatacctctttactctctttatatagtgccattttcctcactagcagcaacacacttgaacactactttcgaactctctctttatctctcttgca

SEQ ID NO: 3317 - DNA, 1977 bp, Arabidopsis thaliana
ttccctcaagtgtcgaattgtccaagaattcctcagtccttggcaattccaactaaggatgccttattgatactgcggtggttcttgaggaaccaccgtaatgacagccttttccatacaatccactctttccaagtctgcaatttccttttttcgtttgatagcattagcaaactcaacattaagactaacctctttttcttttgaaccatcacgagctgcttgcttattgtgaactatagaagcctttctttttcttggattcttctgcttaatacttaatcctgatgcccccgattcattaaatccaaaagggaacccttccgaatctattgaagatgcttgatcagcggataaagaaggtaacttggtaggaacaatcttctctcctggattcactaaacaactctttccatcaagaaatcctgaatcagaaaaactaagatctttctttgattctttagagtttccgaggctaacaaaggggcaaacacttttctcatgtgtgagtcgttgacagaggaaacatctttttcgaatcctttcataatcaaaggaaactgaaatcaattcacccgatggaatcaggacttccttaaagttacgcaagggattccgaacatcaaagagcacttgaaccctgatataattttgtgcctgagatttttctaaatctaattccacagtcaatactttcccaacacatcctgcaatttctttgatagtatcttctgtgtagtagttgatcggaatatttcggagtcttatccagactggaagaaacaaaagagaatcatctgaaggtttttccacccaacgctccatcaaaacacaccactcatcctgagtccaaactccagattttaagatttcaattaaatcttcttctgatttgaaaaagaattgaaatctctcttgggataaagcaacacctcttacccttgaatacaacctccaaattctaggcatgtctaatatccaattagacatcctttggagtgacagattcaaaaacctatccactaaactgcaattatttctgtcaatcgagcaaaactgcgcttgattagacaaaataagaggctatcttcgttaattgacatttcctttatcgcttgatccaagtccatgttcatctccactgatagaagaagaaagcactttcctgatacctaaacttggtgaatatatctttgccgacagaaaacggggatatcttcggtacttacctcctctcaaatatcaaaaaactgatgtagagggagaagttcttatggtcaaatcgattgggacggctttattaacggcgaaggagaaattttccagaaaagctactatgaaagagaacagagagtttttttttttttttttaagtactattggagactaattattcatagtagttaccatttaaacacgtaatgttttcatttagatacgataaaaaaagttaacaaaactctagtgtccttgactacacttttcttacttttgacgtggtcactattattgtggactccccaatatctgactaactcaaattttacctttcttcatacgttttttttatctgtttgttaattaattccagaatgagttgtcaaaccagtaggatttctctgcatgtcgtgtcacttgcattttaaggacagattaacggttatgactagggtcggtaaagcaaataaatcgacaaaattagaaaacaaagaaaatgtggaaaaagcagtcaaaagaagaaaaatgttgacaaatgttacgaatttggtttaaatcaaaagtgaattatccgagaaagatgatatttacccccaaaatatctaaacaaatacttaaaaatgcaattctctaatagactatcaaatatcccgatacctctttatatagtgccatcttcatccttagtaatgtacacacacacacataacacttatttccaactctgtctctctcaattttctttctctttctccaaac

SEQ ID NO: 3318 - DNA, 2000 bp, Arabidopsis thaliana
ccttaaaaagtataccgcgtaaaagtcacatgtaagtacatcaaaactcatcatgaagtactgaacataattggtattatcactaataaattatgaagaggcctaactttattagagaaaagaaatatatcttttaaagaaaagagatgatgggaaactcatgaaatggggactttgggtgagggaaagagagagacatgtgaagtgttcataggcaatttgtggaccaacaaggcacatgctactcttctttcatcaactttttttcttagttttgtgcgaaagataatgttttgtgattatctattttctcataaccatgtttgatcttggtgaaaactaatgatgcaaatgtatatccagtatatgtttttgaatctaacactgactacattcatcgaactatagtttgcaaaatttctataccaatttaaaattttcgtttcactttcatacgacttattttttgtaaggaatcggcaagccaatccgaaatgaagccactggccaagtggtacttccacagtgatcccatcccccatgtactggtttcgagccatgttggtatagggatacttgttgattgatattttttaaaaatataaccattagccgtcgctagacactagtaagaaaaacattagtttcttttaaaatgtttttacaaaatttattctaaatcagtatgataaaataattatgaaacttccaaaaataataattagattcctacactaagtaaagtctcaatttgggcaaatgcaaatgcaatactagaaaaacaattcgaaacgcaaatcagtagagaagaacagctcacaactcctatcctccactgtaactcatgtagagttttgtttgttaatttgaatccatgtccatcaaaactaataagttttctcatttatatataatcaaatcaaaaagaccgaaatcagaaactatttttttttatagagaggtgcttggatgtgtaagatctacaaccaaacaaaaacatgggccaatatacatagattgaaaaatcaacaaggatccaaacaaaatgtaattatggaaccaaaattcttgacctatgattcatcagttcctccatttctctacaataattaatattcaataagaatttcacattaacatccttttaatatattttaattatctgttgatgtcactagtttgttgatgtcatcaacaaaccgatcgataatcaatggattaaaattggttcgatttcttttcacttaagtgtcttttgaagttagctaagtccagttacaatcaaattatcatgacgaaatcagaagttaaaaaaaaaaaaaaatcagaagttaaaagttgaataaataatatttagcatatgcatgtgtgagttctctgcaaccaaatacgaaaacacactaaaccataaacattctggttccaaaaataaacggaataaagctaccggaattacttttttaccagcaaatgatatacaatcccaaattatataaatgattctacatatagtaagaaaatcatgattccattaccatgtgcataaaagttaataatatacatagacaacccacaaattcatctatatttactataattaatttcgtacatgccaaatatgttttagttataatacagaaaaaatataactctttaaggcactaaatcttttaaattatagaattttgctctctgataaatttgaaaatctgtgtgttagagatgtttgaaacaaaatttagaatagtatcgaaaatattttatccttatttaaaaaattcatattttatgaagaagttattattcactgcttactgtattttagaaaattacttataatttagaagaaaaagaaaagaaaagaagaagaatgcaaaagagtataatgatgaaaggtcctactttatgcagaaaccccccgtgtgcccactctccccttctccattaatactctctctccctcatcctctcttcttctctcatcatcatcttcttcttca

SEQ ID NO: 3319 - DNA, 1524 bp, Arabidopsis thaliana
tctcgtgttgtactgtaagcggaaagagtaaagaagaaaaatcaacaaacaaaaagaagattgaacaaagaatgttgccatcttgtaacttcaaaattttgtatagcgtacattatccaacaacaagatgtcacatactataattatattgtcatcataatatagaatgctaattaatcaatagagaacaatagattactcttatctgtcagcagaacaatatcatttctaataaccattaactgtctgtaattaatggtattctgtttctcctattagctattacaccaaacctggcacacagtggacaagtcctctccatggtagtctaagagaaagattataaaccttgaggccataaacaaagaaagtagaaaattttccatgggctatcagataaattactagcaaaagcttccactaaaaccatcacacttggctaaaagctaaaatgttaacgtttgacacatctacagattttgataagtgtagtcctaaattgttcgttgatttcatacgtataaacacaatagaagaaacacgtttcttccagaagaagtaagaaaactctaaatatgcaaactacacaaggaacagaacaatcagaaaagcaaaaacaaaatgcatttacagtgaagaaattaatatgtgaagattccattagacgcgtcaatggacaaacagttcatgatgctaattgtacatatatatgatatatcaatgatccaataaaaactgctgaggcaaaactctaggaacagagaattagggttttgagattcagcagattcaaactcaccaaaagagattccttaattataggtaaacatacgattttcgaatgtagaagaagattgatacgagggaatgaagctggaacgagagctggagagaaaacaacagatggctgtaattttgcctcctcaagtttcctggtgttcggcctcgtttgccgattagtttggtttggcccatttctttatttcggttatcatctgtatttgggccttagcctttgtttttgtattcattaaaaatcaaaacgaataataagtctaatattaaaaaaggttattattattttagatatcataataatttaatacataatcacaaacaaatattattttataatataacacgtaaatacaaaaatttgttaaaaatgagttctctgcaatatcgggttcttaacccagtataattagtaatacaaatatgaaaataaggaatataaaatgatcttttaaaatcatatggcgaattggctattgaagacttttcaccaaataatacaacaaaaacttcgagactcataaaataagtgatccaactaagtcgtcgatgactataagcttttaagtctctcgctagactgtccacagatttcttcatcttctttgtctcttagcctttctatattatccaccatatctttaaatttcttttataatttgctgtatagcctatataaatgcataaccatgagtgacactaataagcaaaataagagggaatattaag

SEQ ID NO: 3320 - DNA, 1342 bp, Arabidopsis thaliana
tatcgttgatcgggaaaaaaatctaagaattagggtttatgtgaatcaaaaagcaaattcttaagagaagcagagaagtattgatggtttgattaagggggaaaagtgtgtaatatataggggatgtggaaacagacgtcataatataatggaaattgtaaaatataaaaattgtcataatattttactttccttttttttggaacaagtgctacttactttttttttttttttttttgttaaatttttctattagctaaactaatcaataaaaacaatgtttttctccatatacaaaattcgattttgttatggatttgaatttacaagttcccattcattctagtttatctatgtttagatttttttagatcggtcctagttttgggttattttttgaaatcgataaagttaatcccttagtttcaagatatctcaaaattttatttcaaattttagttatgtatttaatttataacaacaagataaatagttgtgttaaaaaaaaaaaaaaagttttaatcaattctgaagttaaaaaaaaaaaatcaattttttctccccacaaaccccacgctttttagagaatatgtgtttctttttgttattgttttaatttatttattttacaactttcaatattattatttaattattgatttttttgaaactttattaaaagatacacataccaatctgtaaacaggaaaaaaaaagttgtaagcaaaaaataaaattattgctttgtttttaaaatagtaaattatcatcaataaaataaaatagtaaattacaaaattaacaaaaaaggaaactaaaacctgttacaaaaaagtagtaaattacacctgttctgcaaaataaaaagggagtagaattaaatctgactgttttttataaatagtaaattatcatcaaccaataaaataaaatagtaaattacaaaatttaaccaaaaaaaaaaagaagtaaactaaaacctgttacaaaaagtagtaaattacacctgttctccaaaataaaataaaagggaataaaattttaaaaaatttaataaagttttgtatttttctaccaaaaaatagttttgtattttgtaatttccatttaattatattgcagattatgtggacctgaaaagcaaattaacataaatcaaataggaaggatctagaaacccttataggttcccagtccccacaccactatatataataacatccttccccaaagtctcgtatcaatcaacacttctctgctctctaaagaaaattttgctctctttatctctcgatttgattcataaaccctagctcttagattttttttccgatcaacgaga

SEQ ID NO: 3321 - DNA, 1611 bp, Arabidopsis thaliana
gttgaaggaaagaaagaaaaaaggatttagacttttaaaatcttttttttggtgataaatcacctctccgaagaacccagaaaaaagggtttgtcgaagagatagagaagaagatctggttggaagatcaaaaccattaattagacattttggagagacaaatgcaataaatggagaagaaacctcttcctgccctctttgcgcagaaagtgaaatgagagagagagagatatgatgaggaaaccgctaaaaagacattgcaggacgacgcgtgccttaaccaattattttacttccttttttttgttacaaaaaatttgttatttatttccatttttgttaaatttgtacaactgtactatgcagtttttaagattttacactttctgctgtaccaaaatattacctatgtccatctgaccgaaattattaaattaattctaataaaaaaattctaataaagctgatcaatttatttattttagacttaaactttacaaaaactaatttattcagcttaatttccccaatatgtaaaaacattaatgactacaagtatggtataacagtagcttcaaaatcttaattcatttataccgaagcaaaagtgaatttggtaaaccggtgaaaaaaacaaaccattccgaaacagatttaagatttttgttcaattatattttgtaagcaaacaaattacatcgaactaaactaaactaaacaaccgaaatatgcatccatattatttgtgaactaaacatggtaaaccggtaatagctattttaagatccttacatttttaaaatttgtctaaagataatttgaacaatttcatctattgttaaacctatcaacgaattgtgtctatagttagatgctaaaaaaccttcctgatagatttttttttgtttgaaccgttgattcatataataaacttagaagcaagacatatagtaatattttttcacttgaaaattgatatttatgcaacagattaactattctaaaatcgtcatatttatgagttgttatttgcctgtaagccatttacttctaatttctattgtcagcttatctaattaatttggtgatttgctaaataagtaaaattgcctattattggtgtgaaaaacaacaaaggaaaatccactaatgacgcaaattcgaatcttttggtctttaatttcaatatccgaagaaaaaaggatctaatcaataatataaaaaagcgtagaaaacaatttgcctttatataactttcacgagtgattttgtaaatattttataattaattaacaaaaatatctaaggaaagatatttgtttttgattcgctgtataacagcacataaaggaaaccaaatcgaaaaactatcagggtaatatcaaaaaccaatagaagtctaaggacgaaaatgcaaattatttgagaaactagagaaaaaaggaggtaaactatatatagccgattactactctcatttgtttttatacccctcaatcataaacaataaacagagggagtcgccaaattttctcatcattttctcgagaaaatagactaaaagcgattcccgagagaaagaaagaacaaaaaaaaaacatccgagtgaaa

SEQ ID NO: 3322 - DNA, 1279 bp, Arabidopsis thaliana
cgaacccataaaattagaaagtgatcttaaaatgtagtttgctttgttaatattttcttggaaccttttgagttctacttcttctctgatgagtaggtacgtgtggctaatgaccttactatatataggcatgtacggacgtgcggttcgctggcttctcctctgaattcattaccaaaagatatcacgtgaaatgttcaaaaatcaaaccgtctggattgaattttaattgtcaaatactttggttgacaaaaaatacattgaacgaaaaacaatatgaacaacaacattctcgtgacgctctctcaaagttgaagagaagaccatttgcagattgaaagtagtagtaatattaatcttctttagcccttactcatcttagtgatctattaaactattcaaattaattacagcgtaactaaacatagtaacatacacacaaattgatctcactcacgcgaatacaagaataaaataaaaatggtatttagccatacatgttcttgattttcttttgtgatcgttttaagaaaaatgtcaaagaataataccgcagaatagcgacatccaaagaataattgacatttcgctctctcttaaaatccctatcacagaattagatagttttaatggtctttgttttttggtcatcttgttttatttagctgtggttatgaaaagtttattattattccataacattacaatccaaaacacttgaagattggtgaaaaaaaaaaaacttgaagacaaaaatatggtttaaaaaaaggtaaaactaagtagataaattaaggttagtcaagtcaatcttaagacttggcattctccaacacatatttttcttgtaatatatatatatatatatatatatgcataattattaacttagagctagatgaaattatatatttcttgaagcattgacatgaaagaaaattgacttttatctaacttccaaatttcaattcattttataaacttcatacaagccaaacttatttaatttcaaaaataaaatgagtttaattcatagttttgatgtaaaaaaatcgctaaatacagaaaaatagaggataatttatttaattatcatattaatctttccttttaaaatagtcaaacacaagttccattaatttattattattcgcgaggaacagaaatttcagtatcgatcttcttcttcttcttcttcgccaatttcaacactttcgaaatctgagaatcttctgtgtgaatcggaacgaaattaacggtgttacggaggctagggctg

SEQ ID NO: 3323 - DNA, 2000 bp, Arabidopsis thaliana
actcaaaagagtgactcttaccggatacaaaatgaaaatagaagtcttggtgagataacaaattaatgtgtaacataacaatataatatcataaaagattccaaatggggcttttgtccacacgtgatatgcaatatgcaaaagaaaaaagaactctctttcgatctgccggtcaataacaatgtgaatatagattaactgattaataagtagtttcttgggtcaatgcatgggatattatatttaagaaatacaccaaaaatgtattcgacgttagccaccacgttccattaaaaattcaaatctaaatgatgattaccgtcgtctacatctatgattacaaattttttgtctactatgcgtttagttatttaccatggtttgacgattatatatataacacacataaattatgacggtttaacgttgtctcttaactcaaaacttaattttacaaaaatattatttaagagttgaatctcatactttaattattcatttggtcaactagaatgcgaaaaatccacaatacttcgtaactaatttcgggtcctttaaatcttgatcacctgttgatcaacaaaagatctacacataaagattgattcatccattgactaaacttttatttatcgaagaaagactatatatatctaatgcatgcatgccatatgcacaataatctaatagtaaatccaatacgtctcagaaagataaaatcgtccataataccaaattttattctaaggttttgatatctctcataatttggaagtgtatgtaaaagtttcttaaacataaatataacatccaaagaaaagttgtaaacacttaacatcttgattgaaggggaatctcgctaataattgtgactgaacgatagtaagtattattgtaaaatatcgatcaaaatttcaacgatatgggcgatccagacccaccactttgttgtcccttagcagacgtcaaccatgaccataattagttaaaaaaaacaccaaacaaaaaccacaacttccttttaattctttttaaattctaaatttcagactaacaaaaagtattcataagctgtttcatgtatgaatttaatatcatgaatactaataacttgagccattaactttaaccaaaaaaaaaaacttgaacaatctaatataattccctgtaacatttaaaagatggagatgggaaaacaagaattctaaagaaacattgtaaaaatgaaacagagacaaatattttcaagcaagtcttgtttcatttcatttctgtttgaaaaatgacaagtttaaagtcatgtctcatatgtgtaatattattaactttaaaatataacaaaataaatatctttgattactttttgaaatgttttttatctcaagaatttggaaattttcgttgattgatacattataaaatctgaaaattagatgtgaaacacgactttttgtccaccaccaatcctcctagaaattatcagtttatcactcgattactgaatgaatgaatgagttatctctgaaaagttgtcgtaccatttattatcccacgcggatttactgccgtgagcatgacgttaccgtatctatctcaaattactaaaattgtcctttccgatggccgtctaaaggaactaactcgagggcattttgtcattttgagaaattgttatgagtttgagtacaaaacaaaaggacacgacgactttgtattatttgcttcaaatcctctgttcttcaccttccttgttccttcttctctccttcttttttatatagattttcctttcatgttgtaatacttttattctattagcgttcatattcagctaaacagacattgcgccgccgttaagtcgaaaggatagaaagaaattaaagaaagaagaagcttgttgtctttgcttcttgaggctctcttcttgtcttgatcatctgttacgttgttccacgaaaagaacagtagctttgtctctccatatagggttattatctgaa

SEQ ID NO: 3324 - DNA, 1075 bp, Arabidopsis thaliana
gagagatgctggaaattgtgatcaactacatgcaaaatgtcttttcgcctaaccacttaccatatttgatattttccttttgccaaattacacaaaccctatcttgtctctcacatatatatccaattaatacacccctgccacttgttaattctcgaccatgtatgtatacttatgtaaagaatatccaaaagctttctttttgttccttcgattttaagcaacttgtgttctcatttctcaatatcttaaagaaatcctgagtaaaaaagtttatagcctccgtgaatcttaggaaattactctagcatattcaaattttttgaaacaatatataaatttttctgaataattaaatttacatatctatgctacgaaacttgattaattaaatcaaatatatatatatatatataataataataataataatataacattttttttaggacacaaatatctaatctcactatactctagaagtatttgcaatgcacgatatgtgaatggagaaaagacagaaagagcatttgaaaatatctcgtttcacggatcattatgtctaattattttaccatagaaaagcgacaattataaacaatttgttattcgtggaaaaataatatttaataatggttgtcgtaccctataaactacagccacacattcatacaataagaagttaaaaaaattcataccctaaaggcatcaaccagtgaagggtcagaaacttcccaagatgggtcaaaggacacatgtcagattctcagtgattgacagccttgataattacaaaaccgtgggatcgcttagctgtttcttatccacgtggcattcacagagacagaaactccgcgttcgaccccacaaatatccaaatatcttccggccaatataaacagcaagctctcactccaacatttctataacttcaaacacttacctgaattagaaaagaaagatagatagagaaataaatattttatcataccatacaaaaaaagacagagatcttctacttactctactctcataaaccttatccagtttcttgaaacagagtactcttctgatc

SEQ ID NO: 3325 - DNA, 1259 bp, Arabidopsis thaliana
taatgttgttcggtgtattttggagatttgttggtttgttcttcttctcaaagtgaagaggaagtaatcttgaagagtttgaattgtatagagagatagtcacagacacacaatgagagatttgagaatgagagacaccaaataagactttttgttcctctcttttggtgttttttttttacataatcattcgtgcaaaagtattgtctgacataaatgacgaggtttttttattaaaaaagtgttggataaagatttaaattttgatttatttttaatttttttgggcaaaattttgattttaaaggtttaaatttgattttattatgaacatacataaaaagctttttctgtattaatcaaaaatataataagcttatgtatattgtgtccaaattcataaaaaaaaataaactatgataaagcattgtgttcaataaaattctgattaagttgtttatatttttttaatacaaagtaatttgaatttaagaggcaaagttaaatataagaggcaagtagtcaacaaagttttgttataattgagaattcaaatatttaagagttgacttaatgagtccacttaaattcatattcacacctaactttgactacatgtctaaaacgagagccacgagtggagccccagctgcaacgttttcatagtttcacaagtaagaaattgttaccacactatctcaaattttcaatattttttttgaattataagagttatgttgatgaaatactctgttaattgaaatgactcgtggcctaatatttgcatgtttgaaacaaaaacaaataatctcttcattcaaacgattatgttttttgttggcgaatgtaattttttgttgttttctctttggttcactaacgatttatgtggcctcttgagagacgatgaccggtcaagattgattaaaacgttttttttcttatcacttgcatgcatgtatcaaacattttacatttttgtaccattattgattctgatcaccgtcgatttttataattatatagttctgatgaaatttcttctgtttaaattgcatggaaaaaaaaagttacagggcctataacgatcattataaagcccagcccattagagtttcagtgtggaataagaggaaaaccaaaccggttggactttaaccggacatgcccaatctaattttgaatcaaaccaaaaagaaattgtgttctctctttcttttgctaattctctatctcactcagctgaagcagaaagagag

SEQ ID NO: 3326 - DNA, 2000 bp, Arabidopsis thaliana
cattagagttatcttgtcttactaaaagtcttagataaagacataaaaatggaacaaacatcattgggaatgcaacatgcatgtacatattacatatagtaaatataatatagttaaaagcgaagtcattattatatgactaaactaagataattaaaacatgtaagcacacattatcgggaatgtattgatattaaaagggcaccacgtaggtcagggtggcctctcaaaccccccaagggacaaagcagcattaggattgtcactaaagtactaaccatgtgttattttacgatattatccccatttggtgttaatggttccaagtgtcaatgtaaataacgttgacatatataagccgtgttttgttttcacgttgtttaggaagccaacgaggattgggtaattggatccgaatcagattgacactttcttcttctttacttttcttgctcttccacttgacaataccaatttagggcttggctggatacaaatgtttttatccttcttcaacccgttatccgttttactagacttaaaaaaaaaagaatagtatgtgtaaatatgatacatgatatcatgcatttgttaactacgataaaaaaaatcgaatatctatattgtccattttgcagatatcccttttaaatatctaactaaatatctgtaaatgtgaggtttaaaattgaaatccgtatatttttattgatatgcacaacgatagttacaataagtaacatgacactaataatcactccccaaaatttttatacaattagatataattttaaatactaatattctataaatatttcacaattttagaaattttgatactaaccaattaatgttagctttggataacgaatgaagttatggccatcttatttcttctgagccatctatttagccatagccatccaaaaattaaagagtatcttattcctcccatgtccagcttaagggacaagccagggaatagcgacacgtgtaaattgaatgtcgattttgtaaaaggaggtaagtggggtctacacagtggctgcaaataaacgaatcataactaaacacgtgtcaaagacacagtcttagaggagtcgatgtaagtgggacccagcatgacttatcttggttcagaatgttttccccaatggataagtgtctttttgtttttggtgggatgatgaaaccttttctatttacgtcgacgcaattttaaacaatgagactcttttttttttgtgtgtgtgcaatcgtttagagacttgttcacatgaattaggtgcccaatcatgtgtaaattggtaaggtatatgtaaaactaacaattgttacacttgccaactccaaacttagatttaatcagcctactatattttgaaaatttaagaagatacaagtactgatgcaaaagttgaaaaccaaaaccaactcatatgggccattaagcaactgaaacttgctcatatttttaaaattttaaccaaaaggttatgggttttaggcccattagtttttttcagactgagaatcacgtcaagttacagtaattagacatcaaactctagaaacatgtttgcataacttttgttgtcaaagatgttttgcatagtttcaaaatccgctttcacctcaattctctttttacgttaactaatcgactatgggagactagtcttacattttggtcgctaaaactttgtttatgaatatatggattaccgaaaaataagggaccatgaaataactaataaatgaccaaataatatatgatgttaatttttttttacttttcagttttcatataataatgaaataacttggttactctctttcctcgccgtagtctgagtctgaaccctaaaacatcccgcttcgctgctcaggaccaagaatctcaggtaccttgttaactactcgctgtaactattatcgatatccatatttcttcacaaaattcgattctctttcgttcagattcaactgatctttgcaac

SEQ ID NO: 3327 - DNA, 1163 bp, Arabidopsis thaliana
atattttgtatgtttcgttattgggatttggggttgcttgattcttatatttatagattttttggttttgggtttctttctttggatcaatctgtatagaatctctccatcaaatggctatgagtgttttgtttcttatgttttagaccagtgatgattctttaaaagggcaattgtgtattgaatcagatttgttatcggtagatttcatttagttgagttagctttgtgggagatgatcaaacttatagtaagttcaatgtatttagattaagattggcttcagtgcagagtaaatttagatgatttttttgtctctctaatgtgccaaatgtgtaagatgatagttcaagacagataatgtgtgtattcgaagaagtttaggtgctcaagacttagtctattggtctactaaaactagcctaggactgaatatagcctgttgtgacttggtttacagagattttagtgatggctaggtttataatgatgtctcggtagattgtttaggatgtgtggtgtgcacatttggttgagagttgattgatagtctttctggtttcgtgaatcgaacaaaaagcaggttaagcaatgaccttgtccaaagaagagggaccatttagcattggatttcagtggtattgctaaatgagtatctggttacttcccattccttagttctattggcacagtgtttatctgtttcgattttttcctatatgagtctatgagagattttagttcaaagatttgtattgccttttagcttttctgaattgcctctgcattggagctcccatgaagtattctctcttgaaaagagaactgcagagacactgatacagaaaccagtcacataactcatataaccaaggatagttttagtatagtatgattctccaaatgatgtgtacataccaatttaactacttattactctaatccaagttgagttaaaaaaaaaaacactatgtaaagattgatactttatggactaaaaattgaaaaagttgacaacttggagccgcccacagttaaaaaagtaaaaacctaatcctaagacccgaaaccactcaaccaaaaaactagggttctgtttctcgtctctctctcaaacccacattgcacaatccatttctcgtttctctgatttagatccaaag

SEQ ID NO: 3328 - DNA, 2000 bp, Arabidopsis thaliana
gctaaaacggcttttttttctttcatccattattgattttcgtttattttagttttgtcttttgctttgtattttagtaagattcacatgtcttgcattcagataaagagacgtttaaaaaagcattttagctaaggagattccatttcgggtgtccttatactgctaaagtcacaaactagagttggttaaagttgtatttctttcttttcctatagaatgttatgagctacccaaaatgctaacagaagaggaaaacattatcagtttataaacaagtgacgacattttcaaaaagatgctaatatattatatcttatagtgtctaatgtatcatttagttttaaaggtacatatatcaaaccaatatattttgatagatattcttattaaaaaaatcatcatgcatggtctagtaattaaaagtttatgttgagggtattggttccaagtgacaattaatatatgtttgaaccaatatggtttggtataaacttataagtaaagagaatgattattgagaatttgagattgactttatatatggtttagacacggtttagacacggtttagagcttgatttagtcataaaagagtcaagtggttgaggtgtgaacttcatatttaaagtgacgaatatcaaaagtatatagaatagacgtgtacctgcggtttaataattcctattaaaattcaccaatacattacgtgtcaaattgtatcctacagtatttagatttataatatatgcatcgctaccaaatttatggacacgttgatccactttcaaagattctgttttcggtaatagatttagaatccagatctcacctaggcttacaaaaacaaaacttacaagatccaaaatatattaaaagacgatttaaacaaaaaccaaatacattagaagcaaaatgtgaatttcgaggttctagcttaaaaataaatcgtatatactaataatggtcggttaaatggctggtcaaaaaaaaaaactgatattaagaaactagaatgtttaaaaatattttaagaaataaaagtgcaataagctaatattggccggtgttattaaaaaataacatactatttccacaatttgatctctcatttgtctttttccatctatttttatttattatgatagaaaatcatattatccaaaatatttttaaataaatgtaagagaattaaaaataaaatggtctaatcgaaggtaggtttagccgtttaggtgagaaaagagcttacttataccttttgataatgtgttcgtcaaaacagaacctataaagccaacctccaccgacccatcttttcttcttatattatttactccaagtttccttccaatttcaaaaaatataatcatctctctcactatctgaattttaaataacatacaacaaatatttttaatatatagaataaaatcaaaataagtcatcatgatctcaacatcagttgactagtcataagagaatttcataacaaaaattgaacatacacacacccaagaaaagaaaataaacttttttatttatttataatcctaagaaaaaaatggtttgtgatctaagaagttggagatagatagatgcatctccattaagagcaaaatgtttgtttttaaacagaatatgtgtccacacgaaacaacaatactctaaataggagatgcaaattgcatgtaaacactaattcagccaataacttcgaataaacaaccaaataataatacttactaattttgtttcccttcatccaaacttttctgcgtgtattattattatcatacagatttgatattaaatattacaaatatcttatttgtttgcaatattattatataagtaaagatgtatatcataatgtatgtatcctttatgtgtctctattataacgtggatcaagattctttcttatcttcatcactccacacattttcttgtcttcaaactcacacaaagaaagaaaagtctccaaagctcaaaaagca

SEQ ID NO: 3329 - DNA, 2000 bp, Arabidopsis thaliana
aatttaagtacatttctcatgggttggtgagttctttaattcttcatattttatttttgctcatctttaattttttgaaattttgatcgaagcagaacagctgcaaatttgaaaatctcagacatatctaaagcaatgtgacccacattggttggaatagagggtctctcagtacaaccaactgggtatccatatatgtaatgtctatacacaatctagttttacttcatattggtagtatattaaatatatatactataagaattattaaagttagttgtaaattgtaatgaattagagcatcgtaagtaaataatctttttttttcttttaccacaataattgttatgcctttacagaaatcaaagaatacatgaagggagcgaaacaagaaaacactaatacaaagggaaaacatgaacaaggccttgaaatcaaagagcagaacaataaagctcaaaaccatatcagtctaaaaccaacaaagtcttgtaggggaagaaatatcaccttcacgattaatcaaattcctcttgcttttgagttttgataattatcttgtcctataaccaacaagaccctttcactagcgatataagatctttcgtgatgcttttggaaatctcaattgtagtcccattgcaaggttctagtgtacattctactttccattcgatgaatttcaagaatcaactatcaattgacaaaacaggggaaaccaacgtggatgctcaatcgcctctaccagttggtgagaagaaagttcaaaatgatctgttttgtcttaggttactacggcgttcagtagcccacaagaaactcatcaaatccgtttgaaaagattatgtactttgaggatgatcatcttcaaaatgatggttgaaagtgtattgttccaataatataccctcaatttctagaagaatttgtattttggataataacaaatggcgtaaaaaacaacaaacatactcattgaatatatacttacaatgtcatgtacgaaccacataaaactaacttttcacttaacttttcaaattcctaacaacataaaacttatatttatcatattatgtagtataacttttttgcttctcctttttcaactctcaatgttttggtcatagtattttttttttctatttccataattttctcagaacaaggctactgttatttaggccttgtaatatttttgatgaataacattgcaataacagtgaaaataacaaattacagtcaatttggattgtaatattgtcaattaggctaaaacatataattcaaaagttggatagctcgtaacacttgcaaaatctctaaaaaaaatccgaaacttccaataaatagtactacataattccaagttggattgtaatttgggaaccaaatggttattctacataattgatgattgattgagacgtttacgctacaaataaaccaaagtcctctgaccataccggttcaagaagtcttccctctctcgcgccaactttgaccaaagactaacggtgaccacacgtcgtcaatcctttagtcatccaaactccaaaaccaaacaaaaccgaatattttgttaacctactagttcataaaattctacaacaaaaaccaaatttcaataaccgaaattaaaataatccccttaaaatttcgtaataatggtctcattttcagaaattgtattaattcacattaaatgtagtgtacaagtaataccaaccaaaccgaagcaacccaaaccggatgattttgacgaggtcaacactaacggcttttcacattagagttgaccaagagagagcattgacctgagagagttcaaataattgagtgagtctgtatattaaatacgcaaatcatcatcttcccaatttcgaatctcacacaccgaaagttattttcgaatccactaacgaatcttccacagcaaacacttttgtgttcctctgtaatttctcagtatatatagataccaaaacaagcagtgaaaa

SEQ ID NO: 3330 - DNA, 1567 bp, Arabidopsis thaliana
cattgtctttctcgttgttgctgatctgatcacttgtggaagaaagcgtacagtatatttaagtgtatatagaaattagggttttcgttacaataagcccataccatttattgaaaaccttattatgtgttgttaaaaagcccattacctccactgatcttcttttatgtttttagcatatatactagaaacttgggtctcaagctcttgggttgtacggttgtaccctctttttcttttggatttgagttgttacaatttttcctatcatcatcactcctcaacaagttagatgcaaatgattcttagctattttcttttagagtgttcatcaaacatttcttcatcttttacaaatagaaagttttcttcaaaggtattgaatagtttagtacgtcatttcctttataattttttcatcctctttccttaggtcttgttcacctagtaccaaaccctttttggcttcttcataaaaatgatggcattgcaaaactcaatttgtatttgctagattcggattttcgcagaacttaccctcgggattttaaaggtagaagtgttgtgatttagccgtatttattagtaatacatacaatatttttatttttatttttttggttaaaaagctagtacattattatcaccaaaaccgtttaatattgtagtctacggacagcttccaaactgctgaatggatgacgcaattcattgcagttcagacacacgaagtctcccttgacctgaaacaacaaccatgtaaatgaaagtgatgagacagactaagcagaatgcacaaacctgtagaccgaggtactttagaaaccctttaggatctttcaagtactttggcaatcataatgtctaaatggctttaccatggaattcattatgtatagtattaaaaaaatcattatatcaataaatagaaacaactacttatgactaagctcgaacaaaggaacatcaataaaaccagaagataaagaaaaatcatgaaaatcctgatgtaaaactaagagtttttctttcccaacaactgatagagctgcaatatcttcacgattaaaactcttaaacgaaagaggaaaacgtggttctatcagttgttggaaaagacaaactgtcgctgttacatcagaagatattaaagctatggccagaagattttaaaccctagagttccgattctaaatcgtccggaagatcggagatcatcattgtctttctcatctcatccctcgaggaagaaagcgttgcgtatatgtgtataaaaattagggttttcgttacaataagcctaatcgatttatctaaaagcccattagaaagcccattagcttcacaaaatgtattttaacccgatttaaaatttcgtttgggccaaagccatcttaacccgacccatattaacatcactgcttacgcaaacacaacaagatttggagatttgtcgttaaacaaatttcgccgacctacgtatgagccgtcgcctccaatataaaccaaagccatccctaatcctcgaattcttcctctctgagtttttattctgagatagagaaag

SEQ ID NO: 3331 - DNA, 1936 bp, Arabidopsis thaliana
tgataagatttgatgatggagctctaagctctgctccagaaggaggatgaagagaagaagaagagcgttttatccagaaaagacttatccatcgtcagcttctgtaatcccctctttcaaatcattactttcacggcccattagctcactattttcggcccattacttttaaccatccttctgtgggacaattcattatttgtgtaacccatttatctatattgatcatggcctattatctcactgtttctaggcccattattataataactgttcacaaaatttacccaatgaacgtggagtttggattagattaatgaagtcaatagattattagtagatgcgtttggatcaaaattgtgcatctttcccgattaagtatgttttcaagtcgaatcttttaaaggcatggattttaaactactcttaacagacaaatttaaaaatgaaatgggcccttaccctcagaaaaatccaaacaacaaattgagaagattcaaagaaaaaaaagatgaactgtatatttattttcctggttcacatttcatttggtcaagatattcttgttctaaataaataaaaagttcgataccgacaagatatttgtggattcagtggcatattttattttgtgttaacaattaacaaatgaaaatttcaataaggaactatgtaataacaaatgcagctcttataagttttttttaataacattccttaatgaacactctaaagacaaaaaatagtcgaccatgtgtttcatgcaccttttatcatatgaaatcaatagtacaattactttactatttatgtctgaaaatatctttttcttttcttttttttttgtgtgaaattgatttgacaaccgttgaggagacttattctttgacgaaggcggccttggagcaattaggtcgtcactcctcacattcacattttcaattattattttgcctcatgtcatacgtagttaccctaattaccatttaactatatccgttgtaaccaaaaagaaaaatgcatcaactaccttaataaatgatagttaccaataagagccaacgtaaaaatttgatttatcgaatagtatgaggacacaagtaaagcatcgatcatactaccccacaccttggcctacgtcttcactgaccactccagaaatagcactccaaaacaaaatttacaaaatttcataaaataccaaaaaaataagtaatgataaggaagaaaatagggaaaaaaaaggagagagaatattatgaattattctttgcttgagctcagaaacagttcttcttctgcttcttcgacttcttttctctgtctttcttctttatgcttagtgctaaatcactcgtttacttgtgaagattatggatctctgattaaagtttgtttctcgtatttattccaaggttgcttcttctttttctcaattggatcttttaatttttgtttttctttatgttcttacatatataatctttagttatttgttcattgaattatttattacactttttgcttctttctctgcgaaccatctttaagacggccctcttacacttcattattttcagttcttacttgcacatgtaaagcaccagtttctagaatcaaagggcctcatataaatacattattttatacactataaataaatatacagacacaaaaatctgtatacaccaatctctctacagaatctaactcccgatttcttggttggttttgccttctttcaccagatttctggaccatcttttttgtcttttgttataatctcaattttgattcaggttgggcattgtttatttcgcaggtgttactccaaataaatcaaatggttatatgagaccaggacaaagaaaaactagtgcttttgctggaaattgtgataaagatgggatttttggtgatgataagagaagtttcc

SEQ ID NO: 3332 - DNA, 1424 bp, Arabidopsis thaliana
tccgggtctactacacctagttaattgggtcgttaacaacaaggcaatgatacatcttttttgtatatgagaatgttcgaatccggggacacatgtttgtttttctgaacatcgagagacaatttttcgattaaataaatttatatatatttaagtttgattaaaatcagcaaattcatacaagaactaacataatttggtcaatcctaatgcttttcgtaactgtttaaaagcatgaaattttttatgatagaaaggttaagaatgaatgaggaacatcgagctagagagattcaatggaataagagattaatggcttctaaaatctctggatacgcaaaatactctctcagtctctcacaaattgatgtattttgtgaatctaatggctggtaaaatttcctcattgtggatttcaaatccacataatccggaaaaaaaagatatgatctaaaaaacaacaaaaagtcaggaagaatgggcttggtgaaaggcggcccactaaaataaataaagaattagtggacaaaaaaacctccgccgcatatttaacaactggtcaacgttctcccaataagatacggccacgtgtatgaacccctggatctgcgatgctgctcttaaattctcctctcgtcctcatttccatcttcgtctcctccctcagccatcccctctggtaatcaattctccctctctatctatgtttgtttgaattctctctcgcatagttaagattccttttttcgtattctagatccatagaatttatccaaaattcatgaattgtttctaagacacgaaacggtttaagttcaggtcatagtttttctgtagatctcgatttacgtgaaattttacttaccaatagatctgaattatcgaaattgcagttccttttcctcgagtgtctcgttcggcttcatgtcctgtggaatttttaatctttgtccgattctgaatccggaaattgttagggatttgggttttattcaagatttgtcatcgctgtgaaagttttccctttttttatgtgggttcgaagttttctgaaaatctcaattagtaaaaggatcactggacttgcttatattaattctacaccgtctcttcatagatttggtcaatcctgtatctcagatcttatttgttcatgtgatagcctttaaatgtgtgaacttttcatgtacttgcagagcttataaaaccttcatggcatttgcgcacttctgcagcatccactgtttccttaaaatcgggaaacaacaagagcttcttctccttgttattggattgccttttgccagcctttgttttagtcagttttctcctcattaacttctgtcggtacagaatctctctccaggctggtgaactcttgcagctttctcagtgattctgtatcgatttttcccgtgtaaatt

SEQ ID NO: 3333 - DNA, 1109 bp, Arabidopsis thaliana
ctgaaaaaataaatgtttgacacatgtcaaagatgagtatatgtagataaggcagcttgagattagtgattagtgattagctaccgaaatatagcagaacatatgacaacacataccaagtaaactaaaggacatctagttacatacgtatatggattgcgtgacaacatatacgaagtatatggtatcatgtcatcaatatcataaacatataatctcaggttaaaacatatatcataaataactgatcgactaactccggcgttagcaaacaaaatattcaaaactaacttttaatattaaaaacattatttttatttgatactgtataagaaaataaaacacattttatatccaatataaatatattttgtatatagatttaataaattaattcttacaatatagttagtttttttcaatttcaaaactaaattaagagaataaacattttttaagatatgaactattcattaatattaatagttagtttttttaagaagttaatttttttaattgttacatatttttaatcaatagttagtttttttcttatattatcaattaaaattattaactttttaatttaaactaaaaagttatatactcagttttttcatattactttcatatgaaattcatatagtcatgtgtattgagtataattgtaataatttattttttaataaaaataaaaagttaatttttttaattgataatacaaaaaaaaattccgttcccttacttaattgttgctaataaaaattttctggttttaattttaaatttttatatctaaaagttttaaatcattttttttatatttttagtttagttttgaaattgaaaagctaattattataagaatcaatgtattaaatatatatgtaaaatatatttatagtagatatataattatttctgattatacaataacaagtaaaattatatttttattattaaaattatttttgaatgtttttgttcgtcaacgcttgtcgctggtggacgtcgaagttaattgaccattgacaatctaatagggtcatatctaatccgattgctaaacaaggccatcgtctctctctatcaatcagcgacggaaataa

SEQ ID NO: 3334 - DNA, 602 bp, Arabidopsis thaliana
gagagttgcagccattgtgggctcttccgtatataaactaattatcttttgtgtttccacaggtgaaaatttctttttcatgtttatttatcaatcaaatctgtaaaatagattgaccaaagagagcaacccttctaacttgaaaagttgcttgtgagctgatttgaggctgctttgactgtctatcagaattttaaatttaaaaaaaaaaaaacacagtttgttttgtcctttacttgatcccacagctttacttgacgacacacttttgtttgttatgagttatgacacatttgactaatgcttaaaaccctaaatcccgctttattccttctccttttctttctagttacacaacacagaacagaacaccacacattcgtacttacatatctacttataattgaaagaggacctcatatagaaatagccttcgagctagaaaagcacatagaagactgattacgagagatagacgacgacgacaaggatcaaccaacacagaatccatctctctatctctctacgttatctcttcattcagagagtgcaaatagaacgacagagactttttcctcttttcttcttgggaagaggctcca

SEQ ID NO: 3335 - DNA, 960 bp, Arabidopsis thaliana
agtggttggtggtttcttcctttgttcttggtttgatggtgaattttaagttagaggttggtttatctattttcttgttgaagagtagtatggttggagtaatacgtccaattatatattctttcacataaaattgttatttttattagattgacgattcttgttttatatatttaatttggaattttggacaagcaaactctttgactctactacattcatgccggagttttagacagtctttaagaaaacgtagtagaattgcatcaaactatagatagttttaatcaaattaaaggatgtaatattttctttctaaattctggtatcatcactctttgaaattgtcgtaatatttggaaataaataagtaaggaacacatataataaataagtatgaaatgaatagagaaaacaatgtacacctgcatgatgatttctataattccgcaagttgcaaagagaatgcccaaaaaaaaaaacttaagaaattatcagacaaatatttccttattcttatatgtttataaatcaaaatgacaaaaatatcactcacttacaaaaatatcaccttaagaatgtctccatagaccggctgatcaaaatctaaaaaacaaaaaagctggaactttgggagtaaattgctcagcctcaagaatgtctccatatatacatactcggcagaatgtctccgtaaattttgaattacagcattcaattatggcatgttaacaaaacgctgactttttaaattcagtttagttcttgctttgtgttaagaccggttttagtctcggtttaaccaaattaatttcattacatatttcatgtaaaggtcaaaatggtcattttagttcacctgagctcagtttgaaaaaaggtcttcctcaggtttccccatactcaagtgccggcgaaccctaagacttttgatacctcttctcttctctctcttcgaag

SEQ ID NO: 3336 - DNA, 890 bp, Arabidopsis thaliana
aacaagactatcttttgttttcaattttttcttactttccctttcgtgttttgagtattagcatatgaatactatttattttttactcgttatcctttgttgtcttagataattttgaatgtatcttttttttctatcttttgtatcaaacaaacatgatgaatgttttgattgtggtttctagcgaaaacagaacaagataaagatttcagaattttaagaaaatggaaccagatttatgtgtaaacaaacgcaattaaaagtcaaatcaacaacaatgcacggcatactttaattgatttttatttttctagtaacggagtcaaggcccaattaaattatttattttccacgatcattaaagtctttaacgggtcaacaccgttagacacttgtcatactattactgggccttatttttctctttactttctctgaaaatcaaagcccatctcttcttccttttttttcccctaatttctcacttccccctcatttcgcgtctcgaccttcgaattcgacaaatccctaattccaaaatcctctcggtaagctacggatctagtctctcttttgctcatagttcgacgaaatcgtctctctgttgctcgttcatgttttcgtttcgttttgtggacttaatcttctctgtgttcgttgttatctggagatctggcaaaatctcgaatgattttgatagattctaggtttctaggtgtatctatcggtatagtgttcgttttgtcttgatttgttggtctcgacgatttatctgttgtttcttttgttttgttgggaataatgttgatatagccaagctactgtgatgttgatgaagtttgaaatgaatttttgaaaacaggatctaaaagagtgtgtgataacataag

SEQ ID NO: 3337 - DNA, 2000 bp, Arabidopsis thaliana
tagaaaagtaaaatattttcatttaaaatattataaaacagagaagaaaacttatactatttgaccaaggaaaaaaactacctactcacgacacgaccatcacgtttataatgttaatacacagttacaccatacattttttcattgtagttctatacaataatatatcatcgtttgatctaacaagtattcgatagatagtgggaacttttttttcccttttggccttatatttaagaacatggagcctgtgtttctaaaattctatctaaaaaagtatattttgtattgatcatatctgaaattgcatatattgtaaaatattgtgtacaaaaggatccggtccaagattaaacacacaatacttactgagactaaaaggggctaaaccacaagaacaaatccttgaaattgcaatggttaaacttacaaaaaatatgtctcttattaccagatcttaatattgtttaccgaatttctgaactaaactacattttttgcccaaacaaacaaagaactaaactatatttattcaagtcaagtcaaataattgcatgcaggagacaacgcaaaaagatgaaaaaactaaaaattcagagatgaacatcgagaacacaaataacattatccaaatctcattaggatcctattaaccaaccacaaaaacgtccacttcataatggtctaatagtacaatttgtttttatgtagaagtaaaagtgaagttcgaatattcttacattgatttcaatcatattttgctactatagattaacatgtatacatcagcatacacatggtccaacgattgagtctatactgcacaaaactctggagatgaatctaaactttggttcgaaattccggcaatgtatggaaaagaatattcaaaaaaataagaagaagcatattgaccgtttcttgttcaatatactagaaggtaaacgtcaaaaatgtcagcatgttttctttcaaaaacaaaaaaaaaaatgtcagcatgtggtcagaactcagaagttcttaccaagaaaacttaactaacagttaccatttagaccctaaattacttatgttgtatttttgtccgaaaactttgattaaaaaaataaaggtgtaagacgatgaaaaagaacaaaaaattatattgtcactgtatctttcaaaatcattctaaaatgatagacatgtatcttagcgcctccaaacttttccactctatgaaaagttgttcttcgttttttttttttttttttttttttttgtcaattgttcttcgtttttgaacttctattttgcttcgttttgatatttttatgttttcgtttatatttttgaatttttctttctttcgtttgagttgaagaaaaaacagttgttattatgtaagaatttaaataacaatttcaaaaaggaatattttttttggtcttactaaacgtctgaccggcatgtttgaaatatttcagtttcttgttgcttcttgatttaaccatccgaatctatctaaaccaactaaccaagtgattgaacaagaactaaaccgatttttctttgatttgatctgaatccttaagtagtaaagtccaaaacagcaaatactaaaactgaacacaaactggagccgaactgaatcccgaaggaacaggtgttacctattccgacaacgataaatctcctatttttgggatgttttatctattgaaaagttgttgaatgaggatggtctaatgatttttccggtctctccttacaaattacacttttatggttcaatccactcttaaaaaataattgaagtcaagattttcagcctgtggtcggaaagtccttacacgaaactgaagtatgatataaatttatctttagcatatggtcgaaaagtctttacaataaacttagttaaatagtagtaaacatatacactagctacacgtatttcatctttattatggtcacacatactacacaaccaacaaaaactacaagacgataacaacaaa

SEQ ID NO: 3338 - DNA, 2000 bp, Arabidopsis thaliana
aagtaaaataccactacactacatacatttttaattacataatgcaaacttatataagatttatataattgagtatcgggcacatgccccacccaagaccaacgtgtgtccgcccctggtcttatacattgtcatattgctgcggataacaaataaaacaacaaaaattgactgtatagaaagaaaaagaaaagagataggaaatgtggaaagtgagagagcaatatggaacccactagacccataagagagtattggttattggacggacttttcatgtgtctaccatactttggatacgtgtcgtccatataaagatgatgattgatgatgatagtggtgatgatgggcatgaccatgggaggcaaatctttggcagagaatcaagtgaacattgccatgtctttgccactaccacactacctaactatttagtaaattttcttattcttttgccaacgaatctgatcgccaagtataatacgatgagcgcaaaacactatttcacatttaggttacattttttttatttaatactgttcgtagatgtaaaagcatttaaaaatagtatctataatacttagaatataaaacatcatttatactatatattttatattgtggatttttaacaaatcccattaacaagagatacttgtagcatgggaacttacaactaaattaccgttatactactattttcctctctaaataatacattcatctcttcttatttatctccaaccactaaaaactttgactggtcatataatttttatgttaccaatcatcataattaagatttaccaatttaacttcacaaaaaaaaagatttatcaatctaatttactgattgagtattacaccagagaccaaccacatttgtactaaaagtgagaaaaagaaaacataaaaattatatccaataagtaaatgatacgcagcaaaacacgtcacatcgactcgcatatgaatacacaaaccccacaacataaactgctaaatagaaatagggacgatgttgtggtccgacgaaaatcttttccactagtcactctttcaatcaggaccattacaaattatttcgaatgtttgtgcagagtataaataaaaacaaattgaatattgtaaatacatcaacgatccaccgtaaaaacattcaaaattctattccttttttttttttttgggatttaaaccactcttaacattcaaaattataagcaaattcttaattaggttcaacgattatttgatcggtgacatcccagcagctcaataaacatatattaaaatcgaaaataaaaaatactgtcatcacaaaaactcgttattatttaatctcttttaaaacatcttgttttcgaacatcttgctaactaatgtataagtttttttgtttttttaaacgttaaactacaattctttttgacaatgaacggttttttctatatatatatattttcaaatggctgttaaaacccaccaatagcaatgcatgtggttgtggtagtatacacattattaaatccctcatcctcttatcttaaaaaaaaaaaaagtctttggtgggctaaacaaatcctttaaaatcttcatatagatttctttccattatttattttatccattatcaaagtcttttttttttttaaatttctttctctcgttgtctccttggaaattactttcatcatttaaaaaacttgcttactccgtaaaccaaagctagatccaattagtcttatttcctttttattcgtctctctctcactatccgagatttgggttgaaaaatacaaacccccttttatttctcctcttctctcctacaagctcattcagaactctcaacatttccggtagagaaaaaaaaaccgttttttttttaatctctttctaaagaaggatatcaaaacaaaacacaaagttgaaaactttgcatctgggtttgtctattttagattcagatcttagtttttttcgattgaatatctaca

SEQ ID NO: 3339 - DNA, 2000 bp, Arabidopsis thaliana
gtaggctttgtagccttcttgtagtcgtttcttcttatcttggcacaaaacggcgaggagttttatgcatggtgatggaaaactgtgtgtagttaagcttgtcgagtagacttaaatcaaagtcagcatttgcttattggaccagacgttagaagtaagaccataaataaagccaccactcgagctttgattcttttccttttctcaaaagttcagtttgttagtattatttttgtttttttaaatagagagatcaattatctaattgcaatttgcaaccttaacatgaatattagaaagacgaaaaagaaaaagtagaggtcgagggaagtgaacaagaaaaagaagaccattaaggaacgttgttgaatttttaatggatttttaactagctttcatcattcacgtgaaagattcaagagattaaaaaatgaaggctatattttcgtatcttaaaagtctcaattaaacaatgttttataaggctgtaatcttttttatattttgaagtttgatacaaaccagtaatcactaatcaattacatatcatgaaagaataataatgaaaacgatggtgtatatcaactttgacttattcaatttttctttgagttaaaagttggaatgaatcaaattaaaatatactcaatattatagatcctttattaaaaaaatcgcattaaacatacttttcaaatttagtgaataatatatgttccattcatctttgacaaaatgccagaaagatgagaactatagaatttccaatgtattttgaagattacttatatttattgatgtgataatatatgcgatagggtttcggttgccaacggtggcagttatcttccttgattatttttaactcgcacgattcagggccagaggggtccaacgttcgcttaaagtgtttgcttaatgggaaccgaatcatatatttataaaaacattccaattacttctttttttggttttaatgttaagattcaaaggcataacttgcttatggtctaaaaaatttcgttttatttctattaatttgggaacctgattctgttggagatttgtcgtctctttgagtttcttttacttgagtggcaagtacatttctgatatttctttatgacttctcacttttctttatcacaagatattttgttgatgaaagagtttttttttttgggtaaggaaacatgtaaatattttagtgagtcctcatgttggccgatagccatatatataagagattctgataaaccgttgaaaactttaacccaaaaacaaaaagtcctttctgtgacatcgaagtgaaaacgataataaagaaatctagcatagttttggacccaagaaaacgttttactctctattttgacaccacacaaataaaaaaatatgtcccaaatgttagctaaacataattaactctcgttaaaacaaaaatgtgatggttacgcgtgaaaatggatgatttatgtatttgtgattatatttccaatattttgctagcctactgaaaagtttaacgaaagcaatggataatggaaagattacaaacttttatattcgacataattttaccaattaggcaacgactttcattacacaaaattgcggaaactatacaaaattagccatggataaaaatggaaaataacaaaccgaaacttggctgtaacaaaatctgttagggatgtttcataaaaatatacaccaaactaataaaattcgaaaccaaccaaatgataaaattttgcctatgaccaaaaaaacataaatgacacaatgtgaaaagaaaaacatatttgttgattggaggaaccttcctgttgccacgtggaacttgaagtttgacacaattgctgacaccactgtactacctatctcttctttatgaatcttcaaatgtctttttttacgctataaactcactttcttctcctccaagagccaaataaacacacaaaaaaaaactcaaaatcatgagaagctccgatcat

SEQ ID NO: 3340 - DNA, 2000 bp, Arabidopsis thaliana
gacatttaaaaaaaaatcctatataatgataattaaaaatcagataacggtactagaaagtatacgtagtacatcataaattggtgataccgttttggtatataatcaatttttattagttttgatatttgtagtcatgcttgtggtttgtggtaaatctcataatgatcatttttgttttagttggacgaataaaggttgtggttgagaaacaaacacgtatgctgtgggatcaattcgaaccattcatacgtgatacgtcgactatagcaactaataagcatattttattaactacattacacaatattcttgattgacagatacatagattttatgtttgaattaattaatctttcgttatgttatatttaacaaaaacaatacacattatttgatatgtattatatgacaagatacgattccatgaattttctaatatacattacacataaattatagagcgtacgtcaaatcataacataaaatattactatatttaacaaaacccaactcgatggtctttgtcaatatctccccatgcaacaaaatacgtacatccctcgtgctttctaagtttctatttttgtatttttgttcctcaagtgaaatccatatccactacttttctagttgaaaaaagttagaagttaaaatacaagtaaatccagattcacttgtcagctcaatcctaacatgtctttgaaaatgtgtgtccgaaaacttgtcagcccattattaagtatgtgaaacaatactttaatttgaagtaattaagaaaaacaatacattaaatctactttttttctcatgtaaaactctttgacaccattggtaaaatccaatcatttatcttccgatcttattgacgatgtcattaatttgttaattgtatgatggttaataagtttatccaatgtatgtttttgtttaatttatttatccaatgtattattttattttaacatacaatgctaatcaaaattttagtttaagtaattaagagagtcctttaagaataataaaaaaatgttggtttataacagagagtcctttaagaataataaaaaaatgttggtttataacagagagtcctcaatgcaaatcagattgttttaaacctgcacacaatccaacaaaatcatctcttcttgctaaagctaatcatctcaattatctcacaaggttcaacaatcgtatgaatgtgaagtatatagccatacacccccatctgtaattaacgtgtccgaacggattgtacattagagcacctccaatgtataggattcatatagtttctaaaaaaacaaaaagtattaatattttatttttatatccaaaaaacaaaaaaaaacaacctatatgaataatagaaacgatcctcccaattttagagattctctctcatctcttttttaatttataatttttttttgtaattgtatgagtttctactaaaaaactacggttggagttggttttagttgctacaaatatagtagcaaatgtgttttaaatcggaatcttaaaaacgtatagtagtgctaaacgtctacgtacaaaatacgaatattgaacgtataaaaaaaaacactttctgaaatctgcaggttagaaaattatttaagagatccagttgcaatgtgagtagtatactagtactgttgtattaataagtcctaatcgaattaagaccatatcattataattcctttcttttgtggtcacgggggtaacattatttttcgattattctccattgattggcaaagattcattatccaaatatataaataaatcagttcacacacacaacaactggccaatgactcaaactggaacccactcacattgatcagatcataacacttttagcttcagaaaaaaaaaaaaaaacagctatcaaacatatcgtcttgttactctatttataccctaattccacatatctacacacaagcaataaagagagaaaaaaatataaagctaccaaagagaaa

SEQ ID NO: 3341 - DNA, 2000 bp, Arabidopsis thaliana
accctttttttttcttatagtaatgtcggaatgatatacgaattatagatatgaatgtacataaataagcgaaagttttggacgtacgttcaacctataattttgtagtaaaatcatttcttggtataaatttatacgtggaaaaggaaaacttatatcatcgaggaatcaaaattttctttgtctttatcatttggcaagtgaaataataatgtcgggatacaatacatttttaaaacaataaatttaagtaaatatgcataagcaatgattaagaaataagaaaaatataagaaagtatattcagaaaacaaaagtgaatttgaaagagagtccaagtcgatcccaacttaaagatttgagaagctgacttaacgagtaagttattagatgttggtctgactcaattttctactctcatgcacttctttaatttcaattattttagataaattattgtatatatgtgtgtctttggactggtgacttgccttttatccttcctttttttccttggatcaataaagctcccaaagcccccaccaaaccaaagttgttccaattttttgcttcaactttccagcatcagcctttgatttttacaaatagcattttaggtttagtcctctttgtataatgttatgttttatacactagaaataaaggttacataatttgtctttcgaaagactaagaaaagaaaatgaaatggattaaagatgattgtttcattgttaaggaatcgagattagtttaattggttggaacttggaagagagtattcatcagctttcttttgctgaatcttaattcgaatgcaacatgactagcttatatttgataaatattttaaattgttaacatctagctttaattctagtccaaaatttctctatataattttcatgtgttgaaagtaggcaaagctctatttgttttatattcataaaggatatagaaaaagctttaaatttgtcaatttagaatcatatgtcttactcctcccacgcagcattttggatttggtacttttcttcacctcgaagatgttggctttccatttcctttatttgtttgttttcaatcttctttttactttagattttgatgatttagcgacatttcttaagcaacgacatacataaatgaaaagtttcatttctttataacttagtgttgtcaattgatggttgatattgatatggtacaagcaccatcttcatgttcaattattctttttaaccatacatacacttgaacgtaattttttgattggttctccaatgcaaaaagaaaatagttttaaaataatgtctttgaatctagttctaattgaatgggtttaccaaagcatactaagttagtcaagtaagttacttttctttcctttttttttttttttttgaataccaggaggttttgggacgaagcccgtaattcccttaggtccgaaatttgttccaagcgtcactcgaaccgacgacctctaaactttaaagttaatcacaatggagattgtaacattttgattatcttggagcaaatgaattcttagaagaatatttgatatacaccaccaaaaaaatacatgaactagtcaacaaatagctgggtgaaccgccagttcccggttccatcagagttttaaaaagtccggttttatgactagtttagacccaaatgtgcctgctggttccctattaaaccggtcgggtccgggtttaaaatcactgagtctacccaccctatatatccgtacactcggcccagatcatgatccatatttaaatcaaacttttacatatttgatctcaatatgattatttaactgttgggcttttaatgggggttttggcccaataagtaagtaagcggcgtctcttgaactttattgtagccttttggggtttttgagaaaagtttttagggttttcagtcgctgagaacaattttcttctccttcttcttcttcaagcagagacgctctcagctcaccagac

SEQ ID NO: 3342 - DNA, 2000 bp, Arabidopsis thaliana
ttttatccctttcgattttgactaacattaaacaaatcattttcaaaatgagaaagagaaaaaaaaaaaaaaaaaaagataaagagttgggcttaatgggccttgagtttccctccggagcccaacaaagcccctagggaagctagcgtcgattgcaagaaacgcatatgcttctttccaacgttttgatttgtggatactagagaggatgtcaataaacatgattggtccaagcaaacagttgatcttcccttccctttggttgatatgagttccctggcaccaacaaggttggtgaaatcatttcccccaaaatgtataccacccattcttcaactttccttcttcataatggactcatacacgatatgtgcgtctctatctcacccgaaccttgtttttcttcaaggaccttaatgtgtaagagcttgacagactctgtttttttcttctttgaatcaatatataagcgttggcttttcaacatcaagcaaactagttttttatcttaccattgatgatttgcattttctgacatgtgttatttctttttattgttgttcatattttgagtgttttgtttgtttttgctcagaaggtattatatgcacaagatttcattgaactgtatgctgcagataatcatcgagaagctcgtttatctatgaggattaagccattgtggaagttttggaaaacctaatcttaactatcatttgtcttaactaccaataggtctaattctaaaagacagtggaaataaaaaagcagggaagagaagggttaggtgaaggtggtctacataatttgcctggaaatcaagaaaagtaagagaaggatattggagcggaccatagcacatgaagatgaaacattctaatggggctcccattttaaaagggtcccacagaaattttattgtaattaaatatacatatatatatatattgatttttaataggagaaatagttagttttatacatattaatcttaaataatagtgtgatccaaaatatttataaatctaacatacaattaaataaataattcagagttttgtttaaattggtttctatttactctatagttttaaagacaaaagtactttgttttcgtaatttaaatggcccgaatttcattggtccggctctgtaaaataatatttactattgcagattcctgcaattattgggaaaatggggactagtcaacggaagcaagtcaagagaacatatcaagaatggagtgtgttttcttagctttaagaagcagatgctacggagagatgagagaaaactcaaagagaaacaaatttagtgagacaaagagagaaggagaagatgaagttgcaagagggtctgatcttggtggcataatgctttatgactcaaaatgtctaaatgtggggaaaaaaacaagtcgtaataaaagcatcataagaaaacagagcatgttgtgatcaggattcaggagtctcaattcctatatcgtcattttaaaaggcaattttcatattttgagcgtgaaattaactgttaagaaaaagagtaaatttgccttgtaatatcgagaaaagaagagaggaccgagactgaagttgacttaagagggtcttcataattgaagattccttgcaagttgcaactgtcttaatctttgaatagtaagaaaataagtgtcactgttaacaaaattaaatcggtttccccactaacgaaaaaaatatcaagaatgacgagaagaccaagacctatagttgtcactgtttaaatactatacaggaatatgcagcaaacgtcctcttcacgcctcatgggttacattggttgtgtagttgaattttcgtcttcttgcattatatgacaaaatgggagcgggcctgcgaaaatgagtgaagagaacatttcatatacagttgtttctaataagaaaaaggagattagcgaaaactcaaaacaggaacaaagttaaaagagtgagagagaaagaaagagagaag

SEQ ID NO: 3343 - DNA, 1829 bp, Arabidopsis thaliana
tacttcaaagtctttaacctgcaagatccaatgtgtcacatgttacagaagagacccaagtatcagaagtattagattatgttatatcttcaatatcacagtttcataaatactaagatgaggaataacaagagagaactctgaagcatgatataacaacttttgattactctttttaacattgcagaagtgactccagaagccctgaggcatcgcaggacattgacatattgttcatatagtgaaaaacagattacacagattgaatacgacgaattttcgaattgttatacttatacctcatcctaagaactactacgccaagagtaagtgatagtactcacaacgagatcaaagatgagtacaatcatggtatgaatgaacaactgaaagttgcaaaacatttcagcaaaatagaactttcttctgcatcataatggaaacggagagaaaatcaattggtcacattcatgcccatcagtctaacataattgtccacaaaatcagcgcacttccctttaacgagtcaatcaaccataaatcatcaaccaaagcaaaaataaaggcaattagaaacctaactctacatctatacatccaaagctaacatcttttaaacgcaggctactgttactcaaccaaagttctcaaaaccagatcaaaatgtcaaaatgaaaggagagcagaaaatatcaatcaaaaattggttctttaagcaaattactccaaagtccacaaaattaaaatggaatcgaaaggaacctggtgatgaaggtttgatgatcactcgaaaatccgaaagatacaacaaagctgatatttttttcttctacagagaatcgtgcctaaatgcgacagaagcctaaagtttccctatttagttgacaactggttcggtgacgcttagtgtcgtggccacttaccaatctatcgaaaaccctaaacccagtaagagctctcgtgtgaaagagggatagaggcagaaagcaagccgtctcgagttcgaacccaactgtataacacaagagaagagatttattgcttcattatgtaaaaaatattgagatgatccttgtaattttggaatattatcaaattgaaccaccatactttttaaaaatccaaataaccctcaaccaagcatgtttcatgttgtggcctcattcacactatacgactatcaagttcatcgaaattcttgatagagaactttaaatacttaaatagttaatttagatactatctaataacttttggcggtttataagtttttgtgtttttcaatctacataaaatttagcgatttttcatgttacaaaaataatctcaaaattaaagtacaacccaaaaacataatatcaatgataataactacatttatctatgattcattttcacccaacatttacattcaaaaaaatgctgttgttacttgttaatgataacgattaaggaaggaagtcaatggaacaaaaaaaaaaatggtgataagtcaatgtaaaacgatgccgtttgtaaccataacagtgttaaacatgagaataaaggatcaaactttgaacagtggcttgcttgcttgcttacacacacgggtcaagtgaagacccaaaaaaaaataaaaaaattaatagatccgtacgcacatgactttcacttcttgtctctcagatctgttttgaccccaaaaccaacgaatatcaatttctccaatttcattcataattcactcaccccaaaattacaaaaaaaaaaaaaaaaaaagattttccatttccctcttctcgatccaccaccaccaccaacctcaaaagctttcatctttaccggtc

SEQ ID NO: 3344 - DNA, 2000 bp, Arabidopsis thaliana
ttttaaagaaaagtggtcccatatattttttctcttatctcttaatataaaggcattttagtatttgatatatattttgtcttgtagtttattacacaaatcctctatctcacaaaaagtaaaaaaagtgtttatttctctaatttaaaaaaaaactacctagtttgtaaattatgtttgaaaaagtgtctacttttctaataaacccttaattttaaatcctgtatatgaattgattatgcaaataattaaaacttaagcttagtaaacagtgatatatctcaagttaaataactacggtcaatactgagaacttttctcggttaggattaattagcattatgaagacgtggaaccgacctgaaatgtactaatattaaatgttaattgtcgtcgaaggaacaatttctatgattgaatattaacattatacgcgagcggttgaataattctgctgattgtttagtcattttgttcgtgaaatgatgctttgtcaacatcaaacattataatgataaattgataaccataattgtaattaagcaagtcaatgttctgattatctcatacgtgtaatttcttttgatatttactttttaagtactccaccgtcaccacaaaaatccagtgaatcgtaaatacaaggtttatacaagttctatacatgacacgaataacaaatatgacaaacaaatgcgttgggcgtgtttaaaagtgtactttttcaaactataaacccgtgtttataaataaatttgatgtagaaagaagatttttattctgtctcgttggtccaactgtccttccagataaatattctaagcaacaaagaaaagttttataatgatcaagatcgccaaaatatatcccagaataaatcaattatttcgtcgaaaaatataattaattgttttaatacatttgaccatttgcatataaatctaaaaccatgtccaaaagctgctctaattaagtatatatatgttttttttttcctcatattacaaactgtaaagaaataagaatctctgcactggacagtttatgtttgcatgtgtacatatacataatacatcgaaacgtatataaaacaaaagcgaccaagatgtttgttttctattgtttattctctaattcatatgagctgtatatatatgatgcagatttgatttactctattctcaattacatttttattctgttatcgtatgatttatatagataatctagctatgtgtgttgtcaatctgtccaaataatatctttgagggaatgcattcgtttatacatgtgtacaaatatagatatccaccaaattcaatgattgatccaccgttgacaattacataattcattcatgaaactatgaacacacaggatatgtttcactctcatttctttgctttataattttcttattattatttggccatacctcagttttttatggacgtaacatgaacatcgatattatgaatctgatgattgaccgttaaaattcattgcatcaactctttacaagcttacactcattgcatcaaccgtacgttaacattcttataattttttaattcattgtttcaggttgtcaacgtcaatcttattttcgcagtaatatttaccatcatattctttcctcaacagaaacataaacattctatcacgctgcataataattcctaaatacatcacaccaaaactagtggttaataagcgacataaccaagatgaacctataagctagcaaaccacaaacttgggttttatcttctgatgtttgggcctttcctctaagcccaataaagtaatctagcatcaccaaaactgagagaacccacccacacgtttgagcatttttttaaaaaaactatttttaaccgccgttattattgttttactcccgtaaaaaaaaaaaaatctatctccctctcacaatctctcctaacaaatactacaatttggtaacagatctcatcggagcaacagtcatcaaagagcca

SEQ ID NO: 3345 - DNA, 2000 bp, Arabidopsis thaliana
tatttacaaaacggttacaaggtgaatcacaaagtttccaatcatgaaaatataataaaatgttatttattttttgtttgttgcatgatccaatttgggaataaatttagagtacgtaaagctgaaagatgtttaatgcgtctagaatgtgcacttattaatgtctctatgtcaccaatcactaatctcaaccttttattggggtcatatataaagaaaactgcatgtacattatacattttttttctgacaaaacataaataaaaaagctttatccccaaaatgtaactcaaaatacggttaatcgtattcaatgctataaatagcaagaattagataataagtttagccattttaattcactaacttaatgtttcaacaatgtgaatgtaatcgtccataacacaaaccacatcaacgacgatatttcaacggctaattcagctcggaccattagatttaacattgtttctttcacatgaaatttgacaactcgtcagggtatgagacagaatctaagaattacacgacaaaagacaatttttcattcggacaattttagcccatacctttttaaaccagaaacgtgactgctttgaacaatgtctggattgatgctaagggtaacttcggtaagataaaatatccactttttctgaaaagaatctctcgtcttaaaatgctgacgtaactcattttaccgacacgttatagttagcttttcataattattttattaaacgttattagtttattaaatttcgcatgttaataaatctgtgagattaccgatacaacctatggttagatattttaatttacatctgtgttgaaaaccaaacaagaagattccatcttaaaatatgggccattatatgttcatctaattttaatttttttttttttttttacaaacacaaattatttatgttcaaaaatattacaaagaatttttaccactttcatatatatttttaggattttagaattttaaaatatggtggtacgtttgtataataaaacaaaaaaatggtaagtttttattttcaagaacacaaataactattttcattaatatagagtttttggtgatttcatgaatatgatttttactagctttttcgttatacattttatagtaatattgatattcacaatctcatgaacccattattatttataaaatcatgcttataatattcagtaaacgattttttacggtaaaatgttatctaagttgaaactcgtatataatttatagatgataaatatatataccttgtatggtttaaaggatgttctccttaaactaaatttatattgtgtaaaaataatattgatttctatttttggtgtatggattaaagtcataataagtccactgacattacccccactgcccctaacattaaacctttcttctaattactttgctgcttaataaagcaacggctgtgatttcattacctcggtgacttcagatccaatcaacggccccacgttcatctctctctctgaacattcaaacaacaaatatagaaaaataagtagccaagcaacaccaagagacgacgagagcaacaaaaactgaaacgtgcctccatttctaaaacccaaatccttcttcgtacaaacgacacaatctctcttaaatgccaaaggtcctctttttcgtcttcttccactctctctatacttctctcacaaatctgggcatgttttgaaatccacattcttcattcactgagtttcctttacctcttaaagtttcaatctttaggtctaattctctcttcttaaaaatgctctgtttttgttacttatttaaaaacttcatcttcacgggtttccttccgttttttctctcatttaatctatttctcaatttatctatttctctgaaagatctctaagagagaaaaaaacaaaccttttttgcagattgagagagaaatttgaagtaatttaaggtaacaagaagagaacaattttgttctgtt

SEQ ID NO: 3346 - DNA, 1881 bp, Arabidopsis thaliana
ctccacaattaacgagcggcggatatacaaaaccaccactgacacaacgctgcagaaacactaacacggaactgtgactctccagggtttgttcctcaatttcggagtacaacgaagacgatgaaacttagatagaaccaacaagtgatcgtcttcacaccagagccagaagaactttaaagtaaaacctaaattgttcaaattacaatgattatattacagcaatagaatcggcttaggttccaaaaatcgaagaagaaatacctccaattgtctcagaaaaaaaccctaatttctccgattgcaccaaatacgaaagagtttataggtgaagattggttaaaggcatggcggtttgcggagctcggcaagtctctttaccaattgtgatacgaacgaagaataagtcactcttgtaattttttttttctctttgctaaataatttttttttttgttgatttagtagttgacattttcaattactaaaataaattcctttttgtcatcaattcactagctccattactagtagaaatgtagaatctttggatcatattattttaatgacattaaattttaattttaattttttctgtttttattttggtgaaatttgttttctacttttttatataagttataataaatgcatattttgaaaattagttacttcatttacaattttgtaattaccaagatatgagtaatgagaaacatgaaaggtaaatggcctttgtaaatcaagtcttttttttcttggtcaagaaatcaaaagtctttttctatataaatataatgtcttgttgataaataaaattaaaaaataagatatatatatatatatagtcattagacagagatgaaaacaaaaagtcaatttcagaaatagtaaatgatataataaactaaatagaaactgtttgatgtagtatagtaagtgatgatatactgaatacaactattgtaaaatgaataatgcactaacttaaaaacaattgtgtcccaaaaataaattaaaattttcaagcatatatatatatatatatatatatataattctgcaaatttattgatagacaaaaattatcaatatgccattacatttgaacttttgaagtttaaaaagtatacacttcatcaactatattaatggccaagggcccaagtccatggatgaaagtgaagcctgttaatacctatttcctaaatgggcccatagatatactagccaatttgttttattcacatatgctcaaatcatgttcctcctactaatttcgtttcattcagccttcattacaacccacaaagaaacttcattcacaaggtccacaaaccaactttatatcactaaacaaactaattgataacggttttctaaagataaatctccacaaagatgatgtcaaacaaaaaaaaaaaaacttgaaaaggaactgaaaaaaaatctccacaaagactcaaagtcttattagaaaaagtcaacaagtcaacgatgaacagaggaagatgaggaagaagacaaagtccaatagggcgtacccaaaactgagagagaaagagagaggaaagagctcaaaaaaaaacatcttttcttttcattttcaattagtttcattattatcacaaaagacttttcttctccgagagaacaaaaggttaggctttattgattactagccagctcaattttctttctttctttctttctttctctgggagtttgggattttcttaagggtctttttcaattctcgctccattttgtacgcatagaactgggtttgtgtttacacacataaagctcttatcttttttcttctttcaatcgagaagattatagagctgagtgactgattggtggtttcttggagtttta

SEQ ID NO: 3347 - DNA, 1309 bp, Arabidopsis thaliana
aaacaaaaaattgtaaaagcaaaataaaatctatcgttgttatctctcaataaaatctatgtttgtaatccttgtttttcaatatagaatataatatggagttttcataatttcttctattacaaaattaaagttaatgcacaaataaattgaagggacttggaccttttcgtgtaagttctttctttaaatcacgaacaatttagatttatattttcactcttacaaacacaaaacatggatgctctttaactctcatccaaacaaaatgcatttctctctttctttttctaaacatttcacaacaatatcccatattatatctaagatatatgatctttttaaattgaatttatttaggccatgttttaaaatcgtgtttggttagattgacccatgaaatgttgacatattttaacattcctaaatatgactaaaaatgattaaagatatttaataatatatttgctctattaaaaatgattaaataaataataataaaaagtatttccaaataattttttaaaaaacatgtatttataatatctccaaataaaacataatcatgatcagaaaatccaattaaacacatatatccataaaaattaaaatagtttcgtcaattcaatgttaaatcattttcatctaagttaggaatgaatgttttaagtttgacaaagagacgagaaaactttagaaatctcctcccgtttaatgaatcaaaattatagtctttgtactttttggatgatctcctaggcgatgctccagatccggatcggtccacaacagtccatcgtctcacctcgataagtttgacaagatctcattcattctcctggagttggttagcattccaaactaccatttaccatctatacattttcttatacattttgttacttaacctgcacaattatagtagttacgtcactttttagtacttgtaagattttgccactagtttatagtatatacattacatataagtacaatataacattccttactcataagattttgcttatcaactacagacatacatagaagttggaacatttttagagcccaaaggaatgggcctagtatgccgaagcattaatttattttattttcatcaaaaaaaaaaagaaaaaagagaaggcggtttataatgccagcaaactctgcaagggcaaaaacgaaactcatcgaacaaatttcgaggctttgcttcttgaatctcacaagaagccgtacagtttctcagctttctagtgttttctcgggtagaagagagatagagagacagagcaaagcctaataagcg

SEQ ID NO: 3348 - DNA, 2000 bp, Arabidopsis thaliana
ttttgattatttaagttgccaaccaagctagaccactttccaacttttatagacaaagtgtaagaacttagcacatgctttccaacaaggaatatgaaactttatttcaaaaagattattgttaaagcttttaatcattctaaaaggtgattaatatttgaattattggaagtaacttgttttggacatataccaaattaatcaatagtatcaatggacatataacatgttgtgagactatatcaatgttatattccaagccagttaaaccaatttataatgataccatttatagataaacaatacactttacacacattattttcttagaattgggtctcatatagaacactcacaaaggtgacttataaaaaatgcttcaaagatcctagtcttttagtgtgcattcctcaaaatcgtagttgatatgtatcttgctcctattcgggttttggtctagaattttggtttcaggaattttcaattaactcattaaaacatttataacataaaaagatatatcacgaaaaccgatcaatcatttaatatatttttattttattttattttttgtcacaataaaatctagacaatagtgtttaaacatttatcaaaaaattcaccttacgattaatttgttttatattttgtgatgatgcaatttaatctatataaattataaaacatatcgataatctgtgtttttctttttctacatataaaattcataaaaatgagagttttgaagctcttaaaatggactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctctttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaaa

SEQ ID NO: 3349 - DNA, 322 bp, Arabidopsis thaliana
atcatttgaatttcagatatcaaataagtgcacattgaaaaaatgttttggtttattgaattacattggagactgagaaaatggtattaagattatgtagatcaaactatcttatgcacaataaagtagctttctttgcaaaagaggcaaaacagtaacgaatatatgatcaaaaagataatcgcttttgaacctctcatcagtgataagagagaaatattccaaactcataaaatctcaaatggctaataaataagaacattgtgagtcactctctctgtttctcatctcctcatctttttatcttctttgattgatccac

SEQ ID NO: 3350 - DNA, 2000 bp, Arabidopsis thaliana
ggactacgatctctattctactatatataattactattaattaaaatgtttatatagttatgatatggttgatagtaatttaatagtaattgttaaacagtagagaagtgacactgagacatatctgagaaaagcctgaactcaactcctacttctggtttgatttcttgggattcgttctctttcatttacttacctctccatctatacaccaacatatatatatatatattggtatgttaattctccaaaaaaaaaaaaaactattttaggagcaaaactttttcacagttattcattttttaagttaacttaacttctcttctttgtttgaaaattcatttatcatcaaataattctgttataaattagacctgataataattctttaacaaagaaaatatattttaggagcaaaataggcagagccgcagaggcatacatgtattatatataacgattatttatgtatagaaagggacaccttttgtacaaaatactagttaaatttgtacattcacgtgactggttggctaaatttagaatattattattttcaattaaaaatcatcgtcaatgttcaaatattgcttgagatacgctatgcttcataaaaatgtttaaaaagtagttccaaaaaatattttcaccaaaaaaaaaagtagttccaaaaatattcatttaataacaaaatttgcctacataagcttagcaaacgacactaacaccaaaattgatatcattttcttagataacatattgtatacatatctacatacatactaaatacatatacacgtagattacacgtatggattcagcaataaaaatcaaaatactaaatacatatatacatatatatatatatatatgaacatttaaatactaaattatgtttaataaataattaaatcaacgtagagatatgtcatatgaagatggcttgtataattagtttgtgtaccgggcaaaggatctctaatttttgttttctttagttcagtttaattatttgttatctatccaatcaattttttttctaaactgtttggaccaatgtacgtacgtaccatcctttttgattttttttgtaaactaaattttcgaattagcaggttcttaataattgaacgaagaaaataaagaatagaggtagacacctgtagtattttcttggtcagaccaataatttataattcaacgtcaaagaagaagaaaaatataaaccattatttcattatgacttacgtataccaaaatacacaaattaaatgtataattgtgaggcattttatatgcgggaaaaaataaaataaaaagaatattaatatttcttttgaaaattgtaaagcattttgacccacttgtgatatatatatatatatagatatatatagagagagagattaaaacattgatggctagctatagagtctatggcagggtcatgatcacctgtcttctgatctctgaagagataccaatctgattttttctcttcctaggtttaattttattttaccattttataattctttatttttgcctgtagtacaatttacagacccatactaaaagaaaaattaaattttgtcaaagtacaaaacaaagagagaggtgaagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagac

SEQ ID NO: 3351 - DNA, 2000 bp, Arabidopsis thaliana
ttatcatccagaaacaagagaaaatgtctcatccctgaaaagtgcctaaaaaaaaaagagaatattacgtgattagacacttttttaaaagttagttcataattatgcactttaaatagagaaagcactttaaatggagaaggcactttaaataaattattttatttatttactctttaactacattttttcaatcggctatctcttctctctccttttcccatctcttcttttttttttctttttttttttctcactttatcgaagaaaaaaacctttcccagaatatcttcaattccaaatctgcaattaatctccaaatccactctacgcgatggctttctcttctctcttgactaattggagaatacgaggtcttggtttctttaagattgtgatttattttgcaatttaaatatttgttttgacataaatttgagatttagttatctaagaaacttcttcttcttcaacaatggcgacttgaattgatttctgctctctctcatgtgtcaaactcgtttcacctatgtagcatcgagattccggttaatcaaatttcctgttattatggacatggtatacataatggatatagatcagtaaaaaggtttccgaatggatatatttaaatggactcgttattatggacaccaaaaaattgtttgttgatttttctttcggtttgtagagacctctaccttcaaaaccttatggacatggaactttagtttctttacaaaacacggttaatcaaatctcctgttattattgatagggtatatagaatgaatatagatcagtagaaaggtttctgaatggatatatttaaatggactcgttattatggacaccaaaaaattgtttgttgatttttctttcagtttgaagagacctccacttccaagatcttatggacatggaactttggtttctttacaaaagcacggttaatcgaatcttctgttattatggacttggtatatagaatgaatattaattagtaaaagttttctgaatggatatatttaaatgaactcgttattatggacacaaaaaaattgtttgttgatttttcttacagtttgtagagacctccacctccaagaccttatggacataaaacttttaccaaattcctgagataatcgagatcgaattgtttaagaaacttctctcaaaagttatggagacgtggagaaagagaggcgctacaaatcatgaagagagagagagagagagggagagagagagagattttatttattttgggtaaggatcgtggaagaggaataacaagaaagagaaattgagaattaaaaacataaatattgaattgagagtaaaaaaatctaagaaaaaaaaaatagtagaaaaaatgtttatttcctataaagtgccttaaatcgaaaaatattttttaaaaatgcctaatattagaacatttccaaaaaaataagattttctaaaaatgcctaaacgtgtcaaattatcttgaaaatacgttgaaacagtggtggaaaaatctcgacccgattggtatcaattaaggatccgacgcgtgtctcttttattactgagaaattgctgaaacgggtcaaatactatgaacttgatccttgcatcgttctctttggccccttgcttctgtgttcgattctttccttcaaaccataacaatctcaatctcttattcccaggtctctctctatctctctctctctgctacaagcttataagtattttgtggtcacatgtcactaatcattctcatgatccttaatcttagctcctagggtttctgtgaattagtctaattttacaattttatgcctttgaggatatatcttaatgtgaaagttttaaacttgtaactcaaaaaccatttgttagttagtaatcatcatcattctgaattgagctttgtttgaatttgagtagggcaacgaaagattcaagttagttgcggtggtaagagtgaggtgttgaagagtgataca

SEQ ID NO: 3352 - DNA, 2000 bp, Arabidopsis thaliana
tactactgacagtctgacagaagtaaccaatacaaaaagataaaaaggtgatatgtactatatacccaaaacctaatgagccttgttattagcaacaaaactcaggtcatatagtagtatttaaacaagtgaaatggtaaaatcgtatagaaaggaatttggcaacctattaattaatggatcattaaatatttagaagcacacgagcacttaaataactcgatttttgattaaatgctgaaatgctggtcttctttgtggatcaacgtgcagagtttgtcctatgccatttgttactccagattaataaatattgacaacttctattagtattgaaatttgagttgtggcagctgtttttagttgtattggttttctcggtgtttgtttccaacaactagtaccaaatcatcatgtccagtttttttattattactagtagtattttctttcgtcgacctatattattgtttcaagttttgtaaccacataatctaattagcacagtaatgtagtcatcaaataacaattcgtcttgctcgagtcctgaatccaataccctgatctaaaccattttctatgggagtatgggaatgggactcacattttcatgtgggtgtttttgtatgttgactgcttcacgcggttcgtatcgttctactaaattattggtaattgttcggatatataacatttatgaaaaccatttgcactttcacatgactcgcattaatgccactttcctcattttccatagttcacataagaacaacatagtacatatactataaactatgtgattgattactattttgaagaaaataaagcttgcatacatacaggtttctgtattcacatttagattttcggattcacaagctcgaagtattcatatttgtattttcaagttattttctctgtgttatactcggaaaccacattggcctatctaattaacaaaacatatgatatgcttaaatggcattaaatgctaatatgaaaaacatgtcctatggattattggtaagtgcgagatttaatgaaagttacaatgcttgatttcttaaaggttacaatttcgtactattgaagacaaactatatttgcaagagaagaaattagctaccaaaattaatacagtatagtattccctcttctgtcactatctgttcactgcttctgcaaaccaatattaaaacaagttgacctatttgcaactatctgtctccaattatgtttcaatttttgtgtattttggattttctttgctcggcctttttccttatatggattctgaatgctaggaaaaaacagaatagagtgaattggttctcacatgcatagaagaattttcaagagaaacatatttgctcaactaacaactaccaacccatcaccaaattttcgtttcatttgttgtacaaattatagacccaaaaatgttcatccacaatcgattgaggtacctcatgtacacctatattaaacatacaacataattccaaaatggtttggatccggtctggttttttactttgaggcaaataacattagattatttaagattgaaagctcacaactagccttcttttagggcaaagtacacgtaaccaattttttaattttcatatcgaacttaacaaattgtaaccatttgcaaaaatgaagcaaacaaaaagtacaaaacagattacatggactattatataattggaagcccgtttggccttaaagcccgttaaaaaaacatatgtgtattttttagcaatatgtctgataaaaaaatttaaaaactaatcttgtttaattcagtaagacatttactagacttttcacaattcaacacagttgttgttggttgagctacccagccagtatcaagagaggaaggtagagaggagtgagagagagctttgggatcgatttcatgtcgtagatctttcactctgggtttgcgttccacaaaatcctaattcgcggaactctggatttgatcggcg

SEQ ID NO: 3353 - DNA, 720 bp, Arabidopsis thaliana
ctgtctctgcgcgccaccgagggatttatgaatcctggccgttgatattttaaaatacagatttgaagcttgaggacgaacgagagccgttcattaattggatcctgtattttatggttcgttgactaagaaatatattattgggtcatcattccgatcaaactttgcttgcattatggcataacaattagatttttgttctgttaattatgcaagtttgaataattaatttacatttgtatttttttagtagaattttcattttttttttcttaatttggccattcaaatctctacttttgaagtatttcattgttagttgttatattagttccatattacatgatgactactaaattgtggattataaactgattgtcttttgttggtacgactttttctcgttaatgattttgttggatatattagcgttatgtttatttacccgaaccaattagctaaaacgcaaataaatttaatgaattaattaattaagtgacacggaattgtgtgcctgtatgtattgtatcgtatagctgacatgaatgcttcaactccaaatctctacacttccatataattaaaacacagagagacgaagaaaatcgagatctcgaataatgcgaatctgaaggatctttacgaattccataatcttcagatcgaaaggtttctatcgattcgttggtcaagaggagattgtgcgtgtgattcgtgagc

SEQ ID NO: 3354 - DNA, 799 bp, Arabidopsis thaliana
ttcacgtgaattagttcttcatcgattgtactatgaataagaacgaaatgataatgataattttcaatgtaatattttttttctgttttgtttttgcctttcatacttttgttttgtttaataatgtaacttacatgaagcctcctccattagcagcatacggaattagttacgtgcatcatttgttaggttaccattgccaccgtagaaactagaaagcaatgataaactaggactacattatttgatttatgtcttcggccaaagaattatcttccacacaaaaattttcggtagatttttttcagaatattccgcaaattgagaagatgatttatcgaaggttgctgaatctttttgtccttttctactgtgtgatcacgttctatctaatacatgattcaaatcatattacttagtactaagaaaaaatactttctttatttgttttttctttctattttgttaaacacatttctttagttttgtacatattcacaagtgtttggtatttctcctatatttttcaacaatagttttcctatctatgacttttcaaatttgccacgtattttcttgtaagaaaaatctaggtaaatattttcctatacatgtatattacaaatttacacatcgccatctgttcataaattgcatatatctttgattttaagcatcactatctgagtctttatctcgagcttatcctcactgacggcaataaacggcaataagttcttttgtcttaatgtttctctatatcaaaaaaagcagagcacaaaccagaggaacgacaata

SEQ ID NO: 3355 - DNA, 1231 bp, Arabidopsis thaliana
tctcatatttttctttatctttttagttgctgacaaattctctttatatatttaattatgtggatatatagatatgtaaaccaccatattcttttattattttatcattttttctaaatatttttttatattcgctactgaataaaaacgtgcgatttaattacagttaaagtacggtaaagatcaactaataacggaaaaatatatatatatatatatatatatatatatatatatatatattttttttttagttactattaaaactgcattgtactatgcggttttattatcattcaaaatttaaaggtttaagaaaataaaatatgtataaattaattatcgttatttatgctttcattttgtgggataagtatattttcttgatatgtcaatgcgatgaaacaatactaataaaatacatctaattataaaagtgtttcttgataacttaaatgaggtttataattatacattcggatatgtttggtcaaatatactacgtaatcatcatgttgtgtttttgtttttaataggatcatcatgttgtggttgataatttcattttgtgaacggtgtctatagtttttctagctcccattcatatttttaaacgttactctataattaattacgtacaaacaaaaattaagggtgcgtcagaaaaaagaaaagaaaagacagaatattttgggaatcatggggaaagtgaagcaccgatttggtaaatgtaaataaatgttgggttagtttatgtaaataaagacaaaatatgggaccgaaacaaaaaacgaattcaggtctgtgtaacctcgaaagtgagaccgttgtcgcccacaaaacacaaaccctatcttttcttcttcttcttcttcgttcagtcttcactttcttttcttttctccgccaccacacaaatacattcttcattctttgtaactttcacgctattcttcctcaatatattcattcgacctcctctcttcattcttaatttctcaaaaatcttatctttctccctcatttttcccgtcgagggttccttaatctccttcctaggaacgtttcatcgatttcatatttgctttccttaatccacaacgtttcttccttcgtttttttctgcaattttgttttcctttacaccaaattcatctcttagtcttgtccaattttcgattttttttccgacaatcctgattgtttgtttttttatctgtcgggatttcga

SEQ ID NO: 3356 - DNA, 2000 bp, Arabidopsis thaliana
ttatattttgattttgtttctttaaatgttttaagatgttttagaaatatgtggaaaaagggaaaaaaatcttgattagttatatcaattcaattggatggataatatttggtatgcaaaattaagatgctgatttttttctgttaataagtcaaaagattacaaaaatattcgtgtatgatttactttatgtttttaaatggaaattaatatatttaaaaatatataattagtactatctgaatgattagtttagtacaagtggacaaattaaaccttatctcgtttacttttagtacaattaaaaccaatatcgttaatgatacaaaaaaatctatattataatgaaaatttgctaatgctggattagtgcggaagcaagaactttgactcgttcaaaatgcgaatattggtttattttatactttaattagcaaattactttgctgagtcatgaatgtttaaaatgtaaaatgaatccaaaatcatctattttacaatatcatatacatgagatcaaattattgtatgatccaatcctaagattttaaatgttggtttttatacagttcaaagcaattaggttttgttataatcatgagttgatatagatcaaataacataatatatggagggatatcattagaccaattagataaatctaaccttatctctttaactgataatcttgtttatgaaatgtggctaacttaagtctattaattgtgtctaaagggtatcttcctgtttagctttacctctggcattttattttagaaaattcaatggtggactatgaaacattttttaagatattacttttttgtcatcctgttattaaattaattatcaaaatctgttaagctcttaatgttaatgtatttcctcttgtttataattacgttgttagactttagatcttgacgatgatactgaaaagaattggtagtttgacttgtataaatcgaatatgtgaactagctgtgttgttgtttgctagtgacttgatgaatgattgccgcatttttttttaattgaacatgttagttgtgtgtatacttgtgtcgtgtgtatatttgtccgcatttatataatcgagttgatagacacaaaattacttccaacactcgtataacctatatagccagtttaaacttttgagtcttaagtatataagtttcaacccatcaaataaatagatgggttatattctcccataagaaatctcgaacccaaatttatttgagttgggttgagtcaaccagttcaattaatctaatggataacattttgcatgtatttatggccccataatatagaaatagatctggaagcccaagcccaaccttctcccacttatactcagagccgacatttggtgtcggcaacgccaatatattattggagaagttgaaggaagactcatgttgtgtggcttcagagagtgatgccaaaaatacgagaactagacagacccgtgagtgatatcaattgttttactcttcgacacagacaaatgggaaacacgcttaccatcatatattcatataccttttactcaaatgaaatgtgaaacctgatctccaagactccatttttcagcaacttctggggccaagtttttgtatcagacgcatcccaatatgataagtttcacttcccaagtatttggtcttttctagcatatatattggatttatctaaagaaaactatacactaaaaatggttagcaaaaaataacactttgctttaagtattaacttaggtcctcttttaaaaccttgcttaggtaaccatattctctattcagtcgttaaaatctttattaatactataacccggcttttgtttttatttttcagcaaaaaaaaacacaaacacacacacacatttaatcagaaatccagcaaggtccaacaagaagaaaaaacacaatcaaaattccttataaattaatcaaaacactagctagacagtagacacaatacaaatcaaacta

SEQ ID NO: 3357 - DNA, 2000 bp, Arabidopsis thaliana
ttagttatagttaaatagtattgatgcatatatatactatctcattattttggtattactcagtactcacatctttaataaagacaaagatagttagtgtataattcaaatcgaactcacagaagtcaataagcgcgtaaaaatacaaaaatatctggcagactttagcaaggtttgttttccaacagaaatggtcatttcagaatcatttacatatccatatatatagctcttaaatggtatatattgggtaatgggtattcgtttaaataattttgttttctgtaaatttcaaatattaatctgatcagtttatccatgtgtgtatatttagtgtattatcatcaatatatgacatagacagactttcaagttggtgcaagaggggatgaaaatttcttcccagttgcaagagtaagctgactagcattttttttttatatataatttatttctcaaatggtttttattattgttttgttgactttaagtttttgccttttatgggactgcaatcacccgtgccaacttttaatctccatcgcctaaaaaagaaagaaaaggctaccattatggaccgaaatatttaagaccataatacaaaattatacgaatattttctgtaacttatatatatgatcatttgacaaagcaaagtcaatcaaataaacttcaaagaaattatgagcttataataagtttgatagtgttaaatataatcaaatcattaaatttagtatttatttcatctcggtttccatttgatagatagataaatgaaagatagcatcgccaataatgaaaaaactttatttgatggcaatactttgttacatcatttctgttttcttaatttcatgtcgaaatattgccatgattgtgttcaacataactagttttgaggtaacaagttaaaaatttgttatattttttgaatatgttattcagttgaaagtcatttagatgtaagtaaaaacaaacataagaagttaacatatcaatattaacacagcgaataatcattattacaaaaaaaagcaaaaaaatagaagaagatattatatattggagaatctttctttagtcttagttgggaagattttgtgctatgggattaaaggtatccatccctattctatgatagaggcgtggggttattggaccaatctatatatattaccacaaggcttaagatgaagtgataatacagtattattaataccctcccaaattatttttaaatatttatcaaaagaagcttacggtatagatcatacttgcagcattattctataagtttatttaatttcagtggctcgttacgtgaacacaaggtaagctaatagacttacgtgccccattaaacacatacataattatacaagtatcatgaaactagtgacaaaacctcgatcaaataaagaaattaccatgacgacaaaagataattaaaaaaaaaactactatatgtcatactcatgcatatgcatgtacaaatgccgctttaaatatttaatttagttaaagcaatgatatttaaattctctctacttcatatatattccaaaagacatattgtcaaattcctttttttagttatatataatcatatattcatattgttatattttcaatatttaatagtaagatggactttcctgaatgttgtgtatgatttataatttgagatattttgtcggagatggatatttgacaagttaatgttactttattaaaattttctaaacatttaggtacgaattgactttttcaaaagtcaacacaataaattttaaaagtttaatgacttaacgggttcacatgggaaacgaaaacaccctaaaccacaaacaatctaatcttatttccttctttatataaaccgctgtttcccaaaaggcttgttctcgtcatatgtacttgtacaccaacccaccaaaagagataaaagaggaaacaaaaactcgaaaagagagagatatatgggtgaggtggcttat

SEQ ID NO: 3358 - DNA, 638 bp, Arabidopsis thaliana
tagcttccctcagctttttcttccctctttttttttccatttttttttggttttgagtttttcacttcatcgactcgaaaagcaacacagcatgagaaggccgtagaagtgtaggacaatgcactggttgacaaagatgaattgtcaccagcgagaataagccttatggttgaagtttgcaagtaatgattaatacaattacaatcataacgaatcataaccttaagtacaataacaagtaaaaaagtacaatgacaagtaatattcagtaatggttaatcgagtgatttgatcatagcattatcgatttctttcggatttttcaatagctcttaaaatatatcaataaaagtaatacaaaattcaatcaaatctagtgacactaaaaaaaaataaaaaaatctaatgtcatttaaaaaatatttgagcaaaaaaaataaaatctaatgtcattaaaaataagtgttaaataattgatgacataataagtgatagagaaaaatgtatttactctatttacttatttaggcttatccagacaataaacgttttcgtttttccagtccaacaagtttcttcatcaactctctcaactgttttcgacataaacattccagaagctgagatcagatactaaa

SEQ ID NO: 3359 - DNA, 2000 bp, Arabidopsis thaliana
agcaaatgatacaaaagtgggtcctatgcatctcttgtcgatctcctaaaactaaaataagattaaggaaatgattgtttatttcttagtgttctcgttctgagggctttatacaatcggttttactttggagtttggatggatagtttctacgttaacatcgatgtgagtatgtgagtagcaattgatgactgtattattggtttttctgacaaaaaaaattagtttaaggtctgcaacaaatattcattctagaatgataaaatctagatagctaattctttttcgagaacatatattcgaactaatatcttaatgttttacttatactatttgtattttggataagttttaatcatgcatacaaaataatagtattatttatatagttttatacgtatcttattgccactcgaagacaattaagcttcatgtcttgccatgcttttagtttgtggatatttgtttgatgcgtttgtcataaatattttgtttgatggttatagaataagatgtgtgagtagaatccaaagcaagttggatccaagctcttaatagcttaattaataagatagaaatataaaatggaaaacaaaatagctcattataactttatttacatacaaaaaagcaaaataattattgttatttcggtttctatatatgatttttttattgaattatggctgtataactattttatgatcgtcttgagcattaaaaaaaaactattttatgattgtttatttacattttgtcaaccaaaaccccaaatgttccctctatatatatatatatataagaaattctgaatttcttaacaaaaatcacaccaagtggaggttggtgtgctaagaatcaataactacgattagtaatacaatataatactggaacccaaattaaaattctctttttcatttgtactttgatactttctcgtcaatacgatgaattacatgtatgcatacgtattagtagtataattagcagtaatgtcggttttgtaaaacatacactgacaaatggaagataccgtgtccaaggattctcaaattgcaatattatatttttatattcggataaaaaatatcaatatcccagttaccatcacgtcgtcacacgtggatgactcaaaacataaaacgcatcgttttctgcttacgcaagaagaacacaaagctctctgaaagaggagaagaaaaagacgattccatctgttttcttaaggaaacttcttccgttgcaaaagcttacgaagtcctccattaatggaagcggccttatttcactcttgctgatgtagtagcttccataagcttcttaaagtgtaagctgcgtaatttctgttattggaaacaaatcgaaccttctactttcagcttaaagcccaaagtctccttttttactctctatctctctctctctaccgcaatttctctctgggaaaaccactcgtgtagttttttgtctctgttttgaacttttttaagtctaaaaatgacaactttagtcgtctcttttgtttattaggctgagatgttcgggaattgcattttgtaagttttgggttttgttggaactttttgcaattcagtgagagatgtgcgtgttgtttgctgcagaaatgtgctgctggtttcgcatttgttgaattttgggctttctgtcttattttgtgcggtgatatttgtcctctttgaataaagttttcccctttttaaaaaaaagtttgcgtttagagctaagtttatgttttttgtaatcttattgagaaagttcatgaactgatatcgtgacgtcttctatgttgtaggttactggtggaggtttgattcattaaattttgctacgttgtgggatcttcaagaagaatcctttgtatgtaagattccgtttgaagattctgtcttttaatttgttagtaatgtttagtttgttattcaacttgatgtgtcttatttttcatgctctagcagtttaaatctgtcatcgaagat

SEQ ID NO: 3360 - DNA, 1085 bp, Arabidopsis thaliana
aactttttttggaagcatactaaactgctaatgtgtgtcatagccaggctatatttagttttgtatgccagtttttgtatgattatgatctttttttttttacacattctctataacagtaaaacgaactttgatttctctgttgttccttctccttgtaccaccaaagtcaaactggctatagagtagaatagactatactcactagcagtgaattaggcagcaacataagaacagtgttttttttttctcgccgttaatttcgttacttatctaacgtattattatgagttgataatgccacgtgtacgtcatcgcttgtaaagggtttgagagtcgtacatgatcattaaattctctactgattgattttgattttgccaacaattattaaagcttaacaccacgaaatgtttgatgtttaaattaattgccatgtctctctgtctctctctgtatctctctctctcttcttccccgcgtcgatttcacattttctcttttaagacagctttgaatctacagacaacttcatttttaccaaaatttctgtttcttcaaaggattgaactttcatatttctctcttgcccagttctgagttattgcaatcagaagttgtaaacacttttcctgtctctttctgctacccgaatttatcttctttagcgtctgtctctttcagcggacgtgtcttgtctctttaaggtaatttcaagacttaaacttgaagtatctctggccttcttctgctgtctgtttcatttttgaaatcgatttggagattagatctgactcagcttcgactaaaagccattgctttcgcctttggattgttgattccctagtggatgttctttatctctttaaaaaggtcctctcttttaaatcaatttttgctgaacttgcccaattcggaaactttgttgcaagtctcctcttggtctctggtaatcgttttcgcatcaatccttatattgatttgaatctgtaatcagattcgatctttgatgctaatttggtattctatagaagacaacatatctgaattgggtttcttcgttggataggataagtggttaggga

SEQ ID NO: 3361 - DNA, 2000 bp, Arabidopsis thaliana
gaaaaaattcattaaacgagagatttcactgtgaaaacagagaatagaagaaatctggagcttacgctagagagggaaggaaaaggaacaacacggcgatgactcaacgcttgatgaagagtggagtagagagagagtgagtgaggaagatgaagagttattttattttggaaaatatatcagaaaaattagagggtgatttgcaagaataacacatttttatacaagaattaagaatatagcactattaattaacaaagtaatttaaaaatagataaaagagaaattttcacaaatagcataattttaagtttttttgacaaaacctattttatactatagttttttgacaaaattttaagtttttttttggacaaaattgatgaataaaacctatgatccaaattgtgaatgatttatactataagcaatatagtggccacaaaattggtcaagaatttttagtggctttatcaaatagccactgactggagatttttttttaaaaaatatgtgtctggtcaaagtatgtaattatatatctatgtgtaaaattgtatcataaaacattaaggtttccaggattatttttcttctcaaaatttaatatagtgactttgttttactctaagagcttatagtcaccaaagttgttatatatattaatatatgtctcattttttttttttataaaaagaatcaattatgagaaagccacttttgaaagtgacatttgttgattttgcaattttccatatagtttgtgaatttgccatttttagttaataatagataccagttaatacgtggatatagtcggttagatttgtttttaaaatttagtatttggtttaaagtacatattttgcaaaaacattttatatatacatacagttttaagtgttcaaaatgacaaatcctcaagattttagtaaaaactaatgacattgttgtacaattttagtgcttaattttagtattttagttattttatgggctgcactttagcaataaatgtctctttgttttcacttttcagcagttggaactttgaacaaatggaaacaaaaaaatgtagaagacaattttatttttaagcccatcaaaaatacaaatgagattgtaagcccaatatattaaccaacctacctttttcttttgtcagctctctctatttctctaaaggtgacgtcatcttcggcggtaacggctcagatattttccacaataacttccaataatacccctgccattaaccaatagtacccatgtttcctctttgcaacgtgggggtagattcatgaaatgagaacagaacggaggttccaacgagtagaagatgatgtgccacgtgtcactatatcgacccccctttcctcttccttccttccccaatagagagggattttcccgcttcagcgtctctcagtctctctctcggctttatccaaaggttccttcgtttactccgcttctatggaagaagcttgaatccttctctcttcttcttctccttcttcccttgacatttttgttctgagaagcaacatggccctcggtggcttgatttcaaatcggaacttcggttccttcatcggctcaggtatatctatccccctcctctttttgaatctgttagggctttttagttgtttatcggattatgttagtgattaggcttgagcgtagcttgcttctgtgtagcgaacgatatcactaatgtgtgcattgcttccaaatttgctaagattgctttactttgtaggcaatggttgtcagagacttggaaaaagtggtgcagaggtttccaagctttttccaaatggtatatatcggtatcttttatacctctctacctagctatattatgcaatttgtgcttaagcattttcttaatctttgtagcattgttgtgccgtaatcatcaacctctgcaagctagtttacatcatgaatcgggacacatgagaagaagttttggatgtttccttcaaccaaga

SEQ ID NO: 3362 - DNA, 2000 bp, Arabidopsis thaliana
tcaatagtcacatttggattgcaagcatgggtggatgtatgttaggagtatgtgggacacgtgccccacattgattataatgttttgcgagtattagagtttacaatggctacttagcatctttggtcgtaatgtagtaaagtattaccattcccatgtttagatccctttgatgttgcaatgttttctttatgtgtttattagttatccaaataacattattctaatttcttttttggttggtctttcttataaaaatgtcaattctaagttttgttatcattattttgtattttactaatcaaaaaaatataatattgaaacaatatatatatatatatatatatatttgaaataaaacatatattttttttgtgccccatacaaaatacatgtttagatttgtcactgattctaagaacttattttgtagaaaagtaattttcttaatattctatgaatctttcgaatatgttatgcatttacgttggaactgttaggtttctcataaaacattgtaaaactaaaatataataaggggtgtgtggaattttggctcaaaaagattgtatactttgccagatttattgattttgagactatgttgtgcagcatgtgcacaaaatttgttgattttggtaatagtgacaatatagatccaaagatgatttttaaaaaaattaagtgaatatatagttcatttttatcgtaaataattggttaaattataaaattaaaatattgtataaagagaaattaaagcgattgtaccattgtagcaaccacaaccagcatatatgtttgctcaagatttttaagttgttttatacacgattcaagcatatgatcttaatatcaaaaaggatatattaagtttaatcggctttccattttagttggtagcaattgtaaaaatttaatattatatccttatttattaaatattattattacctaaccttttttgattaacaataatcataaaaaagctgaccatctcaatttgaagataaacaaatagatttaaagaagtgatcaaatcatgtattggtaatgtctaacatgttcttaccacatcttaattcacagataaacatatacatatacattgaatatgtttttatataacacatggttcaagggaacaaaggtgggataaatcctatcatattttctattcttgacttaccttcataagtatctaggttataagtttaaattttctttataaaaaataacaatataaaaagaaacagttaaatttgaaatttactactttttaacaaaaattattcatccatctgtcattcaagtatcaatatagaaaataaacaaattcatgttgtcagccatactgcatgaacatgaatttcttttatctttttactttttttcgtaaaccctcaaaataacatcagtaaaaatggatagcaacataacagataaataaaaaccaaaaacaaaaacaaatccagggtaagttaatatgaaacaaatgcattagatcaaaaacttatttattagtgtagcaacttaaacagaaataataagtctcaaagttaattttttttttaataccaaaaattatatcttttatattttgaatgaccacgaatatctttttcacttgatcgataaaattacatcatacagtacatcttttctaaattaaaacaaatctaaaacatggttaacaaaacaaacgggttaaatgtgaataaacaaaaagtatcgggtgcaaaacataaaaagacaaaaataaaagactgagtccaaaattccaaaaagtcaaagccaccttcctaacttgtctgcatagacgaagaagacaaagaagaagagattcgatcacacaagaaaaattacaattcttcttaatcctcattattatatatataaataaacttcaatctaagcttcttcgtaatttctctttcgttcaatgttattcttttagatctcgaacaaaacaaaatctccagaagaaaaaaccaaattcc

SEQ ID NO: 3363 - DNA, 1352 bp, Arabidopsis thaliana
catctttattttaatcaccggcttatgtttgtagtataaacctagcttggtataatattgttatctattcatctctcatgtgcttgtttttcttttcatttttaagataaaagtgtacaagttagcttgtgaaactttactgaagaaaatcaaaaatagagtaagagtagtataaaatacttgagaataaataaatgtttggtttgcctcgttatcacttcttgatgttcccacgatcgatcccttcaagagaaaataattaaaacgaaagattgcattcgtatcagcatttatggcggatgattgcgattattaatgcctcctgtaaaacgtgttttattctgtttcttttgaaaattctttcgtcgaaatgaatcattgccgtaaataatcagacattaatatctgattctatctctttaattacatcagataaaacataaaaatgacaaagatttattataaaataatatagaaaatgaaccgtcggaataatgatctgatctcgctatcgataatgaagccaaaatatatatacagtagaaactaatgacataaacgaggttaaaaaatactatcaaatgcatacatcacccaatcaattatatgtggctgcatatggtaatttctttgtatcctcgattaaacgcaacctgtattgtaaaaaaaaaagggtacacatacagaaaaagactcccccaggcccagtagacattttgaatatagatattttctgaatcaaatgttgattgttttttatttttttttgggtaggcaaatgttgattgttgtatatagaggaataagctattgttagaaaatagtttctatttaaaagctaccagtaaacattggtggtgtgtgtgatctatcaactgagtgagattttttttataaaaaaatttaaagaataagagagatcatcatatattcagtcaatcttttttttgtcggctagtattatactaatcaatttgttttttttttctttgtcggctagtatactaaatttgttagttatcagatttaagttaaactttgaatggtaagttactaaatgagacctggaaaaatgattttgaatgtggtcccaaaatgtaagtatgacagggcatgcatcgccgccgaataaaatactagtaacataatgggaaatatttcgtttaatgttttgtctaattattactctaagttcgactaatacatttttttattaaaaaacaacaactgattaacaacagtcctagttaatttcttgtgaaagaaagattaaagggatctaaagatcatcatcaattcatcaagagaccaagaaagaaatacaaggttgatcgtacaaagaaatcgaaaaa

SEQ ID NO: 3364 - DNA, 1334 bp, Arabidopsis thaliana
tttcttataaaattgtcgaatgaagaaccctaatcgaccaaatcgattttgcagaagaagaagaatgaaaacgacgtcgttttctttctctttttgatgagttaaacgaaatgaaaacgacgtcgttttcttaacgggtctgggtattagtcgggttaatcgcaatcgcggtacagtaaacgcggatttgtggttaatcccggttaaatgaatggttcaattggaaatgtatgtttaagcatgaatccgaaagtagatgatgtaattttgggaatatgaaagttgatggtggaaatttaagggcccaaaagtccgggggtgaaagctgagaatcgaaatagtttatggctcgaaaatcagctaacccaagtagaatcgatactgattgtgtctagtgctttaattatctctagtagatcttcaaggtttatgccttgtccctagtacattttgctatctcggtctggtgggtgaggtgtgatggtgtttgtacttatgtctctggtttcagcggcttcttgctttcctctctgtcgatttactattagttttgacttcggtgtaaaatctatccgatcttattggtgtttccggcgttcacattttttaggagaagtttaggtcttatttttcccatagttttttattttcttttgaattttgtctcttgattcaatttcgttggtttaaaatgtttccttatatatgtttttggttttacttcctttttttcagctaagtttctcaaaatattccgttggtctgttggcttatgtatttcaacttgtattctactttagtttctaatataattcagatgagaaaaaaaaagaattaaaactgatttcagtgtaccaaactaaactgaaatgaatgaaccaacaaattttaaaataaaatattattaagtttttgaaataaaagatcaaactaattttttttttcattaacaaaaacaagaaaccaacccgtaaatcggattataaaatatctaatatctttgtttgttttgtccaagtataaaaaatatctaatatctaaaagagatttttaacaaataaagaagagatcaacgttattttttttttataattagttagtggaaaacgtatgtggtttataattgagctgaaaagtgaaaatccaacaaaaaaatcgtctcgtggctgacacgagactatcttcaatctacggctcagaaaattccataaatattaacatttcatctcttcttcatttttttcctaatcgttgttttttttctaacacacgactccaaaaaaaaaaaaaaaaacaatcttcttttacttctcctaagagccacaccaacaaca

SEQ ID NO: 3365 - DNA, 1410 bp, Arabidopsis thaliana
taattgcttattagttcttagcttctttctttctattttgtttccctctctctctttgtgattgattcatttaggcaaaaggcgagtttttaatttatagctagcactggacaagtcgttgggattaaaatgacgtaagatatatgattttaagacaaatcattttaaatagttaactgaatacacccccgactcttattgtagatgatcaatactattgtattgtgtagataaagatagatatttagaatctttcgtttgatttcttcattaaattagtcaacttttagatactaatcaacaatgccaaagaaagtggtagatgctaaatcaacggagaccaagcgctcatcatcatcattgattcatttttccttcaatcatatttgtttgtttgtttttgctttttattagtatatctgaaacctttgtccaaaaaaaaatattatatctgaaaccaattgcatgcataatgaaacttaaatttttgtttgtttctcggtaccacatgtttcacggtatagatgcataatgaactcgtgtcttaaaataactttatatttacgaatctatatgtactactttaaaaaatacatattaatatattttaaaatccatatttctcaatcctcaacttaatttgctatctaactcgcttcacgagaagctttccaaatctcagatctattacttgatcttgcttccaatccgttccggtggtgccgtctaaaaataacagacaaatatatttgttaatgttgcaaaacgacttttcaaatgatcaagatcaaccattaaccaaatatatgtttaccataggacaatgcacagtcgtagatggctcctcacaacttatctagacgaagacattcgcctataatgttgttatagcctataacttataggtttaattgttatgattaactatacgttaatgaattaaggttaattttaaatagactgtttcatcacttgaaatttgagaactttctatacacatactaaatcatcatgactattgtttgcgtaaaagaagtatgttccgattcaattgtaaacttgaaaagtacgatttatgagcgataggtcttataaactataacatttgaaggatatcaaaaatataattgaaaagaaaaagtcaacttatcaaaatctcaatctaaagtttaggttagcgtctcaagttagctaatactaaaagaaaaaatcaaaggaaaaaaagaaaagaaaaaagaaatagcaaatatctcagaaccatctaaaccgtccacgtgtcccctcgcttatctctctgtctgaaaccaaaccgacttcttctcacaacccttaaaggaaaagtccgatctcatttctcattaccaaaatcagcggagcaaaagttacttccgaaaccctaaaaaaaacacg

SEQ ID NO: 3366 - DNA, 2000 bp, Arabidopsis thaliana
ggaatttaaagcaaatatttctagtcaattcataatgttagttttacatcgttgctttaactcaaagcaatgctgtaaatacgttccttctcgattgaacctgactaaccggtgttttattaagaaaattagtttagaagacgaccatattgaattaaacgatcaataattttcgagcgagttgtttcttggattttttttcttttcttttaatatttatcaataaacgtatgactttgacttgtagtcttgtaccattgaatttgacttaagctattataatatactatattcatctcatattgtaattaatcaaagagacagaaatttctaagtaatttttgtgaagaaataagccaggtgattttcaaaagaatgaatagtaattaatgtttaggaagctgaatcgtagcaatatgtgcacgacctaatgttttaacaaatttgtcaagagtttttgatttagacttaagtaccaatagatctacagtttcaattggatgaattaattgtaagtttgtaaccatgacgttcttttctcacaacactcgcatgccacatgtataagttggtgatgaacaatgtccaatggggaatggggattagccaagtttgtccagcattataagctgaaggattggcttacaattcttaaaatttggtgttggttggtcctgaatgtagactcttgtttcaaaacaaaaaatctactgcagaaattttgaaaatgtgcatgaaacttaaaaagaaaataaacaaacccacatattattggctttagcttaaatggaaaaaaaattgaataattggaccgagaaaatttaacaaaacttaataaaaatcaaacttatataattgaaaacaaagttaaaagactttatattttcaaagtctcgtaccaatcacccctaactttgagaaaaatgaaaattatgatctatctatcaatccggtctaaataatgagaacctaagctgtctcaatcaataaatcttcaaaagctattcctctgggaaaagatttagctgagaaataaaaattctatcactttcccttggcctaaaaaagtttgccactttctttcccacaagttccttttttcaattagaaaattgatgttcttggcactgaagaaaatggccaaaagaaaaacccacaaggcacacacacaagcttctcacaatataagaaagagagagaaagcacacacagtagagagagaaggcatgccttgtcggccattagaacttcaagccaaagcaaaaaccttacttatcctttctccataaaatcaaaatccttattggaatatacactaattgattctcctcatcactatctctctctcttcactttttctttccttttctagtttctctcttttaattcttgggattgtggagctttaaagttcctttttttgaaccttttgagtttctgattctgcttgattccagatcataaccatgatctttgttgattccagaactttagctttttgatttcattctatcaaatcactgaaattttcatttgaggaatcagaagagtaagtttttgcgatactctcatttgtcctcagctgcacaaagtaagaaatcttaaagctttgacattttttgaaaactttagttcgtttcgtaaaggttccatttttttgtttcgtgcagctataacttccgataagattgatcagttttgacctttgtgcttggtggtttcttctatggattcacattggtaagcttcttcgttattcattctctagtttccattcatttgaaatgaactgaaatttgaatcctgaaaccaaattaatcagaaccaatgctagatctaaggcttcgttgcttaaagctctgagttttgcattatattgtctctgttaaattgaaaagatttgattttttttaaaactttggtgtgaaaagaaatgtgaatctctctataattgcaggtgttgagggattatatagtgtttctctttgttgagaggatca

SEQ ID NO: 3367 - DNA, 1923 bp, Arabidopsis thaliana
tgttctcgtgacccgaagaaggaagaaaaaccaaacgcaaccacgaattcgattttttgaattccaccaaagagagagagagacaacagttttttgttgtttgtttgggtttgtgtgtacggaagtaagaaagatccaaaatacaaggagaaattgaaagggagcgagagatatagggacgacgctgcgatccatttttctcctttctatcaacgtttttttttcaaaaattaattgcgttatttaattctagttaattactttaactatttaatgtttctgttttctaaaagtaccagtttcggaataatggttcatgaattttaaggttgttaaatatgaaacaatcagaaatttttcgctatttgtttatatgtaaccatatatagcagtgtggatgcttaaagtttgaatttatgattttgactaagaccaaattatttctaatagtatgaactctatctgcggatttgtttcttattaaaaaaaataatagtttgcgtcaactatagtagtactattcatcttttgtttgtttctatagaagcaaaatctatgaaccatggagatggaggtcaaaatggtgttaaaaaatagttgaccattgcatgccattagccaataggtctgtgatcatggttgatacatttatatttgaccattactgtttctacctctaatgaacgtttgtgatttgaggtacattggaagagagaagctacacagctatctcacaaattagcaatctaaaagtcgactgaataacaaaaaagttgctttatatatacttgtaagattaggtgaacaataattaagttataagattagggccggtatatgagattaggtgaacaataattaagttatacaaaaagtaatcgaataactaatcttcttaaaaggatcagtcattaatcgtggaagatagaatggacctaatgactaaggggagatgttttttttttttttccatcaagaggagatgtttaaaggtatggcatatactccctttgcaactagttacgtacgtgggaatgtatcatatgttgaccagaaaaaatgtcaatcgctgactgtgtaacacttcagttgaaactaaagatcaaaaaggaaaataaattaaatgattcaagctacgtcatcgaaagaaatgtaagttttttttaataatatgtgtagtacaaaatataagtataactttcatcgtgtaccaaaaggtccaaaaccgtatcacatatctttgtattcttctatcgaattataataaaatcatttttttaagtgaaaagaaaaactgccacgcaatctgtcatgaaaacttatgagagttttaagaagtcaagccacgtgaaattttcgtagcatcctataaagacaatttaaatgtccacatgatacaaaatcatgttagtacgttaccctatcatttatctctttaaatttaaataaaaatagtaaagttttccaaaatagcaaaaaacttcaattttacccacataactcatacatcctcttgttatattcttaaataacatgtttcttttctttgcattgaaatatgcaactagttatgtggaaacgttcctgctaatgctatattcaaatttccattacttcatttgctatgctcactatatcacaatttagtctgaacaaagacaccaagaaagacagaaattacattatttaattctcgaatccagggaccgcgtaaagaaatataagcccatgtctctttttttttctttcttaagttttgttttgtatgacttttttgagtttcaagaactcaagccacgcgaaagccgtcattctttacaacttgtgtgactatataacaaagccacaaggaattgatgattcacatgcgaaagcaaaatatccattgcaatattctaaaaattttcacacttatccatccaa

SEQ ID NO: 3368 - DNA, 2000 bp, Arabidopsis thaliana
tcttctcccttccatagaaaaccaactattttctttcgccaactattaacttttgaacataggtttggctctaacaaattccagtccaccgtttatgaagcttttgattttgccaacgattaacagaggtatattgggcacaaaaacaagacagttaatttttggaaatgacatttaggttttgctcgaaattgaattagaggttttgatttacagaggcacgactttagattttgttggggtctttggtttttttaagagactttggttttggtttttgaaattcaattagtcgagattctcgctaataagcgctgaatttgatcaatctctgttctctgtttccttcatttgatttctttttttcggtctctctaatttattggcgtcgttgtttccttatcctgaaccaataaatcgattttgattttgagaaatttttgagagatactattctattttgtgaatatactatttacgtataccttgtactatatacgttttaaaatgaattgtttgttttgattaaggatgttaagtgatttgattagtgttttatattaaaagtcttgggttccctatatattatcttagggtttagtatccttccatcaaaaagtatttaattgattatttggattcatcggaataaacgtttctatttaaacaaatatatactattctatctttctatgatgatctgtatagaatttgatatcactattcatttttttaaaaaattcgtttccgttttttaaaattcaaatcatattagataaacaaaaaaaaatctgtttttacaataatattattaactttaaccaaataatattgttaaactaataaagtaaacaaaattaagaggggtgaatatatattagtcatatatatttctctttcctcctgctagtggcttctctttctctccaagcgcatccgtgggaaagagttgagtgtattttcacaactgacatgtgctatcaaataaattacatacattatagtactatatatttaataactttttcaaaaaccgtcattttttgcaattcaccctataaattaacactttataaaaactataattaaaaataaaatgaaactacatgttgatatacagagcaacacctcccaatagaggtttggtgagtaattattatataacaatagtatcaatttattagaacaatcgaatcatattctagattctttcatcaatttttttttaaaatcattctagattatagataactttgactttacttccgacttttcaaacggcacatttttcttggcaatatatttcagagaaatggcctattaattactctttgattttttataatgttcgcgtctttgaattgaacaacccaacttttagcatactagctctttaagcacacttttatttttttcacaatttggccaataatgttctagaaggaccgcatatcatatgattagtcattattggtgcttaacggagactctgttttttgccaaattgaaagttttagatttcatgctaatagataagagtgatgttttaaaacatatttgaaaccaaagttccaaactaataccattagtaaaaatcatttacttataagttataagccctcgtcatggcccattttacatggttttggattttagatcgtaaagagaatacaacaaaactgtagacaaaacgaaatcaaaatttcgaatcaaaaagttgtacttgtacagtatataagtaactaatcgtcaaatgtgtatccagttaaaatcgtcacatatgtagatacaatgacgtaatgagtacccaaacatcaaatctctatttttattacaaaaaaaaaaaacacatctcatcgatgacttcacctactcttctctataaagacttgaaaaaaacttgaaaacttcttcaaagtttgtatccatttcacattcacagtcaaactcggttgccgaagaaatttcccggcaaaacctcaacaaacaaaaattagaga

SEQ ID NO: 3369 - DNA, 1749 bp, Arabidopsis thaliana
gtgatgaaaaaacactaaagaatattcacaaatcaaattagattcaacgataactgacaaagttgtagctaaacttatctcaatactaatagaagtggaaagtaagatagtgaatccaatcatcactcatataacttgagcaccaataaggtttcctcttttttataaaaaactacaagtattcatgagttggaaacttggagaaattgggtgaagaaaggaccacacattgaataaacaatgatctagcatcgaattgatcaaagtagaggtaaacaaactttttttttagttttggctacaaataccattgatcactccccctagttctaggtttcatgacctttctgtgcatcaaaagataacaagaaagaagcgaaactttttgttctatatctcttagactaattaactaatggagaaacaaaaacatttgattctatcttagttcttgtaacccaaaacgatcgatccgagagataaaatcccctaactatcatctgaaattggaatcatactagtcaaattcaacttaaaagagacattaactgatgagaagttaagaggaggacgaaccttgaaatttcgcgtccggttagggatcgtagtaagcgaggaacagttcttctggtttctgctggaagagagaagactaaatccccgcgagggaagaagaaatcacgaaatggagacacatttcctcagcttgcttaaccaaccatacgttagtaatttaagctgaccaatccggttcaaccgaaattctatgtcttttgaatgtttttcttgacttttttttttaaggggtccttgtcaatctttgttaccaacgccaattcacacaagaaatataatgtgagacatttttcatcgttatcatacaaccgtgaatatacttgtcaagcaatgttggtcaaattctcaagatacaagagttttttttcacgctaatgtagtcacactacaaatccattaatattatttttttcgtttagaaatcacacataaaacatagattgtgtttgttggtataagtgatagagagagcatccccatatcattttccaaacacaaatgctcacaccaaaatggttgagttcataaggtacatttccacacattatgcttaagtttcactcttattacacttctttgaaatgtctattaatctttaggaattagcaagtacgacacacattcaaatatccaacaactactctctctttatcaatcaacaaataaaaaacaaaacttgattgattaacaatttcaaagtttaaattcaatcacacctaacctgaattaaaatttggtctattgcatactcaaatccggttcaatgttacaagaccaaaaccagatatttatcttaaactggtccacttgaaaaaacgaaaaaacttaccacacaacacaggctgattctgaattcagcacaaatagtttcaaagcccaacaatcatcgcccaatttttgttatataccgccgcttctttctacacaacctacaaagccaaaagcttagtatactctctctttctactttaacaacaaattcgccgcttatcgcctccgatcttctctcaaaggtacggtttcgttttcatttcctccgattctcgtttcttcttcagattccttcatcgattagctctaggaaccttctcatcggaattcatttattgtctttgtttgttattcgaagcttcttctgtttatttgatacatattctctttcagttactctat

SEQ ID NO: 3370 - DNA, 637 bp, Arabidopsis thaliana
tttttgctggttttatttatttttcttcttctgtctgtaacattagtaatctgtgtgatgatgggaaatgatccatcttcatttgtactttgtgtttccccttaagaccagacaggtcctttgttgtatgcttattatgttcagaaataatgtcctttttaggacgaattgccgaattcatttcaattggatttttataatttctgcttagtgtatcttttgtgataaatggtttctttcttcactgttatcaaaatattagagatttttttctctcaaaaaatattagagagaatttcaaacaatgcaacagaaaacagctttattatagtaaagaaattgcaacaattgttgtagacaatgacttcaacaaaaaaatattctatacaatgaaaaagtatttctaaaatgtaaataaaatgacatattcagagtagattttttaggaaaataaaacgaaaactgaatgcataaaagatgataaatacgaataattttacatattaaaataaataaaaacattgaaacaccaaaaataagacaaaacctaaagtatataaagccaacactctccagtgtgcagtcgttccaagtccgcttatcgaattctccgattccaaaagcagcagaagaaaaa

SEQ ID NO: 3371 - DNA, 689 bp, Arabidopsis thaliana
acttgcagtacttgtaagccatctcttcctcaatgtcgattaattctatagtgttcaagatggacttgaatttgttatgcatatcatatgcttcatcttacttgtttaatgactgtgacatagttgtgtttttgctttcaaaagagaattgtggataaacaatttttttctcagagtagaaaactatgtgtgtgcgctctcttgtggttgatgcatctgaaatatatatatatatgtcgatttatttttgatatcgttggtaatcaccaatcagtgccattttagatctctttagctaggcttctcgagccttgttactggaatcctttataatcatctttcagctagaaccatggcattatgaaagacattttattttttgaattctctatgtcaaatgttctcatttaactctattagataagtaactggagagtttggatctggtatttctctacaggtgatctcaactctacatatttgtgttgcggctgcaaaatgtttttttgaaaatattgcttacaaatatagtttccacgttcatgtatcttagctgtctacgattattatagttcttcatattaatgggtatcttgtttattacatacttcattatgttttctgtagcctgaatttctggtaaaataattttagagattttccaatcgacaataattaagcaaagctta

SEQ ID NO: 3372 - DNA, 2000 bp, Arabidopsis thaliana
cttgtaaattagagaaataccagctcataaaaaaaaagagagaaatactctaaaatactattaaactaaatttgtgtttcatatatatttggtccaactggtcagagcgcgagtcatgtaattaataattatcttaatttaatgttttctataaaaaaaggtcttagaacctgttacaataaaataaaatataaactcttgctctataattaacatgttttcaatttatctagcataaatattttccaaacaagaaaaaatgataaagtgtgttatatagtgaaaagttaaaacttgaaaaaacaaagaaacataatccattttagaacaactaaacataaattaaatcaattaagtttttagaatattatatatatatatatatatatatatatatatatactagttgtatttgtcacaatcaggacttagggaacccctccagtttctatttggaaataccaacttgtcccatattgagaatacattcctatataagataggaatttggaaacacccgaacagttatgggatggaacaagaagtgtgctaacctctaactgaaatattagtaaataaagaaaattctaaaagtaaaagaaaattggttgttacgcatctaacattctctataggaaatagccatctctatgatgatttcatacttttgccagttccttggcttatctaggattagctccatcatttggcaatccgatttacgaattcttcctatcaaactcacaacactcttttcactagagcaatattgaagtagatcaaatatatttaaaaggtcatcttcctcccctagcgacatagcaatcaaacctttatgatttatctatagcagtagacatcttgtaaattaaaactttaactatatgaaatttgagaaatccagaacttgaaggaaaaaatagcaacaaatatttgtagtaataagaccactttaatgaggtaactgttataaatgtgatgattatccatcacattacttctctttcaagaaaatggatagttatccaaagttcattattatccctcatcattttacattatctacttaaatcctaagtagcttcctccccaaacaatggtagttatcatatcctaaaggctaaatgtctagcttatcttaaattccctatatatacgatgatggacaagaagtgagtaagatagacgaggaaaaggtgaacaaaagggcttacgatctagggatgatgaaccaaaatatttttcttttatgcccaaacaaagaaaaactatttttttacgatttgcttttcctttactcgttaaaataaaagtatgacagtttaacatttattgctctttatgcaagtatgcaaccaatcataccataagttgcaatcaatatctcacttcaaatctccataccacaaatgagcccaagaatgttatatgatcgatcacctaaaatattttaaaacaagttttaagtcgtgtcctacatctatatgtgttttttttttcctttagttagaagtcaaacaaacaataaaatagtaagtataatgattgaaaaacttgagatcatgctctgatgtataaatttttggtcaactcttcctcttcggtctaatttttcttcttctgttaatacaattatttatgagcaagaatgatattttattttatcttgaaatggagaagccaccattaatgctacagtaagggttaagacgtgaaagtggggccaaccactgtgttgccgagagaaaacttaattccttgaaagtgaagggatccaaagtcagaaatgacacacacacccgtaataaagccaactagccaagagtttttttttgttataaagaaaaaaaaaaggtctcactcatcaacaacgagtgaaaaaaaaatgtgaaaccaataaagccaagagttaagctgcttattttgcctcttttgccgaaaccaaaagaacaaaaaaaaggaaccatcaaagaggaagccaagaaaaaaaaacgtcggtg

SEQ ID NO: 3373 - DNA, 1333 bp, Arabidopsis thaliana
tcatcgagatcagacgatggaggagattgagtcaagaacgaacctcattttgtgatgaatccgtttttgtgatggttcgggtattgactcgatgaaatttaaaaaaaaaaaaaaaacaaagaatgttgtaatttggatcggttttattttggatcatgtcgatgaaatgtaattgtttcttgtttctcttcttgtaatgactcgataatatcgggacagcattatatgaaacacacaagttttttttaggggagctcaaataattagttataagcaaaaacgtattatcatttttttggttataaatcaaggcaaccagaagcacaatccgtgtttacttttgtggtagtttataatgtgaaaggattggtttggaccgtgtcctttatttaatgttgttccaagtttacagtacttttctcaataagatggaaaaggaacgaacgaagaagagtgaaacacgtgagtgcatgaatttagttgcaatcccttatagttattatatccatgcaatgtagacaactacaacgaaaggctaattgattaggttggtttagagattgtttgataatgctagcctagatccaaaggtcacatcagaagagaccacaggctactaatgggcttttatctaaagcctgtcattaactactctattatggctaccaagtaagtcttctcaaagtgtattgggccaatcattaactaatttattgggctagattttaagtccattggagtatatactattattacaaacgacaataatattattattacaaacgggccgaaagaaaagagtcaaaaggaagagtcaaacttccgaataatccgcgcgcttaacgttcgatcgccaccgttgaatgaacaaacggtcacgatcgtatctaatacagattatttaattccatttttttcttgtggggtgatgatctctgaacagaaattaagggtatgagaatgattgattggtcttggaattgtgtaatagaccaatggcgagaaatgccatctgttcttttttagtttaagctatatccgctccgccgcagagatatatatagatatttctataaatatgtttttgtatatatacacagagagttttgattaaggaagaaaaatccttagatcattttttttttgttatctttgtttcgtttttctggtagaagagagaagaaggagagacgaattggcagctaagcgattctctctctttctctctttctcttctcgtgtaatcttttggtgttcttgaaaccacttttttttttgttaattcctctgtttccttggaattgttttctgcttttttaagaagaaaaaaacg

SEQ ID NO: 3374 - DNA, 896 bp, Arabidopsis thaliana
gtgatgatattttagaatgatgtaaggctttttagtttatactagtattatctgtgtttcaaactgagaagagataataacagtctttgttgagatgataatgttttcaagatgttcctaatccatttcacatcttctcaattttatatgcatgtgcatatatatgttccctccaattatgttgttcgaatgtttgatgaaactttgaatttttttctttaagcaaaaaaaaatctcaaacaccaaagcgaggagtcattctagttcagttttgagtcattctagttatttttacaaagttttgagtcaaattgggtaaattttttggttattttggtcataaaaataactagattatctcttatatcttatgagttaatttggtaaataaaccatttatttgggtcaaactatttttttccccatatatatatccaatcaataataaattcataatatatttcattaacgcgattgaaatactagtaattaattgaggactaaagaaaaagtaatttcctttttatctttaaaatgtgcaaaaaaaacaaaaatgttaattgggtgatgaaataacttgttttcaaaacgggagttactatttgacaatttaaaaaagacccatctcgaaggagctagaagcgataacaaaataaaaaggaaacaatagtaattagatggcgcaaaaataagatccaacggctgagatctttactcgtgaacgttctcgaaagctctttgccgacccactcttcattcatatataaacaaacacctctctgccttctcttcctcacacaatcataaacacaacaacactcacaaattctcttaaagctcacagacgaattctttctatttttaatctttccggcgaacaattctgatctctaata

SEQ ID NO: 3375 - DNA, 2000 bp, Arabidopsis thaliana
agaaatcatatagtggcaaagagttaaagtattcttactaattcgagggatccaagagttcctggatccttcacaaagctcttgtatttgactcgcttctccattgatatatgcccaaggttctaaagcatggtaaaattggtggattaagtttgtgagccggaggaggtaaggagtgtcgacggcggaggaaatatttgaatctggcggaggagaacggctagcgtcggcagatcagacaaaaatagctaaataatttgggaattttgttaattttaagttcgagagataatgaggtggttagaaccacgtgtacgagccgtgatagctcatgtcttgagatggttcaacagttcacacccgaagttgatgagtctcaagagccacgtgtacgagccttgtttaaccgggcctgcgatcaatagtagtgttgttagcttaagcccgtatatgtatggcccatttattgtctcgagctaaaagtcgcaacttttttttattgtttttttttagtttattataggcagacgataacatttgtcttattaatttcatgttaggaggacattggtaattttcgcttgtttttttgtgtttggtcaatgaatattttttttttttatggagccgtgacgcaaatgggggtggctaggtggggcaaatgcaatcatgaatagcagccacaataaaattaataaattgatcgagtacatatgtcataagataaatggtcggttttggatatgtaaggcgccggcattaggtggtatgactccacgtatcttatcgtcgatgcattggacggctattaaataatcagtctccaacataaaaattccaaaatcacacttcacacattcttttatcatgtcatgaggcttaatgggtcggtctttttttttagtggctagtgattttagctgatgtttcaacattttggttttaagtgtttctattttgcagcttaaatatacatataaaaataataatttaaagattgaaggtcctcaaatcgtgtaaatgtggatttttagtttgagaaagtatctcacatgagccttttttatcattaattacttaattacagtgtcaaaatgattgataaggagttggaaaatactaggtggtaatcaagatggcccttggatgctacaagagcgtagggccatagggcccattccagaacaatatagcaaccactaagcatgtttttgttttctttaacattgtcttttctatttggcaattagtacactacttacgttttgtggtaggaacaaataatttgtaatcttggcacaaaccagtgctttgtaactttgatgatagaaaaaatttattcactagttcgataacgattatcaatcatcataaataaaaaaagttagtttagacgatcatgaagagagaaaaaacagaattattggtactatctcttaatttcccaactctgtaggtacactcattaatcattatggagaatgtcatagtcatggtacataatgaatgtgcatggtgcttatggtacagatgttcttaacttcttatcctggctggcaaacgccagatcatctcaactggaggatcatgttttgttcgtaacagttagtaactaaccaaattagtgacaatcatgagggattattaaaaacagacattgatctatttttgattagaaaacattactgataaaactacaaaaatagctggaatggagcattcaaaactctgtccaaagtccaaacggttaaattatcactgacccaatccaataattagatttatttagtaagtatgattactacgaagataacattaacaaaattttatgttattgtcaatttgtcatcatcgtctttattttttatttctcaactttctttgcattacatcttccaactatataattaaccactctactttctcaaatcccacactcagagaagaagaagaagaaaaaaaacagagctttacaatttctctctacagagatcgaagat

SEQ ID NO: 3376 - DNA, 679 bp, Arabidopsis thaliana
ggaaggaagtctctcacgtgttgtatctttcaataaataatgggaccaaatagacattaccatttttgaaccgcgcatacatattgctactacggatgagtgatgactatgatcttcccaaattgacaaattgtatcgcctttaggcgagactttagccatcaaccgattaaagccagccaaacgtaataaccttggcaagcataatcatcgttgtacaaagaaaaacatcattttacttttgtatccgacatcaataaaagcatagcatcctaatatccaatagttatttgtcacatgtaaaacaactaaatatagccgtccgatcgtcccaattaggacgtaaacgaatatcaccgttgatttagcatactttgataatttaaaagtcgtccatccacgccacaaccccgaaatccacgtcgctccacgtcaagaacaaaaccttgctccaatacaaaactaccacgtggctatctcacaatacgatccgttagatctgacacgttggcaaatcatgacgaagctaaccaatcaggagaaactaaagtgtacgcaactaaacagttcacacatcactgaatcatttcctattatatacggatctatcgagctgaatcatcatcatcactgagtaacccgaaagcaaagactgagagaaccaaggctccgatctaaca

SEQ ID NO: 3377 - DNA, 1605 bp, Arabidopsis thaliana
aggactttaaagactcatgttgttgcagaagaagattctgtggagacagggtaatcttttcttttcggtttatggaatctctcaaagcattacaagagagaacattactagaactacaggagcagtcgaatgtgttgtgaaattagtattaatatttttttctatagacgaaatatacactcatgagtcgcttttctgtgcaagaaaatacaaaatttgtttcccttttctttcttcttcttctactatgtgtcctctctggacttgcatgtaacattgttgtcactttctaatcaaatgttgtagtttaagatgttttagattgatttatatgcatttatttgggtactacatcatttctatggaaactaaggttttcaagaattactgttcaagtgttgactgtggatgacgaatgtagtagaactgtgatgacctatatggaggtagaaaactaccaaattaactacataaaacttatctgacaaaagacgaatgaagttcattatcactattttgtgttatcgtgagtaccactatgtggtgacaaccatcatgcttaatatgagtaacatatttatataacaaattgttatgatgttcaaaaaatgttacgagtatgcaatttaacagattctttttaattcatgctttacatatagccatgatgcttaacgatatccaaaagaaaacaaaaaaaaatcattgaagagattgcacctagactagattgcctctcggatgaccttgtacatgtgttgctcttaagaaacgtaatctatgcatcataactaaaggaaagttatacatgtgttttaatatcaattaaaattggttgattacatacttaaactagtaaatcacaatctatgaataatccggactctttttaacatagacacatgacacatcaacaagtagtgtgcaacatattctagaggatggtcatcttaggtagtattcattcaaatgattttggatcaaaaagtaattgaaatcccacgtttattggttcggttcactccttgattagtcaagtttcatattaacataattttcatcgaaattctctttagcattattcgaaaaaccaaatatactgtaatactagcaagaaaaacaatagttttgacatatcttgcttcataaccgaatatctcattacaaaataatccatttttcacgtttagataatcaaacgaaccctcacagaattttctacacaatgcaaaaaacaaaaacgaatttcatcgagtatatcacgagttatggtcaaatgaatcgagtctaaaagcacaacaaatatgaccaaagcatctaatccacatccactaacttactcatcccaccatctacactccttctttctctgccgtcgataaaatttgatccaacgattaatattcaaacctgagaaaagagtagcgatccgcgtagtcattgttttaaccaatcagaagccagatatgaattgccgtctaatacacatctaactatataaatcggacgtttccaatgatcctcttcacaatcctcataatcactttcgaaattacatttacgctttcttgcaatcaaattttccgatcttaagttcagaagacg

SEQ ID NO: 3378 - DNA, 2000 bp, Arabidopsis thaliana
tctctattcttttgacgtaagaacaaatagtaacttttatttgtagaatattcattctaagaaattaatacgtaaatacatatatttctcacccgtgaaacaccaccagtcgagtaacgtgattgaagatatgtttaaaaaaaaaaaaaacatgattgaagatatgagagagcaagagtcagtgaactattttggccgcacacatgtgacacatatatatatgtgtattattccttttggatttactacattcattctgatttctgaaccattagtaacccttgaaaagtaaaagctgataacgttttaggatttgcaaatttgaaaaaagatgaccctacattatttccaactgcaacatgcacgttcctgttatgttaaaagatattattatagtatatatattttgaaacataaaatgattgatgtaactgatccaacggctaattcctcttactagttagtgaattagccacctaataaagattacatgaatcattaaataacaaatataataactatacaacaaataattcatattgtcgtacattcaacaaccgaggtactccaaattaaaaaagaagtcaagcacactcatatatattttaatttttaactgataaccttgaaagaaaaagaaaaaggatatggaatagaatggtaaaatcaatcaatctgccatggttatgaatcaaaaaccatagaaaaatcgttatttactgtttagtattataaatagtgtcaagttaaaaagtttttaatattgtaaaatacactctacctaaacaaaacagcatatgtaagataacatcatcacgataaattgttttattctgacaccacatgtgagatagataggaaaatctttagtatttaaaaaatcaaaatgttggcagattaaccgataatcacgcagattaacacctactgagatagccgttaaataaattaatcgacatagcagaaacaaataattgagtatcaataaaaaaaaggaataatagagagagagagagactgactaatgagtcacatatgacgaatgagtccagtttggctgccagtctgtcagcccctaccattacaccacctctaaagatttgtattttatcataatccaaccaaacaatgcttacaaaaaaaagataatcacatcacatcacatggccttcttcgtcgctgtaacgtttaattaaactagccgccaatttcttttaaagatttttttgttttgtttttgggcttatgtttaaaccatataatccataacttcatttctattgctatttttgaatttaccctataaagctaccaatattgaatttttgtaattcatttaagtttattacataaataatttatttacttatatgattataattttttttatcggctatatgattgtaatttagatcagtacctaatcaagtttctatctttttctatccgttgacagaaaaaagaaaacaattttctatcaacaattcacaaatcaaattggattagagatacaacaactttagtcaaaattctaacacaacaattcatacttttgatcattcaaacatgattttattttttatttatctagaaacatagtaatgtcaattttgacaattattcattcaaaaaaaaatgtcaattttgacaagaaaactaggaaaaaaaagaacaatagaggaatggtcaaaaaagaataaaagaaaattcgaggaaaatcatgcttcttagaagttttttgtttaattagcttgactagtaaatagatttgaccggataaataaccggttgaaaccggtaacctttaaccggtcttcatactataagaacaccttaaacaagtcgtctccttccacttcttgctttattcctctcataccgttttctctctctcctccgtcgtctctgcagaatcactctctcgccggagtttttcacctgcagagctctcgattttttctctcgagcatcatcattttcgtcggatcaatcaccaagag

SEQ ID NO: 3379 - DNA, 1489 bp, Arabidopsis thaliana
tttgttggacattgacctctctctttctcctatctctatctcttttacttgcttttttttgatctgttaagactttttatgttgggcttttttaaagaagcccattttgtggtgttttttggttagtactattttgaacaatggttggttctataccagtttagctacgatgacggataaaattaaaagtttgccattttctctcttattttggttatggtgtttgttcccttccaatctcgtaggtgaaacatgacttgttgtttgaaatgggaagtatttcccaaatggcataacataaaaattacttagagaaggaaccaacgataataattaattaatcaattacgagaaacccattttttattatgacatttgttgaatttatcatttctaacacagactaaagtcaattttacccttgttttgttgaaaagaaaaaaatctaaatctttttcccccacaaaatcctaaaacaaaattgatctctccatgtagtgttctccacgacgagatctggtgacaactccagtttaagcaagaccaaaagacttgaagagataaaaagctattaaatcaatctctttttctttgggtttttattagtgaaaagaaagtagaaaaaaaatctcaaagctttcatgaattggaagtttcaaatttggtttagatttgaagagataaattggaagtttttattaaattaatgttgatcaaaagcctagtgaatcttaagcattcaatttagttggtctatgtgaatgtgttgttgatgcttatttattttatttttttggtcaaccttgatgctttggttatagctttggatttgtgattttatctggattttttactttgatgttttatgctttatttcaaaactatatacgaagctacggatatttgaaacatatacaaaacagtgaaatcagtaggactgtgaattttcttatcctcaaagcctttgtagtgtaacagacaaatcaaataaatagcttcgcttatacctatgcccaatcagtaaaaagaaaagcctcacctcggcccacagccaatgacagcctttagtatgtcttactggcccattactctactacgaaatcttacgtgtcaagtaataaataaatcgaccccacatatgaacgttatagagcagttttccaattttcaacacgcgcttttcagtttttggacaatatcactttttcccttttcaaaatttggacaatatcagttttttcctctttttttccaggaacatatttgcctaggatttggaaaaggaatctatcacttagctaccgtcagatcaacctcaaacataatccaacggttataaataattacagaacattctggaaactcaagtctcagccttataaaaaacaagacttcaacgctctttcttcacaaacctaaaaacctagctctattctttctctttgctgctcttaaactttttcttagctttttctatcttcgtgtgata

SEQ ID NO: 3380 - DNA, 2000 bp, Arabidopsis thaliana
tgacttgtgagtgacgaatgtataggaagaaactgtggaggtgggttccgtttaaggctttggtggtgtggagattagaagtcatggccgccatttttgagtcacgcacgtgtccacctaccttaccttcttataacttattcattcatgtgttcgataaaatatatttgatattaatttaaacatacaacatagaagtgcacaattacaagagttttttttgtttttctatttttgtcgctacaagagtttttagtttttacttacgttacgtatatgcaaacgcaagcaattctgcatctatttgtttttcaatggcagccataattgatatcaaataaataaattactaatgccacatgtttttttagcacagcttcataattcataggagtatcgatatgtaacacaataatggatcttgtagtaaaatttgaatagagtcaattaaaaaaaaaaaaaaagatagagtcaatctgtgcgatataatgaaattagaacgaagctcgaattttaagattttaaattataacaaaactcaaatgtgttataacattcaaaaaaaaaaaaaaaaaaaaacttaacacaataattagtttttctcattttgagaaaaccaaattctcgaaagtatgtgaaaaataccatggaatttgaaggattttgtagattaccaaatagtaaacaaaatttctaaacttgttttactatgattttgtcacgaatacaaaatcaaactcagatagagaaattaggtgatatatagccataattgtgtttactactaaaaatacagttatttctaaaaataaggtaaatgaccaccatggtaccatactattccatgaacaatatagacaaatagccttccattgttataattgggatattgtcaaatccatcccgtatctatatatattattatacacaagtagaacttttgatggtgattcattatctaccattcacatgtttttgtatcattaaattgttgattataaaagcaggatttgattccacctactaagaagtaggaaatataaaaacataacgccaattttcgttcatcagaaccaagatttttttgtcgacacaatcaaaccaaatagataatgatactgttttttatagtagtatatatatttcttttcctatagagtattttatctgaggtcatgtggttggttagtgacacacttttcattattttacgttctaaattaaatatcgtaaagttaaacctcgtttaaagtatactataaagaatagaaatatcattaattcattatacacactataaagttaacctttgtttaaactactaataaactggttatttaaaaaactattagggttaaatttgtgagaaatggaaaagtaagaggcaaaaaacgaaagaatcttttattacaatgattattaattttatcaactttcttttatagacagctcagctccactgatcggctcatgctccactgatcaactttctttcatttttttatcagtttctcatttctctctcagtcgcatataaatttgaaacgccgattcgtttttgctctttaagctttcttcttgatttcgacggtgtctctcaatctccgtcaagcttgacgaatttcaggtgtgatttgcttctcttcttcttcgctttctggacttgtggattttggtttttgattgatttgttctgcttttttttttttggttgaatcttcgctttttctcatgatttttttttggctgttgcatgattttggttttgttagagtcgaatttttgcagatttttgctttgatttgatttttgttgttgttgttgtttctggtttggtgatacacgaattttgatttgttcttccagatgatagttcaattctgtggtagctgctgattctaattatgtgatatatgttattagaattgagaaaaatgcagttatttgtgatttctcatagcttatgatgaattgttataattgcaggagctatatatacc

SEQ ID NO: 3381 - DNA, 2000 bp, Arabidopsis thaliana
tgaaatcaataatatgtagttatattttatggttagattcatttgtaactcgaaatatcaatttatatatttcatgtataaagctgattatttataaaattttaatattttcacttcataaatatatataacaataatatatgatattctgaaaaaattatgagcaactatgttacttgtgtgatttaaaatttgcctaactcaattttaaactaaatcttattttatgtacttcaacaacattgtgataggctcatgattaaaatttggattgacatcaactgaacaagatttgaaaagtattcgtatgaaaaaataaaaagataacaaaaattaaatgtcatttaagtcaatattttttgatcttctgtcattgcatatatcaatattagagaaatgatcatgtcttgaatgatttgaaatttgtctaacttgattataaataaactatttctagtttgatgtgttcacttgatataatactccaacaacagtgttatcgactcatgattaaatatatagaattgatataaactgaacaagatttcaaaagtattcatatgaaaagaatttaaaaaaaaacaaaaattaaagcagcatttaagtcaatacttttagatcttctctcattgcatatatccatataacagaaatgatcgtgtattaaattatttgataggtctaatgttttaaaggtttattatttaaaaaaacttgaatgtcaatgttatcaaagactcaaaataaaattactaaactaataagaggtttggtaacgaacaagtacaacacaaaaaaatagtataataaaaagagtatagtaaaagtagtgcttaatttattatcattaattttttttatttttttttattttaaagaaatcaattaagagtaggattgatgatatatttaatttgcttatttaatttgattaatattttaatttaaaaaatatagaatgacacatgtcatttttttttgtgatgatgtgtcattcatttggagagagttggccaactttcatatatatgatttatattagtcaattggagaaatttacacataaagactaatcaacttgattactgcctatatctcatccctcgtgatgatctccaatttcataaggttttttcaagtgatcattcacttaattgcacagaaatatagtaatgtttgatctttttatactttagtatggtccacgttcattattttgcaaacttgcatgacttgtcaacttatattgtatatcatcaaaaataatgtattccacatacacaaaaacttactttccatcactagagtcaactttaaatcctatcctcgttgtaaacttagatcttgagaaggatgtaatctggtaagatggatcaaatcacatgagttcttcttcttagtccctcttgttcaagtagttgctaagaagtggtaacatggctttgagttggcaaagataagattaagatcaatttaaacttgacaccgagactggtttagattttgcctttgattaagaaaatctgattaatgacacaaaatatacatttgtttttataactgtaactaatttcttcataattataatttcagtcaatactagtatactactctttaatgcatcataaaaaaaaacagccatatattgagggttgaattatattgtacccaaaatacatggttgaataacactctcaaagaaacatacataatcaaaagtcctcaattaagcaattatagcctatatataacaacagtataataaaataaaatattatacaaatcactatgtgagcctcaacctagcctcacatcaaactcgcaaaatatatgattggacattacagagtgtaacaaagtcattatcataattgtattcttcaaattataaaataaactaaattgcatgtaccatacgtaacccgtaattgtaaatttgatcaactctataaatggagacaaaaacacacacaatgatcaaaaccttaacattctaagcc

SEQ ID NO: 3382 - DNA, 1243 bp, Arabidopsis thaliana
cacgattaattaattattttttttaattatgtactttcaaataaaaaatgaattaaataaaagattctgtcttttcgttttagctactggtgtgtatatctgtctggaaagcagaaatgaagaagctaaaaaggaaaagctgaggaggagaagagctatgaagcacaacgaaacgacaacgttttgagtattagttcttttttcatttcatttttttggaatatgatgatgcgtgaagactgaaactagtggaagattccaaaggatcaaagcatctaattacacagaaactgcatctgtatagaacaaagtagggtccattgtagagggaaagatgataacatagccgttcaagcaactggttcacgtggcgccacgtggagagttggacaatcttgttgacacgtgtctgactatggagctaccgtttattgccaattcgtttggaactctttgacaaatttagcccaaagtcggagttggtgtttctcgcacggcagatgcaaaagtcgtcaactttttagctctgcaaattgagatttgaaccaaaattgctgactaaattaaaccaaacaaaaaccagactaaatgaatgaaatacaagtcaacccaaacattgtgtatctacaacgacggttccttaatttcttgagtcatcttcgttttttagccgaatgggcttttaggtgctttacaaatagtggtttaggattgggccttctaatcagaaacacaccttgtagaatattacattcactataaaatgtaaggtttacattcacgtgaggcccataagtgtttttgtaataattaatttaatatatagtgtaaacttaatattaatatcaaaccgaccttagctcagttggtagagcggaagactgtaatgggtaattccaaagaaatctttaggtcgctggttcgattccggcaggttgaatatttttaacattttatttcacttttaaattatctgggacccacactcatccatcttttgcttcacattcaactcgcgtgcctaaccgtcgattactacgccaaacgttatctttgttgtaacgtaacagattcacccactatttctcatatttcgcaaaatagccccaactttctcgggcacgtatcggaagatatttctgtgatagttcctgccacgtgtacattctctcctcccccaaattgttgtatacaacaatctcagaaaaggaaaaaaaaagaagcacagttgaaagaaccaaaa

SEQ ID NO: 3383 - DNA, 1793 bp, Arabidopsis thaliana
agttttttttttttttttctgactattgattggtgactcgttagtgtagatttgttaggatggtgagagatattcaatgggagtgtagatttaggatggtgcatgtggttcgttataatgttcttgagagaatgtgttggatataataagtcaagaaaaagttatcatttgtcatggcttaggtactaaaatccaatcagggtttctttttgacatgttttcgagtacattcctcagccgagaacaaaacccgaacccaaacctaatgtaggtgatgttggaaatacttaatcctacttgacaagatcaagagaagatgagaagaagaatcgtaagaagagaagaagaaagaagatgtttgtttgtgtaatgaagaaaagaagaagaagaagagtcaacatgaaaggaagagaagataaaggcttttgggccatgttgcacatgaatccttagtcttttttcctttttttttggtcaacgaacgagcgcatgaatcctcagtcaattattatatttataggctaaagatagtcggtagagattttaggtttgataaatgagataaaattaaactttcattttatcaaagttataattagagagatttaactttttatcaaatattttgtgtatgtcgggtttgcacattcaaatattttatattatgtatgggtaaaaactttcaaggtcaaaagcacaagacaaataagtgtaaaaaataatatgaaaggttatgctaaatgtagatagaaattccagaaattgaaagatattgtgactggttattgaaattgaatttgatcctgacacaccacttcattttgttttgttatacatacggagaggccacacacgtctctttttctttttctttctttgtagtttgtatacaaaggaaaaaaataaaaggagaccccatggcgggaaaatacgatcgtttgggtgagttaaaagcattcgacgagatgaaccaaccaccacaattttcttatctaatattgcgattttaatagtatataaattttataaaatatctcaacctaataatttaaagctttacacatatcaaacacgtccaccacaattttcttatctaatattgcgattttaatagtatataaattatctaaaatatctcaacctaatagtttacagctttacccatatcaaacacgtgcagtggaacttctagaccggtgaacactaaacagatttttatcatttattaacctaaaagacaactaataaatatttattaacttaacagatttacacgtctctttttcttatggcatatcaacatcaaacaatattatagcaaagataatgtgattatttggttattgtaattgaaattaatccatataccaattcattttgttttgttatatatatcgagaggttattgtgatttaaaaaaaaaaaatatttaatcatctacccagtaaaactacgccacataaccaccacaataactctaagagcacttcttaccttgaaacgtctcttacttaaattaataattaaatctttaatttttatcatttattaacctaagaaacagctaataaatatttattaatctaagagacttacacgtctctctttcttataacatatcaacatcaaacaatattatagcaaagataatgtgattatttagttattgaaattgaaattatccacacaccaattcattttgttttgttatatatatcgagaggcctaagacaacacttacacgtctatctttctttcctttgtataccaaaaaatataaaataaaaaacact

SEQ ID NO: 3384 - DNA, 2000 bp, Arabidopsis thaliana
cttggattttatattcactgctctagcaattactatacttcattttacacagatttttcaggaagtttgacaattatgttgttttggaatttcgcagtgagtttgaaattatgaaagttccatttggttgtgaattatcaaaagggggaagtgtacaggggtaatttaggaagtttgggttatgataaatgataatcatatgcaaatcttagttcagaagtgccgcgaatctgggaaaagaataagcacagctttttaaaattacctttaacccctttattttaaaacaatttctttattcgcctttacctttttttatcaaccaaattttgcctctttctctttactctgcctattaagcaaaaagccaaagattagatggaaaccaattaacatcaagtaagactgaagaaagaaaaagagtattttaaaattgcgtacatatgaatctgtcctataaattttgaacctatcctaataccacggacttatatatgtgaacgttaacaacactttcaaactcaaaaagaagatatatggataagcattccacgtaaccgtacattgttatgttcttttctagataaacaaaatctttgcgtggtcgaaattgaaaaataaatctttatatctgtaaagaaaatttcgatgtcactttataagaaaaaccaatgctgcatcccatgaaacaaattaattccaagaacattatccaaaacgaatttaatgttatccaaatagatcaagaaaattagttggaccgtcgaatgaaatgcgatccttgctgattagcacatgacgtgttcatttatttttgccaccattccaccgacctcaactcttcttttggtaaaattttatgtttatgatatcttgtgatacacaatttattactatttggtacattttgaagtatttgtttttgcatgatatatgacgttaatttgaactgatattagtcaatttatgggtacaaaagttgaaagtttagagcactatgttggatttattaaaaatgatatcatacaatggttcaatatatatatatttttttccacgtttttaataacatttttgtaaacaagtcttctactattgtctttattgttaatgagtttctagtacctaattaggaattttgaggatatacgatacattaatgagttacattatcccgaaaacaaaatcttgaaaacgaacaaagataatttggacattactcgttatgtatacgtatggaattggatagagccgttgaaccatcaagtgggtcttcaagtcaacgaactgaatttgattttacactcatgtacatcggccacaattttattcacacactactaacacctctggtgtccacttttttctttctctagattgatgtgttaagatttttgttgcaattcatttattcaggtatttttatatatatatatatataaattagaataaactaatttaaagaaagatatagcaattatgtttcacattttaacattctcaatcatttataaaactaatgtggtgatgaatggtatatatatatatatatatatatatatatatatatattttgttgtgaactaatggtaaatatttaaaataagacatacgtacataaatccacggactcttaaagtcatgatgcggttaataaatgttcacataacggtaaccaagtggctcaaaatcatgaaacaacgtcacataatttatcttataatgtggataattagtaccgcattatttgtaagaaaattaaattaattatagattcacagctaagaaaatacgaaaagacagctcaacacttttccacttctattccccactgtctatataactctgataaataatctctgatctctccatctaatatctctttctcaatttcggttccactttcctttcgtttgcaaaaacccatcccatcaaaaataaacaagagggcctaaagaagaatcctaaagactttacgggtcttgtttaggataaaagaa

SEQ ID NO: 3385 - DNA, 1117 bp, Arabidopsis thaliana
ttgttgtgttggaatggtgtctgatggatcttgatgcagacagaatctaacagttagtcagatttgcatcactggatttgttccattttgcaatacccactcgtgagcctcctgtaacacaaatattattatatgtttaaatgtgttcattgtctgttagtctactaacaatttaattaagatcaaatatataacatgtttagatcattattatattaaactttggttacacctattatgagtaaacaaaatgattatgaacaaattgtcgcagctactattcaacaaattaattattgaatttaccaaatctctattgtttattgctctccatactaaataattaaagatattgaagagtataaaatgaatggagcaagtggattaagatataattagtttggtaaaattggtagaaagagtgatgacagatgacattttagattaagaatttttatcaaacaagaggaaaaaagactattatttacttaaaagtaatcatatttcatcaaacaaatagaccacttgattaattgataaatcgattcagattatcttttacaagactgaagattgatttagccaattgatatgtgtatggttcaaattgataatctatttaataataattaaatgaaaaaccttttttagctgaaaaaaaagaaaagaataaatgcaaaaagacaaaacagtgccagcaagtcactcgcttaacatcggtctgaaccaacatatatgctctctcctcaattaacagtcgttagccagctcatctttccgttaaaaaaaaaacccaaagacagtgattcacgtcacttgggtctaataactccgtttatataaaccgttacagacatcgcacaccgagagagagataataaagagagaagcaaaaaagaatttttatagaaagaaaggaaaaatcagaaaaggagagaaaaattaaaaaagtctctcttttctctttttcttcttcgtctcccatattctccgatcaaaaatatatttctctctcactttccttggttttctcggcggcttcttcttctcctatttctccctcaaatcgttttctccagttttcttgggataaatcttcctcctttctgcagacgcc

SEQ ID NO: 3386 - DNA, 2000 bp, Arabidopsis thaliana
cctaatgcccctacctcttcccaaaaccaataactaggcgtttttttttgtcccatttttctttgttggtttcatttatgaatacactacatattattgaaaaataacacaaatgccctccttaaattcataattttacaatatttatattagtattacgttttttgcactaatcactagatatatgaatataattttaattagtttatgcccaaaatacacagaaagggcatcaaaagcatcaatttatttttaattgaccaaatagctttagtgattcttattattagtaatttaatactagttggcgagaaaaaaaaatacaaagaagatgaacaagtgaaacaaacttgagaaatatccgtggtcaaagaagatagacgagtgggggtggcaatagagtaaatagaaaggaacacgaagggtttgtttgtaaggaatatgttaataatggaagggcgaagaaaaagatgagacagagagtgggacccataaacgcgtagctgaggttttggtaaggatcgtcgtgggttcctcctctctcaccctataaaccacttctttctcacgcgcctctttcacatttattattacacctaaatttaaataaattattattattattgtggtcgaccacttctttcaaaagttgttgtcatttacctattcccaacacatatattctactccaccttaagaatatctatttccttttgtcattagaaacacttatacgaacctgttacatatttgcaaggtcgtatcaatatgtttatcgacataatcgttaggatctttgggtttctcaatgtttaatagtcttttacctctcgttaattagatataaagattggatttatatacataaatacaaatttaaaattagcgtttcaatatcatattattatggatgtacaatgtatgggaataatgtaaagcttactcaaagccaaagggcgagatatattatgcctaatggggtattattttaatgtttaacgtatgtgatcatgaaagcgacaaatgcgtaatggaggattttgttgcttggatactgttcggcaaagtagctttttttaattcaattatttcgtattattattgacaacttggcttaattatttagtgttaatcattttgtttgtcaacaattacaaacatctgcacaataacctttgatgtgacttcatttttgtgtagggggtgatataccatttcttattcaaaatattgaaatagtcctcagtgtaagaagtagagttttgggatcagcagccatatgtcctcttcaaattatatatgtttataaagttatctaatgctttaaaatatgcatagctttttttctattttttataaagtaatttaatgctttcaattgtacttatagatgtaagatattaggtttaaattttaatctctggcctttaattttgacaaattacctttgaacttttgaatttggagattgtaatcatacatcacacagaatatcacatatttgaatacttttaattttttgaaatggtataggaaatgaaaaatgtaaagcttcttattgaatgataacacacatatgtgatgagaataaaaaagaaaagaatacagaatttatgtgacatatatcttattcacaaccatagtattgatccattgattaacatatcaaggaaagtaattataaagttaaaggaaaaaaaaaaaaaaaaaaaagctaaacaaaaaacaaaaaaggaagagacaactaagcgcgtgtagttcacaaaccagaagccgagagtcggttaagaaaccgtcttaagctgttcttggacacgctgaagcaaatttaatcgtgtataaaactatccttcttccaccttctcattatattcatttccatctttctaatttatctttccatttccgagccgttgagaattttttctgagagataatttaacaaatttcttcttcttcttctgtttctgaaccaccaaatctgcctttctcaattagct

SEQ ID NO: 3387 - DNA, 2000 bp, Arabidopsis thaliana
gtttttgttaaccaaatagtataacaagtacagtatcaaaagtttcaagtttccttagaatgacctaatcactattcgatgtaccaacgtatctactaaacataatatgcatgcaatggcattattgcattttttgcacattttacaatttctttctgttagtgactaacaaaatggtgtaactgtttagtatttacctcatctcaatgatgatctggtccacatgctgccaccatgtgacccttactccagaatattcccagtctccaaaatccttcgtggagaaaatgcggaatattctactaaaccgaatcctttcattttattttattttttcctactcttttctgattatatttaagatccgatcaacttttcatatgggcgatcgagaaaacatctatttaatttgtagaactgtaaaagtgatataaaacccatgcatgtgtccatggtttgatagacatctgaatatatatcgaaaatgtgatataattctataaccacatttgccaatccttcttaccaaactaaaactaaaagtatgtataccatttcattttgttgtaatttttggtatctgaaaactgattatatttttttaacaaaccgataaactgataccgttaatatttatattagagcaattttttttcaaaatataatcagatcgaatcaattgaaataaggaagatcatattttccggcatattttcttaaaataagttctaactttcagctaatttcctccgatccaatagttgttttggtggcaggacaaggagtccccgagtacgcacgagccgggataaggcgtttaggacaaaagagacacgtgtatggctatcttccacgtagatgtctttgtccgcgtctaattattggcacgtgggtcctagtatccaagatcaggacgattctagcgagtcgcaagtgcttttcatgattaatcatattattatataccttttttcatgatcaatacgcatcttctttaacgaaaattaaataaaaacaagcaacagaaaaagtttcttaatcctgtggacgatcgattcaaccatacaaaataaattctatgtcaaggaacataaacatttttttttttgcatgaaaccggttaaatcatcaagaaaaatatgagaacttgtttcttaaatggtatataccgtccttgagtttcatttaaattttttgtgatggatattgtaaaaagtagtttgtaagcttgctaataatgcatccaaaaaggatatgtgacatgattaacaaaatttgatacaattgatttgtgataatgaaaacaaaaatacaactaaaagctccataaaccttgccttaagataatgacaacgaaaataaaagctagtttactgtctcggttgattggttgatcccaagttctcctttatcttagagcaaccataccactagacaaacgagaattaatttttttactaaaaatggttcaaaaaaggtttatttagtggctctaattgtttcgttaatctaaactatacacgctttatctagttttcagataatcttatttcaaattaagaattaagaaaatagtatagagataaatctaattgttaaaaatggattatagtacatactaattatttgttaaaaaaaaagcatcgagtatatccgaatctgtggtccgaagttgggacaagctgacataagatctagctgtctttagccatcagatccgacttagttcccaatcatatactgacacgtcatcttcttccaaactcaaaacagagcatcgaagcactctttcgcggcgccttgtatctgttttttctcccacctctcaggcgggtccctaaccccttatccgggtcttacttaagccttcaatttttctgactatatatatcccttccacttatttctattttcttcatcgaaacaaaaaataattaagagagaaaaaaacaaaaaacattttccatctctctctctctctctctcgcctgcttcaagaa

SEQ ID NO: 3388 - DNA, 2000 bp, Arabidopsis thaliana
atacgtaacataaaaagcccaaattatattgggcctaaaataaaatcggtactaacaacaattacgcttcttttatttttcttcttctcgagtcaatatattgaggtaacctatcatcatgctgcttcattagaaagttatttaaagttgtgtaagtatatgtacatcttaagagtaatgtttatattaatttgttttgttgatgttggtttgtgatatttttctgattgaaatattactttcattttgtctctatgtttatatcatgtcaaaaataatctctcggctctctttgtattgttgtgcttacgtaaaatgattgaagacaagggtggttatgagtagttcctccagggtaaactataaacccagtaatgggttacatagactttcctgaaaagaagacttgatgggtatgtcgactgtgaaagcaccaacataatgatgcaatctctttctcaaagtaaatcacatgtttaacttatcaggttgatacatttatagacgactaatatccacgcactatccaagtcactaacaaatgctcatgccataatgatactgagcttgcaccttacagtcggaaagataaatatctggccgaacacatgtaaaagataattagataaattaaacactacttctgaaataataataaaacacacaaatgaaattgtagccgacataaaaccaataatgaaggtccatgtcaaaagatatcataaattgacaaaacttggaaagtaaagtgggaacatgggacggacgagaatcttggcggccgaaaatgggattatgccaattgttatagcccaaccttctccattatctctctatttgtttaaacactacttctgattaaacgtataaacgatttactactcattgttctgaaaacattactagattttaatttatgctaactcgactaaatatatattagattagatggaagtggatcttaagcaacacttgtctaccacatttgcacatactattattaccttacattctcacaaaaagaaaactatatttgttcctatgtatatgtatgttagtctaatttaaaaactctatagagtcttgttgtaaacaaagcaattttctacaacttatatttagaaaaaaaaaatcacatgaagactaagatttatgaaccattaaattataatctagtgataaagaaactagtcagcttgacaaagatatggataaatgcaactttgtatcaacagtgatatataaaataacttatcaaaaattggaaataaaaaacaaatatcatccaattttgggcaaaatattaatagtttttgtgcccatatggtgacatcgaaagggtatgtgaagttgtgaacacaaaactatataaaatagagagagtgaggataagattactagtggatggacttcaaatttggctcctcttccaacctgtctttttctttgctacacaatatacatttttgtaaccccccatacacatttcaacataaaactatatagtcatccaattgaatgattttttttttcttttaaccaaggtatcattatcaaacactgtttcaaaaatcaataatagaatttggcaccaccaaacaaacattttttttgtaaaaatagacctctcaaaaatatcatagaattaaagaatactttttattttatttgtttgtccatcatcatcttcatcatcatcatttcgccgttaagtttctctctctctctgtttccacccattatagaattcagtgaatcaacaacaacaaggtaacacatctctctctctctctctctctttctctctttttatatttttgtgtcccaatctcttcttcatttctgtttggttgccgagaaaacgcaggaaacttttctgcaaaaaaactcggtgaccatattcaaaactttcccacgttaattctctcttctttgttttgtttcagattcattacttttctccaaaaaactttcttcaagatctgttcttttaaataatt

SEQ ID NO: 3389 - DNA, 2000 bp, Arabidopsis thaliana
ttttggtcaagacttctaatgccttcaaaacgctttctaagggacacataagagaagatagttactgctagaactttttttttttgaaaaaccataagttcccgccaataccgttttaggacttcaaacattcaagggtaggctgattttatagccataaactaaatgcattctcagcttttccccccacactttttgcctcttaaatttccaccataaactttgataattctttaaattacaacatgtacttttggattcatccttaaacatacatttccaattgaatcggtcattaaaccggaattaaccacaaattcgcgtttactgtaccgcgattgcgatttacccgattaatcacctatatccgttaagaaaagggttgactgattttatagccataaactaattgcattctcagctttctcccccacactttttattcctgaaatttctaccataaactttgataattcttaaaattgcaacatgtactttcagattcatccttaaaaatatgattccaattgaaccggtcattaaatcgagattaaccacaaatccgcgtttattataccgctattgtgatttacccgactaatcccactcacacaaaaaagcaatctatgtgatcaatgagagtagttctagttctttattgatttagattgtcattggaacaatcttcaaccttttttgtctatcttggatgatgtattttcggaaaatgattctctttaagatgatattatttaggttgactgattgatttggagtcttatctatccttatgattaggagttttatctagttcgatttgtcattttccttaccaattaacacaacacataacatatatagatagattcacattataaaacaaagacaaaacgacgtcgtttcttaacgggtgtgggattagttgggtaaatcacaatcgcggtacagtaaacgcggatttgtggttaatctcggtttaatgaccggttcaattggaaacatatttttaaggatgaatctgaaagtacatgttgcaattttaagaattatcgaagtttatggtggaaatttcaggagcaaaaagtgtggggggaaaagcagagaatgcaattagtttatggctataaaatcagccaacccttttcttaacggatataagtgattaatcgggtaaatcgcaatcgcggtacagtaaacgcgaatttgtggttaattccggtttaatgaccggttcaattggaaatgtatgtttaaggatgaatccgaaagtacatgttgtaatttaaagaattatcaaagtttatggtggaaatttaagaaacaaaaagtgttgaggaaaagctgaaaatgcaattagtttatggctataaaatcagccaacccaacattcaaacaactcaatcttaatcgttcatcaccattaatttcttctaaagtcaataaggttgtctaaggggatgagcgtgtaaaaccgaaaaaacataactagaataagtaaataatccaggtcatacagtagatttgggatgataagtagtaacctcggacgattagctagaattctgggaaaccatctatgagcggtacccaattgaacaaggcctatgtagtaagattctagaaaaagctaattttgattcaggcccaagtttcaatcttctaagctcaaagcccaacacatatagatgatcaatccaaatgatttggtcctctaatggtcaatgatgttctagattatcaggccttaatttgaattgatattgaaaaagaaaaagaaaaaaagaaaagaaagaatcagaacaaaggaggcaaaacgacgtcagataatatcagaataagatgggtaagagaaaaatctaatggttgaatcctattggttaccttatccacttaatccaacaaactctagcttctcatttcgcaatattatctcttttctcttctcatcaaaacataccaataagcaatttgctcattagagaacagagaaaaaaaaaaca

SEQ ID NO: 3390 - DNA, 442 bp, Arabidopsis thaliana
gtattttgtttatatacttgtacatctctgtttctcctagtccattagagaaggtagatgtaaaggtataaaagcccatgtgttattgaaattgggtggatacttacaagagtctatatgaataaaaatgatgcaattctttctttggagatggtgtggatgttataacaaaatatgaatcatgtgaaattttttgtcccatctttgttcttacccaattgtaccttttgagatgaaatcccatggttgcttctagtagatagctttcttctgggaaacaaagatttggtttaataagttgaaccaacgaataactcttcaaacattccccacctacttctcatcaaacctccttataaatagaggattccagcacaagtctcttcatcactcaaaccaacaagaagtagtcaaagcacaatacagcagtagtagtagcacc

SEQ ID NO: 3391 - DNA, 213 bp, Arabidopsis thaliana
gttttatctcgcctgagagaagaagaaagctccggttcctcggagaaccaatatatatataaggccaactaaaaacaataagcccatcaggcccattaaaaactcagtaatactaatgggcttttaataaggcccataattcaatacagtaaaacaacacaacaaagctaaagagaaagaaaaaaacgtaaaaatcgaagaagaccggagaaa

SEQ ID NO: 3392 - DNA, 1446 bp, Arabidopsis thaliana
atctgtcacttgaaattaaaccaggttaagctatacggactttgtcaaatctcgtccaggaatttagaacacagattagggattgttagatcagtcgagagagacaaagagctgtttctctgcgaatttctggaaccaatcaaatcaaatttgtctcttttgtttattgtcgacttttctgtttttttctgttctggtattattcctccaagggactcggaccggatggcaaaacttgaccactttgctcctggttcaggttgcggttcatggtcaaccttagacccgacctatccgtttcgttgatttcattaattagtctgcgttttcttgggtggagtgcagacagattttcttctgcagtaggcgttaatccgataggctcttgttgggcctcaaatagttcagtaaacttttcgtggggcttttagtatagcccatgtattaataacaatattacacttgggaaatgacaaaaaaaaaaaagagaatgaagcggtactcttatatcaaaaaaacatattgtatatcttcgaatatgatgcaactcatgcaacaacaatactagtaggctacatgtattgctccatttaattacatataacttaatattctaattcataaactttcttttaattatatattttatgtaagttttaaatattgaaaaaaaaaaaagttttaaatattgaaacatgataagtttttacatccatttattataaaaaaaatagtgatgatgatgatcaaaattttgagtacattttagagtgttttaacttttacatttgttgttacaattgttatgagtctgatatttcaaatttcgttttcaaagaaaaatcctgagtttaccttaaaagattaaagccagtttttaagaaataagtagaaaaatatcaaaccagacctagctgaaccaaaaattatacaaaatctagaccggattaaaccggctacccgacgaatatgcctagtaaaagtgtcgtcatcggaaaagaatcttttacatggctgaaaccgcaaatacgatcttcaagagagcaacataaaaatacttgtcaaataagtaaagaaaataagacactcaatatccacactcccaaaccatgaaaatatgaatagaaatctcaatgagccaatcagaggccagcaaagtccatctcattgtcccaagcggatatacatccgacaaaactcaacctcacaagtagactctcccttcttccgtaactattcgtccacgtgtccttccctctcaccacttaccttcaaaaccaacgcttcttttttagttccttggtccgaagcgtttaccgatgagagaatcataaactcccacttggagctcaaaaagtgtaagagacaaccaacaaaaaacgattcatctcttctcctatcctctcctcttcgaattcaacgtttggagaatccagcagccgcaaa

SEQ ID NO: 3393 - DNA, 2000 bp, Arabidopsis thaliana
atgtgatcatttttgtataaaaggaaacaggaagcttaataataagttcaaaaatggcgtggcaaaggcggagccgtcggaggatttttagtttacgagaaaaaaagaaaaagagagaaatatctgaaaaatacgggaaagatgcaggcagctgtcacagccgcaggtaaagagaaggtgtgtgacgtgtctcaataaaacaccgtttctctctataacacgattctgtcattatgtgtctgagcaaaagtgcctccttatttacatctctagaaccgtttactattggccacgtggaagatatcggtaccgttgcgttgttaaaaagggttactagtactcctcgtgaaatgatttggtcccacttcacaagtgttaatgtttctataagaaaaaaaagagaataaagaaagacagaatcgagaggagagagtatcggatcttcctaagccataaacaatgcagcaatacgctccatgcctttggatatttcttcggcaacttgtaaaactgacaatcggagccgtctctttcatcccacggctctcaattatcctctcgaccatatatatcatcgacaacgtgtatatatgtgtttaccaaattatgttttttattttatttttcaaaaaattgcactattaggtggacctacatatgggttcgattcgactccaataaacaagctaatgatgccgcccgatgaccattcaaatattgttggtagtggctttctcctaaatatttgcattttcttaaaagaccctctttgaaaaaatcataattgaaacacgacgtatcacctacatgcacctcttgaaaaatatttccattttattctcaacgaatgtatttattgatgtatattatttcacaacgaaagttcgcatatatgttttctaattggtccctagaatataattatgcgatattaaagttggatgcaagggaaaaaaagataattctgaaaaaaagataattctgaaaaggataattctgaaaaggacaaaatattcctctagaatgtataagagttggtcattttttttttttggggtgaaagtaaagagtttggtcatcttatttcgtttgacgtccttattttggaccgccgtcggaaataagcggtcaactctgaggaggatgcaaattcttttacgtttaaaaaaggggaaaaattgacatcaaaacaattgagtgtagatgactactttattattgaccaattacggaaattcataaattgaaatatatattttgttttgacattggccacattacacgaatattttttttaatgaaagtttatttttaataagttttttaaataataataataattatatatatattttttgcatttgtacccgaacattacaagttatgtaaaagtcgatgaaggcactattttaaactccctcagattttgaaaagccttgaaaactaatattttaattttaaaaacgacacgtgatttaatatagataaagtaatagccaatttagccaccaactcaaagaaaaaagttgtagccaccaactacaaaacctcacaacaacaaaaaaaaaaaaagaagaagaagaagtaataccaaaaggtcattacagtcatttgaagggtaccctcgagactatttctgtgttggctaccatgaaaaagctcacatgcctcaacagtcaacaacaccaccgtaaattgatctaccccgataccaatttgataaatgcgaaagattagcctttccttgcattaagcacaagttaaaacagtgagcgttaccacatttcatttacaagtgcaaaagaaaatttcaaaaaaatcctttccttttaccggatatatacacatcaccacatttgttaatattcaattggcgatactatattctttcattgcactaaccaaccagtctcctttatcatctctccatctcatcatcctcctccatttctctcccattttttcttctgtgtatctgcgggagagagtgaaatagagag

SEQ ID NO: 3394 - DNA, 1671 bp, Arabidopsis thaliana
cataacattgttttttgacggatttttcgttagaaaggaaaatgaagaagcagatgggtgataatggagctaactgttttagatctctgtatattatagaaacaatatataatgtatctatatatatatatatataatataatgaagggttcttgagaagttgactgagaagtcaatagtttttgcagtgtttacaaatatataatccagaggtactgcaagtaatgagggaagaacataacttctcctgtaccttgagtagtctacgtaaagcccatgagacaagccgcaacggtctggtatctcttcaacatctttaccaaaatgaggatttttgaatccttacaggtacttgtttcatctgcattcttacattggaaattcttttatcaagatgctaaacaagtgtctggctaattctaacttggctagttgagagtataagttccttgattagcctggttctgagggaaataaagtgggaaagctataaatagattcatacagttgctattagtagactgtttgcttaataatttttggaaacttgtgcttatgaacattaccgaagctgttagttagtgactggaataagcatctgacaggacgcacaaaacagagttgcagcacttgcttttcattttgtgattttcctgttcacttggcattggttcccacgtactccctatgctagactctcttcttatgtggtggattcgtttttcacaacagtaaccttatgtcaagacctttcctgattattcgccaaaacaactctctgaaccggacaccaaattaccaatgggataaagctgcttcaggctgagcctccctggcggtgtttataaagccttatgcatgcaagttcaggcctaatcactttatctgaattctgatgaagattaagagtgtgattacatgttggttctagattaagagtagttacaggttggttctggatttcgttctcaccacgacacaaaacctttcaagccttttacattgtgttttcagttggctattagcctcaaaatatctaaaaccggcacattctctcataactagtttttgtaatgcagtcactttacaaaaagtaatagatgccaagtgtaaagagctaaggtccaaaaaaaaaaagagctaaggtgcaagagatttgagggaggtcggtaaaagccattggtgtgttgtcacgttcaatcattttgcatagaatattggaagataaactggatgttggcaaaaaaaaaagtatagcaagttaggaagcagctaatgcaaccaaaactctctcatgcaacaacaaaacattgcaacctgaaggcggcggcggtactacaatttttggatttggtaaacattggttagccacaataagtatttgctgctgcggtccaaatatattcaactcctagtcctaggtaactaaaatataatagtagaaaattccaaacattaaagccatcactatatttgataggtacgtggtcgataaaatagataactcagagtacaccacctttgactcatcagccacctgccaacgagaaacacgactcctaattccactttcctccctcactcactctattatatataaacaaatcacactctgacctaaaacaaacaactctttaactatcatcagatcaataaaaaccagaagaagtc

SEQ ID NO: 3395 - DNA, 529 bp, Arabidopsis thaliana
cagtgtcaagatggagtcttgtgagtttgtcatagttactatatggttacgtagccattttgtgattcctatctagtctagtagtaattcacagattgaagagaagtaatatttgagcggaaaatcaaaactaatatgattggtacaatttggtggtcgattgagtcattcgaataaagtaatgtggggttgcaaaacagaagcttcatatctacatataaatgaaaattactctcaaacttcattatttgtgggccggttataaaaacacaaacccaacagaaggtccattaccctcactcttcattatttgtgggctggttctaaaaaacaaaagtccaatagaaggttcattaccctcactcttgattatttgtgggctggttctaaaaaacagaagcccaacttgctgacccaacaggtccgtttacgaaaccctaatctcaaaacagagatataaatacactctgccttcctcatttcatttcttcggcgatctagggttttagttgtcgcacgaggaggaaaa

SEQ ID NO: 3396 - DNA, 2000 bp, Arabidopsis thaliana
tctaaatttgtaagatgaaatatacgagtacaaccagaacctaatataatatataggttttggattagtactgtatttctactgatatcgataatcatagtttaataatttagtgtcattggcaaataaaatatttaatacactgattatcataatttatgtgactgacatgtttattataataagatcatggattaatcagtgaacttatgttcatcattgtttccaagtctaaaagcagatctcgatatatatttatatttttcaatgcgcttgatgatatttaattcgacctatagtatcaatcttgggttttactttgtttttaatcatatgctttaccaataagcaatgtttgttcagggaagtggatcctattattgagatttaaacatattgaggcatgcacaagtataataattattcgttattggtgttaagtaactcattttatctgtcaatctataacgaaattatactcatttttttcttctataaatggataaaccaaaaatgaatagaaaataaattaataaataaaaattggttgggggtgagaagtagctatctaatatctaaaaatgagacgagacaaaacggcctaagcgtggcgcaatagccgctcccaatttctgtcccctcatttattcctcactattgttttgaaaattctgttttgttgcaatcttagaattaaatactattaacgtcgacttgaagctacaaattttggaaatttggatccgatgtttataactcatggatcaaataaatgaaagatgcatatgaatctgattttctaatgattttgaaatatgaataatcaaatatttatatatatacatctaataagtaggaaaataatttcataataataatcattgtctaaataatcagacctatataaaaatagaatattatcaagtaaatttatacaaaaatataccattaaaatactctgtatatagaaatatgtgaaactgtatttgatcactgtctatcgttagtcgttccaaaagatcctattgatttaggagtatttagtagtaaatacctttataatgatggacaacttaattaccgtgtgatacagtcaatgaataattaaataagagagcactaaaattaattatgtgtttctattaaaagagaatgttacaataataatcttatttaacaaaaaaaaaaaatattacaagagaatatcattttctattctaaaattagcttatgagaggaattagatatttaattccataaaaattgattttgtagctatatcaaatttcttataaagatggaatgggtaatcagaaaaatatcaatacattgatacatatgtcattatgctgttgaccaaaaaatgtcattatgcttattaagttgttgacatactaaaaattcaagattatactagtaattaactacttaagatgaatttaacgaaaataaaactattttagattttttagcttggtaattaagttgtttttagtgggtttttaagtttaagtatatatgcaatacatatttggattgtatatagtgagatacgggtaaaagtggattttatatcattaattcctctgtttctcccccattgaaaatgacatcaccatggctttaagctctacaaatacaaatatttattctctcactttctctgcctgcatggtttttgagaattgagaaaacccttttaaaattctctatcgatctcatcacaaattttgctatatccacaattcatgtgcttaggcatatagttattcccaagaaaccggtttaactgtttacgtatgcaacctccggcaagcgcaggacttttccggtcgccggaaaatctcccttggccttataattacatggattatttggtcgctggtttcttggttttgacggccggaatacttctccgtccatggctctggttacgtctacgaaactcgaaaacgaaagatggagatgaagaagaagataatgaggagaagaagaaggga

SEQ ID NO: 3397 - DNA, 2000 bp, Arabidopsis thaliana
actactacaactgtttgcacaacataacattgaattgaaatctttatatattaaaatgaaaacactcaaccccttaaaatagaaatggttcacattcgagtttggttattattttctgataactgaattagatgccgaaccaaaaccatacaaatttccgagagatgtagaatgatgggcattttaatcgtaccaaacagaaccgaaccaaaccaaacaaccgaaccgtagtgacgtagtctacatctaacccatttggttaaacttttttcaaccctaatggttcggtttgaaccattaaccctaactgttttttaatttataattaatttcgttaggtagataatattacatgcttgattttggttatttatcaaaactaagtttacttagttctttcaatccttaaatctctaattctaagctacaattttataaggtatggaaaaaactattcatatctcatttctattccgttacttttcaaaaatttcaagttttttttgactaagaaaagattttataaaaaaaatatggctaataaccacaacgtttttcttgagtattattattaatagactaaacaaatacaaataaagtttaccccactcgaatataaatatttttgaggaaatgtatctactatcttcttaaacaacgtcgtgtcattactcaaaagtgtccaacgggcaatacaagattatgatggacgacccatgattaaacatgttcgatctaatctaaaatctttttagtctatattagtgaagcactgaaaacaaaatgttgttatcaaatttgatttgttcttgttaacaataaattcttttcaaaagtgagcaaaatatttgtagtcgtggacttaacaacaatacatcaatcgctaataaaacactggcttccacaaatgatgtataaaaactatattcaaagtcgtcgtccttgttttttctctcatcagttcacaaacaagctcaactttggataaaacgcgtcggacgtacgaaaaaaagaagacttgcagagaaacaacagtcacacacacaatcacctcagatttaaaaatattcctttggtattacttgaactaacgtcatccgagttgtttctatatatatgtacatatattctttacatgttatttatagctaattggaagtttttagtgcttattgctagctactaattaataacgagtttaattctaatgaaaattggacacaaaatctgatactaagttgcctatataagattagaaatttaaactaataacagttacatatatacaaaatcgtgttgtacctcatataattatggtgcatttgaataagatatctattgaaaaatatataatgaaaaattaaattggtactctaatcaaaaaaaaaaaaaatctttaacacatcaaatgttcaatttttttaaaagtccaaatcgttttgatattgttttttattgaagagcaaactactataagaaaaatatttgaagaaacatagcattttcccatgcataaactagaatgaccaacaaagatactctcaaagtctcacttgtctaaaaaacagataaaaatcatttccaattttgagaaaaggaaaaaaaacaactccaataatactttttgattttcttttcgttgcattaaaataaatgtggcaaaaatccaataatattactattataagttaaaaaaactcaaaaaaaaaaaaaagtatattccgtcaactttttctcagtccggttcaatcatctccatcatcgttgatctctctctctccgtcaacgttctctctataaagcagagagtttcacagcgcgtgaaaaatggcttttcccacttagccacaacgacgcgtttcaattctccatctctccctctctctctctctttcttcaaagattccaccaacctatacatatacttatatataatctatgctacgtgtatatacttccgatatccttcaaccaactctttgaattccgactttggatct

SEQ ID NO: 3398 - DNA, 804 bp, Arabidopsis thaliana
attttgtatatagaagctcttagtttattatttatgcgaaaaatgttgatatttttgttcatccatgtcgtttttacatgacactattaacttttgttaaattcaactaatctcattaaataattctattctttacatggaaattatataatgggcctaggaataaaattggagtggcccaaaagggcccaaaagaaggaggcggctcattaaggtgcagatatttttgttgcgacgatggatggttttataaacctaactaacagagacggtctaaagttggacatccttgcttttggtctaactttctctctcttgcttctacgcttcttcttgtggcgtagattgttatagagagggaaaccaaaaaagggaatctcaaaagctcgagttcacagatttgacccgagtctttaatccaatctgctggttcgttttccacattcaaactcgactcttgaatatcaaatcaggtacgcgtttatctgttgacaaaattcctcaatcctgacttagattcctagaatttggtatttaagctctctgtttcaatttctagtttctctctaagattgcgtcggtttggtcgtgtttaattctgatttctgatcgaatccttttattacgtgttagtttttttttttattgttcgatttgaatccagatctgtgactcgattgcagttggatgcttttctcatttatggttgaattaattgaaacctaagtcgagtttggtgatgatttctgtggattaccgatttggtttactgaatcgctttgacatgttgcagaagtctttgct

SEQ ID NO: 3399 - DNA, 297 bp, Arabidopsis thaliana
tgtgtttttgatacaagggatgttcagaaaccttttgcgactcataaaggttgtagaacaagaaagaaaagtagaaaccctaaattaagttgggctaattaaaaggcttcagaatctagtcgggctttttgtaaaagccctaaatgatattttctcgtttcctaagaaaaaacagcatgcagtctacgtttctatcccgaaaacgctaataagtgagtactaatttcgttttggtcatacgaaagcaaaaacactttgtcttttaccacttcttcgatacttcccaagttcaccgca

SEQ ID NO: 3400 - DNA, 1634 bp, Arabidopsis thaliana
ttcgaaggaaaatatagtgtatgtgatgctttggtgtatgaagagatttgatcaagatgagaggtatttatagtagaagcaaaccgtttacaataatgttttttcaaactaaatatctattaagataaaattattagttttttgaaagaaccatgatgatgattattgcacatgaacgaaccttttttttgcttatatataaaagcaattgtactattttacacctcatgcccacatagtatggggtgactggagagggctttagagggtagctgttactttatataagctgtaaagtcttatactgtgatttttattttttaaaaaataaagctatgacttaaaaaaaaatatagttttacgaatttttactttaaaataagttgtaaagttatatacatactgtaaattttattttaggaattttttcatatttttaaaaagtacaaaataaaatattgtttttgttattcctcagctcttgtgaaaaatcattacttaatcttcattaatcgattgtttaggtcttattaatcatgtgttgagttgggaccatgattaagcaataagagtcatttacctcctgtcaagtatgcatatgcatatacttttggttgttgaatattgttggttgcaagcagtacaatcgggagagaaaggatcgaaagatcgacaaaggtgttgctaaagctgagggtgctgattaatcaaggattaatcaatacgatatctgaagctaaaactagaacaccaaaatgttgattcatgatcttaactcctaaacatttccttggttaatgaaagagttcgttcatctttcaaaccattgacaataatagcagctgtcacctcttcttcaccattacgggcttcttcttgatgtaatggtgaatagtaaggcctctatgctgttatacaatgctttaagtacaaggatttaaaaaatatttacaagcctttttttaagagttttaaaaggatttacaatgattttaaaggattttaaaacttttataattccttttaaagtcatttgaaaacttttgtaaatgctttcaaaactctcaaaaaatttttttttttttttttaaactcttaaaattatccttgttgtatatattatttaaagccttttaaacccttaaaatatattttacaatggttttaaatgatttataaggattctaaaatattgaaaaaatgttttaaaaaggattttaaagtatttacatgtatatttaaaaactttataaggattttaataagttttaaaatggtttacaagagtttttaacaattttacaaagctttaaaaaactttactaggattttctaagaatttttaaaggatttacaatggttttttaagggttctaaacaaaattagaaagactttaaatgcaattttttggcgggaaaaaacagagaaaataaaattttggcacttaaaatttaggtgggtaagttttggtttctaactacatgttctcattagatttgatgatgattaatttagtcattttggttaagaaagtggttatttttaaaaatgggccaaaaaaggatatcatagtagaattgtggtttgggcttaaaagcccattacccctcccctaattagttttcaacttttc

SEQ ID NO: 3401 - DNA, 2000 bp, Arabidopsis thaliana
ctctcgtttctgttattctgaggaatcaacagatccaaaaaattctagttttctggtattccgaggaatcaacggatgtctagttctatccattaaaacttccgctacttcagttggtatcaaagctagaactagagattcgttgatacacttaacaaacaaacaaaaaaaacttaaaatcaaaatttgacacacacaccaaaatgagttaccttttactcattcatgttcatactatataaaatatattttcgtcgaaacaatcactcctcctaaaatattttaaatttttaatgcaaaaaatattagttgtgttttgtttattttataataaatgatttaatcatataaacaacgaggatcgataagacactcgcatgctatttttaccaggattacattagaatgagagtcacaaccacataatgaagacgatcgtctgctagctatgtgacgagagatggtaagtggtttcagattttatgatgtaaagtggaaggagtggtcaaataattaggtcaaagagagtcgaggtggttgtcactggttggctatatcgatgactaaaccacacacctacaccttcaatttctattttaattatgttttctgaataacttaatactatcttatatgatcgttagtaacaaatatttttttaaaaaaaatttatgtacattcataggtagcacgaagtgaacaaatacttgaattttcttgcgtcaatatagaactaagatcatacatacatgatacataatgaatttatgtttatattagatatgcgtcacaagggagacaagaagcgaagcgaggatcgtgctaaaatcttggtcaagttcacaaattatgaattgctttatatattaaacaatctctcacaaaggatggataatttaattagttggttccctgtcagttgttaattaagaattaatcacaaaccgcccacttcctttttatattccaaaaatgcttctccaatgttctacacttaagtatatcatataattaaatgaaactatgaatgagtaaaataattgaaacatactatttaactagctagctgggggatttgtaaataatataacaaaggtcgacaattgatactttttccatgttgggaaattctgaaaactgatcaatatatatgagtaatcgacaagaaaataactaaaacttagactttgaatggttatagcggtttaagaagacaaaaatgtctatataccaaatcgtgttttatttactatttataaattatattatgtaatagtgcggattccaaaaaataaaaaataaaaattgttgtggactaactacgaaccgtctttaaattaaatttgcagcggattgttgttcgatctaaaattagtatggactgaaccgctaacggattaatctgcactaaccacaacatccattcaaagacttaattatttactatcatgttatatttgtggggcattaataagtgaaacatattaatagtaattaaaatgaatgatatgagccatgatcttaggactaaacattgggcatgctaaattgctaataatatctatcacaagaagaagcgcgacacaaaggaatagatgcgatcatgaaagatcattatgatgattcagtgtttttcttctttaggttctaaagctcaatgattgaaggcctctgtaaaattttgtttggtctttggagatagaaaggagcttagatagagatatgaaatcagcatccaacaacattttagagtcattcaattttgactttagtatctctttccaataaaccgaaaatgtgggtgagaataaagaaaagtgaaatgttttgggtcatattcatcataaaatgcaaatagcggggcgaaaagtatgaagatgggaaaaaacgaaaaggactgaaagtgaaagggcttaaccaaaagcaaaataatgggtcccacaacacgtggcctgtgtcatttcttcttcttctccatccatataaagaagaagaaagag

SEQ ID NO: 3402 - DNA, 974 bp, Arabidopsis thaliana
tttttgtgtcattgttttttggttcttgatacagtatatcatgttcgttttatggtccagaaaatcttttttactagttgacaaatgaaaaatctctagtgtactcgtgatgtatttgattcaagtttgggggttaatttaagttatcaacaacttgtagaaacaaagttaattcacagagtaataaatcattctaataggtatgctcaggggcaaattggcaaaacataaaaataaaaagagagctactaaagttttcgagcgaaagcgaaaatgaaaattttataattcgagcgaaatgttaaaaagctgaaaattgggggaagaagagagaagagtttcatcgtcactggaatcaatagagtcaattggcgggagaggttagtctcgaaaagaagtggaagccctagggggaaactttctcgctcactcgctcgtctgcaaacaccatggaagacagtcctcaaggccttgtgagtctctctttgcttgtttgattttgtttgggaattttggattactcttaagtttttctgctgggcgtgtagaaaaggagtagagatccggatcaggatcaggatgacgacagcggcgaggctggcaaggccgacggaagcggcggagagaatcaggagcgcagcagcgaccagattgagctcgatgacgacgatttccaggaaacccgtcccaagcccaagcgtagtcgcacccatcctcctcaacagaatctcattggtacaattcatattcctaaatcgctccaagctttgtgccaattgattgtttcctaaattgattgattgtttttcttagagagcttcatcttgtttgtttgggtagatctttcagctttcatattttttttgctaacagaggttgtcaaaggcaacggggatcttatttctaaagccgtcaagatttgggttgaaagatatgaagactctcccagccttgctaccactgagctcttgtca

SEQ ID NO: 3403 - DNA, 2000 bp, Arabidopsis thaliana
gcatggtttactttactacagttttctttggttataatttattggaccataaaaaactagatagaaataatacaactggatacagaatcacaagtttccataatgaacgcaaaaattagaatgagacgtgtagataaaatgggtccaagtcatgtaaacgtgttcagcattatccactagtcttctcttcgtactacgaccccaaaccccactagcctacaccaatcaaacctacaccaatcaattataatattttgtcagacgagctttatgccaatctaatggctagttgagtgttttcttttcaaggtttgtttattgattctaaaacttgggccgcctgaagttgaatttgatacaacaagccttggaaaataaaaagtaatgtttaaaaatcacaaaacatatgatggtaagatattacttagcattatacactaaataaccaaattgtgaaattttattttgcaaaataaagtggtgagaaaattacaaaataaataggtgttgatttttcggattgtttaaaacaaatactatgagtttttatcgtgtattaaacaaatactagcttttaatttatctgatgatacattattcttaaatacaacaatccacttatttatattttcaccacaccatattttagcaaaaataaattaaataaaaaattgtatatcctaattaactcatatgttttacaagaacaaaacacaatactatttttatacgttccaaaactttgtattataattattttaatgtttctaaagttatagcaatgtgactaatgtaacataaaaaaaaagagatttatatcctaaattttgcaatgtcactaattaacaaaaataaaaaatatgagaaattaaaaaatgagatttatatctaaagttttgcaatgtcactaatataaaattaacaaaacaaaaaaaaggttgattttggttttttatgtatgtaaagttaaagcaagttaaactaatgtgatattaaaaaaaccaggactcagaatcccgcgatgtcgcggaggaaatattctaaatatgtttatataatgatttaaaaaaaaacaaatcgcatattataaattttagtaattatttaaagaatatatatatatatatatatgtatatatatattaaacagattaataaccgtcaataattttacaaaattttgcaataaaaaaaagatacagacgaagaaaaaaaactcgtcaatattaacaaacaattacgataataaacaagaaaaaaataatcatcaatgttttagcaaaaaattgggatgaaaacacacaagcggaaaaaataaccgtcaatatattaaccaaaagtatcaataaaaagatatgaatgaaaaaaggtaagtttcaatatttcattacaccatattttagcaaaaataaaataaaataaaacaactatatatcctaattaactcatatgttttacaagaacaaaacacaatactatttttatacgttccaaaactttgtattttaatgtttctaaagttatagcaatatgactgatgtaacataaatttaaaaaaaacaaattaaaaaaaattaaaaaatgagatttttttgttttaacatattctttcctatttatattatgaggattatatagtaaattttgcaatgtcactaattaacaaaccaaatatatgtaattaaatttagaaattttaaaatgagatttatatctaaagtattgcaatgtccctaatataaaattaccgatttagaaattaaaaaatgatggtgtttttatttatgtaaagttaaagcaagataactaatctgatattaaaaattaacaaaacaaaacatataaaattaaattagaaaataaacaaaatgtgattaaaatgatataaagagagagtcaaaaaaattggagaagagggaaggagcaacaaagaaaaagtctgtttatcatcttcttcttcttcaaatcgagatcgaagaagaaccaacaaaaaaccaaaa

SEQ ID NO: 3404 - DNA, 2000 bp, Arabidopsis thaliana
gaccattaaatttaatttagttgtaaattatttatatttttgacacataaaaatggacgtcgagacaaatataattttgttagaaaatgctagattaaaaataccaatcttaattttgtttgatttggaaatcaaagaaggttcaaatcaccatggctcatatgagtattggtttctataatctgtaacaacaacattgtggtattttcccactttttgtaacaaaatcacattgtccatatacatagtgttgaattatgcagttttttcacattttctatttccgtaaaatctctgcgagtattttataagaaaacttatatgtcatttctaaattgaatttaaatcaatccaattcaatatagtttaatttagtaaactctctgtcaataattttgatagaatgttattaggttgtaaatacgaatgttgaggtcaatataattagactacaaaaaggctagtataataagacttttattattaagatcaataaatactacaaaagtcatcttttaaaatgcggtaaaaaaaaactataacgatcaaattgccaattactaaaagaagtatcaattcctacgatgtgtagcaacaacattgtgggttgtcttcaccttttgtttgataatcacaaaatccatatgcatattgttgacttgtacactcttcgttacatggtctattaccgaaagctatctcacatggcccaatgcaatgtggctcttgctcttgctggattgctgcaaatacacaatccaataatatacatacatataaatagctattaccaattctatattttatgatataaaaatgttcaaacattgctcttcaaatgatcaaagataatttaacgataacaactaacctggtttggccaatgttgtagctagaaaatgaaattgtcaatatccctacaaagaaaataatcacatatgtttttctgatgtccattatatattttcactatgaactctattgagaaaaatagacttttatagttttctatatctttaataaagattctttatgaagatctctatttatagaaaaatagatttttatagttttctatatctgtgatcagttcaaatattctttatgaagatctctatttataagattatttttttttcgaataaaaatatcagttttcacactatatttcagttttttcacaaccataaatgaatattctatatttttaatatgaggttggctaaaatttattaattatcgttcttaattataaatttcactaaaaataaatttaattgtattaaactgaacagatgattaatctaagcatgttttacacaaatataataataaccaattttaatatatttttgatttaaacaattacacaaactgattttgccatagcttttgccgatgaactggcgagatcattgtgtcaataaaaactacgtaaaatcccagtgtaccgtgatcattcaaatccatgaaaatattcgtctaactaaatggaaaatctcagatgagttgatatcgataccaaaggaaattgagcttaatactatggacaatataatacacatgaaattgttactataatcattgcttggttaattcgaagaagaactcaaaaataatttttcattatacaatagtcttgatttacatagaagtctcaactcttaagactttcaatagttaaataactgatacactttgaagtttaggtgtcctgtctgattaaaaatttgccaatgtcatttccttttgaccaggcttggttaagaaacaaactaaaaaaaatcactcgttaacaaaaaaaattgtgtaaagaataataaatatccattttgtgtgatatgagagaaacaaaaccaaagacgagccagagccacctctaacaccatcggcgacttctcctcctactcctccgtcgccgacgtgttcgatttacaacgattcggtggctattggttgtaagatttagaattaaaggttaaaggagacgacgacgagag

SEQ ID NO: 3405 - DNA, 1273 bp, Arabidopsis thaliana
gcttttttacacaactcgctgtagtgtacttcccaatactttttcttttttttgttcctttccttgctccctatacttgcagtactaataatttaattgaactatatgtgttctaacttctaattgaactaaatactgtatgccttttgtgaagttattattctcaaaatcatgaccttatgataacggaatcgtcatggaagaatttggaagtagttagttagaaactagtcaattgtgaaagaaaatacacattttgaaacgatacattagagattttgattaagaacgggtaatgaaggacttgtgagttgtgatgtgtcaaaaattggtttgtgccgcaggtgttgaacgatctactctacacaggtgtgggcttacagggctagggctcagaaaccctttctttcattcatcaagagggctagacgcgcctttcgaaccagtctttatacctgtgaaataggtagaagctagccgacaaaaaggtagaagctaatgtgaatttcaatggacttaaaaagcccatatgttatctaaagtatgggctttttctcttaaaaggaccatactcaaaagcccatatttgtatttcatactaactctcaaaagtataaaatataaatatgggcttaaaaattgacgttagcttcttaagtgtggcccatttagagtatataaacaccaataaatccatcgctcagttttccgattctagggtttttctttggcaaactcgatttcgcctagcttcttctgagcatccgccgcttccgtctacaggttcgttccattgttccgtcgctctgttaatatcgtcgtgcttcagccgcttcttcttctcttttaggattctcatcctaaacatgttcgtagaatcattgcgtggtgtttctggagtttgaatttcttagatctctccttgtggttttgtatatagttgtccgttctacattttttaattaacacgttgctcgattatcgatcgtactagcataagattaggttgagttagagaatccacaaatcgagaaagatctgtcgaactactctgtgttgtgagttatagagccttttttgtgtaatttcagattgttttgtgttgaacataagcattggttttagtgatttgatctgtggaacagtaacaatcatgtattctacaacttttttcttagataaaagatttagccttcttaatacaatcacatatttcaatttgagctctggttggtatgaagatcttgacattctacatttgtgaaaatgcaga

SEQ ID NO: 3406 - DNA, 1088 bp, Arabidopsis thaliana
attaccaatataccatttgctgattgattgctacgcaaaggaatgtaacttgtaactgttgtagtatttggtcatgacttgctcatcgcattgatgctccaatatttacctaattcccgaaggagatagaactctaggaaatgtcaagattccgacctactgtattagcctttgtaatgttatacataagatgatctcaaagattctaagcctgcacctcaaagtttttttttcttcttctgtatttgatatccgagatacaaatatgtgttttgtagccggaaactttattatagacaacattctcattgcccaacaaaaatttgatgaagtaagtgtcgtgttttcttctattattttgctctaaattaagtagtgctattgccacattcttagatactaacgtagaagagtcccatcgacattttttttttgaccaatattaattagagttcaaaaaagcctatcattcacagtagatgccaaaaacaaaaggagtcattcctagaattgttgtttacatatgtttttagtttatattcttagcttaaccaatatgctgcgaattgattgcagaaaagttttttttttttttttaaattaaacaattcaccgaaaaagaataaattcttattattgttttttgctataaaacaaaatcatgagcaaaagaaagtattcatcttgtggaataaatttttattttttaaagtaatggctttatttttagtgttaaacagtattcttttgaaatgtaaaaaaagaagaagtattcttttgaaatgaattttttattgtttcttttggtaataatgcgttttaattcgaaccggaaagagttaagggattaaataaaaccggcggctttttcaaaacccttcaccgtttgttcttcatctcctcgccgccgcctcctactctctctttctctctaaattgctcaattctctcggccacaggtaagcttcttcgacttcactctttgacccaatactactttcctcaccccctgtggtttcctttgttaaacccttcaattctctttctcaatttgataaaccctagttctgctatagacctagacaagg

SEQ ID NO: 3407 - DNA, 584 bp, Arabidopsis thaliana
tcttacttagccgagtgacttacaatagtcgtcggcggcaattttattttaaaggccgccacgactccgccgcatgtttatattaaaaatgtttatgttgttcccttttttttttttttttgtcggcatgttgttcccttataattttgtttccaccctaaaacttttatttattaatttatagtaccttatttcatttaaaattggagggtccttttgtgttaaaataacttaatagggtgaaatgtggaagagtagtgtaacttatgtctttctcttttttccgaaaatttccaatttaagattcttctggtcacagcttaaggtttcaaagctctgaaaagatggccggagctgtttctgccgtcgatcaaccgttgaaaatcatcaccggagctgatgactttggagcgagcctcaaggacgcgatggtaacacacctccgctctctcggcatagacgtggaggataccggagtgtcctcttactactctgctggatctgaagtcggtcgccgcgtctccgcttcatcgtcttccgaagttcgcggcttagtctgctgcggcaccggcgtcggagttgcg

SEQ ID NO: 3408 - DNA, 2000 bp, Arabidopsis thaliana
atggacattattaccatagttgaatttacttccctttcttacaataagcttttgattactcatatatacctcacacatgttatgtgaatcggtaaattcatactatatgtgaggaagtcacttacaacagttggattttaaagggaatccgtctgaaaaaaatttggagaaaaaaagaaattgttttgcttacataatttaatttaaaaattataaataacaatacttttataagagaatagtttatctgttgaccaaaaaaaaaggaatagtttatctatccacaaatggatgatccatattggagtatatagaacgataagagatgattcgatacgtactaaatgaaaactttgaatactgtgtatagtaagcaatcagcattagtttacaagatcttagttttcgtaggattagtttagactgtttagtaatttgattccaaccattgtacaggagaaaatttttaccgctcaaaacaactaactgaacgtcatacttaattgggaatttgggagtcgtcaaagaaatgaaaaaggtcagattaatttatggattaatgagttttatagtccttattccagcttgacattagcaacatatacattatttgtgtgacataatcagggaatatatataatcaaaattaatgggatttaaaatttaattattcttacaaaatatcaaaaaatttagtgtagacgaacaaaaagagaatacatatatatatatagttcatttgaagaagacgtgtatatgatcgatccgagttgataagtattaacagattacatacatattgataagatgatgtgatctcatcgattaaggttcaatcttttaaattggttaactatctggtgatgacatgtcaactagtcgattatgagcatcattaatgatcatgaacatggaccacctctctctctctgtaagattatctttgcatcaaagagacaaaacatccaagagactaaaagtatggtccttgagagagaagaagtctctttaattaggtctttctatttctctctctctctattagtagtaaaatccatgtacttatacgtagacataataaccaaataggtccgtgatgttaaagagtacacacctaacttcaccttgctaatgatctcttacctacaaactctcactgtttttagttcatctcattactcactgtgaccccatttcatctgcttacgaccaatttggtaagctttttgtcttagtttcaacatttgcaggaatcactttaagaaacaactaactaaaaaggagataactttgaaaaaggaggattgatgggtttgtttttgatgagatggatatttgtatatgtatgtctaatgagagatatattgcgtaggggaagtgaatgtagattagaggtctccctatatattgattgattttatccggctatttttacctaccgcgacacacggtatagattcatagtaagctacaatttaaacacaagataaatctgtaatcatatagtatagtactatgcttccatatataccccatatttacgtctcctatgcttccatacgctaattagtttttttttttttccaaccataattgcaggtttatataaacatgaactaacgaaaaaaataaaatataaacatgcaccatggagtcaattttaaaattctatgaggtttgattttcaaaaggaaaaatctaatatactaatgaaaaaattgagatcataaaaaaactaatgaagaagtagatttatttattttgaaaaatatgtacaagtgaaatgtggatcattctttagctatatatatataggtggataaacgtaaaatcacgcacgcggccatgctgcaggggttaaatagcaattatgtatttaccttaaaaagaatttgggaacctctctttaaattaatgcaaaacctcatctcttgtctttctgtctctgaaacagtcaacctcattcttctcaaactcactctccctgatctctctcttcc

SEQ ID NO: 3409 - DNA, 1824 bp, Arabidopsis thaliana
gaaagcaaaacagtccatctatttattccccgggaaggacccaaggtgacacgttcttttaactgatgtggcccttaacgacgatgttttctcgcctctgtatctttgtaactcttttttttttttttaccattacagtgtatttgcatacaaaagaggttcgagtgactttgtgcttttttttctcacttgtgtccatgggacttctgtaataggaaaactctgatgtaagtagcttcggctaacaagacaagagagagttacttgttttagagttcatgttgttaattgtttcctttttttttttttgtcgactaattgtttccttttatcttggaaaagtgtgattctcatttcatttatccctaaacaaaagaaggtccgattctttgtgtaagtcatcttctttttagttattaaagtaagaattatatttttgacttttgaaaatgtacttatacgttttatattcctaactttacaagtttaaattaatataataaattatgcaaaaacaaatttcaaaaaacaatatattggataaatatattgcatatatatttagttaatatttattgaataatttggtattaatataataaattatgcaatactatgtaactaaatatatattgattaaattttttacaaagatttttgttttaatatttataaattctagtttcatagatcgcgcatttcgcttatatcacagtttttttattaataggctatgttttttaaagtactttaatgttgtaatcttagtcactatttatttataagcataaaactataatttctatgtttttgtcgcctttaaaaaatcaatattaatactaaaatttaaactacatttaagtttgaatctctaaagcttgtgttaatggatagcttggaaagcttatctttccggagaacattattattgtacaatctattagctcttgattcttgaatttagttagtgcatctcctgattatgttccactttcattttcttctaattttaggaatctggatgcaaatccaggttaagtacatttagcttaatagaaagatgatttgactcggactgatgaaaatggtgccaagaccaaaactctaccactcggacgagtcaggtcaaaaacaactcaaattgactattgaaccatttttctaatctagaccagacaccaaaactctaccacagctctccgacattggtgggcctaataaattcccacaaatatttttttctgttttctttttctataaacggttggaattacatcttttgaacccatatttttttttgtactaaaatgattaaactcgagccaaaaaaatatcaatttattaggcaatcactacttgtataatgcaatttatggcgtgattagttccacaactgcatatagactatcgaatacttacacttttatgtttttaggaatgtgagtttggagtttgttaccgaaaaaccaatcaagttcaagcttaaagccttaaaccaatcaaaccatatcactttctatttttaggaatgtggatgcaaatcaacattaaatacatttagtttctaaaaccaatgttaccggttttgataattcccacaaataataagatgttcataaaaacgtggccaacaaccatttatgttcaccaacctaatcgcccctctctcaaaaaaaaaaaaatccaattttccaattttatttaacggtcacattttcctcattgcctaattaaaaacattcagacacaaatttagtttcttcttcttttggttctgtctgaatccaattttcttatattttatttcctccaccaccgtgagat

SEQ ID NO: 3410 - DNA, 1971 bp, Arabidopsis thaliana
accttaataataagaatggtatgggtctttgttacttccaaaataagttttggggtccatatttataagagaagcaaaatcaatgccttgaggggacacagctcacgagagtaggcttcaccaactaccaaacggtcaagtcccatgtccaaatttctcacctacaacagtttcaaacaaaatcattttagtctttttgttattcataccatacttcatacttgtcttcactgtttttatgatcgagttttgtatgagtcttttcaaaattcaatcatgcttcttgtcttcagtcttcactgtttttctcctccacaagattagtatttttttttctttttttgtgcgtaagatagagttgtggtcgaaaattgtaagaaaaagaatctagcgtcaataatacaattggtggaaagaccaattttgaatctgattagggaaaaatgttgactagtgaacaaaaatttcttggtaagaaactataatttttttttttcaaaattataaattagaagtcgagagctattggaagtcggtggaactaaatggttgattggttcattagtaaaacacacgtggtgccactacacttttttaatagttacttgactggtgctgtttgcaaagttattatgattgatgattatttttgaaagaaaattggaatataaattcggttaggtcagtattgtcatgtatttgttaaaccactgtatattatactcctagcttagtttaatttatgagatttaagtggaattcatactaatcaaatgtgagatttcttgaaaattgtagtggaatttcttcaaggtcgaataggattattaaagagatactataaaggagcaattggtgccgacaaaaaaaaataaaaataaaggagcagttggaatggtcagctagaatttcatactccctccgtctttttttacttgatgtttagcagaatacatacaaattaaaaaaaaaaaaaatttgtttatttctaaattaaaatatcatttattatttaatcaactacaatctaaaaaataaaaatcatcaaaatcaataaaaatataactaattctgcattaaaagtttaaaacatcatttattaaagaataaaaatataaagcttaaaacatcatttataaaagaatttagaaagtagtactaatataatcgttttttaaagtgagccaaaatagatgactttgacacaccaaccaaaagcctaaaaagtggaacatgtaggctttcaaggcaccgcggacaagatattgttaatcgcaacgtcattattattgatttcgattcgtccatctgtggaataatacgaatatcattattagagtatttactaatcaaatataaaattatgtagactataacgaatcatttttttcttcttccaaataggtaaatactctaagaaagatattcatattattccaaaatgaatgatagctatatttgatttctataataagattccacataaaaactgactccataaagatatagatcacgcagagtcgcagactatcgcgtgcgtcacactactcacacatctccataatcaattctttctttttcgctcgtcttgtaatggattagaatataggtaaagaatccatttatatgattataaaatggtaaggaatttgcgaaaacccaaaagaaaaaagcattgaaggaatatttcgtaatcccttattattttcacgatttctatcatcgaagaatccaattttttgatggagtctccaacttgtctgacatttctgaagttacttcgttttcaaccaataagcaaaatttctttttggaaaataacaaataaccaaattttataatttctctctttcttactggcataataaatgaaatccaataatggcctcatctcttgcattattcagtgatccaaaaagactttaaaaattgagtgacaaagacgaacgaagaccacgattagctcttccc

SEQ ID NO: 3411 - DNA, 765 bp, Arabidopsis thaliana
ttctttttctcttcaatatggaatgttttgtgcatagaacccacccacctgagcataacaagcagtaaattattactttttagcatttacgattcttgtgacaactactaaatcgaaaaaattattttaaaactaaaaagaaattgttgtctgaaaaacataagtgatatacaacaataaataaatatctcttataagaatttgggaaaaaaaaaatccaaagattagagatatttgggtggagaaaacaaccgcctaggacaaaaaaaaattgtgggtagaggaggaggaggaggctttgttcacacaccacacgacggaacattctcttccgagtcttatccaaagcaaaatcatattttgcttaaatatcttcttctccggctctgtctctgtctctcttcttcccgcggagctttcagtttttgtttggtaacatcgtttctctttctcactaactctgatatcatattatcaatttttccttttcaacacccaaaatcacaatctttcagctttattctgtttttccttgcttgagaattgtgttcgattcatgtctacgaactgaaatcacaaattttgccaacgttttatgattcctggttccgtatttttttttttgtaatcaatagttagctcatttcgaataatcaaactcaattttattgttcatgatttgttatctgggataaaagagagtaatgtgctaattatgtatactcaggtattgcttggtgtggggaagattagatagtgtgaaga

SEQ ID NO: 3412 - DNA, 2000 bp, Arabidopsis thaliana
aaatcaaagattcgtcatcagacaaccaacaaacttctacacaaattactataaatgggttttactgcagtactttagtagttgttggtcatcagttactaacttactatacatagattcactctaggcttagagtagttgttggccatcaattgttgtagcctttttttggtcaaaggtaaattgagaatagacagtaaatatagcttttgactatgtatagatccacaactgcactcaatttaaaacattaatgcattttgcatgcattcatatcatccgttcatgagattttatacattagtataagttttacacgacagatgttaaaatgttgaattaaatctgttgtcgccattgattttcatgctcacttaatagaaatgtctaaaagcgtgacaaaatgttatattgctacttaagatttttttttttttgccaaatttgctacttaatatatgatagttcaaaaccatgtttagctatggttatagcattgaaattatttggtattacaactaccaaaccatccaatttaaaatagtccataagtaaaaagccaagcatgacacaagagggctatgtgatggtattggttcgagaccgtgtggaatgcataatattttatagacgtttttcaatactaatatcttaaacttatttaaattaaacataatttattatcttaataatcatttataaaataaaagatacatatagctaacttaatagcctataaaatccaaagtataatacatcatttgtgtttaccaatatcaaagtaggataaatggaccagttttgagtcgttagacaaaatgatatataatataccatcaacaatagtaattaactctgaaatgcagaatcgcagaaaatagttgataaatcatttgtcattttctaatgtgatttcagttccctatatagtatagttgctatttaacaaatggtgttggaaagttgaaacatttaaactaaaagccaaaataaaataaaatttaagtctcttcttgaacatttaccattaaattttgttttcttctatacactaaagaaaaatctcctaaaatagatacagctttcattgctctttttgtttttaaacggttaaaagaagaaacaaactttaaataaccgttaaattagatattgatcagaaacaaaaaaaccggtttcgaaaacgcgttaccaaaccggatattgcttaaaaagtcccacttcaatttgtttttttcctgcttcttcttctaaaaataaaaactctactcttgtcactctctttttgctgtccctattttcactccactctttttcatttttttagtccctactttatttctcattcattatccttttctaattaaaaaaaattaataccaaatctaaacatcatcattcattttaggagatgtattagaccttacattttgaatgatgagttttagttatatgattttgatgattttaggaaagttgatgtgatttattgtaaaatcttttcaaatttcatctaaaaccatataatttggatttctgtatttttaagtgattttttttttcaaatctttcaatattaataaacatcaaattcataaactgtttccaataacagtgaaatttaaggtatattttttagttcaacaacactagatttcattagaatttttaaaatttataatgaataacataagatttataaatttacacaaatcacttaaaataataaattgaatacgctcctcttaaattattcacaaaattatacgttaccaactatacataaattataaataaattaaaaattaaaagtctataaatagatttaaatttaattgtgtagggtttagttatggagaaaacataattgtgtaagtttttttggcttctatatatattaccacaaatatataacacaatccgctctcaaacccaaacaagcccaccaatctcttcttctctgctcttctctctctgtagacactagaagaagaacaaaa

SEQ ID NO: 3413 - DNA, 943 bp, Arabidopsis thaliana
gtgtcctttactcggtcaaaaactaaatgaaacaacaatatagaaaatctttaacagtttcttttgaatggttccaaaaaaaatgcaggaacaactcaaacaacacggtttcacgtcctttggcttcacagaaggtagggaatggtcctcgtggcatgaaacagttcggtcctgctgatatgaagcggaaagctactaacgccagacattgaaggccactcactcacacggatacatacatacacactcacatggcttcttattggttttgatttgtttatttttcatccattggtttttattgtttcttcttctctcgtttggttgtgcgagcttttatatacataacacagacaaagacaatagctagacaatgcaacaacagtttcttcttgttgctctctttcttgggttttgttttacttttctgttctatgtatattcttccactagctgaacataaaaaatatgaaagatttgtttgttaactatttgcttgagagtttttttagtatattctataatgcttcaaatcagagacttgttgcatttcttctaattagttacaacttttgcaatctttgctagtataaaaatattttattagaaatatgtaaaatttgggaaagtattatttcacaacagaaaaaaaaaaagcatagtacttttcaaatatcgaccaaccttctgattcgttgaatccgtttctcgaatattataattttatttttgttgtttgccctatctttctttctccctctgctcttgtgcaacttgatccgtcgtcttctctcagctctccatctccgtcttccaaggtttttgtttttgctatttacgtttacagattcgtaatcctatcctggattgagaaatgcgtagtttgatgattcttcgctcgcctctttgttgactgcagttttactgtcaggtagaagaatcc

SEQ ID NO: 3414 - DNA, 1870 bp, Arabidopsis thaliana
ccttcaaatggcaaaaccaacctgcagtgtagacaaaaatgaatggtctatataagtgattctcatattcactaatgtgaaatcctagtaaatgtagaaccaggtcatccaagcaagaagggaattgtatacaaaagcaagacgtcacagttgttccaaagcggaaaatgtaaaccatggagaacagaaaatcaacccataaggcgtttaaggtgacacaacggtcaagtaaaacttagcaaacgtacaaatttgtggcacagaatgcaaatgattgcatgcaagcctagagctgattctaatttctactgaattcgacagagcctatggaaaagcaagtggtacttgtgagatcatgtgcaaaaaagaaaagccaatgaaaaatgttaagaaaagcaatgcagaagaaaccgagatagcactaaaccctagaaaaatcgcaatcccaatcgaaattagaaaagatctgaaaccatgggacaaaattgacacttgagagcaaaggaaccaaaacgaaaccgaggaatcaaaacacatacccaagagagatcgagaaaaagaaagcactatcatgcgccactttcggagaatccagaaggcgaaacggacaagtaaaacacacaaaaagcagtcaaaaaagcataacaacacatgtaacaaagaagagacgaacacaatcatcaataacaaacaaaacggaacgaaaattcgaagctaatgcaacgaaatcacaacgaagaaagcaaaatcgcagaagaaaagaggatcgatgttcccgccacaacaaagaaaacgattggagagaattataaacaacgaaattagagagactcaatcaaaaatcttacggagaatgtatgaaattgggaatgcgcgtcgtcgagagagagaggtggtctctcaaggaaagaatacaagtgttgagatctcaccgtctctcttcgtttttctcttcgctctctctctctctctctcgctctcagctctttttggtcgtcgtccttccttatgggaaagacgggaaaaaaaacttaatatgcgaattagcctctcaccttttttttgttattttatatcttaagtagcactcggtttcctttttttgtttatacaggtgttgctgttttagagccctatactgtagtttttcctttttctatagtagcccaataactgggccttgtcttgttatatgggccttgaatctttagctttaaatggggttggatttgaaaccagtattttattcattgcttacgatttaaaatggtaaagccttaactctccaccattattatttgattaaattccaaatgatgtttgaccaaaaaaagaaaacttcaaataacccactctagaaaccaagtcattaaataatgtttcctgtgtaaaattcatggaccaatcgaaatgcagaagaaaatctttacagtaattagaatggccaaccaaagtttgttgtttttgtttttgtttttgtcaacgactcaagatgatatttatttgtgtttacatgaacacccgccaaaaatatgtactaaaatatctatttcaaatatggtattttatggcctaaaatataataacatcacttttttccttttcttaaaactaccaccacaaaacaacaaatcaaattaattaaattcttcatccataaatctatcaaaacttggtaccaaactcgtgagtgacgaagcctcgacgacttacacatatcaacacgtactttatgtggtagttgtctctatccagcggccaagatttcgccacgtcctcacttcctccctccttaaaaccactcgtaacaccatcccccaaattacatatccgccattgtttccggcaacgcaaactaccaaaaaaaata

SEQ ID NO: 3415 - DNA, 2000 bp, Arabidopsis thaliana
ctattattcaggaactgttcgtttatgtttaaaatcaaattattgacttctaaaaaataactgaatacatgaaagactttggtggttgtggttcgtttttttaaattggatttaggattttcttttcataaatcttaggtacggagcaaatggatgactgtctcttgatttgtttattttattattcaaaatgtatgcaaagatcttgataacttgaaacataagacattaaaatctaggtggaaaaaaacatttgaaagcaagtttgttccatatataaattgcaatgaaaataagaaaatgtgaaacatattgatggttttttccttttcctttcagtaatgttcttatcaccaatgttttgtttggcacgatcatcaaatgtttagacatgtggatcaacattgtaataattttctcttcaaatgactgactctttttttttttttcaaaataatgtttttcgtaagtgttaggtgtgaagaccatcatgtttttgctagattcttgtagatctcaacattgatatttgtagatatctatcaaatcgttacaaaaagtttgctagattctaaattaatgctaagaaaccagttttctttacaaaatgtttttgtcaatgtcctctcacaatcggctaaaagatgttacaaactataaaggatcctcctccacaacttttgaagattttactctctccagattttgtccaaaaaggactcacaaaatcacacaatgatggtcaactaaaaaaaatcactaaacaacttaaatgaaatgatgacaaaactattcccttttgttgcaaaataaaaaaaaaaaccttttaaatctgcaaagagatccttatatgatatggctgttgtcctggtattatttctccaatttaatttaggaatttcatgtttgacacttatttagggatcgtataatatacgttttttaattgatttgaaaccaaataacatgtactattgccttagtcctcttgcaattcgtttagaagatgttatgattgagacaaaaggatccacccgcaatactttgtccatatttttctctcaagattttgtccaaaagcaaaagagactcacaaatcacacacaatggtccactaaacagagtgcctttattgcatacaaaattcaatcaatttaataaaggaaactcaactgaaaacgatgacaataaaaaataaaaaatgtcccttttgtctttaaataaaataataacccttactgacgtaaagaaaattaaattaagataaccttgtaaaatacttcttacccaaattaaaaaagaaaaaaaaaaagacaacaagaggattaaattgtattagtatcaccatcataccattacacataaataaaatttagtagagtataaacgaatcacgtgtataggaaaatacaaaatacaatgttgaagttaaaatgaatatagaagtagattaattgagcaataaccaccggttttagatcattgattgatatgtaagtaaaatgcaaagtagtagccgacttggcaaagaaaaagaaaaaagaagagagagagaggtaaaactaaaataaaattactaaaagcagaaggaaagttccaggtcacgagggagtagtcgctgtcggattgaaagaaacagaccaaacaaagatctttgaaatcttaaaaaagattcggtgcccaaagattttgacctttgaagacacatttgattatttgtgttttctgacacttcccaaacacataacatcaacacttgacccatttttaagattttgtttcctcttcaaagatcttaccccgcaagatccgatcttccaaatctctctctatctactatactagtacttattaaaccccaccacctctcccttcttatttatgtcacctaacctaacttcttcttctttcattttatcacattcatttcctttgtcttcaatccaaagctttcctcttcttggaaccaatctgctctcttttttattctgagtttgaca

SEQ ID NO: 3416 - DNA, 2000 bp, Arabidopsis thaliana
aatctgtttggtaatttatggtaactgcctgttgacttttgtatgtctacttttttttttttttgctcataagtgttgtctcttatttaaaccaaagattgtaaagattacaaaagagtggaaacctccgctttcagtctccagacaaaaacaaaataaagataaaagtccaactaaattaaagcccagttgaagcaagaaacccttttaggaagtaattgatgtagtccaccgccgatttggttagtcattgcagggaactccaaaaccaccaggaaccaccaagacttcaagcttgtccgatggagcaacacaaaattcagagaatcccatcaatcttcttcatcttcgaattcgcaaaggaaaatctcccctgggtagtcatatcatcatcttcaaacgacatcagcgtagaacttaagccaatgaaacttccatgaacacctaaaagtaaaataaaaacactcgtttccaaaaaccaatatgacaattgactcaattgcataaaacccaactcaaaggcattagagaaaaccccaatccacaactctaatttgttcttatataattgaaatcgataagcttgaaaaacaaattgagccctttaaacaaaggaggttcaaggaattgagccctctaagagttagaacacaaaggagcaaaatcaaactggatctatagaaaacgagaacataaaacaaaaccgaaaaagaaatccggccaaaagctagcctaaaccgccggagacggacgacggagaagctagacaagagccaaccaccgttggtagaggaaccaaccgatggaggacggcgacaccggacaattctgctaaaggagccagaagattccgggaaagtaaccgaccaaccacatcacaagaggcatatggatgtcgggctgaagcctgtcaagcggactggaccggcccgctagactcacacatcacagtgggtttaataatgttttactgttaatgaatgggcctctcaagacaatgtgctaatccattccttgctagtttttgctcaacttttagcatgtagtgtttaacgttttccttgtgtatgcgtatctaaattggaacttatgtgaccatcaagacagtttggaatttcatcaaagcttgtcttgtgatgcctcttagtggtatggagcggatatcaattgtccaaattgtcctttggcagactcgagaaatgttgaaagcaaatgaaaccggtgaaaaggaaaaggttccttttttctcaagcttttaaaatcaattaaaattgtaatggcaacaaaaattaagtagattatcttctaaagttaagaaagtcatctaaaaaaacaattttggaattaaatccctagttaaacattttgcctttaactgtagtgtttcatttctgtgcatcaaaggttttgaaatcatcaaaactgttttgtgaattctcatcatggacacatacacatacacacaagagccaagagttgacccactcatcaacatcatggatctagacggcttaacgtccctcttcacacttttttcaacacatgttttattccctcccaatttctggtacctattaaaataaagaatagtaaacaaatcatcaaaactagcacgcaagccacttgtattggattgacccctcatgaattctattctattaattagagatacgtgacgaaacttacaagtgacaacaatttatctaattactaattaacaactaattttaaaaatgttatgtgattagcaaaatttaaatgtagttacgttatcgtaattctggatctattactataaactaaattatttttgacgtatgattagataatgtaatgataattgtaaagtttagtttgaaaaaaaacaaaattgaccagacactagagtaaagcttatgagcattgatggaataaatgatacaaagctctttaacatttgagtattccattctctcattaacggattctctaaagtgcgccaagcgtgcgcaagagccatc

SEQ ID NO: 3417 - DNA, 2000 bp, Arabidopsis thaliana
atcattgttggtctcataccttgtaattcaccacatatattatcaatggggaagatttgaaaatttttgggggatcacaaaacgaaggaaagagtacaaaaagagaaggaaaagatagaagatatatgtttttaacttcattggtatgacatcaataaataaatagttgaatgtactttagtttctcttttggtttaatgcacatcatctcgatcaattgtcatcatcttacattgaattatacgaccagatctgataacaagtgaattcgtacttgcccttccctttcttctcatacgtccttctaactaattttgattgtaacttataattatataaccatatttaattttattttatctaaaaccaattgaagcaaattaaaatatcataaatcttgagtcccacatgaagacaatatataaaactcgtgcaaatttgcttaaaatgcttctatgagaccatgaccaagtgagattaataagcgattcaatgtgcaaatcaaaagagaaaagaagctaatgggtttaaatataaccaaacagaataataatgctatgtttagtttttctaattgaatcatacctttgtgtccatcacctacttaccggtcagaataaagcaattacgtctgcaaccaaaaagcactaagactttcggtcagacatgatctctaacatcggacgaaccctaagataaccaaaataaactatatcttatattcaaatctctgtttattttatccatttatgttttctttctttcccataattttttttgtgtctcatcagactctcttaccaaactgaatttatcaacatggttttttttttggccacatcaaaatggtggtttataaagtagactaatacaaaagacatttctgttaatttcactaacaaaaataatcttagcagtactatagattggaaaaggaaaagcaaatctagcagtaagatttatcaaaactagcagtaagagttttagatatcatgaaaacatcacaaacgagtagtgttttactttacatttttaaccaatcacaagggtagttccgtaagttgggaaaatcgtacgaggcttcacctagttaaggttaggtcacatgattccctgaactcgattttataagtaaaaaagaaaaatttataaaatcaaaattttttatataaaaaaatcaggtggatttatcagaccctaccatcgagatgtcgacacgtgtccaaactcattcattgccctactattttctgtttagggttgcaatcactcatcgcacacgcgccatctccaccttccattattaatctctcattttcaacatcacactcttacgaatcatacgattttaatatctctgtctctctcaacgtattaaataaaaatggttttaaatgttagggttttttgtaggattttcaattattaatctctataattcgatgaactaagtaaaaaagcatcaaactttcttggcagaatcacatttttctctaaactaaatatggactgaaattgaaaaattaaaccactagctagaataaagtgttggtgagagtggaactctaatttctctcctttactaattatgtataaacacaaaaatgcaccaaatttttaggtttgaaaatatctaagcatggatagggtaattaacattttttctttcaattttgcaatatttgaataaatcctatgagggtctttggtacacaataattggagggtatatagttgagtctgagagtatattagaaagagaatatttcaagtaatgaagctgacatgtttatatgtactttgagagaagtgttgtgagatttgtacaaatgtatatgtacactttaaaaagcaatataagatagataaaaaaaatataaagaaaaaaagaaagaaagaaagaaagaaagagagaggctcatatatatatagaattgcttgcaaggaaagagagagagagagattgagatatcttttgggagaggagaaagaaaaagaaa

SEQ ID NO: 3418 - DNA, 2000 bp, Arabidopsis thaliana
tttggaccttttttctaaaattcaattaaattcattagaaaatcatacggattacatttactaatatgaacttctacaatgttaaatttacatacgtcaactatatctgataatatcactaaaaattaagttatattagctaaacctcgataattaacgtttttgaattcaaaagtaatggtaacttttttgaccaaattattctcacgcttgtataagtaaaagttgttttttagagtgatcatgatagcattaaaatttggattgtctgaattcagtggctttgttttactattttatagtattctattatagagcaggactatatattattaattttctagctttcaagtttgaattttgcaaaagcaaatgtgtcgcgccctttgtcgtttgtgagtgttattcgttgtggtctccctggatagcaaaataacaaatcaacatgagatatgaatatatgatatgactaagacgaataagagagaaagtgtcaccatatttattaattatctctctcaatgagcaatcgaacaactccaaatcaaaacatagagaagatcatatcatcaagtttatttcgaagcttgaacataaatggtcttttccatacatatgatatggtcagatcagacgtcgtcattctccattcattttgggatcgcatgggtcaatatgagctgatatttgtttatataaaattcgcatgtcgttttcatacatcgcttcatatgtgtgtttaatcgatttcccaccatttatttactcgtgtctaaaactcaacaacaaatcgttggtattttcaaatctacacccacatgcaaaacatcaccacattttaaaaaaaatgaatgtaaaattttaccaatccaaaaaaaacgtttttacaactacgtgttactttgagtttgaagtttcgtaattaaatctcttagacaatgcttcgatcctttgccgtagttgcttgacgttgtgtgtattcaccactttcgtagcccttcttcatagaccttgcttcctgatttgatagaagacaaatcagtaaacgatcaccacattttttgatgttaaacaaattttctttaccatatgtcataaaaccaactgcaccgtataaatctctggatcatgcccgcgtactcacattacgtaagagatgaaagtaaactacatcctcctacaatctttttgtttcccaagctgccaaacaatccaaaaccgttgtagtcatttttaccatcatccatatatggtgaatcggtgatgacggtttaaaaaagaacttttttcttccatctttttattttgccgactgattttgtctcatctaatataatatcaaatcatacaagattcagaactttatatgattaaacatcctcagtggtagtgacagttgggaagagtaagatttacgtactcaattatttaattgcttcaaaactgtaaaaatgtatagaaccaacaacctgaaacacgtgaggagcactacaaacgacgtcgtctagtgtcgtgacaatttataacatggtgggccactaagtaagacagttgttagatgtaccactccctttatttcgtaaatatttcatgctttgttttcttctttgactcgtgtccatcaaaacaatcatttcaaaatactttggacgagaattacacacgattacgccacgtgttctattcacatccaacggctcttacaaaaataaagaaaaagtccgtctacttgggtcatcaatcatcatcatggaagcccacttagtttcctttttctgcatacgacgccgttttgcgattccaccctaaccatttctcagtgacgaacagtctcagaagtttctagaccaaaccacactcttcttcgtcttctccgttctctctatatttctcctcaccttcaacgcagctttctcgttctcgtctcagatcgtgttactaacaaacaccgtttctccggcgaaaagctctctgttactaaaaactcacagaacctaaaa

SEQ ID NO: 3419 - DNA, 2000 bp, Arabidopsis thaliana
cgttgaatgattaaaccattcttaaggaaaatcaagaaagtaggctatattaaagcattaatattggtagtattttagattagtcttaagtctaaacatagtttttaggaataattttataattaattttaaaaattttgatgttaaaaaactaaaattttggcaatatacaatggtggtttttaactaattttttttaatatatatatatatatatatatatatatttatatatatttatttatttaaaaatagaaatattttaattttaaataacttaataattattacaacattgttgtagcgtcatcaaagcttggaaatggttggcgatgcttaatcatgttgatgttgttatcaaatttggaatttaagtcatttaaaacgtacataatcagagttcgatctgaaacaagggtatcgatattatcacacaagtgtttagtgaggcgattgctggcaatgaagatatccagctaccacatctaaaggaaatgactttgagcgtcatgacaaataaagacaaaaacaatcacctcttttacgacataacatgggctattcctcaacgtagggtattaatactctttaaattcaactacaatgtttataatccgtatctttaggcatagttctatttatgagatcgtgtagggcggcttcatctacattcataaaattatcatcgaactcctccagcgcctaaaaggtgtcgattttatgaatatcacccacccaccaaatgcttcatattatacattttttataattaatcatgcttactaatcagagtttacaaaacttgatttataatatgagattattcattctttatagaagaacataataataagaaaaaaacattagaaattagaatattatgtaaatatatgataaaactaaatatttcttagtttttgctcaactagtcctttaactaaatgatgtaaccaaaaaaaattcataagtttttcctcaaatatttttcaaactttatgtcaccatagttattatggcactagctactattaaatctaattctcatttttaagctttttataacccttctaaacaaacggaaacatttctataatggattagaaagaaaaaaaaaaagaacagatggggcaaaaattatactcggatctagttcggctatagaaaggatatggatacccggattaaccttattgattttcacatgtgcctctcgtgctttctatccttttgcaaatgtagaccaaagtattttgatattatatgccaccacgaggttgaacgccaggctatcatgacaagtcttaatacaaactaggccaatacccgcacgtttataacaatttacctcgagtgtattaatttgatttaactaattcgataaatatttttttttggtgtttttaataaccattttgataatatctgatgacaaaattaaaaaaaacattttcatttacgctttaaatataacaaatttaattattattaatgttaaggtaagtaattagaattaaatgttaacaatataattaaaataaataagtaaacaaaataacaaacgaattattaacttgagagtcagaataatttattagtggagaacagatggaccaataatctaaatttaactaatatatagaaaagcaacatgaatatattcctgaccttggtgtggacaaattttccaaaaaaaaagataatgtcagaagtggggtttgaacccacgccctcttacgaggaccagaacttgagtctggcgccttagaccactcggccatcctgacgttcctgattaaagatctcataaattcatcatatagaagaatcggatgatttagtgtcaccaattattttattaccaaacaaaagacacttgattgaatgaatcgccgggatcgaggagattagtagtaagcacatcatcatcactcagatctagtagttccacaaactcacattgggtcgttgaccagaaaaacacacagagaaaggagaaaaac

SEQ ID NO: 3420 - DNA, 1745 bp, Arabidopsis thaliana
caaacattactaatatgagttcttaccagtgttttcacgcctgacctagacttactggttaacccacaatccgaactttttttcggtttgggtttagtactagaaaccggtaacttcaaactgggaaaattcgtcattaatctgctaaccggttgaactggtcagatataggttgtaaaaaaaatcattgagcaacttcatcgccggagatgacgatattctaacatacaaactgcgaaattttaacaatcgtaataaggccattcctataactctataagagaatcaagactaacctttaagagcaagtcaactagacgagacgaagcgccaatgaccaattttttttgtttttgaaacctttcacctaagcggacggaagtttcgtgggctttatttaaataggcccataacgatatattgttttacgtatagtctttaatatctcctgttaatctttcctcacccaaaacttaagaaatgtgtctctcatcatattaaaattgggattttcaccgcggtcatgaaattatttcgaaatccatatccgtaaatttcaattatttaaaagatagaggattataacccccgaaattagcaaatatattataatgatacaaaaagaaattcctttacatatcaaatccaaaacaacaaaacttttcgtaaagaaaaatatctacaaaaaaacatttaagagaattgaagtaaaagaaaatgaaatcaaatgctgaattctagactttgcgtaagagttgggactgctcatcacaggatctagccatttggacaaaagaagcttcctgaccacgaccgtaaccaaccaaccaagttgaatgtattagctgtctccactacgacaattaaacatttgagtcagtcaatttcatcattttaccaactactaccatatccactctttaacgtggcatcttccttcttatccccgtttcaaattttgttttcatcaaagcttttttataataaaacaaaatcataaaatacaatgttgatccttatcctattttctttagcaccttaaccaatctaaatttgttaagtgtcagtcaatcaaaaaaaaaaaaaaactcaaatatgagaccacaaaaattactcaaagttcaatttcattttttaaaaattactacctagtgaataataacactcaagagtaataacaaaagaactacaaaattggaaaaccactgaataatgtcagaaaatcgtataaatacttttagataaaaaaaatctcaaaagttttatcatattttaattaactttttaaaaaccaacactttccccctttttttggtttataacagaataatttggttctattagactaaaactctacctctgtcaaggtcggtccaagccggtggtaaagaatccaactctcaaatccaactttttctgaggaaaaaactcccaaatccaattaaatctgaaaccaaaaaaataaaagtaataattaattactaaaaaaaggtaacattactaaacaaaaaccgcgtgatttccaaagccaataaataaaacacaggcttttactacaagatggcccaatcaccagctgttgcctcaaagacgcggcttcttctttcgccatacgaaccttcctctatacgaaccgcctcttaaaaatcttcttcactcacttactatatatacattcctccataaaccctcaaaaaccacaaaccaatctaactcaatacaagaatatctacaatctctagaaa

SEQ ID NO: 3421 - DNA, 2000 bp, Arabidopsis thaliana
aacatatacgaacaagtcaaacaaatacaagtataatcttataattaattcaattagatatcagcttttgtctccctataaagctaaataaataaaaattcaggtatataagacaatgattctgtgcagtgctagacatacgactttacgagtggctgtcattactcattagggctctgaaaattaattaactcaactgtgttagttaattagttcttaattactcactagaccgaggaagtaaaagaccggaaactcctgagtttcatgagttgaaaaatccactggctaggtcaatctagtcatttatgttacacacttatagcttttatgtcatttaaataatgaaaatttggtatagctgaggtcaaatgaaactttactactgaatcgaatccgaaaataagatatggtaggtatgcttattggtttccacattcattggattgcttattcatcattacaattcacaaaaaaaacatgaattgtacaatcttgtatttgtcacttattcatagcagttaaatatgctattgtgattaaaattgtttagtttggtggaaatttatgtgcgtctttgttcttgcttttacaaatgttgcggtgaatttgtaactaccaaatacatattgttcatacgctcacgctagtcgtttgaaaatttatttgtttaatcaattgccactaagtttttttttataaacaaaaaatccagtgaggtaatattcatgatattgaaatactaattatgatcacttccgttcatatgttcatatgatgagttattcataatagtgaattaaattaaattattagggactaaaatatattatttggaaagagtgattatcattcctcatgatatgaaatggaatatatatattatatgttcaaaatttatatgcttgaagagaatgtatgtttctaattatgcattggagatatttatatgagtaaaccctagataagcacgatcgagcatgtgaaggaataatttgctctaggtttcttttatttaaaggaaatgatgaaccatggctatataggtcaatccattcatctttttttttgcatcatgaatcggcatcatcatataaatttgattcgttaaaggacttacacgtttatcttcttaccaattcaaaatacataattacaagaaatctgttaggacattttggaccataatgcatacagaaatcatggaatcaaatatagaagaagtatagaacatcgaaaaatgttatttaatacctgaattttcaaaaaatggccaaattaaccgtgaactcttgaaatggtcgttttatacctcaacaaaaaattgacttttaatttaacctataatttatcgttgacttctaatttaacctataatttatcgtcgacccgaccaaatcaactcaccgttaacatttcttaatagcgctcctaacagccattacaaaacatggcctaacagccgttgtcgttggtttaaggacgaaaacaattgttagttacgctgttaggagagctgttaagaagtgttaacggtgagtcgatttggccgaatcaacgataatttataggttaaattagaaatcaactatttattgaagtataaaacggtcatttcaaaaattcacggttaatttgaccattttttgaaagttcaggtattaaataacatttttcccgaacatctatacacattacacaaatattaagttttctttaaacttcaatcaaatgtattaatatgctaactgctaagaaagaattcgcgagagacaagaaaattaagcaatcacagtctgacacgtgttgataatgtaaaccatccacgtagatcaattcaaaccacaaactcaaacagtgtattattgccttccctccatttttcgaagacatcgcgcgctttgtcgcttgagcatcccctgcgcaaattatcctcctccgccgtcgcataaccggcgcacattagtgaaatcggaaaaatccgtctctcctccttcgta

SEQ ID NO: 3422 - DNA, 504 bp, Arabidopsis thaliana
aacgtctctgattgactcttttttggggtggaatcgatgttgaagctgtgctctctcccgttttggattttatcggttatttttgtttttcaatatgttaggcgtactcatgaatgtgaactcgactttgtctggattttatgcttcttgtttcctacttatgaaaaaacctttcccttaattcctatattttgtgctctttattgtgttaacaaccatcgcttctttaaagtgaaagattttaagtcttggactgtgataccaacttggtgtcagttaaaatacgtttcctctactgtaattttgccttcaaacacttaacatatgacaggggtattacagtcattttatgctcccgacagagaaagcatctcctttcacttaggatagaaaaatatagaaagattcttacattaaaaactgtgcttaatgatcccagaatcccagtagtagctctactcaaagtcaacacagctaccggaagaagattcgagtctctcggaa

SEQ ID NO: 3423 - DNA, 2000 bp, Arabidopsis thaliana
gtaagagtttaagcaccaatattattttaagtgacaaatccaaactatgtagaacatgttaaacttttcatgtaagggtttagtcctttcaaacagaactaatcacaacatttatctttgttaaaaaaaatgtaagaggtactaattttcttctcatatcgtaagagttactaactttttttgggaacgacaaccaatttctccactaatcaatattttcttctttcgttagccttgtccaccaatccatggaagttaggcattgtcgtttcgggtccttgaaataaaactttggagatgttgtcgatttttttttttttctttctagcagtaattttgattcaaagacatgggacgtttgtacttgtgcaaaacaaactagatattcgtttcctttaaacaagttcggtttactttctccacctccatctcagaatcaccagagacgtttgcagccgctgcagctccgtcataaaccttctacaatctcttatcatcattgtctggctagcaacaccttgtcttgtgaactcctccgccgtcgaaggaactcttccttcttccctcccccccactcgcacatcctctctacatataaagaaaacaccccaaaatattatcttattgtatatatatatagtcaatttatttctatattccatgaaaacgtaggaatctcagaaatatatatgtaccttgatataaaaagagtaaatacatgatcttatattatgcttggcgattgattttgtatttacagtttcatgcataagttttcgtatttacaaaatcatctttggaagtgaacattgaaagaagtagtttttttggttgcgaagattagagaggtaagacaaaatcgatgtcctgatgacacaataaacaaaactataagtcgagccgatcgatgtagttttcttatacatgtacatcaaacaacatgatgagagggggggggatgagataatatcagttattattatttgaacatacgtttttgattcttataatcgagagtacatatagaataagagatcaatcaattcatgaccggactggagatgggagaatttgaataattattgcagcaacaataattttcaatagccaatcggccgtgacttctgcctatatatgcttgacaatgccctccgcctttcttcatgcattttatattgcattctggtgtgctcgtacatccttttgtacattttgatgattgtcctattcggttcataaacaaattcatcaacaaaaaatttaaaagcaaaaatgtccaatttaatattttagagttttatttttaagataaaaaatgaacaaatattgaaaaaaaatataatatatataacaaataaacatgttaccagaaatcataggtatgaggaggagagcaaacaccatcaacgtgagtagtcgatgagatgaaaccattttggttgtcatttgttatttttgtagaggattctataactccttctcaaactatagtatttaagtctcaggaaaaagcaaaacctactaaaatcgagtttcaaagttattgttaaaacaaaaacgaaaatctagtataagaggagcatattctaaatatttgtaatttaacttaccttttgtatttgtaatattttaatacttattgagaatgatttgtggtggtcttgggtgtacatttatatagacatacatacatatacatattggaattatgtttcattcaaagattcatgaattcattatctgccatatgttgggattatgtttcattcaaaagacatccaaatttagtttatttaactaggtaaattaataaatttcgtaagtgcatgaattctcttaaaacccaacccggcctaccaacctggttcgcggttaaataccggttaaagacagagatccaccacggcgtcaataaaaatagtcaacgttttgtccgttgactgacatcgtcttctttgctgcttctagggttctactattggttctctaacattgtcgtt

SEQ ID NO: 3424 - DNA, 2000 bp, Arabidopsis thaliana
ttttagatgcatctaatttaccaatcattcacgcattgcctcaaagataatatgacttttcgtgtccacgaaaatatataattcctctaaaagaaaattatagtaagtattaatttggtcgtggtcgtcgtcttttatcgtttttacaagtaaacgtagtatattgataaagactactatttaaaggtccacacatagattcagtaattgggtcgagttttgtagactcgtgtaggatcgagtttaatagttctaaaaccagattaaggtaaactgcgattcatatggaactaatccagagaatgataagccatgttagattcatgaaacatgaattgttttgttcgtagcagttacatgcaaattgatccgcataagtcataaccacctacgacaaaaaaaaaaaaaaaaaagtcataaccacctaaaactcttaaaactcattgtctaatattaaaatagttcttatcgaataaatttttcattttagaactaaacaattaatgtaaactagactcgtcgttctgtcattactctcatcatcagtttctttttttttttgattcatattctcaatcattattgatagcaaaaaaaaaaatatataacaagaagtacgtacaatccattgttgtataattaggtcacataaaatttacaaaaagtttgtttgtctttctgtacactacacataatctcggaacgcataattctatctatattgacacgtcatgaagacgtgtcgtaaagacttacttggatatgacttctttgtaagttgcaatgaaactcgtggttaatgccgccaaatctgaaattcttggaaaattcttcgaatatacctttttaatactcatacatatatacattttctcacataacttaatccatatttgaggtttccaccgaatcgaaatgttacaaaattaacgtatccatgcaaatcaatcttttttttccctctccgtcgtcaatggaaatcaatccatcaaagaaactttaaagcatgcgacttttctctgcatgtatagattagtaaaaaaaaaattactttatgggaacgtaaaattgtcatggtcttttgaccaaaattgttttagattctatagttgcctagttggtataatatcttgagccacaaattagaaaatttactaggtagattttaagaataaaatcacaactgcttaggtaacgtaaaatcacaactgatttgtttactgatatatcaactatggttcttataaaaaaaaaactatcaactatggtaacaatgctattcttaccttggactaactaaagttattgaccaacataaaaagtgattaacgaactgatcattgagcatagtcaatatcaaatacaaacagaatgaatatgttccaaataaatatttaaagagtcgttaattaacgataattgacaaagcttgttccatggtaaatcaaacggtaataatatatagtcttcaacagtcatttttattgtataatgaaaatagtaattttattattattattaagatgtaaaaaaagaataaaaaaaagagagtatttgagctggtgatgcttcatcatcatcgtcgtcttcacactttgctccgacaggtcaccacttaagttttgcttttctcacgaaacaaacaaacttgctattttcttctctttttccagaccatgagaaagcaaaataattgagctcattctctgcaaaaaaaaccatctttaatctcttccatttggattcggagagagaataaaaacgaatagacaatttgattctctgtttctctctcacctatttttattgtgttccgatctgatcggatttaattatcaggttcattttcgatttaaatttcgattcttttttttgctggtctcaacggagaaattttccggtgacagcttaaagttttgatttttaattcttttttcacgaagaagaatttcaattttgtgaaaccgttagaagaagaagaagaaaaagattataagctt

SEQ ID NO: 3425 - DNA, 787 bp, Arabidopsis thaliana
gagcttaaaactgcagcttaacaatgaacctcgagtactgtaaaaggaagttaaacagtacgtagtaataataataatgtacgaaaatgtgactagttttgttgaggtttacctgtaaaatgcaactccttttctgaataaaatcttttcaattttcgatcaagttaatacaaatctaggtctaaattaggttcttaatcatagagactagttctgatttttatgatttaatacatttgaatcatcatattattttatataataatccaatattaacattagacaagtcgccaaaatattgtcatgcttaacaaatttatattacctcattttctttatctatttataatacatcaaatgctttaattttaatttcaaatatctaatttaatccgtgcataattttttcaataaaataacagtgtttttatctaattaataaataaataatttgtgggaccttgtaaacatatttaccatatattattatttaaattaataattagatttattaatgaaaactgacgtaacgccgtcgttttaattctttgtcggtgagcaacatagagtgacgtggcagctatctgctggttaaacgtattagcggaagactaaagtatgtaaatctaatggacagaaaagtacataacgtggccgaaatctaatggctaataaggtctttgtttaaaacggaacgtatttaaaggccaacagattaagcagaggagttatactttactacttactaatctctccctctctctatctgactctttgatcggaaaaa

SEQ ID NO: 3426 - DNA, 2000 bp, Arabidopsis thaliana
gtacgatttacaatctctggatctatgaaactcatcaccaagcaggaacctgtatttatacgtcaatatttgtgaattttcggatacccaaaaaataccaagaatatatatttcattttctgctgaaaatcagagaaaaatgtgttttaaaaacaatgtctataaacaaatttatagattgaagttagaactaaaaacttttgatggttatagatttcagcttgatcatttatttctgaagtgttttcgttggatgaaacatagattatatatgtctataattaattgagacatatacattgatgatatacaaaataaccaggaatttttcgttatacagaaaaatacacaagtctatgtaacatgcgtaataaccatatggtccatatcgctgcattttgtgtcggtctacattattggatttattttagtataatgtatgtgatacgttcttaccatgcatgggtatacatagagaaaggtgtataaatcaacgagcatgggaattatgacgttaataattctaaaataatgcacacacatcctgttaatataaacaatataaattatatatcagtttattatggaaataatacttgaaacttctatagatcggtgtgaaccattccttgacatcataggcatgtcggttatataacctcatccatatgttctatcaattaatcaaatatggtaattaaagaaagtcaaatattgtgacatacatgcatttttttttactaacggttgatatcaagcatttatagacgaacgtctatttgatgatctcaataatcatatcaattggcggctaaactaaactagatttcacgatgacaaaagtaaaatgtatatatagacactaaaacacagatgatgtcatgaatcttttttgatatttgtatattattgtttacgtattactttctagataaacaataagatacgagtcatgaccgatcattgtttctatgtcggcgttttattttatagtaaaaagaaatctgcaacaaaaggaaagggcacaacaagtagatcaagtagtagtaatctggcattactcaataggtccaaaaggaattaaaatgttcactaaagtatgcttaaaatatagatgtatggatctacgtagttataagtagttaagtaccattatagaagagtgtattcatgtgggttctttgtttttgatctggaaaagattagatgatcatcattccatcacttgcttatctattttgtttaatcattcttcttcttcactataatcattctatatatttctggaagatatcatgataaagaagatatatttatctataatcacaaaatgttttgaaccttttcatttatgaaagaaaaagaactaattagatgatacttttctaagttccagcccagtttggatagtgaatatattttctccatccccattgattggtattgatgggctagatatatgacatgggatctcataaggcctatttattaaatgttttgtaaggcccacgtattgggctaagagaaaaaaaaaagagagtactcaagtataggtttgtgtttttcaaggcaaaagtcaaagtattgtctagagacactggcacttgatagattagacgcataatgtattcaacataatcaatttagaataaaaattacaaaatgtagtatagtaaagagttatactaatagtttttttttagaagtatataagaccaattaaaggaaataaatcgcaattaatattctacttttgtttagtaaggaaataaaattatcgacagtaatgagtaaaattttcggtacctcttcatccatttttctttttacctaaaatttgaaagtaaaaaaaaagaaaagaagcgagtggtcataaaagtccaagaagtctctgtaagtgaaacctggcctccacttttgtttttccacttctacggtaagtgaaagagagagagagagaggaaaaaaaaggggaaagcttaagatattggagagtaaca

SEQ ID NO: 3427 - DNA, 1359 bp, Arabidopsis thaliana
atttctaagtattttgttgttttttgagtttctttctttggtgtttgtcggatttttcttgacagttgatatcaactatcttctcttttttttcttctggatattatcaaagtttctttggtttaagattagatttgcttaaacatatatttcattgggttatggccacagttacattattatcaaattatagtgagcctaaaacatccagcaccttgcatttagtatacgtgtggcttaataagtaggtatgatttgatttgttcagattcatgaagcttttatttttatggtctcaggacgctagctctagtacccattgaaacatccatctaacctaactagaattctttgttgcaaacatagggttcataattcatgacaactttattcacaagtttttcaagtccttgaccagcttgtgagagcctcttaattgcgatttcctgcccttgaaatttttcctaaattcagtattaccaatgaatcagtagttcttcaagtccttgaccagaagcttgtgagagactcttaaccgcgatttcctgcccttctaatttttcctaaaatcagtattaccaatgaatcagttagtttacctagaatcagtattaccaatcccttcttaggattcatatatcaagagagagcttacagaaaaaggaagttttgcttagatataccgcattgaccaagcttgttgtgagaccaaaattgtctgttgctgaccgttgtacagactctggaactttcatcttttgcaactttacaatgttatcttcttctatgtttcttgtgcatctaaatggaacctttatgatgcatccattagtttcctggaaaagaaagaagaaccagattaaatgaatagtttcctcgtgaaggatcttaaatgcttttccaaaaagtacggtggcgagtttctccggttctcgcctcggttccaatcttggcaagaacgagtcatgtggataattgaagctctcccttgcagcacaaagttccctgaacagaacaactcatgttttccattgtgtggcctatatactatgagagtgttattagtaatacctaaaagaacgaaatatctttcacctttcgaacccctgaacatttcactcgcacactattctgctaatttaccattcaaaagtcaaaacctctgaagttgttgtggttacaaatctgctgctcgatttggattcaaaacaggcccattaataaattgaataaaagggcttcaaggcccaatatctcaaaacctagtccattaaggatcaagctattttaggaggtggaagaggttttagggttttaattcatcgcagaaacttgacttttgagagagagagagaagaa

SEQ ID NO: 3428 - DNA, 2000 bp, Arabidopsis thaliana
ctttctaccaacaattacttaatgacttatataatattctaattatattttaattatgtaattaaataactattgatcccatctccatagtgacatgtctcactttttcttccacaacaaaatgcgtcactcttgattcatcatgttcgtagcaaaatccacgttattacaaaaaacgttatacattttgaaaggtaatccataaaatagtgagatggatcaagttttctacgcaaccctcgtagaattttagcaatgatccaaagctactgtatatatatagttacgtttcgtaacacaacatgtattttaccatgattatgcctcttttttttttctttccacaacatatatgtatttacatccttatttggtttaggctgagtttgttaacatagcatcaccaatagggacaatttttttttttattacaatctaaatatctaaaatataaattcacatgaaattaatgtttctaatagagttcttcaatcttcatgtacaattgcacatttttgtgaaattattattactttatcattttttctttaaaattaattcaccgagtaccgataaatgtttatattgaatacgatttagtaaacgacatatatgtttcgtcacatttttatcactatttgtaatatatctgttaaatttgatgatgtagtttctgtttttgaattgaaaacttacaaagtttagaaaaaagaatgtaaattagaaataaatacactttctgtatttttgaatactataataggctaaaatcacatcattttctaatgttgctttaaataatatatatcaaataaaggcttaaattacatttatataagaaatattgtaatacaaatatcaatttagagctattaatttacaattacaacctgttgcccaattgatgaataaatcaaacatgtaattaaccaaactttctaattgatcaggaatcaatttagctaaataataagacataaatttggccaagaaaaagaagagaaaacatgttaaataggtaatgggttttaatattgggatagttacctttatttgaaaactattaaggtttgatttaagacacgagtcactcgagagtcgcatctcgccagtcaaaaactaaattaaaaaactatatagacccaaaaaataaaaataacgacttttgtatttatactggcaagattctcattaaaacccagcaaaaaaaaaaaaaaaagacaaagaaggaagaaaatttgagtgggtgagaattttttacgatagaggaagagacagcatcatctacttgtgttgtctgtgtacatatattacagtaagcgttgcaatataacttcttgaggatcttctcacattaatgggtcaaaccttttgctcttccttttgattaatttagtgtttgacaatctcctcctccttctccttcttcttcaaagttttgtcgcagtatctattgttcttacagagagaaaggtaggcttttgtgtccatcactcattttcgctcgtttggttaagcttcatctgccatgtggttcactgttttgatacttttgggctcttatacctaatgttgatgtaacacaacgatacataatctaatttgttttcgagtggaaaatagttgaacccagttgagtatttagccaatacgattagaggatttacttgttttttctcttttcatgttcttcatttgcttttgaagatcttcctctttatgtttgtgtctcttcgctattttacttgcttgaagaaattgagtttctcatctcgcttaaatttggctttatatacagatttagagatctcgattcctaatctacttgtttttgtattcaatttgcaggaaagctttagtcttttaccagtttgatccaattctgggtttcactgaaaaaaagttgggagtttgattcttctaactgtagaagaaacagagtcaacagaagaaaactaaaaaagttgagatttttctctcacgcgctcaagaacttgagt

SEQ ID NO: 3429 - DNA, 658 bp, Arabidopsis thaliana
ggctgcttcagattatttttcttgttcaacgactctcccgtctcctccatattaaaagactttggagaaaacaccccattgttctgatattaaataactgaactccacgtcgtttttatcctcaacagtaataacatcatgtcgtttctttagtcaacatatatttaataaaggcctgactaaaaaagcccattaagaacttccagagcctctgtcgctccttcgctgttctcttcctcaggttctctctctctctctcatttcagtctctttcgctgttaaatattttctcctgagatttttttcttcaattccaattcagtgagcatttttattgtttctccgatctgaattccggcgatcaaattacgacagcgactaattcaacgttttaaattactctgtgtgagagaaatttgcggttagtttattagctacattacttccactttttttaatatatttttctgttacttttcccaccttttttagttatcttctggagatagatcccccccaaattgaagataactagggtttcgaatttcggaatcttattatccctctaattagattcgaaattcaatcgcaattctctcgctgttcataatctgggtttctgaatttcagctctggatttgcatttttctaatccttt

SEQ ID NO: 3430 - DNA, 2000 bp, Arabidopsis thaliana
atggtacgtactattctactattttgttagtattatttaggtttagttttagtaatatatatgcgtacgtgtgaactcaataaaaaaaaaaaaaagaatactttcataactaaacatggaacagtgactatcaaaattgagtgaagctgtaagatgatgtcggagacttagtcatatactactacgcgtaaaaaatttatttatcttatattggcgagagtttacaaaacataagagagttatttatgctgtactagtgaagccgacaaagagaatgaatcaaagaaacggccaaaagcatcgtcaattgaaccatttctgcagtcaaaagttttactcgattgcctttgttttcaattgatctaaaaatattcataaattgaatttcgtggtcaaagtttatgaccagtcctataggtatatatcataaagtcaacttcgcatcaattattgttaaattctgttcacatttcactcacatgcttagaatctgcgtttgacttttaaaaacttttaatttgaattttcaaaacgtatattgttcatttgttcatacgaatatatacaacttctttttactaaaaatttggaatcatctttattattaacattcacgtaacgaatttggtaatcatcaaacaagtaagaaattgtatatcatatcgtaaactccgtaaaaaaaaaaaaaaaaaaaaaaagagaatggtaatttgaaaagaaacctctaattttttattttgattaaaacataaaatttatttcgagaaaaacttttgacataagcgttgtctcaaacattttgttgaatacaaaaagccaataaaagaatagatgagagcttcttccttataggcgaaccacatcgccatacacgttcataacgtcgatcaccttgatcttgtatggaggtaaataccgattaattcttagtaactgcctgacctgatccacaagttgaccatgacgcatttttttttagcgtcctacggattatgtatagaactatatcgtgtatatagcaaaatctatatatagagacattatataatatacatttgtatgatgtaatgcaaaataaccaaaagcgtgtggtccaaaggtttgttcaaaagaagggtatggagtaaagtaaatgattaatcttatggatccgtgtcaattatcaaattccgttatccccgaaaattgttatagttttcttttaaaactatttgaaatgatctaattaacacaaatattaagttatatatatatatatatatatatatatatatttcgatatttagtttcaatatcagtatagatctactctagttatgacagcaaactgttgtgattgcacttgttaaaattaagaaaagataaaagcgactcttgagcatcaagtaaggacaattaacatcctcgacaagcaaaacaacgaccaagtcaatataatcatagctaaattctaattgtatcacctaacaaaacaaaaacgttttattgtatttttatgagttttgaaaattacggctatagcgtgaaaggtgagacgtttgtctttagtctttacatgtcaatttacgaaatgacgactgaaatcaaattattctacgtgttttgatgtgcatggcgtttagcttattgtttttttcgatatgcgataatagttttaagtctaccagttttatataataaaatggctattatatttatatctactgtatatgatatttacaccaattttagcaacatgcttcttgactccgactataagtaattgagatggacccaaaacaattataatagtgaggcccatacaaggcccaaagtgaactgaataactaagatacagttatctccgcgccaacacaaaacgacggtaaattactacttgcctgagaaaattttgcccccttttgcttcaatttgttgtttccttaaacccttcaaagcaaaattagggtttctcttggttttcgcaaattagggattttttctctcgttctcatgaaaag

SEQ ID NO: 3431 - DNA, 2000 bp, Arabidopsis thaliana
tataacaatctttatagtccaaaaagaagtttctaacttttgcatgtagcgttcaaaggtttattcgttgctgcccaccgaaaactcaattaattcttctcttcgtaaaccttagtgatgtaataactaacctttcgtataacaacgactctaccttaacatttttcgtaatatcaatcaaacttagctcgtggtctcgtggataccttttgtggttcaaatacgattctaacactgaatgtagtgttgcaatatttaaacattatgttttcactgataccgttgtacgcagtggactatcccaatacccgtttctcttttgacatctaaaagttataatttttactcattcaaaacaattcatgttcgaccaccgtctttcagtcctagttgtccgttgacatttcttaattcctagacacaatcaatttatgtctataagtgtagttaggttggatgacaataaactcacaagaaattaagagtagcaaatagaaagaaaaaatgattgcttgtctaatttttaaatgcaatcggatataatgttacctctcattaagttgttacaggaggataattttcttgtaacatgttacttttatgtaggaatcaaaatttataggtgtgtaaaattttgaatacatgattaatttttgatagaacactatatgatcaattaaatctccagaaaaaaattaggacaattctcaaaactatcacacttaggttttcgttttccaaaaatatcatttaagttttggtttttcaaaaatacaacaagactaaaactaaactttcaactttcaaaactaaaccataaatctcaaacctcaaatcctatctcctataataactctatcgtaaatctaaaatagttacctgaacgggcaaaattaagaatataaattctgaataaaaactaaagcttgaaagtatagtaggttgaggaatttctcaaaaaaaataacatgttatgaaattttttcattattctactaaaacttaaataaatataaaattatactattcctataaaagtttaataaatgataaaattagaactatgaaatgttcattttgttttatttccatttactaaatttgttttttttgttttattattatctacttaaaacatttctccatatatggtcatctacatataatgcacaacaaaatatggtcatctacaatattataatctatataaaatactgaaatcaattaaacattttattcattttccaaatatggtcatctacaataatatcatattataatataaaatattcattttccaaaggagtagatttgaatttagtaattttagccaaagaaaataagtgatggagaaaaatctcaatctctctctccgttgacgttggcggctaagttattagctgtttgcataaatatatgtatgtatagattgtttacatacacatctctttctctgtgtcaatgcagtgtttcttcggtcaaatgataccaatctgaaacaaagaaaataataatccaatctacttttatttttgcgtacatctctctccatcttccattaaagtcttaccctttcttcatcacttgctcttgaaattttctctcccaaaaaaggtcaaattccccacttgattccacttcccctttcatgggtttgcgtttgaattgtgtttaaagactttatatttgatcatcagattcaaattcttcatcaagatcgttgttttctctgaaagttgttgcctttttgctatggaggtattagggttctacagtgtatgaattggattcttcagctgttgttgttgatgggttcagttttctttcttgattgagtttgaatttgacatcaaagttttgttttttgctttgtgtgtattcagggatggtgttgggtctcgctgagccattaaagttgttgtctttgttatggatgaattagggattaggattttgagctgttgttgttgttgattcttctctatcgaaaagaagttgtt

SEQ ID NO: 3432 - DNA, 2000 bp, Arabidopsis thaliana
tgtaggaataatttttttttccggagaagctgatcaccgttgtgatagagagacttgccaatcatatgtaagcatatggtctcatcaatatcataaattaataaatttataaatttatcagaatatattatgtatatgtaagaaaagttagtgaaatatgattctagtattgtttgtttttcttaaataatattaagttttgatcaaatattcatttttaatatgtttactgtataaaaaaaagttgtgctttttttaaaaaaagagaatatgttcttttacttgtatttgtatctaaaaagatgttggttatgacaaataaaacttcttttcatataggaaagttaaaaaaaattacaaattaaccaaatctctctataaattaataattcaacaaattaatatctctataaattaataaaatttcacgttcccgacattattaatttatagaagttttactgtattcctttgtgaatttccttttcataatttaaaactaagttggcaaccttttcatatcataaataagtaaattatttcaaactatttttctggatttttaatctgttcattggagtcatatcaagtcttgcttcgtatgatttgttcttcctactcataagagctttgtagacatacttagatttactagactatgaattgtgcaaattttgtaatgattaattttaatcatcttattactttctcgattcaagatgaattacggacaaagatgaatgtctgaacctttagcgttcaatcttttatttcttatcttttcttagtgatgcatataatgctaaaagaaaaagatgttagcaaaggagagacttttggattatgtatgataatggaaaaaatgtcacatggattcatcacagtgaaaatgatgaagatgaaagtatgactcaaaaggattgagtagttaaaaatttgagaatgaccagggagaaaggaagaaaatcaaggaggaaaatattttagtaaatttagatgattacatttgagtttttttttttttgtcacaagtgtgttttattgatattatagagccaaaagtaacaggccaataattcacaaagactaaaataaacaagcccaaagaaaaaaaaaaaaaacagcccaaaagcccaaatgaataaaccctaaactgaaggaagagaacaaatgattgttgtgcgccgcatagaaaacacgtgtcagtgggaaacattttgaaggacacataggaactggaagagaagggagtcgccgtcagaagcttcaattccggccgaaacaccggaaaacttgtttaattggcatagctcactcgtcgctcaaaagattaatggcgaaatttcagttgtagcttggacgagaatttgactccacgaagtgcaaatcttcttcttcttctttttctttttcttcctcttcttcttcaatcaacatctttttaactcttagggttcatcaatctttgaactacaagcagaagataaaaaaaaaacaaatcaaatctaaatccggtcaaaaaaccggagaaaaaaccggctaaagacgccggagaaaagcccgacgaaacaagaaagagggtatcttgctctcgggagataagccagccaccaccgctaaaagtagccggtcgatgccggaagctgagccagccaacgcttctaaggaagccagcgatgccggagtagaagccgaccaaacactgctgataaagccagtcattgctggccaaaaaagctgaaactctctgaaagatgaggagagagaagagagagaaaaccctatcaacgtgaaaataattacatttgagtttatatactcaaaacttggaagtaaaggtaaattaaaatatgattgttagaaacaattacaccaataataaaacgacacgtgtacactacgtagacgttagataaccacagcaaaaggatatgtattctcgaggcgggagagagaaagagaagagagtgagagagatcgaagaacatttacacacatca

SEQ ID NO: 3433 - DNA, 2000 bp, Arabidopsis thaliana
ttccttttattattggtgtggtattgtaacactttttcttcttttataattggtgtctcgtgattttcatttcacacagttaataatactttcccacatttatctttaatgtcacacattgtgattaattctctagatgaacaacacaataaatgagctgtagagttatgggcaaaaaaataaataaattttggttggtgagataaacttattttgtaaaaatcacttgtttcctatttattttgaacgtgtgtttgtatatttttctctctctctcttcaacatccatcttcgaccatcaatgtcaatttctctcttatgctccctagaatttctgtcatacgcagcccttgggccattaccatctcgacaaacttcgttatcaatgataatttaccaaccttaacaaaatcaaacaaataattcaattaaggtgacatatattaaaaaactacaatgtctaaaaaaaggagaaaagaaaaaactacgatgtcaaagaaaaaataatagaaagaatggataaattacacttcatcaccgatgacaaaaaccagtaaattgattgtactagaaagatcttacgaaacactataaattaaaaagatcttacaaacaaactagagagaaaaaaaaatctctagatctaaaagcatctccaacagaccctcaaaccctcaaatttgaggggtttttaactctaactccaacaacccttcaaaccctcatggcactattcacaccctcaaaatatttctcttatttcattttagtctttgtactttatattccttacaaataattctattaaagtcaactatttcaaatatattcatataaatttaaataaatgaaaattatttaaatataaaaaacaaatacaacaataatagtacactgagcatttcaacacaaattaaaattaacattacaatgataaataaatacataaacacacaaaataaattaacacttgaaaaaattacattaaaacataactaataaaaaattaaattcgtaatgcaatattaatattcaggtaaatttgatcctgaacctccaagatcaccaaaatattgtccataaacatttgatggaatcggaggttgttgttgttcttgatttcttttttgtatgattcttgcttgttcagatcgtataaattcacatgtattactatcatcaatatcgcttaaacgtgttagcaatattttattttccttccctatttcttttagagctaatttttttgcttgattttgcatacgcaattgagccatctcataatccttgcttctagttgatgcactttctttcaaaaaatcaagagagacatctcataacaagaagcatgccgaaaagatgttgaacgtgcgtttggagtcttacaatcgaagtttgctatcatagcatgatcgtcatgttactggaacaaagaagtattgcatgatataatgacagcttgcattataatgcataacataataattgaggatgaacatgatatcaatgcactgattagagattcaagattgatgccaccgccaacagttgaaacggggttaaatgaacagacaagatttcaacaatttttatcttataatctacagataaaaaataaagagactaatttatcactttgaaatgcattgagtgatcatatatgggagcattttggaaatatttatatagagtaattttgtaattttataaatcattttatgtttttttttatgttttttttttaatttatatataatattatattattatatggagttttttttttaaatcttgtttggcataattgtttctataatatatgtgttatatttatttgtgaaagttttatcactataactgattattgttaaaaattgaggattataatgtaaatacttcaaaaaattaaaataaatttgtgggtataccattggagtaagtgaccctcaaatcttcattttgagggtgtgccccctttaaaatgagggccattgttggag

SEQ ID NO: 3434 - DNA, 2000 bp, Arabidopsis thaliana
tagtatttgtttttatcttgccatattttagtgatttttcatagtagtaaatatatcactttgaccacatttaaagttgatgtatgtccccttcgcatttgtcatgtcggttaggcattatatgtctccttttttcctgatcatatgctcctatcaatttctacaaactcatgaaaacgattactagctatataaatcaagcatagggttcataacatgcaactttaattccccacaattatcgcaaataaaattgtatataaagggtttatcgtaattatcataatgttaacattttcataatatagatacttttggtttgaccatcttttccttaatataagttaataaattaagatgctcttttacttgcaaacagaaagttctaatgtgaaaaagaaattgttattgcgtaatcatgatctcacttatccgtcagcataagtaacgatccactccacatagctacgtcacttaaagtcccatagtaactaattttctttgaatgttatagcaaattattagcaatgtatgattctttgggtcaaatcttacactaaaaacatgaaaataatttgaatatcaagagattcatatattcatattttataaccaaaatatgtagggtctaaattattgcttcttgactaggaattacctatgaataattattaaggttcgtgaaacagtgagggaaaaagaagaagaagaagagaagacagtctctagcacgtgccaggtcatgtgtcggcgacggtcaaatgccggtgcaagtgtttccacgtggcagcctaatactcccaaaatataatcttttgttttcgtaaacttttttccctttgaatctttgactgcctcttactgcattcttcacaccaaacgaccggccggtgactgagtgtttccggtttccggtaacacatagttttcgctgactaagactccttcaataacgtcgtcttcttccacgcgccgtttagtcgtagcgcgtgttatcaagcccgtccactatatatgccacgtatagagtggggaagaaaatgaaggtgagaacttttcatgtcctactttttggccccataaaaaaggcagcacacaaaaataacccaaaatttatgcatgtttatcaaatgtggaaaaataaaagtagaattttaggaaatttatacgaagatacaatgcaaagactcgaagaaatgtatttagtggtatagaaatacttgcaagtaagcatattctgaattaaaaatatagaagcttaagtatgtttcctcactagaagccagttttgcagctctatttttgtcaacttagctttacgtaaagttcttattgcccgaaaccaaaaagtcattcaaaaggcataacatgatatcacaaataaaattatcatctacttctatatcttatttcttgaatatatatatatatatatatacctatctattaagttgcttatcgttcacattattaatttataattaactttatgtacatttgactgataaacattaaaaagacttatttgaacctttttgtatatgaattcaaaattatactgataaaataacgtgaggaagaaatattatgaaagcttttaacatataaattaatttgcataggaaaaaattacacaacttaaattgagattagttaagaaacaagaaaaaacaaagttgatagaaaaataaaagtattaacacgactttggattcacacacgtaccattgaattatatctcaatacacttttacttaattaacttatttccaaaccaagtagccaaaatcatattattcttctctctcttccttttttgagtttcaaaatgcataaatacgagaacgagagacgaagaccaaattaaagtccaagcaccaatctagacctcttaggaaaaaaacctaaaaacctaatccccaaacctaaaaggcttatctcatctcttcttctttgtcttctttactctttttttacctctctcttcattgttcttcacc

SEQ ID NO: 3435 - DNA, 2000 bp, Arabidopsis thaliana
ttttttttggttgaagtttggttgcgtagagtggtttaagttttggttcgatggaacttgaacgtttttgtgatttgaattaggtgggcttcttttgagttgttttgcttcattcaggctgtcgataatgacttggaatcgatcttagaatgtaaggtggatatgtagtccaacattgaattgtgtttatggttaaaaagtaaagaatgattatttattaattatatacagtcaaattagagagtcttaagccgagatcaatacattatccaacgaaatttcaaatgagtttattttcttaactaatagtctatattcttgcaacttctttttgataaccaaataaaatgtgtaaccattctacaaatgattttcatatagagatttgagtttagaaaagaataagcaagaagaagattcaagtagcctttgtgtcgagaagaaggttcaaggagctctctttgtgggctatagaactgttgtttaagaaagaaggtgactcatttaatgtttggttcttggggttcacagagcattgttcactgaagagagatgtgatactagagagattcttagtgagcattgacagaaataatagtagtactaattaagtttttttttgtttgatgaatcttgtatgcatcggtataatatgagtggatatgcaaatgttaaaaaaaataaaatgaatggatctatatatgttgaaaatcaccctatgatccataacaacgataaatacgcatccataatgttataaatgtaaaggtaaacatcatgatcaaaaaagttcgacaacttgggccaatgaatttccagttgcttccgcgtatatatataagtccttccacgtcaatttcttaatcccaaaatgcaaacctttttataacaaccaaataaaaatgtgccacttgtaattaaatataaattactccataagcaataatattcatcgttttaatagtatgctctagaacacagcacacaaagatttgttttgaccagaacatgttttttttcttataccggaaacggtaacgtgataataaaattaggttaataataatatagatactaagatgactagattattagcaagaaattgtattcagttgttatccgtctttcttagttgacaagcaaatatatcagctacacgttggctacaggttactcatccttacccattcattattcgctcattataacaatttcccactgatatattcaaatacaaaatatataagacacaaaatagaattaatttattgctatttgcagacgatgtaaacatttttgtagacatgaacaatttaattgattctttactcatcgtagacatgaatttatatttcaaaagggtctactatttctaaataatattcaaacattgactctgtaaatcacatataaataaatatatatattatacactacattaatataatatctcctatttcaaaaagaaataaaagtagctgttgaatttagatatttttttgttggaccgaatcagaatttaagtttttgaattgttccagaagaaagatattttagtataatatacggcaatgacgtttatgtttgggccaaaactttgtctatttattgagaaaaataaagctaaatggagaagaataacaaaaataaacaacgcgttgaaaaaaactgcaaaaaaaaagagaagggggagggcgaaattaaaacaaaacgacgcgtagtctacgtagccttctaagaaacggcacaagtacaagtcatctctatcaatattcttcttcttcttcctcacgcggttttcttttaccaccaccaactcaacacacacacgaatcccttaaaaccgatcagatcaaacaaaaacgaacgaatcaaaattcaataaaaaaaaacctttcgatttctctcatccaatcgaatcgaaaatcttgttatctctttctctctaactctactgcactcagaatctctctgtatagaaaaaccctaagtaggttgtg

SEQ ID NO: 3436 - DNA, 2000 bp, Arabidopsis thaliana
attccatagacctctaaaaatagcattatttgacttactatgaagtttttgttctaaaagtattatcactaatttattttttcaataatatcacaatttttatataaaacctattaaaccaaaataaattagaaataaatttaaaatattatatttgggttctgtatttccaatttatggtatatatttcaaccatttaaaagaaattttgatcattttaatattactttatggcattatatttgggttccctatttctaatttaggatatatattttcactgtttaaaagagatttttcattttaatattagtttgtggtattatatttgagttctctatttccaatttagggtatatatttccactattttaaaaaaatgtgattcaatttaatattagtgtttgctctcatttttatttgggagattgacacaaatgacacttaaaaactttattatttaattaatttttagaagattaaaaactttatgtgctatttttgaaagtttaaaaaaaaagtgtcatttttggaataataaaatttttaatgtcatttgtgtcaatttcacaaaaattaaaaacttttataccaacatacaaacgaagtcattttgagtagacacctcatcatgcatgtgttagctgactcaacaacctattaattacacaaaatttcaaatcgaaaactatactatacagattgtatgagcataaaaatattaattcaagacgaagtcattaaaatatcgaaaactatactatacagattgtatgagcataaaaatattatatttttatcagaaagaattatctacagtaaaaacgtatatataatagtttttataatcatatatatgaaagttgaccaactctctccatatgattgatatatcatcactttaacatttgccatgtgtccactgaataattaatgtaagctcttcaacttttaatttctagattaatgatgtatttattatttaattttactaatacataatttattttgttattatatgttcttcaataaaattattttattggttttctcatattcgaagaattttttctgtaatcttaactcaaattatgagtgtatagtagtcatggattagttaatagtttgaatagtttgcatattgttatatatctatatagtaaatcgccaagggtgaagagtatgtaagaagtttaatcatcaaattcttaggtttcgagaatttcaatattaccttctatttaattagtttaagacgaacattgtttaggaattgtgtgtataatgcattgttgaaaatgttgttaggaaaaaatattttaatactaaaaataattacttattacataagtaaatgattatataattaaaaattatatttaaattaaacgatacaaaaaatttgaaaatatcccagcgtagcgcgggtgattacctagtttgtaataaataataattcaagacgttagaaaaagagaggataattcactgctcttctatacactatttgttcatatttaaattctttattcttttcatatcattggtagtttatatatatattatgtagttatttaatccttgtttgattgtttctatgtatcgaccaaaaaaatatacaaagttgaatcttaaaatattgttttcatattaatattctaaactttggtaaagttgtaagttataaaacaacttgaacataaaaataatgattgaaattaatgagagaacacaaaatagaaaaaaaaaggtcatgagaacagaacagaaacacttttgtggctttcgtgggctaaagacgtgcacgcagacacaaccctacacatctctccctctctcaccaactctttctctttacccactgcacctacccccaaacaatcccttttaacatctctcattcctctgctcatgattctttgtctcttcctctgatttctcaatcctctgttttctccgtctcctctgtttttttcacatcaatggaagcgtcattgttg

SEQ ID NO: 3437 - DNA, 453 bp, Arabidopsis thaliana
ctcaaacgtcctgagaaaaagtcccgattttggaggaatctcaccggtgacggtaatgagtttaaggtgacgatgaaccctcttcttctacaagaaggtctcatttgggcctattgtttataaactaaagcccattatattccttatcataaataaatgtaggcccattaaaagcttctttgtcgtcttctctgtttcgtctgcccgtcaaattttgaaaacacaagtttagatttgcttgtaagaactaagaagaatcgcattcacacagtgacgctctctctcactcacttgcaaaaaaacattcccttttctcttaagataacataaagttctcttactcacctttttccttcgtctgtcgaatcatattcttggctgctaagttttgcttttgaattttcaacgactctgttcactcacatatctctcttagtgtctactggattcgga

SEQ ID NO: 3438 - DNA, 286 bp, Arabidopsis thaliana
tttgtgatgctttttgcttcttgtataagttatacaccatttctgtctctctcctttatcattgggcctcaaatagatgatgcaggaatatagggaggaggaggaagaggaatttgaaggatcattcaaagtgtcatccttgagtttatttagggtttttgtctgtgtttgttacaaacacaccacccacattttctatgcccttttttaatgttattttcacaatccatgacttaaaaggccaacactaatcctttgtctcttatttcattgtgaactcacaaag

SEQ ID NO: 3439 - DNA, 2000 bp, Arabidopsis thaliana
cttctttctcttaagtttccaaaatacttaagagaataactgaatatagtcacagtcaaatatgttaatgtttgattcagattctttaatttaaaactaaacctagggacacttatcttaacctagggacacattaattttgaaaaacgtgttctaaggttagctaaggagagggccatgcagatatatatgcgccaaatgaatcataagcggtgggcatatttatgtctgtcctttttatggcttatgaaacaaagttaaagctatatattgtgcatgaaacttaggctacgtttcccctctattttccattcattttgaactcaacatttgcaagtgttaaccacacttcttctaactgttgtgattcgtttattctagccatttcacagattgaggctagtataagtattctagagtacattatatgaatacgtctcaaacttttactgtataaacaaaacagttttccaaccgcgaacagaggttggattagagcaactcatggaaaagataaatcggagatgaaaaaagttgtcacagtggtcaatccacaatgatatgagagtaggacaagtaggttcattcccgtataattatataatacaatatgttatagtagcccaaacattataggaggtggagctaaaacaaaacaaaaattagcgagaggagatctccaattgacaataattgaatcaaccaaaacctaacctaacataaaaacaatatcttggattcaaatccaaagcttggaacgtaacgtaacatgaagccacagaaagccaacaacatcctagtatataggttgggtcccttccagcatttgtatcatctttattaatgatcattaggtatgttcatagtcggtataaatatatagggtccgcacaaactggtacacttttttaatggcaaacatagtggtacgaattgatagtaattaagtgtgttttggtcaatagctagtttttttggggttttcaaagattatatatccgtgaccatgagttctctagttcaactctcactcacgagaaagacaaatgaaagaacatactgtactagtttttgtctaaaagtactctttgattaacctttagaaaattgatgttatcattaaacaaaaaaaatagtttcactatctcttcctataaccttttttacgggctcattgaataattacatatcttttagtacattttgtaccaagacgatataacattaccaatcatcttgaattagccagaaacaacaaactaaaactgtttaagtttcagaaactaatccatatataatgttgagattagttagtattcataacctatggagtattaatcttcaaaattttcctcatgaaatctgtatttagtcatcacttttttaacacagatgaatcactagtccaatatttctccaaaaaaagacacaagagtctcgaaattgtaatccatatctgtaattttgcacccctataatatgcctagaggaaataagaagaaaaaataatggggaaaaagagaagctactgctacactttcaggcacgtgacaacgtctcacacgtgtcatatatcttacgtcatcaagtcctctttttctctctttcacttttctgtttacctctctcacgcgttgaaaagtgcaatcaatcttacataattaaccacagtaagaaaaaaaaaaaatggtctctgtaacgtctttttactgttataaccttacacgcataaatacccctcaccaactctctctgtctcgcctctctctaaaactccaacacttctccttcttccatctctctcaaacttctgaaaatcttcttcttcttctcaatcataaaccctaaatcttcatctcttcagatcagaaactaatgtccattcaaagacaccctgtcctgtttcatctctgtcattagtcttctgttttcagattccaattttttttcttgaattatcctcttagccatttcttgatttaacttcgattttcccggcg

SEQ ID NO: 3440 - DNA, 1732 bp, Arabidopsis thaliana
caccggcgttcatgcaacaaacttatcgccgtcgggagaaaatcaacggccagatccaaacgagagagagagagaagaaagagagaggtttatggatgagtgacaatggtttgtttggagcgttgtgagtttgttttggagagtaggggccacgaatgccatccacagttattataaacgacccaggtggcgcgtgcttctcaccgcactagtgggggcattcacggtatttgttctgttggagccaatggcggagcctctcggatcaacggctaattcacagattagtaactttttaattaacttaattgtctttctttaatggaaactattattatctaactctggaatattccaaaaagtttaccttataaatttgggagacaaaacctttaaaaatatttgttcatgaatcatactaatacagaaggaaaaaagttggaggttggtaatcattaatgattaatatataggtcacgtgatataaggggttattttgattatcaataaataaggtcatcgaacagctagcgataagctgtgttgatcaagagtatggataagcggccacgggatgataagcgggaaaagtgactattcgctgagaatttatgtgttttgatcggagaaattagacaactcgtaatctcaaaagttttcattaagataacagcattcatttctatggttttgagatcaatctgatttcaaaagacaatcttctacactgtctttaatgtcctttcgagttagggattgctatctctgtatgtataatcaagtggtgcagtgcgtgtgtgtttgtctctctttatctggtgttgtatccattttaggatggactgtaggctaaatctgaattgaatcaatgtccttttgtttgcagatataatccattgcacatgcacacatcaccagttgtttttccttgttgtatcaagcacatgatacttaaagggaataacatgaaaggtacatagtttgtctcatcactttctcagtttccgattcatgtatctttcattcgttcctcttttgatgtagccaatttcaatgctctattgatttgcattatcatccaacttttacaaaaaaaataaggatgagttgagagtacaatgaagttgtgccgatccaaaggaactagtcatgaaatgatgatggtgaatagctaaatgattcattgttgttgcatgtacaaatgatcccaacaacgttattaataagtttataactgcaggattgtgaaaatcttaataagcatcaaaatctattaggctcatagtatagtagcaaagcttgttgtttaagagtaagtttcaaaattatgctggaatatagtttgaataacttcattggcatgtggttttcagagtgaagaagaatgatggagtagtttcggagaagatggaggacttttggggttgcattgtcatggaatatgattcaagcaattgcaggagatgatcaaaagtctttgagctttggtccttgcttcaccaagaacaagactttttttagttttcttcaaaagcttagcaaaagtcaaaaacctaagctgattttgtgtgtttttaatctcatattcattgcatattttttgttatggatggaatattttagttagctgataatattaaccaaatataataattattttaaatatcgaaaattatatgaggttcttgttgttgttgttggtcttttcgactttctgcttaaacccagaaaa

SEQ ID NO: 3441 - DNA, 2000 bp, Arabidopsis thaliana
tacaccgttgaagactccatgttcatgatagactacacaacttttattggaggagtttgacaacatgctaagcatttgctagccatgtaaatggcaacatttagatataaagtccatgataaaagcgtttttgttacttgtaagcaacattgcttttgaaaggcaaacccaagaataaaggagtaaagattaatgcttgacgtgaagaattttcaacatacaaggtcaagaaacggttcaagtccccctaggagggacttgagcattttaatagggactttcaattcaagctaaatgattagattacaaaccatgaatggggagtatgtatcacactggaagctttatctttagacttcaggtacactaaaccttgaaaactaagaaaattgattttaaagtacattttggtttcagccatcagccatgacggggaaaaatgaaaaaaacacaaatcataattcccaatgatacgtgaaatagtagaacatgaaggttgtgattggtgtgtagatatatagagttaaaaaaagttgacaagtaaaaaagtaaagttagcgcgaaattttttctcatgttttaaaagtaggtgaaacgtttcgttttattgtttttgactttttccctattttaagagtaaatgagttgaaaaatattttcagctattattattctgattggctaaattttggtgggaatgggtagaattttttcttttgctttttttttcttttgcgctatttgtgaaacagccaaaattaacaaagcaaaaacttaaaaatcaatcaaaagaatttaaagccttaatgccgagattcgagacaagggccacttgccttagggagttacttcaaccatttacagcaataacattatctacataacaataactttgcaagttgtaattgtaagagagtagagccacttgaaaaaatcagttattgcattatggagttacatgataggatttgaccagacacaacagcaaaagcaaaaatggatttttaaattattttctatgaaaaaattcaatttcacaatttatattgattcgattacgaaatattgttgtttgcttgttcacgttgtcgaaggcatggtataacggaatactaataaaatagaatagaccaacttggtcaaatactaaaaagaaagcctcgttgacgcagaaacgaaaaaaatgaataaaaagaacacaaaaagtaaacaaaaattactcgtccaattatttgctagaatttgataccaatctctgtattatttccgattgttttggttctattcgaagatcgtataatatgaattattcgtggacactcacacactcatctcgactatttagggagataagatttgtgagaccagcgtatttagataatttaaaatacatttatttgtttggaaccaatacatattcgctttttaatatttgtgatttcctttgcttctacctgattttatattttaacaattgctgccttggctcgtgtggtctgcgaatgcactaagagtacaacgtgtgacgtgtacaatgttcgagcaaggcacaggtagagagataaatatagaccacaaaaccaaagcaaaaaaaaaaaaaatcaagaatggctttgtaccataagcttagttttcaaaacggtatatcatgcgaacctcccaaactttaaccagccaatacaaacgaattctcaccgagttaaaacttgaccattaactttgagtgaaggctgaagcatataaaaactggcaaatagaatctaacatcaataatgttgcaatttgttttttcccatgtcatttggtcccacttccttagtatatttaaaccacacactcaacatcgcaccacacacttcactcacaatttcttatataagaccattttggcatacccgcttcttggcaaaccaagtaacaaaaaccaaaacatttgtattataagagtatttttattgatactatttttaaattgtgcccatacatattacctataggga

SEQ ID NO: 3442 - DNA, 1665 bp, Arabidopsis thaliana
gattaatgagagagagaaagatttttaactttagtttttatgatttttattttgatgaccatctttaggtcacgtttggaaaatatctgaacgttttttttcccgaaatagataaaagaaacatacttgattacattggtattttgtttttaagagtttcagatcatatagagattttcgtttcaagatgatcattataatttgtccattgttaggtttttctttttggttatgattttttccaatattgttttttttcttctgtttttatgtttgttttctgtaaatgcaaaatagctaattattgctaatattgctgctggatgtttagagagtacacttactctaaaaacttaaatatgtttcttcatgacattttttctataaaactcgagttactcgtatgaaatgatggttcaacgttagtaaagtgaaaattcagttagtattagtcatcaacgagtagccttgtgatatgggtaagctacaaaaagatttgttgacaattgtataatgtatacttgtttaccaatattcactcacaatgaacgaagatgatatcgtaaagttaaaggtcagcaaaagctaagagagagagttaaagtgaaaaaagggagagaaacatgaagaagaagacaggacaagaaaagagattggatatagaattttataaacgctttaggggtcgaggccttatttaagttccttcgacgtctaaagttggaacatccaatgctaatttagtaaaaaggctacacgaaaactccttaagcttcttcctttttcttatggatcttcaaaatctttttttcttttttttttcctcactaatttttgtttctttcttttgttgccgttatgttcgtttcgtctatgttactctctttcttttatgtagctttcggttttgttgacctgtctcctaatttgttaattaattgaccatttattgttattatgattccagcttgaatgaaacgttatggttttctcattcaccaaagaaaaaatatgggaaatagattaaatttcttgagacggagttttgctgcacacattcttcaattaaattatacaaaaacttggtttttcatggaagaccaaagaattattttgctaccgatatgcaacaccaaatatcagtggttatatagtcaatattttgcatagaacttcaacaaattaaacaagtaaaatttcgcaaattcgtatacatgattgaatatcggtcctccgtctgccacagaagatatcgtttgtattattagatccgaaccaaattgattttgataatgcatataaccaaagttgtaatttgtctgttacttagctatacgttacgtatcatgtcttattaaacaagatagctttgggcctgtatcagatacaaatgttttaagtttcaattggatcaatatattgggccattaaattatttttagcaaataggcccaattggttaatatgttgtagggttttgtcttttgtcgtttcatatataaagttccattttttccaaaaatcgttgtgtagcagcggctgcttctccattgcagaggtatgagaatctgatcaaacgctctcatcttcgttaccgttgtttagatttcaaaatcgatttcttaacttagtctctgtgaatcttttgagtaattgcaggtaaaa

SEQ ID NO: 3443 - DNA, 2000 bp, Arabidopsis thaliana
cacatgtcattttcttgtgtgatgacgtgtcattcatatagagagagttggccaactttcatatatatgattatttatctttttgttgtcatattttttatattgttaactaaaatttccaaaataattgaaaatcttccattttaaaatttagtcgtagtcgaatcattggcacaacattgtttagaagtgatacaatagcttcgggaaaaatattttcattatcgacatgaaattctattcgttcatcataataagaagagtataatcatgaagtaatttgatcgatataccaaatcttagactgttactagagtgtaataattgtgtatttgaattctaaaagactaaaactcttgctagtaaatcaaacttataaaataaaattgctttgtttactacaatttatattttatacagtaaactatgcatatacaaggttattttaaaaaggctcgaaaacaaaactatgttcattttgttaatgttttgtaacaaaactactagttttgctctaataaaaatgggtaaccttgttaaataaaaaataaaaaaaaatgggtaacccttaaaaaataactatgtacttttttatatgagttaattgtccaggaaaccacaaaaacttgaaaaaatatagatttaggtactttcgcaatgacttacgaatttgaggacttttgctaagatgagattacttctttgcccttagtgaatcgtttggataaattgattatctttattattttctctgttgcagacaaaacctcacgtttatgtcgtttcttcaatttcatcgtcattgttactctatcgtcttcgaactagtgaacgagctaattgcagactaaaacggagagctctgtttataattccagactaaaacgaactggcgaatcttagccaaaaaatttcccagatctatcattcaaaggtcagttctactactcgatttgattttagttcttactggtcacataacaattatattgaacaagaacaatgtcacagatccagatctatcatctccacaaagcaacaattgcaaaagagtacagaggaagcgatagatgacatcaaaacactaacatctcgacgaggaaacgcagcgcctctgtctcctgcgaagctcatcttcttcttctcttctctatcacaaaattgatttgatgaaagtctatgattagaatccatgggttccatatacattatcttagggtttagatttttttatgaaaactcctttaactggattcattcaattgattggaattcaattgttaaattcaatttcaaaccgaaattattatcttgtcttcactattacgaatcgaaacggaagatccaccaaatattttgtttggattctctaaattttaatgattaaaatggatttacagtttctggaaaaaaaaaaaagagaagaaagaagaagaacgatgaagaagaagaagcatgaagaagaagaaaaactcaagggcaaattcgtcaattcaaatacatgaaaatacctattcttgtaagtcaaatagacaagtgcctaatttcaaattttttgtctaaaaagatcctattttagcaataacccctttttatattgttttgaaaatggaataatagcacctacctaatttaattctattagtttctgtttgggccagaaaaaggtcgtgaccactgactgactaaagtgactactcgtccgttttggctttcgaagaagtgaattgggcttttgaccttttttgcccaagaatcaagaatggacctagttcttccggacactacaagaaagaaagcttctagtgttcattttgtttggaaaataaggatagcacagagacacgtggcaaaaacccatttgctataaattcatattttggataaggaactggatcatccccaacttttaaaacacaatccatcaccaagtcatcagataaacaagaaacagagagagataaagagatcacacgtgggaatccaacttaccaattgca

SEQ ID NO: 3444 - DNA, 2000 bp, Arabidopsis thaliana
atacgaaacacatcgtgatagtgagctatatatataatttagatgttaatttgatgatatatacatatatctccattttcttccctattgatgtgttatttgttattatttactcctccaatgtaatttattagaaataaagcgtatgtaaatacgaaacacaaattagtcagttttccgtcgtccaaaatacaatgtcaattaaaaaaaaattatagaaaaaaagtaaagacactttaataatagttttatatattaacagaatgtttcaggtttactgcaaaataataaaaataggccacatagcgctcttgtttgttttcacagtttctagttctaccatttggtaaatctctaatataaaattttcaatattaattgttttaaaatcatatgaaccacgaggggacacgtgtcggatacaaagacaaccaattggatcagatctggtcttcgataggacaagtattcctgggaccagagagagagagagagagggacaagatcgccgttcaatagactctttcttcctattaatcacgtggtgaggtacttaccacgtgtttatattattggcttcttacgtgaaccaatctcatggtcctagttttcacatacatcgttttcctttgtgttgttgtttttctatatgacaataactttgtatctcttttatggtttatataatgtatatgcatgcaatgattaagttctcaatattacgattactctcttggaaacaaaaattctcgtataaactaaagatttgcaaacttcaaaagattatagaagaacaagttgtataaaagtgtttgtttgatcacttcaagagttggagtttttgtgattgtgaccattagagcatccacattggtgattctctagaaatgtctttacaataattattataaaaattaatattattctaattttgagtcatttattagttctgtatgatgtctttaaagatacaaaaatgtctctatagagatatgaaagacacaggtctcccactgtaccattttcttttttttttttctttttcttttaaaaatttaaagacactgttatttttttatgcaatagggatggtctcccactgtaccatttttttttttttttttaaaaaaaaaattaaagacactgttatttttatacaatggggatggtcttagatctccagaagatacggcgtattgaaaagtactgctgatctgtccaatgtaagggctgagttggaactaaccttcaatccactgagcgacatttgtcaatttcaaccaaaacaacaccaactggatgattatattgttttcttgttatttgattttcttgatgatatgtacaaaactataagtcttttttggtatcaatttagaccattagctaggacgcaacaatatgaaaccgtatcgctataagacattttaaacctagattttaatagttctactttcaaacaaatccgatagtttactcggcctcctatatcaaacaaatgaatcactatacaaggccacatagaaaaatcttatccctacgttatacaaatacaaattcacaatttttatttataataaaaaattcgcaatttgattagaacctttggttgttatttattgtacacataatattaaaatggtcaatcattgtctcgtcttgtagtttagcatatgtatggattacatagttttctgtctgttaccctctcacaagcataagcgtcgtctcgccaaaattagacactattcatatacacaaatatagatacgtatataaatatgtagacatttacaacttataaaagaaaattaaataaaaaacaaaagtcggcaaaccaatttgcatgaaataattataataattttttaaagaaataaccaaccaccaagaagtgctttgttaacagagaaagctctgtaagaaccttaaaaaggttctgttgcagaggttccgaccaaaagccagagtttcatctttatgtgaacaaagacagagag

SEQ ID NO: 3445 - DNA, 528 bp, Arabidopsis thaliana
acgatgcgctacgaaaatggcattagtctttgcttacaatttcactcctgttcagtatctatatgcagaaatagcaaatccaatcgcaactattttgacgatgcgcggtttttcccgtttgtgtttcctaattttgcattagcatatcctttcaacaatgtacaaacgtttaggaggatctaataacatcaataaacttatcacattcataactttatacacaagatttgaaagacaatgactgctacgttagtacgaggcacaacaccagtaagaagactagagacgattaaaaatccaagatgctcaaaaactagcacttttgctcacttttatgggccgtaatatgttgggtctgtatatatattgggtctcaattaaattatccataaaatcactactttaaccctaacaaaaattcagactattaaagcaaattctgatccgtctctttcgctagctaaaggtaaaaggcggaacaacaaaagaaaccctagcttccctttgtacctctctctgttccaaacc

SEQ ID NO: 3446 - DNA, 973 bp, Arabidopsis thaliana
gaacataggaagtttgaggtctatagagatttcatagacgatatctcaagaaatgacacgtgcattcactccctctcttttttttgttctttttcttttcacgagtttctatattctctaaattaatgtcacaaagataagataatatacagatttgtatcatagtgacttgtgcattaacgttaatgttacaaatgattttggttctgatgggtatcatgcatagattttcactaatctcagaaatatgtggaatcagtgagaatcaaaatttatgtttaatacgtctctcacttctcagattaatcaacaactatctattgatatatcatgcagaattttaagaaaatataagaaacatcgttaactctgttaaaatacaactacatattaacttattaagatgagtccaacttattaagctgaactaaatgtttgtattttagagaaattcaaaatttgtatctataaaaagttggttatttttgaagaattttgaaagagttgaaaacttataattatgcattagttcttcatttccataaaaatgttagataggaaaaagttgttaccaactttgtagatacggtaaaatcatagccgttcattggtagacggatcaaaagtaaccacgtcagctatccacgccaaaaactttttctctctttgccgcttcatgaacttatggcggataacaaaaagcgcaacagaaaattcgaatttttcaatatttcgaaaaagaaatttaaaatcactcgcgcattaaagtaaaatagatctgaaccatccattcaccaaaacccttcatcgaacagcactcatatctccacgtcacgcatccgcgtttcagtatcttaactaatcagatctcttcctattctcttatataaacaaacacacaattctcgaagataacagtatcaaatcaaaaccatcacagcaaaaaaaactcactccctagaaaagtttgaaa

SEQ ID NO: 3447 - DNA, 2000 bp, Arabidopsis thaliana
ccagagtccctacatatacttgtatctgtgcgaatttatagttgttacctaagctacaaaaaaaattgaagagatcttccgtaatatagatgaactaatttgatgtcccattatgtttctcgtaaaagaagaaatacatgtgtatttgacaagatggtacatagaccgctaaaccatcatgtcctaacaaagtagattggtatcatttgcaaaatatgtcacttaacattaatgttcttcattccttaataccagtctacttgatgagtctctcctctttttgatgagctagtctcgcactttttttcatctctaacttttgtattttatgaaatgttcatagactttattcaaggcacattactatcatatatctggatttaaattgccataccgtattcacgagacaatttatatgtaataacaatttaaaaaatgcattgtctgctcagaagctagcttgcccatattgtgtgttcttctaacaattttttattgtttcttctgagggtttttgcattaaatatgttattgttgacatcatagatgctagtggatatatcatcgacgacgaactcgagttgcttaataattatttccagtttcatacatcatcatcatattatagaacatatacctttatcatatgtatctcaaaaatctataatcagcttgatattaacttattctaaagttcaaatcagttttaacttttaagaaaatattatgagttttctaatttgattcggttttcgccgggttaacctgaaatcggaatctggattggacaaagtacaaaccgtgggttagtattagtaacatccaatttgggcttgcccgtatttgtctgctcagaagctagcttgcccatattatgtgttctccaaagaattgtttattgttattttggagagggtttttgcattaaatatgttcttgtgttgacattattgattattagatgctagtgatataccatcaccaaaattagaattgcattatcatcattttatatatcaatctatatatttatcatatgactcagactatcatgagacgcattttttttaagtattatgaataatataccacttgttcacgttttaacgtttgaaaaacatgattttgctactttttacgattcaaagtatttattaagaatttacgttcttgaaaagtgattatactgtatatataactataagtaaataaaacttttttcgacgaaatttctgatgataaataaaaggtcggatatatttgactttttttttttttttaattattttttgacgataaatttttcgttgaaaaatcatcgaaattttcgacggattccaatgatcaaaaattcgtcaataatttccaacgatattctgactaaactaaatctgatgaaatatttttgacggctttccaaccaaaatatttcgttgtgacttgtcaaaaatccgttagaatactaagcaacttttcgacagattttcagcaaaaatattcggtaatataacgtgttaaaaatatgataaaaaaaaaaacttgatgaatctactaaaactaaattttcaatcatatatatctattattcatatatttcattcattttattatttttctcttaacaattatttagttattctggtatcgtgtaattatattcatatgatttattctgatattgattcggttagcatccggataaatctgggttgggctttttaacttggtttttctaagaaaaattctaatatgatttggttagcatccggattagtctagtttggtaggcctgcctttgtgattcttaactcggtcttttgtatgggtttgaacaattactacaccatttagattcttctgacccatatcaaataaagatccacttaggcccattagggttagaacaaacatgaggttgcagaataaaaagggttcattttcctcactctcaagttggatctcaaaaccctaatatctgaacttcgccgtcgagagcatcc

SEQ ID NO: 3448 - DNA, 1668 bp, Arabidopsis thaliana
ttacatcatgacacatgggaatctggtataatttcacacaactaataatgaaatgcgcagcttagagcgaaagaacacaaagattgaacaactcagttgagaaattaggtattaaagttatagagaaattactcttctctggtaataattctgatgcgagggcgtccagggacccggcgaattagcacagaagtattttttggtattaacattgcttcatccagatattctgaaattgcaaaaaaaaaaataagtatgaaggccaccacatattgcaactataccaacagagaatcgtagttaagggtttctttctaatgattcacaaccacaaccaatcaagaacagtagtctcagaagtaatcacatttaacatataagctaatacagtacgcaagaacttcacttttattttttttattcaactaacaaggaagtaccaggtacataacatccattttactgaagcagttagatactgaacaatccatggccagattaacagtgctaaatgtgattacttcggaagaaagccataaaccatggaaattttgacaaagcaagtaataaccatatattttgataagtgaatactgatcacaatcagaccagaatccaacctagataacaacaaaacacattgcacaatatcttctaggtgaataggataagaaggaggaagacaaaccttcattagtttgggcattagagatgacaatgtcaaggtctttaccacttcccaaatgcttagtttcgtaaattttttctttgagtaaaccaactgttataaaaggaccatccatggagatggtatcataatccctcgcactcttaaacttgtaatatattgccattggaattaatctgataatgaataaaaatacaatctgtattactaatttattaaaacacaccagaatctactctctttgaaaaaaaccttaacccaggccaaaaaaatggaggccagaaagttgatttccaaaacaaaaacaaaaagtaattacaaaatatgattctttacttctctggttggacttcaacaaaattcgacagaagaaacctctcacgcgctcttcaagacgaaatcaaatcaacgagaatttcccacaaagctcagaaacgaaacgagaacgcccgtgttggattgaatcgaatacatcgcagggacaatgctcagatatctccaaacaattgaatcactggcttcaattcagaagctgaaactctccaagcttcgaatcgaggaaatagaatcgaaaccaccgcggtatccctgatgattcacggtgaaattgcagacgatctcgagagagaattagagaatctttggcgtttgatggatatatgaaggagaaaccgatggatatcgcagaaacacgaactctagggtttgaagaggaatagagaactatcgtaaccgaatccaaaagactcttcacctaattctcttgcgttttggctccttttacataaatttataatgggccatacagttcaattagagatgttttatgttgtagcgaaggcccaatacataaagctaacggaaaaaggcccaataagggctttctttgtctgatggaaaccctaattcccatggagccatctatttaaagcacaaacctaattcgaagaaagaagtgactgcgacgccggaaaatcgca

SEQ ID NO: 3449 - DNA, 443 bp, Arabidopsis thaliana
ggtttcgaccaacacccgagaaatcagggttttagatctgcggcggtggaagagcgagctctctcttggtttggttgggtttaaaaagaaatggtccgggaactttggtttagtaatttagaaatcgaaacagagcaacaaaagttgatatggccgagttggtctaaggcgccagattaaggttctggtccgaaagggcgtgggttcaaatcccactgtcaacaatttacttttttgtcttttggtggatgactcttcttaaaataaaaagagaatgtaaaccctccaattcgatgagaaggttcaaaaggatagcaaggtcagattatggtgttaatatataaaggagacattaagtggtaaccctagaaaccctttctctctcgcctattgttgccgttgcttgctatctttcgccgtcgtctctttagcttcttgcgaag

SEQ ID NO: 3450 - DNA, 2000 bp, Arabidopsis thaliana
gttcgttaagttaaaataaaagagaataaattaaaaatgttttcttttgtcgtcaaggaaaaattctcttctgttgacaaaaaatcaaaagtaaaaatattccactttccgaacttttttttcttttaattaaaattatacagtatgttactaaaattagtgatagtgattacaaaagataagaataacctttttttagtgctgtctgcttttttattttattattctctctattttaatattatttattacatattgctgtgtctactaatattagtgatcataaacattttcttatcatagaaatataatttcctgcggcatttgaaaaacatcgaccgatttcgtgtaatccacactacattcacgattaaaaaaaattatttttttaacatatgagaccactataaacaattatacatgtaaaccatacataatttcataatttgcatttctaggcttcagattttatatgaaaacattaaataaattattggataactacgagaattcgtcttatttctgtaattattttggataactacgaaaaacaatttaattgatatagccatataggttataccacatccactaactactagtatatgattctaattagtaagacgatccttctaaatatatgattccacctattttctccttttaagtttatgcttttacttgtttgaaactcctcaaccaaaccaaataagttagttatgaaaacttaattgcatagagattaacaaaattaaatacacatcgacgaaataaaataaaataactggagggacaagttatatggtccatgtgaacggatttcatccggtcggttcaatttgatctcatttgctaatttattatacacaaattcaaatggtctattttttataaaatatgacacctatatacttacttgcgtagacacgatataaccggccaagcaaagttttctaaaatatataataatctgcaaatatgatgttaacagtccataattatagactatagtctcgcagtggctagaaaagtcaagcatgcaatttttaattataaatatttgacacattttagtagaattataaacaaatatattgattgctgcgagaagaagtttccaactttgttcgtatgatgaaaggtaaattttgtgatcgaaaacgaaagtagacatgtttgaaagtcttaaaatattggtagaaaggttttcgaaattttcgtgacaattaaattgataattttgagtatggaacttgatcgaaaaattagaagattttgagaaaaagacagcatgtttttatgcgatacaatgtatagtttcacaaacaattccaataataatatgataaatgtataattttgtagatagtataagtgtaattttgtaaaagttagtcactatacatagtggtagtgctatgagcaagccaaaaaacatatatgagtaactaaaattagcagtcaaatatagagttggatagcttcaacaccaatcataaaagttttatcaaaaccgttactaaaagttttacttttttttttttttacagctctctcgtataattcttttgtaaattttgcactatttcaaaaatacttacaactccagctaacaacttaattctttttacagttttgtattatcaatgggatccataacagttgtataattttatatatgtctttgttagttcaaaaaaaaaagtttttgtaataataactcttttgaagtttgtacgaacgtaagaaaaaaaaaaaaggaaaactagaattagtatgacccaataactgaagctaggtttaccaggccgtgtgataagaatataaagcccaaattaaaaatgggtctaacctaaaggcccaataactgaaactaggttctctccgcatccattttctgcattactattaaagccgcatttctcatagaatccgccacttagggttcatagcagccagagagagagacaagtgagagggatctaccaaacgaagcaaca

SEQ ID NO: 3451 - DNA, 2000 bp, Arabidopsis thaliana
ttctagtataatgtaaataaagggtggagtataatgtatcgcttgattagcaaatgttttgagacagatattatattggaaaatcatagtacaagaaaacaagctcgattctgagtcatcaagtttatatcaacaaaatagtgattgatgtggaatcttgaggcaagtcaggagtccgacgatgagtaaccaacaggaaagttagatatgtgacgaaatcaatcagtgctcaaaatgaaattgatgtgatggaatggagtttgacaaattcatgaaactattatgaaaggttttagctttcatctgttatgcaactggcagaaatatgattcagaacgtatttataaacctaaggatcaaagactatatttggagataacaaatcaccatctaatactcagaaataaactaaatgaatgcagtgagagggcctgagaactgaattcaaaaaaaatacaagactctgtggttggtgctgttaaaaagttaatttccatgaaagagcctatatgatgtatatgacattccgggatttcttaccagcggaggactaaatctataactgacaacatgtcaacatatcaagaacagtattctaacggggtgcctgccgtgagtggcactttaaccgtgaagcttcaagctcttgttttaatgtctctatttgaatgagcaatgccgcattttcctacccaagagatagtgaactaatgagccatgatcatccaacataagccaacaccaaaagaaatttgaaaatcttgagtgggaatgtcaccttttttaatgactctagcttttgattggaggtaaaggtgtttccattcccagatgactctttgatctgtaccagaacaagacaatgcccataatcaactaaaacagatgaaatgaacgagtcaactaaacctttggtaccaactttttcatgtcataaaacctactaccatataatagccatgaaagccaataagatacactttaaaccatttaccaaaaccattgaatgaacaaaccacgaaaacaatctaagtagagcagacacggctgtacattttgaggataccgtcaagaccaatcaactacagagcaactagtgacagtcttgctcagtgtgaagacaagtacattgaaaataatctctaaagcaactaaagcaattaggcttagtaaataccagtgaaagttctgtgttacatttagaagctttctcagcttccttatcaaacattctccgccaatctgcagattcatccattgcctctctatttgccaaatcaaactgtctcctacaccaatgtaaaatctcaaaccataaacacttacttgattaatccaattaaccaccactacaacactaaccataaacctctaattacataaaatgcagctgaaatacaaaaagtcaattcacaaaaaagttgaaaatccaaaactactgaaattgagaagacccttcatcatgttattacagaaaaatcaatactttgagcaaatcattagaagaaaacccagaaattacaatgattaaacggaatcaaatgaagtattattcaaaccttaagcgctctgtgtcatcggaagatagagtataatcgatagtccaaagccttaagtaaacaccgataccaagaacaagagctagaaccaaacccaccagtatcgtcttcctctcagatcctcccgccattcttcctcctctgattagactcaacaacatcaaggagcttgccccaaagaagacgacgattcattttcaggaaacggttcaactaaaccggagaatattaaagtaaaccgaacagaaccgagtagtctaatttgtacagattgggttacaaagcccatagatgatagaagcccataagggtagatccgtaaatgtctctttcgtaaaccctaattttcacactccttcaaaaaccttggagctcttcttcaagcgcctcctcgtttcggaacttcgatcgtagaaaccttgaaaatccgagacatccaca

SEQ ID NO: 3452 - DNA, 1132 bp, Arabidopsis thaliana
cggccagacataacgccatcgtttagacaagattgaagtggcgactgcctcttttgttgggacgtgatgcaagatctgcaagagcaaatcgttaggaaaagcacagattctagtttcgtttatctgacaactttcggtttctggaacagttgatatatgctcatcgtcgtgtataatatcccaaaaaaaagaccaacaacttaagcaacccatagatgtggccatgtgggataccggatacctagctagacgccaatggaacttttttctcgtcgctggctgtgacacaaaagtgagtctatattataaagctttttttcaaaaaaaaacaattattatacaaatatttattatttgttcaaagaaaaaaaaaaaaaaatatatatatatatatatatatatattattaatgcatataaaaaaagaaactaaattaaagttgcccaatttttaaagtaaaactgcaatatagacacacataaaatatatcaatcgattctcattcttacataattgttagttttttcccttaaaaatctaatcatcaaaccaaacaaaattgttgaaaatccaaattttctagcctggtccttatatttccatttgttattttggatgaatttattttccaattcccaattttgccgccaaccttgattaatttctctacttggcttgctctaattgcttgcaccacgcccttgtaaatgtatcgattatgtttttacgtgccatgaatttaaattttttgttgttacactatttgataaaataaattgaatgtgttttgactaaacggattataatactaattaatctttttaaagttctacgtataatttaatgcatctatgatttcttaaaaaatcaaaataaaaattggtaataatgtttctagtttctgttcactacaacatacaaacgatacttattctaattgcagctaataatagaattggtttttacaagttgaattttttttaattatttgtacatgggcctttaactggagcataattaaagaccaaaatgagaaaaggcccatatagttgtagtcttagtttaggtttggagtctcacccttatattcttcgttccaaacgaaaaccctaaaagagaaaaggaggcgaaa

SEQ ID NO: 3453 - DNA, 1875 bp, Arabidopsis thaliana
atgcttttcaatttcttaagcttaattttatatataagggattttcttgtttctgtagacttcgtggtatatacacaaagaagcaaattaattgatggatgaacacaaagaagcaatttattgatggatgagttaatgaaagtataaattcctttatttttttcgttttatacattgttctatcatgtatttagtgtgtatatccatgagcttcacatacattcataatgtcactagaaaaccaagagaactatttgatgtactatctagccttctatgattgggttacgtgtgcagggaatatagagaatctactggattaagagatatttgagccatgttcgtgtatcttctaacttggccaaaaaaaagagatcgtcacgggtctacatggtcttcacctcctctggaaaaccatatcagtttatacattattgttctaaatgtatgtacaaatataaaattaaaggtttatttaaaagttcagttgtgatttggattcatgatcttgattgttttatcatttatgttagtggccgtgtcttaaagcgatgttaatattcatgatttcatctattattgttgcagatcctagactttactttgggtacatcaatttatacgtctgcttatccaaaaacaaacagcgagctactttttttttttggtcaataacaatgtaaaaaaaaattgttttggttaagaagtaggcattcacgatgttgacaaacaataaagtagaaatcaataaatagttgtgctcaagttgacatacaaaatgccacatctcttttgtattcatgggttcacggacatgcaacttcattggtcgcccgtgaacatttttgtttagcaagtaatttttgtctcgaccaagctggcttcctgactcagttataatccaaattcattttttattactaacttcaaaggtttactcaaaaatttaaaattcatatgtatatcacgttttaatcttggagtttgggaacttgaataggatatatgtgttgggacgtccgtcattggtatccggtttcaaacttgagaaacaaggaatacgtttcttgagaagcaaggtttacattaccacctaatctacttaacatactccatcagcatgtctttaagattgtgttcctcagcttgagtcactgaatcaatatgcaagcagctttgttcgcccactacaaaattggttctgaccgtgatgtacggctggagaaagcaacatgagttgttgggaccaaatacttgtgtctccaaaaaacattgacgtctacattattttatgacaaacttgtccgttgacttcactaggtggcgagtgaaggagtaagattggattgagtaaaaatttaagcctagcatgaaatctagcgccgaaaccttaatgagtgaagatcatatagatacacaaatcctagaatgtgactgtaattgaatgattcacttaccaaactacaagattttaaataaaatctcaattctcaaattcataatttccaactatggtgttttagtggttgcaaattaatctgttagtccaagaacaagaatttgaatcatcctactatgatttaattcattgttggtcattattatgtgaattttttttctaggtcagcctatgattctcccgttaacagaagaaaattcactatgggactccgaaatctaatatggaaccggttaaccatctaaccggaccatgtaaaggccagctttgtagcaaataattattagattatcagcccaataaaagcccaaatccgtaatatataatctaatcgtcttttatccgcagaaaaccctattgctcccctttgctcaagctcagtgcctctttgcagcgaaagctcaaccaacaagacg

SEQ ID NO: 3454 - DNA, 1213 bp, Arabidopsis thaliana
ataacttgtatctgtaactcaaagctcttgttggaatctcactaatctcttcatgattctgtttcctagatcaacttttgagaggggacctttgttttgtggtggggaggaaacaaaaggccatgtactttatgtattttaagggcatttgtaattttttctatcaacaataatagatcatgtattgttgtttatgttgagagaactttgttacttttatctcccgtctcttgattctcttcgttagtacttatcgaagatctatcatgatttctgtgcaaccaaatctgtgaagttttgtaggacgaatctaagtatttgatcaacaacttatatctctagtctccaccactgaaagttttcagcctaaattttggctcgggttgtttggtttatgaagcttttatagtgtaactacacagctgatacgaagaaaccaagtgtaaaaacaaaacagctgatacgaagaaaccaagtgtaaaaacaaaagaaaatattgaaatagtaaacaatttgaatggaaaagatccactaaaaagagacggtgatggtgagctcgtttgcgcgaagacacctgtgtgttggttttgcaatacgtaagtgacacgttctagttatcatcattcagatctcaccgacctcttctgatcttttgtaccaaagtatacttgtttattcgcagatcttttgtagacttttcacctttttaactgccagtatcgtttagtggaagacgtacattggtttttacgtcttctatttctttcaattcaatcatcaaactatcaaagcatcaaactatcatagctttctcactagtcacttgtgggtttctcgaaaacaggcaaaaacataaataaaaccccccaaaaaaatgaattagccatttactattttcacatttcagtttttaaccttactttggcagtaagtatgagcagtgggtccacagtaaggcccatgagcccaaatttctctgtcgtggtctatataagtgcgcctaacccaaaccctaaagtctctcgaaaaaccatcaccggggaatctgacggcggcttagtaccggcggctactgcaaaaaggattgtgttcttcttaggcttgatacttgccttgggaagaatataacaatcattttgcggtagctaaaacgctaagctctatcgtcatatctttatcattgatacttatttgatatctaaatatcataaaa

SEQ ID NO: 3455 - DNA, 1184 bp, Arabidopsis thaliana
acttaaaagtattcgtaaagagtttgtgttgagtgcttatgactactgttgtgtaaacatttatagatactttttgaccgctgtaaatgcttctttgttattaagttggtagcattttcactcggggtctctttttggacttttgagtccatggtaactcaagatgcaaatatctactcagttccaaagtgactattagtgactagctaggctggtagtggtaacagactaaatgtttttatcttccatttgagtatatatcttgaatatttagtttaataagattgttttatatattttaaaatataatcacactaactgtagttttctacttttacctatctgagtaggtcttgatgcatctttcaaactactaaactttaatagttttgggaataattttaacgtcaataagctaaagaggatgtctagggcctaatccaattagaggtatagttttccaagataaatattgccatttagtaattgaataaacacaacttttcatttcacaagaataatagctaaacaaaatagaaacaatagtacaatgttttaatagcaatataatttttaaaaaaaaacttgatacgagattaaacacgttagagagctaatcattagtttaatttttttcttcccatgtattaactttttttttttactttatgttagttatgtctttagagtttgaaaaaaaatttaagcaagttacttagaatatattaaattcatttcaaaatcttctagcccaaatcaaggatttctcggtctcgtcggttgtggggttctattgagcttgacatcgcgtatcacccgggagatttgagcaggtccctctagtcgctaagaacggaatcatagactatcttcatacccattttttctattaaaaattgtccgatttcgccatccgaattattttagctaggttgatatcaatataatataatataatttaagaaaaaataatttaaaacgcatgttgtcggtggaataattatgagttcgttttatcataaaggactgtgattgattgactaatgatttttttttttatataacttaagttactgttttgccaaaaacaataatttagtggaagtggaactgatgaactactatatttatgatagctaattaattctacaagggagaaagagagagagttttgctagagagaa

SEQ ID NO: 3456 - DNA, 2000 bp, Arabidopsis thaliana
tacaattctgcaccacctattgtcaatctcaaacttaaaaccttaaataaactgatctggagctatagttgttccattttaaacctacacctattgtcatttatgtttgcatctgtttgtcaacgagaatactcctaaacgtcttgaggtttaacgagagtactcctaaacctcttgaggtttaaagatcttttgaaagcatgttgaggtggaatcgtagccattatgtatttccttagtttacaagtaatataccataatatttgttttgatgtttttctgttgtagaatcggggaatctcataaattcagacttattgagacttgttataagacgggtactcttgtcattaaaaacgtccagatgcctacaatgattgaagtcataatagaaagattcgaaacgatctattctccaatcgcatgatgaatctttcatccactagacaatatagtctcttcgaagatatccgatataattaaaacgatacaaagaaaattagcatgatcgctaggtaagcaaatattcacgcatgaagcaaaacacggtttgatgttgttacaagtacaactcttctagtgcttgatgaatctgaatcaccaaatatgcataatgttttgtttttctttaaaatctcacacaattgtcggacatggaagaggatccaaaactgcaacatcgatgaagcaatcacttagattttccaggagacaagagagttatttagtcagaagcttaaagtaaacgtttcgatttggacaaaggcctagcttgcaaaaaagttacactagagaataaagggtctagggggtttcatagacgcactacttgtgccgttaattacaaatactgagaaggcaacaaaacaaagactttatagatttgcctcgtatcattctagaatgataactgcaattttataatatcttcgaatgtcaaggataaagttataaactattcggctgtatcaaattttgttatcagttctacacacaaatcattttttaaaaccaatgacggcccaagtagtgcgtcttacgttctctagatatttcctaatttttcatagccgaaactgttgaatatttttttgccaatgctttcgaaacttttggttcataaatcctttaacgaaaaaaagaacatacaacgtgtttggccacgccgaggtttagcactaaaaaaggctcatgcaaatgttgagaaattacacaataggctttttgaaaatattgattttttaaaaaccacaattttcttaccgataggctttcgcgtgtcacgaaaaagagagtgaaccaaactttacgctaagtacaaattaaaccatataataaaatgaaaacctcatcgaaattccacaccaaaataaaataaaaagaaaattaggttcttgagtcatgactagacgaccactgcacctgcaattctgtgacgatgtcagaaccatatttacgaatctaatccaaaataacacaaaacataatcctatgtagtaatcagacaattacatttttgtttctttactcaactattcatccccccgttttataaaaaaatcaacacaaaaaccactagatcattttgatatatttgtttcctacccgagatacgttgaaacttttgcacattaaaaaaaaaaaaaaccgttgaaattattttaaaaatggcaaatgtataacaaaaaaaacggaaataaatattttaacaaaggaaatgaattagtcatattagtaataaaattccatataaaataagatagccctaaaataaaagaagaatgaaaatgaatgaatgatagtgttggaggtgtataagtatcaaataaaacaccaaaccacttctctcctaggaagcttcgtggaagctgccatggcttctctctttctctccccatttaataccctccttcctcgttctttcctctcaaaccaaaaaacaagaagaagaatcaatactcaaatctcaatcatctctctttcttatcttcttctccgat

SEQ ID NO: 3457 - DNA, 841 bp, Arabidopsis thaliana
aatatctcttacacatgtccacttaccacttgtatataatattgtgtcaacgacattaaagcttaaactaattacaaaaatttagtgaccctattttataggcacgatgctccaatggtcacttttaaaatagagtttcctcaaaaataggaaaaaaatagagactaaatgtagagatctttatttatagagatgatatctcctctattttaaagaaaattctattttacatgtgaccattggagcagcctctaaaatagagtcatatctataaataaaggaaaatatagagatcactattgaagatacctttataaaaataaaacatggttatatatatgaatttgataactttaggtaaccttaattttttttttagttttaaaagctttggagtaaatataacaaatttatttaaaaattgttttttcatgtgtgtgttttgaccaaaaaaaaacaaataacatgtttaaccaataacatacaatttatcatgttattttatctaagagtaatttttccatatatatatatttattataagattcaattgtagataatttttacttaataatacatcatttaccatatcatatatagatattagtttggtcaaattgtacaaaaaaaatcgatttctcctgaccgacatagattcagacaatataaagcccagtcataaacccaaaagtgtggataagataataatcttagcccaacaagcagcgagagagagagagacttattattagggctccgtcaaatttccccaatttctctctgattcctctctagaaatcgaacttcttcttcttcgtccaagcttttgaatcgaaaatcg

SEQ ID NO: 3458 - DNA, 2000 bp, Arabidopsis thaliana
attaatcaattaactgaatacaattttaagttcaaaagtcttaattataataaatccaaaattttagaaaattcataaaacaataaataaaaattatctaaataattaaataaaaatatgaggaaataataaagacaatttgaaattatccaaatatatactgcattaggtagcatgcggcttgcaagactatagtatttgttttagaaactataggtctattagctagacagaattaagagctatagaaaagttgttaaaattgataatgcgatgctttttcacataactcaagaaaaccaaatcaagttccgatccatcattgtttgtcgaccaagggatgatcagtcgataggtccacgtacgttgttgtttaaatgaaaatagttaacatggatgtaaatttaataagtaaacaatgaaaatgacaaatgaagtagagaagatggagaaaacaggaccaagggcttgtaaaagaattgccaaataaacaacaacgtggtcctatcaccttctgcttctccctacgcaccaaccagtcaaccatactcaataggtttcattacaagacaaataacacactctcttttgtcttttctcttttttcgaatgggaaacactgactagctttgtttgtatatttaaatcgtttctaacagagagagcgtggcgaagtgtgaacacaaacacctagaaagatctgagagtcaattcttctgggtgacatatgcatgtgaactgtatgaagacgcgttttggggtttatcgtttaaaaatcattagatatgtgactgaccaaagtgttaatcaaagatctgcaccaacaccttttacatatactatattctaatacgtagaggcagcgtagaacactctagaagaagtactaggtgaattatgatcgatatgccattcatctgagagcagagaatggaactttacgcatgtttaattaaaacaactttcaaacttgtcttaaaatatgaaaattactagttcctactctgattaagataagattggcattatattcatattcttgtacctaatatataattgaagcacttgaacatatttagtcatatagtcttgaattttgttgttgtttttccctttttttgtggggtcaaactgagttgctgtaaatttgaacatacatatgaatatgcatttaaattgtggccaacagttttagaaaactgttatcaaatcaaagatactttaaaaatacaaaaaagtagtgtaagatacaagaaagaaaaagttgccactttctcatgtcgcatatatataacgtttctcggaacttgcattttctctcttcttgtttacaccttcctcgcctgttacgagtaacaccaatatttggacttattggatggttgccttaataaaaaggaaaaaaaaaaagaaaaagacccaagaacaccaaagctgtcgtgggctcttattgtttatctgaaactaagccctattactattgggcccaaaaatcaattacgtaaaagagtttgcctgttatataagttgtttactattgtggcccaacagataaaaaagggaatatccggcccattctctttcatcacactccttgaagaggtgataggtcatgtaatttgattaattaagaaaaacgattgagttagacgaagaggcaatggtaggagaaggatagtttgggtagacgaaacggtagagttttggttattctcagattcttgttgttgagagactgatgaactactagaaaaaattaccagtatctccctcaaggttaaaagcgtcatttacggtaaattggggaataaaatggtaaagagaaggaggctttttggtggtgggagtaggtgatgccaaagtagacgactactaatagtagtaaacaaaacctttggctttaacactctcctccaaatcccagatctctctctgtctctgtcccgcggagtccccgagagattgatcaccatcacttttgtaccttccttgtactacct

SEQ ID NO: 3459 - DNA, 2000 bp, Arabidopsis thaliana
tcatactaaacgaatcgatttgaatatagttcatttgattgagcaattttgttattttgaaagtccaaatccattttttcattaccaaagacaacaataaagccacaaatttactaagaattagtaagtatggtcttcctgagtgatcggctagtccatgattcccaaagccaaggttgttcagtactatatgccatcaatgatgagttcgaattatatgtacatatgaaatgggagatatggatacttcgatgccattgagaacaactcaaaaatcttggtgatcgagacttgaaataatgacagcattaagtgtacatctaaaatgtgttttggaacttttcgagatccttcagatgctcgaggtttgacacattttcttgaacacatgatgttcaaaggatcaaagctatatcttgaccggagtgaggtataatgattacaacaatagtagagacgaatacgtggagataagtataagtttgttatggaggctaataagaggttaaaacacgattgaaaaaaagaaaaaagaatcatgagaataagacttgatcaaacataatacattctatgaaaggtaaaacaccaagatgtagagttggcaaaaagaaactagaaaaagaaagtggaacttgttttttttttaatattaaattatatattttttaatattaaattatatattgacaacatataactttttgttaatattaaattatagaatttattttcatctttatttgaaatgttaattatatattgaaaacataaaaatagttacattatttgagtattttattatataaatcttggttttcaaagttagtaactcgtatgatcttgatcagatgatgcacaaactttgtagacatcatggttaacctaacataaatttatctaagttaatcaaaagaatcttacaaattaaaaaatgattaggtcgaggtgaagagaacaaattaccacatagtgttgtaattagacggacatatatgtttaagttaataatgggctttacctctatttgggttgagctcaaccttactcgattaacaaaaaatctgaaggtcgcgtgtttgatctacgctcaccgcaccatttgttaagaataagaaacgtaatctctatttcttaacttccgatacaccgtttcacaaaagattgagccaccggcacatcaccgattcataactctctctcacaagcgacacatacgttactaaacattcatcaaacaatgcataaaactaattacaagtctaatctcagtatttatatacaattgtttcttaatttttcttctttcttctcttcactcacgtgatcaatactaaactttgactctctcttgttacgaccacaaatttttgacgtatcgaaatggttgtcagtctaataaaaaaccgtaaataaaatctagtaaaatctctgttaaattaatagtgttggaatcaaaatattttgatttatagtgataagttatctctaaatgaatatttattattttatgatataaatgaattgttaatttgtagagacatttttttatttttttattaatatacgtatatcaccttgaataattaatacaaagatacttaaatgatactgtgtttatataaaaaaaaaaaaaaatcattagcaatcattcgattcggcttgcaataatctaaatggaccattttatcacttctccaacaagcaactctacagtgtttaattttaaattaagaatttaattatctatatcgtctcttctttagttaggaagtggataagataaagtctaatccaaattaaatcattaatacaaataaagttaagacaaatatttaatttaaataaataatcagaagaagagtgatgatagtgattcttcacgcgcctctctctcttcttcgtcctctacaaaaacacttgtctctcttctacacattgttcttcacgaacctctctgtatcatcttcatcttcttctcccgtaaagctctcgcgtct

SEQ ID NO: 3460 - DNA, 1015 bp, Arabidopsis thaliana
atcgtcgccggtgaaatagggaattgaagattagacaaaaggaaagagatagagaaagaagagagagggttgatttttaggttttggaggaagtagttgaccatgtatgtatcttctggtatagtcaccgtcaccgtgaaattcgccgaagctgagtttttgttttcagaattttttatattcgccagtgtgtctaattatatatttatgtgactgttctaatcattttttttgtttaggttttacattttttatgtatgatgtgaatggataattttcaagagtttgtcacgtttgtagcacatctttttatatgaatagttttttggatgttagtgtataaatataatttgtcatatcgtttagattaaacaaatataggcaaaagagtgattaacgtgttcttttgaaatagctaagagatactaacctatgatgattaagtttatgatacttaaactttttatcatcgagggcactctgcattgtgacgaagatgtgaagtagacctagaagatgacgcactgactttattgccactgctacaaagctaatcaactttgtaccaaatatacaaaacttcgacctctcacgatgttaaactaatggaattattagaacttaaaaaaatcggattagagattaaaaagaaatgaaattatttagagaggtagttagtaaaagtaaattcgatccagcgtggtgctgtgtcatttatttgactgggaattttcttcagacagtgaaagcaacataatcgatggatgatactatttaacaaaacaggtcgtcacacacgtgtgtataaataagtaaagcgcccactcctttctcatttcgtagcgcgcagagagagagagagagggacgatcttttctataactgaaacactactcgaggccaagttgctttagccgtaatcgtcgtcgtccctcttcccgatattatctcttctctgttcttcgatttcgaaaccctaacctcctctctttaattcgcgttttctggatcgaag

SEQ ID NO: 3461 - DNA, 2000 bp, Arabidopsis thaliana
attcttagttcactcattgaaggtttttctgcttattttctaagttttagcttatggtatttgtatttttggttatttatacttttttttttttggttcttgtttttagagatattattttgttctgccgacttattttaccgagaattttagttccttctgctggtttttgtaacttgtactccaccatgtatcacccttagcggttgctatttcatgaataattcagacagaaaaatataataattcaaatttgatatggataaatgagaatttccgaatcttccacacttgaacttataataatccatagagacatacatggcagaatttaaaatctctttcattctttttcatcatctttatatcttcaaagtgcatgtgctcgggcatcatcatccaaattccgtttatactaatattattttcgaagctgatcgagtagctatatacatattaaattgtaacatgtatgaaacgtgtacgggaacgttgaattcgacctattttaaatttaaacctgataccaagaccaacaaaaccggtcttatacaataaatggatcaggcctcaggcctataacaaaaaactacagtttaggggtccattatctgaaactgggtcataatgcagaggcctgccttgccatctctttatacctaagttctacttcttacacatttcattttctctcatttagataacgtttctcgaaattgatcacaaatgaaatgaatatgacaaatctttaaaattgaataagtgatgacccaaagcctttaattgtgttctaaaaacatttcattgtctctcggaaaagctccgtttcaaagagagaaccgtcataggattgtttctttggtttgcgttatgtactttcacttagaagaacgcaaatgcaaaattagaagaaaaaaaacaatcaccaaatatagtattgaacttttctataaagcttcgatttgagttgtgacatatgctatagtatattgtatttatcactataccattttaaactttcctgtatgttttttacaggtcgttcaaaacaagaattgatattttttgacggtgccgttcgagcccatagtttttggacaattcaatgaaccaaacccaaattgcgtcagtcttgttcccccacccacaagtctttctttccactcccctgcgttgccaacaataacatataacactaatgtttttaataatatatcccacatctaatatatgggattaaatatgccatccgtataattttataacttatcctatcgaattttaagtttgctcaggaaaattacatttggtttcattaatcaacaaacaaattatagtttatcattttgtcatcaaatcttctgtgacgtaccttctgacgtttttcagaggatgttatattttaaaaatctactttttaaatgcatcttacgtatctctctactatccgctgtttattaatttctctgaatttttaagtttaagaaaatagaaacacccttaaaaaaaataaggttaagcattaccaaaaataaacccatacggtgacgtatcacagactccaccacttgttctaagccgagccgagccaagccgtataactattggttcaaacttaaccttagttacattttaaccctttctctaagtttggtttatttaaagaaagataagtttggtttatttaaagaaagagaaagtgtgaaaccaacttgttcatattgaaaagaaccattgctctctagattaaaagcttctctctctctctctctctctctctctctctctctctctctctctctcttttggactttctcaatccatatccctctctctgttttttctaatttgagcctctaaagtctcctcgttttgttcatgttgttgttcaagtgaagaagctcaattatgtttacaacattgttgtaatttcaaaacttcataagaatttctctgataataaagaaaaagctggagtagaactattttaaagtgtcatc

SEQ ID NO: 3462 - DNA, 1997 bp, Arabidopsis thaliana
ctttactttacctacaaaaacactttaagattgtaacttagtggcaaaaaaatggagggttcattgatagctgaattattgtacgactattgaaaaagttgacatgtgacaatgaggggagaacaagaaattagtttaaaaccactacgtatttgaataagattacatgtttgtatcaatagcacttacctaatttcttaaacaactacatattatttgtttttttatgcatatttctgatgagatttggtctactccgaaagacaaaaaaaaaaaaatgttctcattcttttgttgcttgaaaatttaatctcacgttgaccatgtagtatgtaatttagggcgtgggcattcgggtacccgttcgggttcggttcttttttttcgggtatcgggtctattcgagtaggaggttgagaaccattcgggtattctaaaaattcggttcggtttcggttcggattcgggtcgattcggttattttagtaaaaatgtaaaaataaccaaaaatacccaaaatatttttgggttcgggttggattcgggtattttactcatatatactcaaatctacccgaaatacccaattacccgtaaatatattgtttactttttatacaaatataaccaaatgtaaccaaaatacttaaattacctaaaagaaaactataacatttgttacttttatcccaaatatatccaaatttatatgaattactaaaaaaatctagtataatcggatttataattttaattttgggtgtttgaggtattacaaatatatatataactaatatatttaggttacatttgtattcgggtacccacgggtattagattcggttcggattcggttcgggtagtgaggtcaaggacccattagggtaattctaaaaatcggattcgtgttcggttcggttatttttcgagttttttggttcggatattcggttccgggtattatgcccaggactatgtatgaacctctacgtatgtatggaccgttttattccaacaaatatactctaaaatattccggataacaataagataagcggtacactagttatttaaattatcaattgtccacactatgggtattaaaccaatctagattactaagagcacctccattattttttttacaaaatgtctaatataataaaaatatagttgataagtttaaaatataaaaagatgtaaaatttaatataattttttatattaaactattaatattatgtggatgagatactcataggttaatcagaaggttgtttgaacttaaaaaatcaatgttgggtggcttaccaagaagtactttagagcatttctagtggatcgagcctttcaatggattctttcggttttttaagtataaatttctgaaaaatgttggatgagagtttcaggttttttttttttaatttttcataatccaagggtagtctcttttagtaagaatttcagaaaaaacttattcttttaaaattattttatttcataaaacttaacaaatattgcaaattataaaataaaacacataagttattttcaaacattttataatagatgtgcaaaaaaaaactgaaataacgaagttctaaaaatatggttgcgaatttttttcatgctcaaccaaatggtttttaattataaatgcatatctcgatcacgaactcgattttaaatgctcatcaaaaactaagataacacacgaaaacggcaacgactccaaagagagccagcttttttctttttagttagttttgatttatttttttcaatttaatcaagagaacttcataaaaaagtttccatttatcaccaccgaaaatgctcttatatgataaagtacaaaacacggaaaatgatctcgtgatgatatgtagggttagtaatcaatttttttaaatctctcggagcaatatatcacctgttgggcaagggtgggatccatcgcggaaagcggacgaggtagcttgctagcgatgatg

SEQ ID NO: 3463 - DNA, 1108 bp, Arabidopsis thaliana
gtacaacttctggattgcataattgtaatggtaatgtgtttaccatattgggattgatctaaaatattgaacgttgtgatttgacaatatttgcaggataaaaagaaccaaggggaggtgtccaatatgtcgaaagaaaataatgcatgtgaagcgaatctatacagcttaagatgtattattatctgtccaatgtgatgttgaatcgttagagcattaataaaaatcatataatttgatattgacaaggctcaggtctttctttgcattaattcgtttcatctcttaaccatctttgtgacaacaccattggttaactaccatagggtaggcaatatagtgaaccattgtttgttgactcacatcacaaaatggttcgaaacccgaatcgataattaaggatttcataaattaattgttaatttctgaataaattcggattttgtatatttcctccgtttcgtaatataagtagttttggaccaatttttttgtttcacaacataaattgtttttaactttctatgtaaataatatattattttaatattttttgattatttatattatgtaatctcttttatgattagctaaactttttaaaaataaatatttttaatttgcatatttttatttaaaacaacgtatattgtgaaatgaaaagagtataaattattgattaaataattaaggactgtaatttattttattaaatttaatattcttttccaaattctccacatattttataccataaaaaaagaacaacacccttacacacataacatatccgaatcagtggttcttcgacatcacacgatggtatagggaaatgagcttccacgtcaacaagataataatctcttcgggactatacatttacaacaaaaagaaacaaatcttgtggtcaaagtttccatacgtagcttctcttctctacactcacgtccaccacaatcctcgtgctccttcctctaaacccgtccgattcacgtacttttactatcttttctcaatccaacagctcacagtccacaaacaaatttcaaatcgcgtcctataaaatcccctctcctctgctccacactctctcaaaaccctagaaaaa

SEQ ID NO: 3464 - DNA, 1031 bp, Arabidopsis thaliana
tttcgtttaacagagacatcaattttgctaaaaatccttgagattactaacacttcaacctcaaatgcaaacgcagccgaacacacagaatccagctagagcttagatatgataatggtgacgagattcatcttcaaaattatatccacttgtgtttgattagtaaaagaatcacctaggctagatacaaaaccctaacagaataaaaacagtgatcaaatccgagccggatcgtttttttccaatgaaaccaaaatccaaacccaagacatttacaagcccaaagaataaaaattgattttttttttttcggcccaccggcccaataacgaatagttaaactgagtttaggtcttcactatttaaagctcgtaaaccctagacttggatatacttcagtctagagccgcgcaagaagacgattctctctgtgagttttcgctcctctctacttgtcgtctctctgattatcttcgttgctactgtctcgttttgtgtataagtagggttcttgcttgttttctctcatcgtgtgttctgctgctagctcctgtagatttttctaagttccttgttttgttcatttcgagttttattgatctgatataaatcgtccgttgatttgttattttgttatgctttattgattttgcagaaagtatcgtccttggaatgagtaatattacactttcagtgatgaaacttttcgtttatttgattggttttgataacatccttactgtattacgactgttaatgtaatgtgcatacaaactctcgaaactttgattctttaagagtttgagattgtcacaagtctcacctttagtatagatttaataagagtgatctttgaaatacttcaagattcgtatctgttttactctatttatgttctctatatctttgagatggtcttttgtttttgaagtttgaggttttatcatttgatttccttgagctgtttaaagtttcatcatttgatttaaagtgtgtctgattgatgttttttggcagcttgagttgaagaa

SEQ ID NO: 3465 - DNA, 347 bp, Arabidopsis thaliana
acaaaatgaaaaaaaagtctcaatttttttaattattattaacttttaaaatgtgattttgtttttcaattcttttgggtttttagacgctagattgtctatatttgtgaatgaaaatttgttctttgttttttcgtgttaaaacgagttcaaaactggagaaccatattatatatttgggctatgaaaagaattgaattcaaggcccaattaaaacctagcctagcccattaaggtttagtgataatacagtgtcgtttaatcgtttatccaatttttatcgtcatctgtggaacggataggacgaaggaaaaagaagaagagtgaaagttgcagagcgagaaaaa

SEQ ID NO: 3466 - DNA, 879 bp, Arabidopsis thaliana
gcgagtattgttgttctttgtgatctttagggtcatatgattgtgagccctttatattgagctattgtgatgcaagagtgttattgttctatgtgatattttggttcctgtgtgaatgtgaaccttttctatcaagtttgtggatttcttcaaatttcaagattataacagacagttacgaagaaacacaactcattttatgttttgtgtcttttggcaaaactccaaattctgaacattgctctaaaatctaatataaaaagtaaaaaaatgaatggggcgttccgagaatcgaactcgggacctctcgcacccaaagcgagaatcataccactagaccaaacgcccacattgatatatagtttgctagcttttaatacaatgtatattaaataatttagttttgtgatataaacagtaaacagaacaagatattttcacccaaagttaaaaaatccaacgtttgttcaaaaataagaaaaaaactatccaaagttaaattatcaaatgttaaaaatcgttagacgttaatcacaatataaaggaactcttttttttttttttgagttaagaaacacttagttgggccataaaaatataggtctagtagatgaaaggcccataaaatcaactagggttagttcttcttcttatagagcgccgcatataagcttcatccttctccgtcaccaccggctctgtatttcggcatttgtggagagaagaaggtactctcatccctttctctttcttatcttaatctccttttttaaaatttgtgacaaagtaaaatgagctaatctcgtctttaagatcatatgtcaaaactgaatttgagttttgatatattcaggtaaagagagaagatagaaacataaa

SEQ ID NO: 3467 - DNA, 2000 bp, Arabidopsis thaliana
  N_region (377)..(377): n = any nucleotide
gattatggcattcggcccaaaatctcttagtattcaaaaaaaaaaaaaaaaaatttaaaacgaataaatagctaaatagttacatgtagtagtactactacttggtttgcataatctgaatcaaagttttacaccaaaaaaaagaaaaaaatctggattaaagtaaaccccaattaattaatcatgcgtgggattgactcattttgacatcatagtatgtgtttagaaacattttttttagcaaatttctagtcatcaagagtaagtaacattagatggagcgtaaggaaaaaaaaaatacattaggattattatgattatggcattcggcccaaaatctcttagtattcaaaaaaaaaaaaaaaaaatttaaaacnaataaatagctaaatagttacatgtagtygmactactacttggtttgcataatctgaatcaaagttttacaccaaaaaaaagaaaaaaatctggattaaagtaaaccccaattaattaatcatgcgtgggattgactcattttgacatcatagtatgtgtttagaaacgttttttttagcaaatttctagtcatcaagagtaagtaacattagatggagcgtaaggaaaaaaaaaatacattaggattattatgattatggcattcggcccaaaatctcttagtattcaaaaaaaaaaaaaaaaaaatttaaaacgaataaatagctaaatagttacatgtagtagtactactacttggtttgcataatctgaatcaaagttttacaccaaaaaaaagaaaaacatctggattaaagtaaaccccaattaattaatcatgcgtgggattgactcattttgacatcatagtatgtgtttagaaacgttttttagcaaatttctaatcatcaagagtaagtaacattagatggagcgtaaggaaaaaaaaatacattaggattattatgattatggcattcggcccaaaatctcttagtattcaaaaaaaaaaaaaaaaaatttaaaacgaataaatagctaaatagttacatgtagtagtactactacttggtttgcataatctgaatcaaagttttacaccaaaaaaaaaaaaaacatctggattaaagtaaaccccaattaattaatcatgcgtgggattgactcattttgacatcatagtatgtgtttagaaacgttttttttagcaaatttctagtcatcaagagtaagtaacattagatggagcataaagaaaaaaaaaatacattaggattattatgattatggcattcggcccaaaatctcttagtattcaaaaaaaaaaaaaaaaattttaaacgaataaatggctaaatagttacatgtagtagtactactacttggtttgcataatctgaatcaaagttttacaccaaaaaaaaaaaaaacatctggattaaagtaaaccccaattaattaatcatgcgtgggattgactcattttgacatcatagtatgtatttagaaactttttttttaacaaatttctagtcataagagtaaggaacattagatgagcataaggaaaaaaaaaatacattaggacaaatgttaatttggaatctcttaaatttagatttttttaaaaatgtctatctgtttttcttctagataaaagtgtttcatattatccatatatattacttttaaagaaatctttttataaatagaatagtatttttgtagagtatatccggatatgttctgcgaaagaagaagaagctcacgagattagtcatgctgacatgggaactagctgtcttgagcaatcattcatctctcagatcttacacgtcctccaatcacagtttcacacgtcaccattcgcggcgccatgtatctgcttctctgatttctgataggtcccattttattctctcccacctactatataaactcccatttttcctttgtttttcttcaacccaaacaaaaaaacattttttctctataaatcctttattattgttataaaaactccg

SEQ ID NO: 3468 - DNA, 688 bp, Arabidopsis thaliana
ttccttcacacgcttcacaaacaaacctcgtcgaagctgaaatagtgaaaagcgtactgtagtaataaaatgctgaaaggaaaagtaaaaaaagagaggtcctacgcaatagcattaactttttataccgcacttccttagaggcccattggctggcccgtaacttcctttacttttttgagattttctgataattttgttgtaaagttcacaaaacataattaagttggaagcacttaagttcacaaaacattctaatgaaatcatcttgttataattgactcaagttacaaataatatgataaaacagtcaaaattaaaaaattaactaccataaacatgtaagattctaaaataaatataaatgttttattactagattcaggtgttggaagactaactaaaagggaaataaatcagacacatagagccaagcaacatttattactttttatagtatttatcattagagtaaagcttattttattaaaatcaaaccttatctctcacacacacacagaccaaggccattttctaagcaacttgtgcgactctccttcgtcctcatctgccaaaaacttcgtacgagtcgctacttctctctctatatataaactccttaccactctctttttctgattttttgacgttaagagatagaaacagagagagatagagagatagagtt

SEQ ID NO: 3469 - DNA, 1598 bp, Arabidopsis thaliana
caccgacgcggaaaatcgatcaccgacacatccagaacggaatctgatgccaatctgcagctaaaagagggaaaatttctaccagaaactctttacgtagatgtaatcacaaggcggcgaatcggggagaaggtgataatctccgaaaatggtgaaaacagaggaattgctagggtttggaactagagagagtgcaagagaaagacaactcccaataattttaccggccaaatcccttggggtcgaaccgcgacgacatccaccaattgcattttttttgcactttccaccgaaaaaattgggtctacacgatcacccggaatgtttcgcccacccggcccaaatgaaatgtggtgagatcttcttataatcttggcccaaatttccatcatggatcttaaacgttcgtttcattgtttcttggattttttttcattaactggtccatctcaaaatgggcttccataaaaatgggcttttttacaaaagggttttgtttcattaattgattttcgtgtttttttatccgtaacaattatgctttcgtttcctaatttatacgagcaaacgtaaaaatgtatagtatttgactatttggttttacgtatcaacaatcaacaacatactgtacatcagtacatacacaatttttttttaacatacacaaacttactttatgtacaaatgaactattaagaaatggctttagccttgttattgcatgcatcttcttaatttgtgtatgtgaaattcttcataggagctaattaagggacgaagacaaagtgtatcccccttcatgtattacctaaacgtatcttagaatttcaaaacattgttttccttagaattttttaaaaaaattgtaaacatgcacatccaacactggaaagtggaaagaagtatatatatatgatatgttatctcaaaaaaactgaaatgattgtattaaaaacatactaaattctgactgatgatagatattgatacgtaattcatttgtttattattgttcgttttgttttcaacactactattcctgtcacggtctcatttaataacaacaacaaaaaagacgtcaagatttgacttttgagttcctcaattttttcaactccagtatttaaacagctaattattacataatttatcgtaagaaaaaaaaaaaaaaaaaccttatccccctgatattgtagatctcgattgtaatcactacacctgatgccacattaaatacacacagagacgtaaataagagtcaaaaaagtcgatgaagccttctgcatatataacaacaaagttgaatatataaagagtaaaattcatcatactacaatcttgaaaaattataatttattagatggttaagtaaatttgttttatagtattgttatattctttttttccaaaaaatatagggaaaacaaaaaccagtaaaaaaaaaagtcaacttaatttgctcaccaccttcttgatcatctaaacacctctttaataattcaaaactaaaaaaaaaaggtataaatgaaagagacaaaagagggaagtatatatcatcaagcttgaagaagagagagaagaagaagaaggaaaaaaga

SEQ ID NO: 3470 - DNA, 1957 bp, Arabidopsis thaliana
ttgtttatagataaacaaaaactgtttccggatttggaaacgggtctaatatgggggaattagccccacattaggccaaaagattaaatgggattgcagacaaaagacacaaagaagacgatgatgaaaaaaaaggagggaaagaggaaaccaaaaaaaaaagttcacatgacaaaatgactaaaagtaaaaggaaacattttttttttcttgtgttgaatcttcttgtgaaagagaggtaagggaagctgcaaaaacacaaccgcaaaaacagcaagagagagaataatgggacaaaaattgggtagtaatctttttttcctcttgtctttgcaaaaaagagagagagaaaggaaaagacatatttagctttgtcacctgtctaacagagaaagagagaagacccaaccgacaagttaaaaagctaagaaacaattaaggtggattagttagttaatctatcccaagttgttcagatgtcttaacaaaaatcatagtttttacaaaagacctaataatatcttctatgtacgaaacaacagacggtggggtttaagactaaagcttattaaagttgtgtaatgataattgttggtcaggtgcattgcttttaagggtcttttcagtcaaaaggaaactttaatttttacaaattcagcagcaactttaaatttccattgttttgttagtttttagttttttacacataagtaaatttcacatatataccttataggagaagaaaacatttgatagtttataactttatatccataaatcaatatcaatatagagttaccaccacacaaacatttctgacagtacaaaaacatacttgattgaaactttttgtgctctcattggttgtaatgtcttttcacataatggtttgttaaaccaaccttgttgatacttttctggatttaatcttttgctttaacatcgtctttaacatttcagcagttagatatcgataacctcaacaaattcccatatcgatcatcatatgctacaaagtcccgttaccaccaaatatctgcaatagaaaaacagaagcataaattctcaacaactttgcccaaagaaataaaaaaatgtcacacctaacgtcctaacataactgattgattaatcaagaaatatacatccataatcgaagttagggtttctcaaatacgaaatgaaccaatacatcttctaaatgtattagctacacggaatccataggcgctaaaaaaagttcaatatagttcaagaaattggtttgtggaacagtggaaggcaaggaagcgagcaagtgatcaaagaaacaattaatggagggaaaacaaacgcttggagcatctagtgagagattgtttttggtaacatattttatactatttttgtttatagaatacaaagatacaacgaagagatacagaagaccgaaatctacgaaataaacaaaaatacgaaaaagaccacaaataaaaatgaaatcaacgaaaaaaatcaccatttgacggaagaaaacacaaataagtcatcggatccgaggctagtcctcaatatctcgaatcaagtggtgcttacagcttttccgagtaaacttccaattaaagagaaagaacttggttaaacaagtttaacattttcctaaggtagtaaggtagttacatcttagttacactacgtgccgctctttgtctatatctaaatctgagacagcgtgtagttctcgtaatatgagtacaaatggtgtgtgaagtcaagtgttactatttgatataccaatcaaaatcaaatcagattattattccttaaattacaatttcactcacaatgacgtgtaacgtcgacgttgtcggtggacacaaagctccataaagacactattactgtattattatcttcgaaatatctatctcttcgtcgtcgaacccaaaaagattctccgtcttagattccgatcacg

SEQ ID NO: 3471 - DNA, 330 bp, Arabidopsis thaliana
tgaatctaactcagaaaaattaaaacttctcctctcgaatttagatttctctctcacttttatctcagaaaacgaatgaaattgaagagacagagagacgacgatgaagcttgaaccaaacccccaaaaaaccctaacttgaaatgccaaacgacatcgttttaacacaacctacacaaatgggctaggctccagcccaataggcccaattggggggaaaattaattctgcgatgagcaaaatcggcgttatccgatcagatcgttgaattgaatcttcgagaagactcttcttttgattcaatcactcaccggagaagaagaagaagct

SEQ ID NO: 3472 - DNA, 2000 bp, Arabidopsis thaliana
ttatatcatctaattgatcaaatttcaaacaaaaacaatcaatttatatatacatcaaactaacaaaaatacacagattttccaaatatctctatatattcagcaaatccaaacaaatctaacaatatatttaccatgcaaaatataaataaaatataaataatataaattaataaaaaaagttagctattttatcataattaacactgtacactgttctatgcatattataatttatacactataatatttttaactaaaaatgtattccattatatttatatacacgtatgtgcagggtcagaatcaagtaaaaattacactataagctctgtcattattagtgtgatgattagtcatggtatattggtctcggactctcggttaattaatataaatcggctgaagaaattgttttgccccgagttaaaaagaataaaacaaataggtgatgacccatgaaaaaaggtcaaaagacaaaagagaatttctagattgccacaaatttctagacaaaagacacaagataagtataaaccaattcaactataagaaactgtgaaatagccacaaattttatgtgtctatttcaacagttttatttgtagtattttgagcgttgacccattttagttattttcactaatcaaattacagcttatttgattatatgccatagctattaagtttttttaagattgagttgaaagatccttaaaccatcttgatatatttctaaagttatacttgattatgtttaagatgacttttcatgggttggcaatttccgtaaatcaatcgattatgtaacttgaaaaaaaggacaaacattatggaggccaaattagagtaacaaaaaccaagttggtagtggacttttcgtgaaaaaagagagaatttgtagtggaattctaagtatacatacaattaatatttgcagtacttatatatcaaataaaaataaacagaagaaggttagtaaacgaaaacctactactttactccttttattggtaggtactcatttaagcatgcctaggaatctctttcctctttcttgtttccttttctatgtcggcctctactctccaagaatgggtgtggagatgatcatatgatgactatgttgatgatcacatgatgacacaaccatgcatgatacatttctttgtctcatgagtcacggtgacatacatgaattttctaaaatacatgtgttacaaatgtcatgcataagagaagcaattgtacatagtttatatgattatagttttcattttctaagtaagaatagcattcattttcatttttcaatatgattttaattcatgtcactagctaataaaggggtattactaatcactgttatttatatatctctttgtttaaattggtttatgtgtatgtgttggatattcattttgactttggtgctatggtagcattttagttctttggtaattttcggttacccacatctttttggatcgaattagaatgataatggacacgtctagacagcgtaataatttggtgattacatctaagatttttggaatcatatgttttgtaattaatcagagttattcggtagtatgagaccccacacggctatgaaccatgttaccatatattctaagtgggtttttaatttgataaccacctacctataactctaaattagtctattggatttttctaatgatcatcatataaatttattctctttatataatagtaatcgttgtaaataatatatgtgtgtctcccatcaatccgcatcacattcgtagaatcatacacgtatgtaaacgcatttttgacatacggaaaccatacaagtaggatctgttaggtggttattaattcaaaataaaatctcttttcattagaaaatataaagagactacttttataaaaagattgggattgtagttccttgccaaccacccatataataatactccccaacaccaaaaacacaacacaaacttagaaaa

SEQ ID NO: 3473 - DNA, 1471 bp, Arabidopsis thaliana
atacaaaatgaatctatatatgcaaaagtgacattttctcaaattgaagcaaagggtgatcatattccttctatgttgggaaaatgttaccttaaagccaaattttagtattttagaaaatagttatattaatataatggttagttattgtccaatatgatcataaccatggatcaaccatttactcggacgtgttttttttcttccagaaaatttcatgacatatcaaaatgtcatgcacgtgaaattaaaatattacattctcatgatctcttaacaaaagggtttttgcgttggtctcatgaaaatgttttcgttatgttcatttatatcattttcacccagttgaaataaaactgatcatacatgcatcttaaattttgttaaaaactttcgtaatagaatacgttaagtcgttaacagtagactcttctaagaatctaagttaagaatcatgcataatagatggttatacattatatactatatatttatcatacacttggtctacgtcatgtttgatcggttagattctgatgtcccgtttattcacatgtctaggtctcaatgtcttattcaagctaagtatgcatatggagaaattaatatgattttttaaaattatctcttatatatgtgcagtcactggaaaagggaatggagagatgtacttgtggggcatgcaagaagcgatgatgaatgatattgttccaagtatgatgcaataaagtatagaagaaaaggagatcacttacgaaccaaattctaagacagaaagaaacatagcaaaaaggagttattttggaggtctaaagaaagtgatgatggattaatgaaggctggttttgttactctctgaaagtcttgacctttattataacttaaaattcgatcaatcgattttttttttcctgttttcctcaaagttggttaattttagcttagagcaaaacccattatttgagattgaaagagatgcgcgtttgtgtgtgtgaatataatcctacgttttgaattttgatctgtgaataaaaatctcagaaaaacatcaggaggatcatagttgttttcaacaaatgtatataaaataaaaccttaattgaaccaaattcattatttcaaggaaataaatgtactcagaccaatttattttttcttttgaaaactcatatggaaaatccacttggttaccaattattttagaagttgtaaattacacacacacacaaaaaaaatgtgtactctttgaagaagtttatttcatcaatttagaaaagattcttataaaaaaatacataattaataaattaaaatagaaataaatcataatatgaattttggttaattatgatggaattaatttcatgcgcaaaataatactcattaattgcgctcacaaacaacctaataaaatccaaacaaagctctctttctccaacaaaggcgttacagagaagaagaagaaggagaa

SEQ ID NO: 3474 - DNA, 1241 bp, Arabidopsis thaliana
aactatctcactctttataatataatgataatataattaatgtttaatattttcataacattcagcatttttttggtgacttatactcattattaataccgatatgttttagctagtcatattatatgtatgatggaactccgttgtcgagacgtatgtacgtaagctatcattagattcactgcgtcttaagaacaaagattcatatcttggtaatgatttctcatgaataattaatgtaacttttactttttaaactgtggtgaacgcaatatatcaatattctatcatttgtaaatgcgatcactatgttttttatgactgatattcaaaattgctcaaatttagtcttcttgtaaatgtgctcattatttgcgctttaaagttgtcgcagcaaggtaccgcatggcacaaatgattatttgatttttgaaaaatggaaaaaggtttgtataaatacgataattgttcaaaatattcaaaaatattctaaaagtgattctatattttttttataaacaactgaatatggtatatgcatgtgttttaaaaatttataaaatattcagtgagaaaacaaagtatgtgattctatgatggtatataatccaaaaataattaacaactgaatatgatgtattatcatccaaaaatgtcaatgagcaaaattgttcttttactattcaaaatccaaacacaaggaatacaaagctattacgtatacaattcaggaatgtcctatcacaatatagatacaaccacactttgttcctacccttaaaagactttagaacacatgttcacgacttaagtaatattgtatggaggagaagagacttttgactctttcaaaatctggttcattgactaagagaaagaacaagaaatgtctaagtcttctcaacccctttcctacgttcaatagtaacgaacaaatctacattatgcaaacacacacacacacacaaacaaacacacacacactcgcatgtaatctcaagttctagcagaatggatttactttcttgtttgataatccatcttttacgtttacaatcagaaatatctaaagacaaaacacacacaaccacaatgtagtctatttgttcctacccttaaaagtctctgttggcttttcaaaacctggtccattgagtcattgactcagagagttagaactaaaaagtctttatatttacacatatacgcagatttaatctctacatctttgcttcagtaaa

SEQ ID NO: 3475 - DNA, 1041 bp, Arabidopsis thaliana
tcaattgataatcgttttcgtcattgtaatagcagagaataatggctttttggtgtgtttttttctttctaaatgtacagttaaaagttacaactttacttcgaaccaaaatgtgtgaaacagtgtatgtagggcctatatctcttatagatatggcccataacgttatattgacaaactttaaagctcactgatcttcaatgctgatgttgtctttttgtttttgaattttgaactagctgagagaagttatatttaccatcttttgtaaagtgcaacgacaaacataacttgtttgctaaaagtgtaaattttctattgaagatataaactaatattacaaacaaataaacgatgaagactacatatttacacatttcgaagtgtatattagatcattactgatatagttaacgtataaaaaataggtaattagtactagtagtagaaagtgtgtagtcaatttgtttagaagagtgtgaagggaaatgacaagcattccaagaagagaatctatcggacgaagggagacgtgggacctacttttaagcgtcgacgactaagcacattcacaagatcggcgtttttgttaggatctgcgtccaaatggtaaaactaaataaattaatacaatgttctattttacatgttgttcactaatactccatgtgatacgtacctatattaatccgtaccaaattttacccctagttctttttttcttttatttgtagccgttagtcgaatcaagtgttgcaaacctttatacgatgatacgaatatgaagagttgaaaagtgaggatgaaatggccagttacattattttgactgtgtaaaaagaaaaaagctagtactacgcactaactctggtctgacagtctcgagacgtgtggtaacatttgccattattacattccccaaattctctcattttttcaaaaaatatactactaataaatatttttcttaaaattccataaaaagcactgagaagtaacaagttgattcagtctcactcttgctcagtagagctcccatca

SEQ ID NO: 3476 - DNA, 1947 bp, Arabidopsis thaliana
cgacgccgccgtatccttagaaactccaaccgccttcgtgtccatgaaggctcgcgcgtatacaacagtcgccacaaaaagagcgcgtaagaaatcggccaccgcccaaagagtaaaatccgggaattttcgataacctgaaggatttttcttctcagtgtggtctcttctcacttgctcagggagcttttgaattgttattggaacacttcacaggtgcacacatatgggtttttgcatacgtgttgccaaggcattgcttaatctacgtgtgcatgccacgtcactaaacctagttatattataggttttatttcatttagacccttaatgtttttacgtactcccaatttacgacttattgtttagtgttttcagataaagtcccaatatatatccgaaatcttactatcgatcaatcgctcacaattatatatcccaaaatatcttgttcaggatctcgtaatcaacaagcgttacctcaaagtttttgttgatttgaagcttaagggttaaccacttatcattacaagaaaacttatccttcttgatggatttcaactgctccacaagactttccatatagttaagtttaatcaaaaactcatgttcaaaaaagctaaacaagaaaggtgaattttcgcaaatctccctccgtaaaacctcgtacgtcttcgaaatagtattagtagtaaaatctgtggactatgtttctgtgtcaaggtacgacagggaaaacgaaatgtatgagtgaactttattgttgtttccatgatgaaatggggttacaaattacgatcaaattatactcaaatcattatttgtaaaaaaactaaagtgatattaacgtggttaactctgttctgttaatttttttggtgatgtgaatccaaaaattactttgaaagtttctcgtacaattaaaagtttaaagttgatgatgaacggaaactataaacaatcataacaagaaattctccaaattatttcagcaacaaatttatattttgtcaagatcaacaatgatcgataacgataatatgatttaagagttttttcataccaaaactctttagaattaaaaatcctcctttcataggcctttgaactaaaaaatagaactcttcaacaatattttagtcaaaagctaatgatacgtgaaagagttcgataccttttataacaccatccaaggatatagatcaagtctaaaactaagaaaagagataaacatctaatcttctaatcctcataccttcgaaaagtaaacaataattaatattgaatgctaacaagtaacaaccaaaatatataaacaaacgctttgtttggtttttaaggttggtttgttatcgagggggtattttatcttttgaattttgtaaaaaatctataaatataggtgatgattttagaaaaaaatgaggatttttttacacattttggcatttccccctacagttaaaaagagagtaaaaatcaaaatatatatcatgtgttgtacaagtaaacacctaccaaccaagcccatcaagaagatactactactagaatcactcatttcctctatatatcttattggtgacaaactgaccagtcaccaataaatgtctctagtcacggcggctcctccggtcaacatcgatcaaatctttcccgtggttgacgtatacacttgcgattcttcctccatcgtacaatatgcatgcatataaataccaatataggtgatggttattgtaaatgtttttagagaaaatgaggattttttaaacccatttttcccttcactaaaaaagaatcgacacacaaaaagagagagtttataaaatacacgataatatcaaagttaaacacacaccaaccaagtaaacaagatacaacacaattggaatctttcttctttgacaaaaaaaaaaggaatctctctctttctctgattctctc

SEQ ID NO: 3477 - DNA, 884 bp, Arabidopsis thaliana
gtctctctctatatcactcattatgtaaagtattaggatcattctccatccatgtaattcgtttggttctatgtatgtaactctttgctgttcccttaaccggaatcggttgttcactatctatgtataaatgctggaaagttatggaatgatgagctgaatgtgtatctgtatgcatcacaagttcataaccaagtaaatatgcatgtaaactataagaaatttaaaaattaagattgattttaattttgggggacccgattgttgaaatagatgcattttgtttatagttttggcttacatgtacgatgcttgtgctttgttttcaatggatgttccaacttccagctagattgttaacaagtcatatcttcatttagttgttcaccaaatccagtctcgcctaattttaaaaatttaatacatttggcgtatgtatattaggctaatgtatttggatctattcatgtatttttttataaaaattggagacaccgacagcattttcatctttagatgcagtcggatttttttcttgctgaaaaaatgtgtttcctctaaagagtttagagaaattgtaatttcctaaacaggattttaaccctaacattttttatatttatttaaaagtaataattcatttaaattcttcaaggtaaaaaatacgatagtccacaaggattgggagtaatcgcgaatacagaacaacagatcagagtatgacacgtggcgaaatctgaaagagagttataatcaaagagaaacgcgttccgaatccgacatcttctctctctctttctgaagtgaactgttgttgttgtgctctttggtttcatcgagagagaacctaaacccgatctgaaccaataacaataagaagacga

SEQ ID NO: 3478 - DNA, 786 bp, Arabidopsis thaliana
gaaaactcccctttttttttttttttttttttccttcaatatttggttagttggtgagagaaagacagcccagagattttgattcctcgtgcatttcttgtttcccgaaacaaatggcacaaagaaatttgtagattataatgtatcagcaaagcaaacttaggaacaaaccagagagcttgtaacattatcaggccagttttaatttgctttcaatgctctgttttcttaacattttcttctttgtctgttttttttttggtcattttttttcttatttgtttaactgtactttctctctaaggataaaatcttataatggtaaaagctctcttttgttctttctatgaaacataggctttgccaaattagagtcataatccgaaatctttacctgaccgggataaagttcagttaaaccggatcagactaagaaaacagagtaccaaacagagatttttgtgatttttgagagagtttgtgtggtggggactgaagtgaatctaaccacataaacacttggaagagagaatctgaaaaactcaaactttaaaagcttgaagctttgagtaataagaaaaggtttggacttttgccaataggactgaagggaaatctcaccttatccacactccaaccacaatcccttattacatcttagtccacgtcatcatcatcatcctcattcatctctaatactaaaatctaatctcttccttgctcactcaccaatcaaactcaaaaaactcttgaatttttcaagaacaaaagaaaaagacatcttta

SEQ ID NO: 3479 - DNA, 1085 bp, Arabidopsis thaliana
tgaaaaaaccctgcagcacaagaaccttcagaaatccaatctttggagaagaaaccaatcaaaatcaagaataaaagatacagttacacaagtggcaagtatatatcaacctggagtttgttgaaaacacaaaagacttctcggaatctttcttgtaagaaaaaacttttgttggagattatcttctgtaggaagattaaattattaaaaagatggcacaaaagagaaatatgaacatataaaaatactttagcagaaaaaaatgaacatataaaactatagaaagtgggttttgttgaatcttgaaagttagtggaacgtgaccctttgcttgcgccggcaaataatcaaaacgtattttgctctctcacacgccatcatcaatctagaaatcttttttagtcttgtctctgcgtcattaatgatttatccataacccaaaatcatagaccaaatttcaacatgattcatgtggacaacgtggcaaagctgtagctcttgtctgaagaaaattatttgggcttttgattccctcaaaatatattaacccagaaccgtttttattgggcttcttcattcatcaagaagcctttttgtatcttcaccacctataaattcacttatgtttcaaccacaacatccacgtgcgattagcccaaaactcaacaaccaatctacgaagatcactaaagttttttatttttatgattttcaccgtttgtacttgttctttcaattggtgccacatggacccctaaaccaacagagcaaatatggcctttcttgatctaaaataaagtttagggtttaagttcagagaataaataagtacactggtgtaaatgggaaattcaaaaaagtaataataattgtctctgcaatcagaaaatgtgaagacatatatttatcttcttgaaaagcgaatgatgtctataaattgttttcgaacagcgaaggctccgcttcaatcatttgtagcagtaagaacgaattcgagacctagaaattcatcgaaccgtctcgtttctgtattcggacgcaagtcttcttctccttcatttgttactctcagagttgtttcatcg

SEQ ID NO: 3480 - DNA, 2000 bp, Arabidopsis thaliana
actgcagtgcagtttacacaccataattcattaaatactaatattttgaatctttgatctatttaaattctcaggctcaatcgttatcaatggacgaggactacataaatagaacacttttttctctttggacaaagcatagatagatcacttatgatctttttttataatgaaaatttagttatccgggactaggggcgctataatctaagattctctaggccattgagttaggagaaagaacttaaggaaaggaacaattgatagggatgcattacgcaatgtataagaaatcatcttaaaaggatttatttacgttgttgcacaatatataattatatatagttaaaatatcatttaattacgcaccaccacacagtatagtttaaattcatcgatccttgatttattcatgacatctttccaaaatctccaatactcttatttaatggtatagactcgatggtggtagcaaagtcattataatgttttggagcgtaattgactttagataaccctatttttatccctatagttagatctaaggtcctaattaaatatcgatgacatccaataaatttggaacgataaagaaagtttactgatttgtttcgacaaagtcaatatttctgatttgagacaaatcagaaacaaagtgaatttgtcaaaattccaagagcgatggcgtgacgaattgcgtgaagaacagccgtagcttcagccgtgagcttctatggccctgatttaaatcataattttatagatgaatatgaaataacatcatgctagaagttaaacataataaacactagcgaacaaaagccaccagccaccttctgccttttatgaagctattacctcctcgttaaccgaaaaagccacatggcaaaaccatcaacatcgcattcgtactaacgacacaatttggacccttaggatattctaaagaatactcttaaagcatgtgttatagacttatagcgacgctaatttgttttcgtatgtgaatttcattttgatacagaagtacagatccgggtgtcttgaattctccggtttactgtgtataaccagttttcaaggcttttttttattttttaatttcatttttaggtttctcattttcggtcattcatgtcataccaacctactggagtggctaatgaatcatggttcgataacaattcatcaccgacgaacttctctgaaggaccatgttgacaaaaaatgtcttgacacccacgcaactagtagacctttttactaaaaccttgggtcaaaaagagttcgactgtttctagtctccacatttccacttgaagagttgtacggagacttgagatatagtatatttttaagttatagattttggttttacttttttttttgtagctatctcaaaacttgtaaagaaggcaaataacatcaataagaagattatttaatcaatgatttttaggatactaatgaatttttgattttatagtatatatttttccttacatagtttttcctttccaaacaccattgaatgtgaaaatcaaattttagtcttcaacatattccttgcttagtaatgaaagataagaccatcacataactcttttgctattagataaatatattactaagcaaaattaactttataatttagtatgatttccaaagagttatttcccaaaaatcaagatttgagagccatgtgttacaactttcaactgcaagatctatattaaccatttctgattttggtttccaaatattaaaaccataaatcccaaaaaattaaataattaaaatctcaaagggaaacttgggaaacttcgtggaagttgccttggtggacccaataaacaaaactaatcagtagtatttaaacaaatcatgacgccatttctttacaaaacaaacataaagaatcagcaaagcaaaattcgaagagacacaaaaaaaccttcgtttgtgtctcagaatttacaaagttttgagtcagtagagaa

SEQ ID NO: 3481 - DNA, 2000 bp, Arabidopsis thaliana
ctattcgaaaagataaactaaagcgaatatgtcctatactagtaaagattaattatttatacggctctactaatttagtctagttatatgatagtagtacaaactgaagtacgaatttatgtatcgtactacttgcataaacgtacatgtggttttgcctatctaagaacatcgtttaattaaacccgattgtatagtttgaatgttttatcggtttttaaacgagtggttcgaattccatgaaaccgagatttcagtatagctctgtgtttgagatacaataacaaatacatgaatccatagcccataggccatacacggttatgcccattcggtattgttggtctagcaaagttatttctgacgatgtgctacatgtactatgtggtacataccttttttatattcaacatttaatctcatatcatgttgactataaatgtataactttcaagctcataacatttaggttataaaaagtcaatatttgttgtagtctaaatcttctttatttcaaacgtaattttttactccaaaaaagtgtaacttatctacttttaattgttaaagtaggaaaataaaatttgatttttctttaaaaaagtagaaaattgttaattttgtacaaataaatttgatctttcttagttatagtttgattttgttaattccttatttttaattttttatccaataattgagttgctttattttatttttagtctttcaacagattctttttatattatctttaataaatattttagtgggatatttcacagcctgaaccactccatatgcagaaaatagtgtttgtaaaatattatagattcttcagaatcctctttttaagactaatttgggaaaatattaaatacaggataacaggaatatgagaatcttgaatgagaagagcactaaaaacaaaataaataacaagtttcccaaaactgaaaattgtaatataattaatagccgaattaaaaggaaaaaaatccttaaagaaaaatataaaaaaagagaagaataaatatatataagtgagtgtaacgattcgccgcgtgtgtacgggcatcacaaaaagattctttcttccatttaaagataaatctaattttaatattgacaaaaacaccctcaagtctccacttatttacagcggctacggttcaccgcgtccttcttcttcttccctaatctcattttttttttgttctcatttatcttcttcagcatcttcatcatcttcttctatatatacctctttaagcttgcttctctttgtctttatcttgtccgatggttcaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaaggtatcttttattaaaattctctccttttcttttttttatcttctctaatcgattcgtgtttttgtttaaagagattgtttttctctgtgtagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcggtacgatcaaaaagcaaccctttttatgttttgtgaagaatcatatgttgtgtgattgatcttgttgaccttatgatcatgttttgacagacaaatgaagaagaagaagatcggtgtgtgagtcagaacccatttcagacatgtaattaccctaatcaaggaggggtatttatgccatttaaccgtcccccacctcctccaccaccagctcctctgtctctc

SEQ ID NO: 3482 - DNA, 2000 bp, Arabidopsis thaliana
ggcagaaccggccgacccgaacagaaatctgcaaatccacatatttctaacatgttttggccccggtccgaattgtttccgcttataaattacagggaaaatcctttttcaagatatttccaaaagagtttaaaatttaaagatttctttcatcaaaatcttctctagcctcacttatttttccaggatgaaaatctaaaaatatcctctcaagttttttttttgtttgtttagaatccacatatatatatatcagtttattagaagatgccaacgtttgacagacttaaagaaataaattggcgtggtaatctgacgaaacgccactcctgatgataggaaaatatttcgagcagttgaaatgctctcgtccgtttatgaataattcagttctatagagtagttgtgtgaaattttaatttgttctcctcccctagtataatataatgttttaatatcattgcgcatgttacaaaacaaagattaggcatcaagatataagaaacaccaatttaggacaaaacaaaaattccaaaaaaagagtatacgttgtaaagttggacatatatattagttttatgttctagtgactattgtatcggttatgacttatattattaaactacgttgtaatttgaaattttatttcacttaaaaacatgcattacaagattaattcggataatgatataacggcaacactaatcgtctatcagaaaacatgactatacgtgtcctactgttcgtacatatatgtttaacaaaagtaattttactaggatcattaccatatggtatatcttagcatctgaaattagtctatctaccaagtcgcagttaatcctatatacttctattatacattaaagaacttaaaaaaaaaagaagatcttaagaatataaaacaaggttaataatcttggaatactctcttgctcattagcagttgttcttttgcggttcttttagttgtactactgcggattaggtcgagtacgtattgtagttttggaattaaaaaaaatatcactctcgaaacgagttttttttttttttttggatgggaagatgtcggcaaaaacgagttgttcttcagtgaaaaatcaaagtacgttatgtcttgaggtgattgatcatccaaaaatttagagtattcaagattaccaatattctagtactcgatcgcgactaaaataaatgaatccaaaataagattccatataatctcaattatgttataaaaaaaattacagttgttgattatgacatcagaacactcgatacttttaattacattcagctaatctttctatgttactaactcactaaaatctactgttggcttgactttttgtatcgatgattatgacatcataacgctcaacacaatctattgcgttttggtatataaaaaaacaaaaatcgttgattatgacatcataacggtcattaaaatcaagactttctatgttactaacttactatagcttgatttatggaccaaacattcaccatcttttaccatatctaatacttttgatatttttagtatcagagtatatttttgatattttggttaatatatattagaaaacaaattcgctacgtgttttagaacatacaaattacaaattagttttacaaattacaggaaaataaatataagtggaaagacgtaaactttaattaacttttttttataaaaaaactcttccaaattgcctcattgaagtgtaacattatctcttcattagtaagagtattaaaaaaccattttgtaattatgaataaaaatttctcaaatttttattgtggcgctgattatgagccagaaaaataaagtagaaaaagagcacatgttagttagcttagatggacccacttctactaccaaacatgcaaactcttctatataaacctatgttaacgtctcaatacatcacacaacataatcctcccaaacagagagagtctcaaaaattaaaccaacaaatttaaag

SEQ ID NO: 3483 - DNA, 2000 bp, Arabidopsis thaliana
caattttgatagcagtggagataagtcaaaggttcgtcttctaattaattaacagcgattattagactatctaacttttcttcttttcttattttgataataactatatatcttctttagccaccttactttctcatcgggttctatttaaatagggacaaagaaaacaaaccatcgatttgtactatgtgctcaattatatcatatgttttgtctccatctatgtatctatttctcttttccatttggtaaattatttaagacccttaaactgacttttctcgtgggcggcgtcgaagttttggttaacagacaaaacatctgttcatgatgcctgcataactctatgtttttatactactcatttgccctctatttcatgctactcttaaaaatagctaaataaaaatacttcaatattagaaaaaaaatcttcttgatgtcaaaaatacactttagatatcccctctagttcttgtgatgctaatatattacaaaattgtttatatatatagaaatattacctctagcaatacaaaaatcttgttatatcaattaaatataacactatccgactagtgtttactaaaataacacataatttttaattatgatctttgaattttagtttatgtattacgctttataattttgttatcaaaaactataaaagctcaaaagtgagcatctataccctaattccgtttttatgcatacacttaggtttatttttattacgagaatctgtgtttagtatatataaaatagagtttatgaatgactaagttaaatacttcaatactaattaaagtaagtcgtattgatgcagacaatataaactttagatatctccgctagtttgtataatgctaatagattcaaattgtctttatgtagaggaattacctcaaataacataaaattttcattttattaattaaatctcattttgtcatttcaaaagtcattttaattactgtgttatttgtctaaagtatactccaaacaagaaaccaaagtagaaggtcagtgcccaagagacaaataaacttaagcatgtccactctttttagcgatcggatcgcttatctgttcttatccattatggaacatgaacgatgttcctttaagactaccacattcaaacgaaaaataagtcatcgatgatagactggatagttatagtttgatgatctagctaattgactttcatatttacataaaacagaaatgtgtttttatcaaaaaagaaaaaagaaaaaacagaaaatgaacaatacatctcacatggagtttgtacaagaatccataataattttttgttcggtacagtaggttagatatacatttgaatacagtttacaagccaaatgttagaagcaacatatttatatagtatcatcaatatacgatccaaaatgaattatagattgacttatggaaaagttagatactatatgcatgattgccaaatacattgaaaaataacaatttaagttcttcaaacaaaagtttataaatgactcggtgtttgacataactcggggttgtttttctttgttaattcacacacggggttggtgtataaatgacttcggtgtttgaaatgtatgacacggtataaataaaaaaggtaaggaagaaatgaagaatagaagaagaacaaaaaaaaaaggaaattaaaaaaaagtcaaaataaatggtcagtaaaggattttgaccagaccggagcggtccatccatagtttcccactaccttccctgatttagcacagaagaatggcaatttgcatgccatttatttcatctattcctccttcactctataaatatattttaaacaaaatcaatttcttccatacacaaaaatcaaacaccttttgagagcggttattttttctctatcaactaatacagtaaccttacgggtgtttatttgtatagatctctgtggttttcttggccaaatctagtgagatctttttggtttctcgaattcg

SEQ ID NO: 3484 - DNA, 627 bp, Arabidopsis thaliana
tttccgtcgccggcgaggtttaagggattaggtttctgttttatccaaatggaaataaatgaattaaaaaaacataaagatggtgacgtgtcagctaaaaaaattcaattaattttgctgagataattttgttttattattctttaattgaaggtaaataaatatttcatgtcggtccaactaactaatataaattgaaaaaaaaaacaaaaaaattagctataaatttagtcctttttttgtcgtaggtatatattagtccgtataaaaggtaaaattatgttgtttcaaattaaaaactgtttttcaaaaattaagttatagaattacaattattggttgttgttatttattttttaccgtggtaagaaggaaccttaacgttgtttcttctactactaccatcgtcgtcgacaagacaaggctaagctatcgaaaattaaatgtacaatatcaaagatagtttattttaacacacacgtcgctctcaccttgctttaatcttcgagacgaagtattggatctcaaaaacaactatcttttaaattcttcttctttgtgatctcgactcttataaataatggaacacgacaaccacgttaagcataaaaaaaacttacttgaaaa

SEQ ID NO: 3485 - DNA, 1366 bp, Arabidopsis thaliana
gaattaagctccttatacattgtttgtgtacatccaatctcatatcagttgttgttgtagaatttaaaattctaactcttctcgaaaaaaaaaatgcttcgtatcatcttcaggagagctttcaatttgtaccggaagtctttttcaaacaagtttttgttttgaagaaaattttggatttgtataatattcctttatctagtttcatttggaattctgttgtagatttcatgtgtttgtccatgatttcaccaaatatctcatttatttgataattcaatcactacaatagtataaaaatgtgatgtttagaagatatatggatttaaaatgtaattaagcacagggttgatggttactaaataaataaagtggacactgacagaaagttagaaaccaaacgagaggaggcaaagacacaaactagaatgcgtatgaaagagaatgaaattttccttttaattttcttttctaaaatgattcgatgtcttcatcatattagcagaaaatacatgtgacaaaaatagtttcttgaataaaagtaatttaggtttaggaaaaaaaggctataatttaaaacgagctacagtttcttcgtatgtaagcgaaggagacgtttttgcctttatttagtgccctaagtactgtacgtagtgtagatacatatcttcattaagtagaaaattttattcataaaaactcaattaactttttttttttcctttttattgcagttttaagttgtaaattacattgtttttttttgcaaaaagtatgcaataaagtattaaattaattaacactatcgctacaactacttctttaattagtctatactattagatatcatataattttatttcttaaaagttaaaagaggcaatattgtacattttgaatgcattgtgccttattaaacaattaaatttatttaactttaataaagttaaaaataaaaataaaaatttggactctggtagtatattacctgattaatatatttgagtatttgaccaaatttatatatttagaaaatataaaaatatcaactaattaataattcaactatcaatgaatttttttccttcattcagttaaaagcattcatggaatttgttttacttcccattttttcatttgatgtggacaaaaaatctgaaatggaaagctattattagctaatcaatcattgtccaaaacttggttttatttctctcctaactcttgacttccctctctctctctctctctctctctctctcttcaatgccttctccaagtcagtttctttcctcattcaacagtttctcttcttcttcctctgcttaaacgaaaccctcaaagaaataaaaaaaagctctcaaga

SEQ ID NO: 3486 - DNA, 1495 bp, Arabidopsis thaliana
cactttagtttgggctttttattaatgggcctttgtagaatacatatcttgttaattatttggacggcccaagctgaacacatatcttgttaattattggtcgatgtgttttgcatcaaagttgcattacttgcgtagaatgatctatacaagagtagcatcgaaacaaaacaaatacacgtactgtctatttaggagataatgttgtgaacgatttagagaacaaaatccctatagaactaacaagacaaaaaataaaaaagagcaatagattctttcacaaacaataatggagtactacactgtcaacacagaaacaaatgcaagactaaaacaaaaagctaatgtccccacaaataggaagatgggttaaggatatggttcaactcaagattttcttacttttttcaaaacaacattcaatttaaggatgcatttattgtataaaggttttggttggataaatttaacattcattcaaaaagactaaaacaaaaagaaaattaaaaaccatgcgatatgctttttttatcactatggaacaaaaaaacaatgaaaagttgaaaaccgtaaactacatgtagaattaggcatgggcatttggggtaaccggtccggtttcggttcggaaacttaagtatttcagttagcaacaaaatcactgaagtaggccaaaattaaagttgggtttgtaatgacaaaatttcggttcagttcaaacaaaaaacaaatatttttggtttggtggtcctcaatcaaaccggccatccaatgatggactttcaggccaaaagttaaaaccgaaatctaagccggcgaattgccaaatttgagctcagttgggttcaaccaaactttcagttcaggttggttcgaccaaacctcagtggccaattcgattcggtccgagtgccatgcttatgtagattgtagaaagcaccactttgaaaagttttcctatagcaatgaactacaatcacatcatccttaatagtattgaccaaaaaaatcaataatattgacaataaataatctgtattgacaattacatcatgagcgaaaaaaacaaaaaggttaattaacacatgagctgtttcacatgatgatttgctcatcaatgacaaattaaaatttgttgattttttcttacggcgacacgcctaccaccattttctcagccattggctacacacacttcgccacgttttttttttactttgggtcaacggttctgttttcagtcagcggctctgtttcggtttataatactaactttatttcggacagccgacagatcattctcatttttctttctttatctatttttgtactaagaataattcatagattttttcctagaaaaattcatagatttaattggttcattgagatagagatagagatataaatgtgtttcacgaacaagaacaaacacatcaagtctctctgtttcttgtttttctctctcgcttaactttcacaagaaaaaaaaaag

SEQ ID NO: 3487 - DNA, 2000 bp, Arabidopsis thaliana
tgtgttgctttgcactactgactatctatagattatgattttagttaaaacaaatcgggacaagagcatgattttagaatctcaacaatttcttgtaacaatctcgcttgagtggtcgatagtagactactagaggtcgtgagtgagctgtgtttgaaaaatgtcttctgaattatctacagttatttgattgtgacactctacaaagtttctatttattaaaagtttgttacgcagtgtccagaatcttttgaagagcttgtcccttcaggaacccgtgctggtgtgggatcagcattcaccacaggcctcttggttgatataggtttggagacatctatacctgacaccttttgtgctcctgctcctcttccatatgatttgcttttggggcgaccacaatgcacagattctgagtccatcaaaggaaggatgagtggaagcagttttgaaacgctagcgacgtgtgaagatcttggggaatcagactgtaaaactctagccagctcagtcattctttcaccgaggaaatcagatttctcgaaacatcaaggattgaagatattggttgatgaagaggaggactgttgtcctatttgctttgaaggtaagaaatcaagaccgttgaataaaaagaactctttaactcttgtttttatgagagagctaaacagagtcgtggattgcactatgcagattatgatgttgagaatccaagactaacgacaaagtgtgagcacgaatttcacctctcttgtcttctggagtggattgaaagaagcgatagatgcccaatatgtgataaggtgtgtttcccgcttgagctttctttggcagatcgattgtcttgatgatcaaagaattgcactttactgttgggaattcgtagttagatcaaccattgatggttgcgtaattagggtaaataagtgcacaatttggcaactaactaacattctgtcttctttaacacaggaagttgtgtttgatgatcgcttgaactagcatcattactatcccctggcttgaaagtttgaaggtgtggcgctttgtttggttagtctactacataattagcatacatctattttgtttcttcctcacacactttaagtgttgggtctccacatttccacttagttttgtcgtattggttatgttcgttttgcccttgtgcgatcatatagatatacataacaattgtaaatattacctagcttcttgttcgttcgtttgtgatctccggggtgtgatagagaagaaaggaccaccatttcagtattttgattgtttgcatcttcaaaatcatgtccactcttgtcttgatccatgattctatcttagcaatattggttaatgccctgatctgggaatcataataagcatgattttgtttgtttgtttggttaaagaaagagagagattctattagatatggatatagtataattccatagtctaaagagaaactgaatattccaaatagtaaattgatccacatgcgactagtcttgtcgtgtgtaagatattaaaaagaaaatgattctttgattaacaccttttgtctgctgcataaagtaattaattagaaataattaagaaaaaggttaggaatcatttaagaagaagagaaaaaagatgtcatggctttgacttctagccacttatgtctgccactgccacctccctcttctcaattcctattctgcccttctctttcttttagttcctatcctgccggtgttgatgaatgagggttaatatagtaactttggcgttaggaactatagttccaaaacctttttctgaatgaatttactttttggaggtatgaagtcacagcttttacagattttatcttgcaaaaattctctccacatttcaaacgtctaatagttaaagagagcttttgttttttctttcccatgtctatcagtatcaccaccgagaaaatatcatcaacaccaccaaccaaacattaacccacccgagagtaccca

SEQ ID NO: 3488 - DNA, 1052 bp, Arabidopsis thaliana
ttgatcacatcctcttgatgaaatcttctctccttactatatccctttaaaccatattctacctttcgcctttgtaaaatcaaaccattcgtcatctttttgtgaggtttcgtctcattaaaacagtatttagtttatgtttttgaattgactatcacaatcgaggatataaaatttgtttttgtatggacaatgctagtaaggaatagttgaggactttacttcaataacaagaaacagatatgagttaatataggatactacatgtaagaatcaatcactaaagttttcagatgatagtgtactcacaaattttgaactaattttttgatctttgatattcttacaaaattggaatgttttaatttccttaattatccaattcctaacaaatcattggttccttttttgataaaacttaaaatttgagtcaaactttataaaaattatcaaaataaacagatacaacctcaatacctcatacgactgtcaaattttttaaagtaagctatcacatagtttacctttatttttttttattatatttatttacgatattttttttttttgaaaaatacacagatatttgattttggtcagatatatgtccatatacgaagactttcaaattttatttgttttcaaaaaacctaaacatacaatctcattttgctattttggaaagaataatgaaatattcctttcttaatcatattccaaaattttaattaagaaataaaagttgggatgggctttaccttttttatttacagtccaacggcctcattcgatgactagtgtaaaattatccagtgccagcgcattccaacttcgaagactaacctatccaccgttagatctaaaatttaatcatctaacggcaacagatgaaatccccaaaaatatgaccgttggaattgaaccgttggctcctcctcctcttcataagcagcgctcgcttccaatcttcgtcacaatcgcagagactctttacgaaagagaaatatcaagactaagaaacaagaagagtaagaatcattgggagagcgatc

SEQ ID NO: 3489 - DNA, 1674 bp, Arabidopsis thaliana
gaggttaagaaagaacactcgtgtctcaaggtatgaacaggcaaatcctatgaaccatggatgtacagttgcttacattaaatgatatatctctcaaacacattctttgtaaatcttcttcaaagtgtggtccactaactagtttcgatcgtgaatcaacgttcaaatgtacaagaagttgtctaaagtatagttattgatattgtacagaaaaatatagtaattctacttttccacaaacttcatggctttcgaggataacacacggcacgagtccctggagaaccctcgtaggagttgtgcgaatacgattgtgttcttccctttcttgcacagctgtggctacaacacttcgttggtacttgcgaaactaattgaacacaaaaacagaggcttggtgtttagattttcaaaaaaaagggagtttggatacatatgtatagatgtataggaacgagagagaagagtaaaggagcactcaagacttgtgtttttactttttcctttgtcctatatttttacaatgaagcaaacgtaggtatatacagagaggaagcttccactttcaaaacttaacaaactttttcaaagttacaccaatagattatctcaaggaacttgcactttcacaacttgacaaaatctttcaaagttaacaacaatgaattatttcaaggaacaaaggaatccatttttcataacaaaagaaattaaacgatcataattattcggatatcttcaagtttggtggcggatgaaacgttacaagtggtattagagccgaaccgaaacgagtttggaccgtttcaatttttgaaaaattctattcgggttaaaattttcataactatgtttaaaaaaataaaaacactaccaatgtttttctttacaaattctttaagtttttcaaatatcatgtcttttaattaagtacaacatgtgaatttaaatgttacatactattttgaaaatttttatgaaactatctcgcatactattgatttcgcaaaaacgaatgatggttatgttatttcatttcttctaacaacgtgagtctatgactattttaagaaaaatctttctctctatatttgcttaatctttgtgtttcatttagctattccttaatattacctataaaactatttgatatagtagttatttttatatttttgttcgtataaaacaaaatattaaaatcataacatgcgacttagtgatgtgtcgattttgtataatattaatttatttcgtaaaagaaatttggtagcttgatatttatatacgcaatatatttaacagaatttcagttttaagaaattaaataaatacaaataaaaaatagacatgcaagagagtataaaggaaaatatgaaacctaccaaaccaaaacgaccctccgttcctcttctaacagccattccctctacctaccccaatttcttctccttgatctccctctccccacacatttatttcttcacttttgtcgtatttttattttatattatacaaaactcttctttcatcaccacctaaacacgcacatttctatatattatttacatatattcatttctaaaaactcaaagagagtataatcaaacaaacacattcacattcttctttcttctcaaaaaaaaaaaaaaaaaacacttgttcatttacatcaaa

SEQ ID NO: 3490 - DNA, 2000 bp, Arabidopsis thaliana
aaagtatgaaacgtttttttggacacctagctattatcgttttttggacaagatagttatatcgcggcagcacttgttttaaacgatatccaacgctattttaatccacacaacacgatctgcataccttttcaacaacattttaaattatgagcatgatagaaatatgtatcatcgaatctcattgatccattccagaaattgaacgttgtaaagtccaaactattgatattcagaactcttgtactgtaataagtagcaatacccttgtattacccaatcattatttacccccacacaatgcattactgttaagaaaagtccaaataattcctatattcaaacatatatagtcttacaccaggctaacccatcacctattccttaaacatacaaagaaataactgaattcccccttgttaatttgactctcaattcatattacaatcttatatttaatgtagtcgtattgtactcatctccggttgttcggagtgaagacaaacagtcgtattacggtaatccgatgcaagcaggcaaaaatatttttgtccaaacacagagagtactaactatcatatttgttttcctttacccaagagtaattaatatcatattttgttatatcaagagtaatatcatattttcagatttactgcttgtttctaaattattttctcacatgctactcaaaaaaattgcgaatggtagcacggatttgcctccttaacgtggaaggacacagtctatctccttgtcttagtggtcacctagtttggcatgcccaaaatgtttcaaggttttggtaaatgaaaatcatcatggagagatatagctgatacaatgtcagcaatgttaataatctgcaatgtcatagtattaatttcttgtatcggatatccaaattgctttaatctgtttgaaagtatctactcctttcacatggtaaagatttacatctaataaaaataaaatctgtaatatttaatgtttaggtgtaatcagtaataactttagacagaaatatctttaatttcttttataaagtaatatcttaaataaaaaaactctctattcataaatataacttatcctgagtaagattttgttgcaaaaaaattgaactcacataatatggatataaatccaaagcattaattttcttttattttggttaaagttgttgattcaaagcattcatatatcattaaattataaagtttttttttttttttttcatctttataaagttaaataatttctgtaaatgttgtgagacacgtataaaaaggggtgatatatgtcaccttcaaagcaaatgaccagttttgtctcacgtactaatgtttagctatttcaggaataaaattacccaaaagttggtttctgtattttgattgtatactgaaccaaagttcaaaaagggtccatttagtgacccaaatggcgataacaatagtactacaatgggctcaatgccgagtttatatctgtacctatatccaaacactcctaaaatcttccaactaaattccaacacatgcgaccggtatgacttccctaacaagtcacttgtttctttttcctctgtcctcctaaaacggacaagcaagctaatttaaaataaaaataaaaaacaaacgtcaatcgctggagaaaattaatccaccgtccgattgattattaataggtcccacttaaataaacgatctagatcttctcctcacgatgcaccgccctagagcttaattttccctcatctctttgtctataaaaccggaaaccaaacctacggattctctccttctccacataagttacatctctcgtgttttgttttctttgtctccgatttttttcgcgacgaagaagaagacgagagatagagagagaagtagagaaatcgaaggaatctgtaaccgattttaagatctcaatttttagggttgttgatttttcaatttctgggttaattttttttagggttttcatttggaatc

SEQ ID NO: 3491 - DNA, 810 bp, Arabidopsis thaliana
ttttcagctctcttaggatgagaaatcgaatctgcgatgctgatttgggagagagacactccggaatttgtacacaaagtcacaaaggtttaaagccaaagacgttattgatttcaccaaacaaaaaaaaacaaaaaaagttgaccgcaataacaaggaaggaacataaatttatccggtctgttttaaagattgtggatcacactgggccttcaaaatagcccattagttcacgtatacggttgcactctcctagaatttttgtcacgtatcttcagggaacgcttaagatgacggatgacgaacgagccaccgccacggtagctttagaaagcccgtttaaaaaaatttgtagatcaaaatgaatatttgtagatcacaatgggccaagcttgggtcgttacgaagttgataaagactaacaaaacaaaaaacaaaaaaactaacatctcctatagcctttgattccttgtcacgttatgaaatgacacgtggttcttttggaaccggtttataaataaccggtaaaccgaagagaagaaccaatagaatgcgccatatcacatccaacaaaacgggaacctgattttggtcgcataccttaaacataggagatcgagattgatggatcctttctcaatccatccaaaatcttcagacccaatgctcttcttcatctaatttcctgtctgacggacacatcttgtagaatcagagaccagtttcttcagtagagactcgacgagaagttgcacctgaaaattcatattcagattaggggtttattgattcgtagcatgcgaaagagat

SEQ ID NO: 3492 - DNA, 1118 bp, Arabidopsis thaliana
aaccatatcccgccaacgttcgttaggtagtttttgttacattgggggttcgattactgaaccttccggttttggctccaagttttatgtaaaaccatacgatatctaataatatggggaagattttttttgttgtacgaagaaatattgttagcagctagtcgaaaccttttctatatataaaaattggtttccaaagattggaattttctggttatatggttttttgttagcttcaatatctcatctctaagttatgaatattcgaaattgtgacagtgaaccatcgatgagtacacgaagatgtaacgttgagaatgagattatgactttgtacagcgtagtatatgatgaaatattgacgtgacatccacttataggcaaaatgatgtgatagcaaataatatctgcaaagtaaaaacataaacgatctataggactttgttaataatacgatgcaacataaaaacccactcagagaaaatgctggtaaaaagaggaaaagtgtgagttaacaaaaggcagaaggggacaaaaagctttatgcaatcgtgggaaaccactttgatctaaaaaactgtggacgtagtatttaatcattccttatcataatccaaaatgtataataaaaagatatctctacttaacgtggccatatagaaaaccttttaagatgaaggaaagagtaatgtaaaagaattggtaatggtatacatacatactcgtgattttatgaccatggctttttgcatcactagtgagtaatgcccacctacttcgtcaactcaacaacttatgaataactattcaattttttttttgccgattatgtgcacaattttaaaacagaagacaaatgtaaagtatatgactataaaatattgactaaataactttccggcgattttgttagtaaatgttaagaaaatttgttctttttccttgtagaaaaggaatgattctaaattactatcccaaaaaaaaaaaaagtaataacttgtttcgaagagtttgtgtgtgagtcgtatatgccgcttaactcctatattttctttctctttctcacaacttcccctagaaacacttttttcggaattcgaacgcacagcgatcggata

SEQ ID NO: 3493 - DNA, 1288 bp, Arabidopsis thaliana
ttccataattattaaattcgtgacatcttgtggacttctcctttagagatattatgtcgtcattttgggattaagtttttatcaactttggatatgtttcaaaaagacaatctttacgtgtgtgtctagtattagtctctaaattgttaccaatttctcaaggtctctattgatttgcattaggtaaaattacaaaaaaaattatctaagaatataaccaggagatatactaataacgtgtacaaatactatgcaacaaaacaattaagtataacttcttaaataatctttaagtgtgaaagcagataatattggacggctgtgattttggtttcaatatcagctaataatatggaccgtcagattctctttcatacatttcgtcaaaggtcaaaagtaaacatgccacgtcaggtgagaagattagatatttccatttgtagcatttccattaggtctgggcaaaatattcgttcgatccgctttgactcgctattcaatttgatttgattcgaaaaatccgaatatccgtaagattttggagcaaagcaaataggaaaatgtagtattcgtaaaaatcgaagcaaataacaaatactattttttctaaactcggatattcgcttcgaaccgtatatatatatatatatatatatatatatatatcataatataggttgtgaatttgtatatgttgggatttgggcttgtatttgtatcctttgggcatgtgtttttttttgtgacacaatttttattagataagtggaattttttaaaataaaattgtttcatattttatattttatcctaaaattgtcgttttagttttcaatccatcaaatataagagcgacgtttctgtttcctttcttcgacttttcactatttttatcactcaatttggttacataatttataacaagaaaatttctagttgctctcaatctcacactcgtaagccataaggtaagaaatttgaattatgttaaataattttttttaaaaatatttgaatatagcaaagcaaaggggatatccgacaaatatcacacaaaaatccggatattcgtatttttggatattccggaaattttcagatcaaagcaaataataaaattaagtattcgattaaaacgaatcgaataacaaatatcccaaattttccggatattcgctgcccaggcctacttcccatgcccataaagttcccgaagccactaaatgctaaaacttgctacaaatgcaaaaacccttaagcactgagaaagcttgaatctttgttggca

SEQ ID NO: 3494 - DNA, 2000 bp, Arabidopsis thaliana
ccacaagctattaaaattttaaatattagaaagtattttaaagatgcttgaaacttagcagacagtttggtttaaaagagtaaaagtggtaatgagctgatgttggcggctaaatctctaaaatcagtaaagcatatcgcgaaccaaaagccaaagcaccaaatgaaactgagttaggttcgttgtacacacgatgttttccaataaataatcctccacaaaattcaaacaccggatgtatctcgaaaacattagatgttctatatacaaacatatagaatcatggtattgagttcgtgattttttttttgtaacatgatgtaattagtaattcatcctaatatatgtaatcatctttatattttgataatacattcgtgattcgttcgatgacattaccacacgaggttacgactgcgcacatatggtgtattatgagtccaccatacgataaattattaaaagtgtggtagagagacttttcttatggttgataaattattattttcaatatcgtcaaaattacttattcattttctctttatttggaccaatttagatttagactcgattagtttttctatagatgtaggttcttcctctcaagatgtagcgataggttttagggttaaactttgtcgtggatataggaagaaactgcatgtagtttttgatgggttacacttttagttacaacacgaaagtttatcggaaatactagttggctcatggctgccttacgttagacaattaattacaaacatctctttttttctttgtcaataattgtttcttattgtaggcatactattggagaaacatgaggtacgaacttcccaaatcagttttttttttttgggaaaaagttgaaattatgcaaaacactgaaaaaggaaagaacaagtaattaaaatgcaaaaaaaaatttttaattaaaatgcatgaacatataaacaaataacatgttataggttcaaatctcatccactgatccacaaaccgtaatcaccatcaaaatattcatgcaagtcaacttgaggatatttacatactataattaagaaaataccacaaatttccaaatcaagtttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaatc

SEQ ID NO: 3495 - DNA, 410 bp, Arabidopsis thaliana
aagaaaagattacgttgttgttcttgatttgctgaaattaataaattttaacaatcttgtttaaacatcaaccctatatttgaacaatcataaacttcaaactcttacatgtggtttgattgctaaacataaacatatctgtttaatccaagataaaagacagaactagtggagcttaaaaaagatcacgtgaaaaacgtctttacctacaaagcaatataatccagatttgcccaatctagtagggactgttcgtgcctccgatatttgtagtttcctttttttttggctccgaatatttatttgatattaataagattttacaaaagaagctcaatcaatcatttcatatcactttaaaagcagcaatgtccgaatacatctccaaagtaagcaataagcaaaggaaa

SEQ ID NO: 3496 - DNA, 2000 bp, Arabidopsis thaliana
tgttaattttatcaaatgtatattcttaatcccataaataatctaatagagcaaaaacttgcagtttatacctttaaggttttgaattcttataataaaacgtttagttgtcaatattgctacttttaacctttaaatggttattgtgttcagggttccacaaaattaactgacaaattgattatgttaacaaaagatattcatttttgttataaatattgatatgactctaataattatttttcttttagtaaacttttaatatctattaaattttatatttatgactaataagatatttgataaaaaaaaatcataagatattttataaatcaacaaaaatataaaaacatttttgttttgggtaataattatattttaaactgttaataaaaattccattactaataaaaaaatattctaatataagttaacagtattttttgtttttacgttgtcaacttaacgtagtaaatatttctattgtttaattccaaaccattagctattagcttaaaggcaagtgttttttttcttcttctgtttgtcttagaaagaactagtatggtttgggttcatatgaggtgggtatcaggttatcacgtgcatggttttagtatagtttggatccagctcccatcctagacttctaggcacctttaatatttgattacgacgaaaaggcttatgtgaatcgaaaagcccaacttcttaatttcaaagcaaattaaaaaaaaaaaaatcattttaacctttttggaaaatagaaaggtaaggtgaatttgaatttctgaacatttgatacgaatgcaaaactcaagatgcacatttttcaaagtaatgcccctagaattgtttgcaaaatctgctgtctaaaatttttttgctaggatcgaaccgattttcgattgggatagacacgaattataaatcatattctaatatcatattagattatagacttccgattcaaaacttattggcaaaaaatgaactgactcatataatttatataaccattaaaatcttatctaatttctgatttaaggtttcaaatacaaattattcataacctaattgatatgagtttcactagcgatgaatatgatgtacttatgtacttatgttacataagggataaggccatttgaaaaaaaaaagttgtaataaaacttaaacccaagagataggattgaaaaacataaatggcccatgtaactataatcagctggggtacattggagaacaccattagacagtccaaatacaattgggaaccacgtgaatctgatagatatttgatactcaactcaatactatatttattatttcaatacgacaatctcattctctaacttctttcatactaaaatctcacttaaagtataccccatctttccctttgcaacgtttggtaaaaatgcataccataacaaattttagagcaaaaagcaaaaagcaaatgaaaattcctttcttagggtttgaagttgaaactagagagacatgtctcacgtggtgtccacatgtcttttatcttaaaaagttcattgtttgcttcctctataattatttttctcatatcacaaaagtaaccacaaaattattaaaatcttaaataatacataaatcaaaataaaatcatacgtagagcatctgattatagttttcatttctttgtagtaacatgtccgagatcttgattgtgttttcggtaccattctttgtctccacccaaagctatatcatatctctcactcccacaattattactttttgttattattaaataataaatatcctttctccaaaataataaaaataatatctagagtataaaataaaataaaaaaacttagcctcgttcttctccctctgtctctctctctctctcggttctcttcttcactgagctcaaagcgattacctcccatgggaaaaatctctgaagtgattatttagcactactttttctttgtctccttctgaatccatttttt

SEQ ID NO: 3497 - DNA, 2000 bp, Arabidopsis thaliana
tatcagaaagtcattaagttgaaaaatgctaaatctaaacgacaacaagctaacaatgaaccaaaaggacctaaaaaactggaaagaaaactaagagatgaaataggagcacctaagccacatagaaaaaaggtgaatgaaccagaaacatttaaaacccaaagaaaaaagggtgatgaagcagaagcatataaaacagaaagaaaaaaaaagtttgatgaaattgaagaaaaaaagtctgtcttcatgttcgttgcactcgtcgtgaaccccgaacctcaaatgatttaaagattaaaaaagtattagactgctttcgataattccttcttagttctatgaaacactataatctatttagactacctcagcgtatcaatatttttttcttgtatagaatatccaatcacgaccaatcgaatttcatcaatctataagaatgccattctcatgcaatttttctcttatagccaacatgctcatgcaattttgattatttacttaaataaataaataaatagaagtttatataagtgtcaataataagcttaaccttgagattctttgagaaacgttgcatttatagaagaatttgtcagtaattctagtaagatacgagcaatcaattggtatttttgattgttacttctctcatctcacaagtttgaatggttacggcagttaagatggataaatccgtcaatggtttaatccgaactatttttaaagtagacaacaaaccgtcgcaaccaactctatttatatgtaaaaacggtatgtggttgatccgcatcagttttcttttttaaatccacacagaagtaatttgtgaaatggtaaataaaacgtggtcaaatacacaaacgaatttgtccaccttaaccacaacaatcatttagaccctaaaattgataataaatggacaagtgaacatagaaaatatggcaatttatgttattttagacaatcgaagcgattatttaggcgttacctgagagtctagtgcctagatagagtgtaaacgaccgcctagaccattttttataatactgaacttttgtaatcatttatttcggaggtggtgcacacgacaatgcctacattactcgtgaaaactatattatacctcagaataccaaagtccatgttcccgatcccaatatcatcaaagagttggcccatatcaaatgctatgttaatttttcttatcttttcaaattattctaatgttgtgttgccaacgactgcttttactttataatagaatagaaataatagaagttagtttccgcgattactattatatgcttacatttataccggactagttatctccagaagaaaaccgtccgttttcaatttgaaaacagtctgtaaaagaaagacttacatttatctaatgcggatttgtattgtgtgtgtgtgtgcttttttcttacatgtatttattggtaatgtacatttaattatatgtcaaggtggttgctggtgtgtgtaaggtttcataatctgctagaatagttaagaggtcaccttcatttaccaaatggattttgtcttctaattgatttaaatccatttttttcttttattctttgaatactttttcataattatttcgtatcctccacactaactcatttctactttgctacatttacaagtttcatctaatctacttaaattaacaaaaaaaaaaaaaaattgtttccttatttaaaaattagatttctcgtaaattggactttgattttaattattgtctattcaaagttttatttttttaccttaaaaagtgttgactttgatatttcattaccttaagaagaagaatcaccgacagctccaacttaggaaatctcaaccgttgattaaatcaaacgagatactaaaatatccaacggccataaatcgtccaattgccatgtttcttcccactctcttctccttcatttaagaaatttcactctccgaagaagaagacgaaatcgagcaaatcc

SEQ ID NO: 3498 - DNA, 1759 bp, Arabidopsis thaliana
gcctttacaatcttatcacttactttcaaaatactctttagcgtctcttgagtttgagacgtgtttggattatgtttcacttctaatgtatcttactattcataaataaagaacaagtatcttcttttttcttacttggtattttctcttttgattctcatcttcttcttgacttagatcagaagaaaacgtatttaatcaacttttatctagcaactccaaaaattctactaggaaataacgatatggaatcagaagcatttaagccttttacacacgatgcaagcaatttgctgaagtggatatcgacagtcatagacatgtccatttttagacttggctattcaaaaatttggaccatttttctattaatcagggcccgtttttagtgatagctctggatattttcattgagctgggccttttctggtcatggaaagagattgcaatatctatttagccatcccaagtgggcaaaacataatctacgcttacaaaatttgtgtaaacgaattcgtctacgcttacatttttgtgtagtaaagagaagtattatgttatcctttaatcaaaaactcaaaaaggggtaaaataattgaagcctgaaaaagccaacaagataggagacaggccatgaacgtgatctgcccatcaaaaaaaactttttttttttctcggtaactttttctaaaaagcaaaatattaaaataagagagagatgtccttgttcttatgttttttcttttatcatctatgtgacccatctcttcaatctaatcacatttttgtatattaaagtgttttcttgaaacatttgtccgaaagcagaaaataaaaaggattcaaactgaaatcatgaaaacataaacaaaaaaaatgtactattctttttacctcacagtaattttgttttatataaaaagcttataaattaacaaaacttataaaaaagtgagaaaaacagagagtctcttcttttcttgttattctgtcagtatctttctgtgtgtgtttgtggattttttggcattttcattttggattttgcttgtttggtccctttcttttcatgattattatttttaaattccttttttatattggtggtgtgaatgataagagtaggcagatgagagattagatgatttggtaatagtggtgtggaattagaagcaaaccttttttgaaaaaattaagaatgttatagagattagttattcaataacaactactaccaaagtcataaaaatgatataaaatataaaccaagaagcactattagtatcactcatcactcaatagctttttttttttcagatctctaggaaaatttctcagactttcagagcattttggtgcttttgttttgcttggtttctcgggaaaattctcttcacacttttagagttttctctctcttctctatctcttgtcacagctcgtttagcattcattctcttaatcgtttcttcattcaaaaattctctctttctaagctgagtaacttgcaagtcgtcatttttcaattggggtcttctcctttttacttcctttgaattgaaatcacagagaaagagaggttccattgctggaaaatggattgctcaaattagtttctgtgtctaaataaagacagagaagaagaaaagtagacaaaagctaagtttttttttcagatatgggagagagaaaaatgagttggtgggttctttgaaacttgtttttgttcagaccaaagttgattgctttaagaagggat

SEQ ID NO: 3499 - DNA, 481 bp, Arabidopsis thaliana
ttctatagtagagcttaagatcagataacaaaacctcaacttccaaaatcagaatctaaaattcacgaaagaacttatgataatttctctacattgatctgcatcgaagaaaatcacaaatcaaggatttaggattctgacctttaactggaagttgtagtgtgagtgaaggcagtgagatgccaaaatagaaattgccaatggccgagaggtgatgttcggatacgccaacagtactgtccctggcgtggataatcattatccggttttaattcaattcatagatcgttaaaccaatcggttaataaataaaattctatttgatttggtttaatttcttcggttccggttttatcttttcaccaacattttcgtttgtcatctttcgcacctaaaccttcacctactcctccactgaaccctagcttacactcactgttcatttctctctattggcatcgacgccattgttggactgaag

SEQ ID NO: 3500 - DNA, 1314 bp, Arabidopsis thaliana
tattcatttttttaaacaatgttattgaatggcaaacaggctttaacgggtgccattttgatttcttctgatgcatgaagacgaagacagctctcactttacattttgttggatacgaataatatcaaagaaatctagatataatatgtttaggtgggtcgctcacttgtaagttgaaaccaattaaagcttatttcttgggaatggcataattataaatcttatgctaaatacgtatattgcttttgctaatggaattaggtcttctagacttgtggtacgttgcatctacttaactactatcactaataattcctttatttatacacacatcccttttctcccacaatgatttagtagctttgaaataaagtaatatacgcattctcagtttctcaccacgacatctttttttatttatagaaaaacttctacgccggtctattatctcaaacacgtgaaatgtcaccctgctaggttttgctgttgattagcgttgttcactaattttgtactaggtattcaaaagaatcgcaactgcagatttaagtgagtatatatgaaagagtctcaacaatgtaagtgaaacagtttacgtaggaacaatgtaacttgatgtaccttattctgttatacgaaaaacattcgtacaatagaaattaatcgttacaaatgtgggttaattctaccgtgtgcagatattgcgtgagtactttaatcacttgaatattttggttcatgcattttgttcatggtgaactagcaaaaaattagttgctataaaacaatatggcctttttagtaaccaagtaattactggtctagtggcgttttgaagacatatgaactgtggtttcgaactctgtgggtgaaaaaaaaaaaaaaaattttgtattgatcagaaaaattcggcaaaatccagagacctaatgttaaatggatacaaaagaaaaaaatgaatataatgttcgttcagcatttttgttttgtattgtattctgtacctatggaaaattagtttttaaaccagaatggaacaaaaaaatcgaatatatgaaaaagtggtaaactcaaaatcggcaaaaaaataaaaacagaaaaaaggtgagaaaataggaaaaaggtaaaaaagtaaaaaaaaaaaaaaaaggaagaacccttccgatttgatttgattgggactatataaagggaactctataacatcatctctctcacaagtcgcaacgctccaacgacttcaattcaatttactttcgattttgtcctcttccaaaaacccttccgcttaaaccctaattcacttcgccggcc

SEQ ID NO: 3501 - DNA, 2000 bp, Arabidopsis thaliana
tctcccctaattaagaaaaccagggaagatatcgcaagaaaacgccaacggtgtacaatcttcagggtaaaatcatgagaagccacaaagagatcatgagaaggttaaaaacattaagcacaatgaaaacatttttttgatgcttagatatcttgtaaggaagatgaccgtgaggaaaattatggagacatatgtggtatgtctctgtgtgattacaagagaatcaaagaacaaaagtagtttatagttttgaagtttaatttgtagtattttacttttgaactatgtacgtggtttaatttcttcaatgaatttaagattttttgtattattttatttataattagtgattattgaaaataaaacaattattaaaaaatatttatgaaaactaaaattaattcaatcggttattcagtatttgacaaaaaaaaattaacatccattattttaaatgatacaattatttgaatcatttattaaaactgacattaatctttacatcagtaatttacaatcaatacaaatatttaacatcacttacaataatcgaaacaaatactaacatcatttttattaatcgatgcaaaattaacatcatctatttgcaaatgatacataataacatcggttataataatcgatgcaaatatttattttaaatgatgtaaattatttacatcaacagtatataaatcatttatttaaatgatgtaattttcttttacatcaattataagtaatacaaatatttaaaataaatgatataaaatgatcacttttttgtagtgactggctaaaccgatgaaaacaaatatgaattgaaatcaaagaaataatgttatcttgtgtaacaagactttgaaaacttaattagcttattctcttttaactttggtataaataaacaacttttatatttgctatgaaatataccaaaaacgggctttgtaattggtcgactctcttatcagaatttgatgtcaagaccgcgtgataaaacatcaagaacatggtctaacatagtggaaagaaaaaaatatttgatagtaatagaatcgttgaaaattcaactatcgtcaaccttattcaacaggaatataaaacgaaaaaccgtaattggctcgaagtttggttgaaaaatcaaaagccaaaatctatgaacgagattaatcgcccactaaagtcccttctgttattggcacacgctcttgtcgttatagttaaaaagttcttcaaatacagagacattttgtttatgtactacatacgattcggtttggtgaacaaaatatcataaaacttggttcatgttgatatatagattcataagatgtatttttgtcttatatatgtttctgtatcatgggttaaaatgttttacaaatatgtttttttttttaaaatatgtatttatgtatatatgaatccgtacgcgtagtagtaaaatgaattagaaaggaataggaattgaaaatttcatattatgtgtatgtgtggaatcaagaaatgaataaaatgataagtggtggaccttgtaacctaagatccaggaaactacagaggagagccactgatagtgtgtcaataattattctcccacccatccacaaagaaaagttaatttaatttatcactctcagtaaattataatcaaaataaacaccaacagtagtcaactttcaacaaatgggtctgagcctatccaatatatataatcgatcgaagcaatctattcgacattaatgaatctcattcataaaatcataacgtaaaataataaatatattaattacagagacagacaataatgaaaggtgtgaaaaatgaacactacaatataaaagatgacatttaaaataaaataaaagagagaaagggattaggtgtgaaatgtggtgtgtctatttaagtggagaagagtccttgacactccatacatactacctttggcctcttcttcttattttatcatagctaagctcaaaaacaatcgatag

SEQ ID NO: 3502 - DNA, 2000 bp, Arabidopsis thaliana
cacttttgatttcttatgggaatgtgttttcgtaaagggcaatatggttttaggcattcatgtgttttggatgagacgctactaccaaaagaatatgtcgttactaaaaaactatatttttgacacatgctgttaattttggatacatagaaggtctaagagattaataggaatcgtttttatctagtttctaatttagttcaaacgttgactactccaaattttcgttgtagagttatttattgaaatagtcatcgattttaaattgggtaatactatatccgatcgaactttaatatgaaatatgaattatgctacttatgagatgcgataacaaatttctatagtttagcgatcttttgttcatgttatttagagtttggatttaaaaaagttatgaaacaaagacacgtgtgttgacgggttgtggtgtttgatttgccttgctttctttcttctttgtgatgaagaatctctttggagatccaatatattgtttttggaagtatcacgacggtgacatgtataggtcgatcgaggaaacgccaatgataaccaaattgaggctgtcgcaactaaatgatcagtcgatagtcattattaatagtatagttcgattaaaaaaaaactttccaagattattgttaccttgtattttttttgaacattttctaaaaatgatatcttctaaacttagataattcaacctatttgtggtatcattaatttgaacaactttgacatgcaagtggttggccatactccatactacaagtctacaacatgtctgcgctaggaactttcttactatacttcatttttagaccattaatgttattgcttggtcttttaaaatgatagtaaattattattttatagtatctatcgtatattattatttacatcgatcataaagtgctggtttacaaaaaatatttttaaaaagaaagagtcaaagttccttccatatttgaccaaccaagcttgaccgactcgattcaatgggtccaaagtcatagtggtcgaggtaattggtcaatcaaaacaccacgggctatatgaatctcgcttaattgctaacacgacgtattgacaaattttccattcgtaatggtgcaactattcaaaaacaacaaatacttgattttattttgaattttattagtgtttgccaaatgattttagtccaccaactaaaaaatatagaaggagcaatagcatgccgctaacaagaaaaaaatagacatcttacaaaaaaatgttttttggtttgaccttagaataaatgtatttagttagcaattctaatttaattaaaaaaaacaacgaaattatcaatatacaaaatacaaataatgctacataattcgcttaagaagaattcaactattttattttacccaaacaagttaattcttacttttttctattttgctcttaatttcccattctgattaagaaacaaatctcatatacttttctatttttgttagacatgaatttcaaatatatatcttacatttataaaattaattttcaatcaaaaatcttgtagtattatacaaccgtgatgttcctaaaaaatacctgtcatacagctgttatgcttcttaaaataagataaaattatatttactgtattaagctagattgtcaaaaattaaacagcaagataataacgtaattaaccatcgttaatatcaaacgcgttaggtcggtttgaccggtctggtttggtgagcgctggtaataatttcaccatcccaatcaatcacagacaaaattgaaaaccccaattaataatacataaaatgaaaaacatgatgaattataaattaaaactctgttctgtctcaaaaaactcaaaaggagtctctctctcacctacaccacacctaaccaaaccccctacgattcacacagagagagatcttcttcttccttcttcttccttcttctttcttcttctttcttcttctagctacaacatctacaacgcc

SEQ ID NO: 3503 - DNA, 2000 bp, Arabidopsis thaliana
tctttgccgtcaatctctttgtcttccaaaccaaaataaaaataaaagattataacaaaatgaaactaatcaataaggaaattaacgagacaccaaatacgtcaagtgatcattgattcaagaagacccatgagtctctgatccgcttgtttcagtggctcgaaacaagactcttgtatacgcacctggccaacaaaaaaggctttgacatagctaaacccttcctggcatgttactgccatggataaacagttagtcttcactcgatcggacaaagacttcgccggctgtcgtgatgtctcggcgtcttgcatcgctgctttttcgagatagatagattgcttgaaacttgaaagcaagactaggaaatatctcactttcttgtgccaatgatgattttttttaactattaatgattctggaagcaactcttgccacgtctgttttacgtgttagctgtagagataccgacgtgtattaaagcaagaggctattttactttgggccttttgggcttttgggctgaagaaagaaactgtcatcggatcaacaaacactgcatagtttgcaacttgcacggtaaagcgacacaaaatccatgacgtttaatttaggttccacgtgaagaaccataccacatatcgtgcaataagaaactgatcacttttatatacctaaacgatttacaatttacactactatgcttgacacgatatgtaatttttttttttttgccaaagggtgttgttattgatattaaacattgtacaatacaacgtacatagactgtttatataaaacaaggacgtctagataaaaaaagcaaataacaaatattacaagactagttaaggaaacaacaaactgagtaaggttttatgtacaaaacagagacgactaccaaagaagagggccagacgtggtagcagtgatggaagacaaacatcctgacatctcaataagaacatttatggctacttcaaatacatatatacacaatatgtaattctcttattacatttatggctacttcaaatacatatatacaaaaaaaaaaggcctaccttcgacagaagttataccaatttattgatcggaagctacaaaatgttatctagggtcaatttgtagcctatctctatatcaaaaccgatacggatacaaaatagtttgataatcatagaatttaacattctaataaatatttgtttctagtattctttaaatgaataatcttgtgttcaattagtctattcatagtagaattaagtctcctaaaaaatagattgaaaccaaaaacagccgcacatggatttaatatcgactttagttaggaggttttgctaaaaatagtaaaatactcacaaactcacttctaaatactaatcttttacactcatgtcatgtgctttaaagatatgagagaacctttcctagtacacctacagtcaaaattttcaagattccgaaattttctaggttttttgagcaagagccaagaatcccaaatgtttgaatttgtatttttgatccaaaaatactacaacatcgtataaagaataaatcatacgtgtcagaacgagacatatgaagatgatgaaagcattgagccgcccctcaaaaaatccgttcaacgtttgagagtcaaggccacaaggtctgaccaatctatctcttctccttcttcttctaatcatattttcaacggtcaaactttttatcaccttctcagaaactactcttcttcatatgtgaccctaaaaataaaaacgaacaattaaacaaaattttaaaataatataatattcaccaatcagacgtgcaatatgttttatatattcagacataaccaacaaatatacagaaacaagaagaagaacaagaaccatcacttctctcattttcttcttctccaagcccccctcctttctatatatatctgaaattggtcttttataaaacaaacttccatttttcgtatggctgcttcttttcttaca

SEQ ID NO: 3504 - DNA, 1872 bp, Arabidopsis thaliana
gtaatgttttagtttctaaaaataattatgttagtaattatcttctataattactgttttagtaagctgttgttttttctgaattattattaactgttggatttgtcatttgtgtatgatggaggaaattatgatgttaaagatcatgtatcatgttgttgaccactcgagattgcgttaatcaaatatttgtataattagaaccgaactttaagttatgggaagtaatactaattaatatcgaatttaaatggaccgtctaaaaataaataaactaattattatcctgagaagaaggaggaaaaacacaagaaaatgataatttttaggttttggcaaataaattaaacctaatgtatcgaactgaaataggaaagcaaaataaagtcaatcgaaacaaaaatttaaaaataattactaaacattataatcaaaagaatcgaaacttgaattactacggaaccaaaatattttggataatcaaaaatatccgaaatctataaatacatttttgcagccattttaacaaataaatcttagagttggacttatttacaactcaatgccattagcattaattttttttttccgaaataattaattttactttaaattcttaatttaaattgtcaaccacattatcaatcaaatttaatccaaacaaacttcacatcaatcccttaaaattagcataaacgtatttgttaacaatattttaaaacaaagttttttgtttaaataaatattattcttactaaacgttttttgtttaaataaataaatcatgtatttgaacttatttacaatgtcatgctactgaaattaattatttagaaagaaaaatatttaattaacgatttaaatcttctaaatctttgcttttagagttattatgtcattatctaaaaagcaaaaatattttaaaatatttatatatttaaactttataaaacattattaatatttaaacttataaaaagtttaatatatcaaaaattttaacatcattatataatatatagtttaaaaaaatctcaaaaaaatttccgtcatattttgtgattaaaatttttaaaaatgaacatatattaaccaattggcgaaaaaatgtgtgggttcaacatcccgcatcgactaaaatatttagacaatgattcataaataagatcaacattaataaaataaatggttttttttgcagaacgggttttgcgagacgggtttgggaggacgttacttaataacagttgtaaactataaaataaaatattttatagatagatacaatttacaaatttttatatatactaactttaaaaaataaattgtccccgcggtataccgcgggttaaaatctagtataattatattttctaaaatattaattatttttggatcaaataaaataattaaaaatacctgaaaatagataaagtagtaaaaatactcaaaaataaccgaaaatgtccgaaaatatccaaaaataaccgaatatccgaatatattcaaagcaaaataaccgaatgaatactaaattttgaaaccaaaagaaccaaaaccgatagcgaaacaaaatttcaaaataagcgaatgaatactaaattttagaaaaataaactgaaaaccgaatgaatacgaactgaaagcggatagataaaccaaacgcaagtcctgagattgtgtaaaaggcccataaacgggcccaatatgcgaatccattttgttttcttgttgggaaattaatctttttctgcttattttaggagaaattgttttaattttaatttagggtctcttgtctttgatcttttgtacactttctctggattttctgaattcgaactttggaagaagaagaagctttgatcaatc

SEQ ID NO: 3505 - DNA, 1388 bp, Arabidopsis thaliana
ggtttcaaaacttgggtcgagagagagagtggaagaggaagaagagaaaggaatgaaccagtgactgcaaaattgggcggtaaaagggttgtagatgacgatgagtttaggcgggaaaagtattatagagagaaatggcggggagtaaaatgaacggtccagatctaatgatcacgtgattaatgtaatgtcgaaactacccctgctggaaataaaaaagaagaggtaacaaaaagtgtggctgccgggattcgagcccgggtccccacggccacaacgtgggatactaaccgctatactacaaccacttttgtgttatttctttcccttagtatttaattaaccaaagatttaataatattatcatctgtttccaaaaaatgggtgacaaatgtggatacaataatgtcatcttcatcatcctccttacgttgaaaactagtgtgatttcttcttacacttgtcttaaatccatagctactatcgaaatttgtgtgtgtgaatttaaagcttttgatttttttttttgttgttgtatatttagtctctctgtattcgactttgatcaaaacttggtcaacatcatctttaacatcgccttcatagtaggcgatcaaaaaatccatggaataaatagcacacacaagtctgaatcatttcccagtctacaacaaatcgttacatcttccttcttctttctcctgtaagtcctcttcttttttttttaatctgttttctttcaacctatgacgaaaatcatcacacttgtcttgattcttcactttctgtctgaaaccaacttttttttttttttttactaggaaggattttgatttcttttttttccgaggtgttacttgttagaacgggataagatcgtaatctttttttttattatgaagatgacatttgaccaaaaaagtataaaacctctttttgtatttgttttcttatatagcattagtatattctgacaatattccaacgagcattgatgatttttgtggaaatagagatcaaagtaggaggaagacatgcaaaatcagtattaaatttttaatttgttatgtgaagataaggtcaagaaaatgacgtatttacttgttggaacttaattccaaacaattatgtaccaaacacgaatccatacgcaattatcacaaatctcaaagtggcaaaacttcacatttaaaattttcccaaaacctaaccaaattgaaatctatctaaccacgtgaagatgtaaatgtgtataaccctttttgtttcgttgtctctcagattctggaatttgagtaaaagcaagaaaaaaagtcaaccgttgcaacaaactcttaaaaagaagcaaagtagtagcagaagaagaagaagaagaagaagaaaagaaa

SEQ ID NO: 3506 - DNA, 2000 bp, Arabidopsis thaliana
atttgctacaatgacaaactaccaaagtttatttaattactttacaaaaagaattatttggataatccaaaatcaaagaggggaaagttggatttacatttccgattaacattttaacgtaaaaaggaaaaatgtgaaacataaagtgggcaactggacattcacggcaacagatcaaaaacccttttttaaatcaactacttagtaaaagaggaataaattaacagattatcacacacactgattgataaattaggagcaaattggttttaacaattcaaaagaaataaacaaagcactaagttagttttggtgctgacgagagtggacggcaaaaaaaacagaagatcactattaagaaagttaaagttaatagtgcaaaatattaatgtagggaaaaaaatgactacaataatgttcaaagttaaaataaaggacattttgttggcaagaagaaaaacattagaaacaaaaacagaacaaggcaaagctgcaaagtcaagttgagtcggtgaaagagaacaacaaccaacctttaccccactgccatcctccctagttttgaacatgtgcactttcttcgttatttaccatcacttttgtgttgtcatattcatcttcttctattcagagaagacatttagccaaaatttatgtaatttccgagattaagaactggttttcctttgtttgtcacttcaaaccagtgatcaacaatgaaaacagtaaatgttacagtggtctataccaagattctaaaagttgaaaagtggaagagggcatgctaatttgaatgaatacccaatatttaagattctagaagctcctttttatctatatatatcaactaaatagtcggcatgaagctctcaaatacttggtccacctatttatagagtacacaacttttttggaaacagctaattggaaaactctgtattatttagggtttggtactagttccttttgttgtgcaactatcaataaataacatataccttctattgataaatccaaatccaaactctaaagtgagtcgctgaaaatgaaagtagtaaaattttgtggcctctcatctcactgtattcatatttcgtttgttgagtgccgactctactatccacctattatgagattcttatgttaaaacttacaaaatatatttacctagattttgtctttgtccatactcttccatgtctcgggatcagaacaaaacaactagtttacgtgcttttttggaaggtcttatagtagtaataccaacagagctacagataatggattaaatacatgtaaccaacaaatgttatattacttttataaaataattataaatcaatgaaaaaaattccttatgaatcgctaaattttcaagaactcaaaaccttattcggttttcataatgagcaatgatgaatacatgttatacgtcgaattattattttggattctcaagccggccctttgctatcttattttctcctttacaacattttttaaccccattgtcaaagagtcggctttgagcccatgattgtaatgaatggatagcttgaatattgcgaccacactaataattcccgtcaaatatttgtttaacttaatgtatgacacatgtattttacgagcaaataaattcaaaaaatttaagcattagcgaaaacattgtttctccgctccacaagacactaaaacataaataatgaattaaatcagtcattctacagaaaattaatcaccgtagtcggttgccatcattccaaaaccttaaaaaaaacccatgtaaaatgatcattaacaacaacaacaacaacaaccaaaccaacaaaaattaaagtaaaaacagagtccaaagcctcgtcacatctgcccataaatacccttcaccgactcaccatcttaccacatcaattctctcatatctctctctcactttcgaatatatcttaagataacagagacacatactcttaagtttggtgaagaataagaagaca

SEQ ID NO: 3507 - DNA, 967 bp, Arabidopsis thaliana
tgcatacagaacaagaagaagatgatcaagaaattagcggaaagagaaaacagagagaaagatgaggaaacttgtcgttgtcgtgtgtagggatgaattagattatcagacagacgaagagccgagttgtttgggagagcttttattaggaaatttctgtttttttgttttccgaaataaaaatattttcttaagaaaatttataggcttttcttatttaattcccctttgataactttttactaggaattggatgagcatgcatcgacccggtttgagagagaataatcagaaccaaagtattgtacttatcatgagattatggatacactcaaaagatacatttaccagcggtacatttgtagacttgtatagtttatcgaaagtgcatgagcatactgacatgagaataacgaatgatccgtttcggttgtagcacaatctttggtagttttgtatgttgcataagttatttttatccgcaatagtggatccccattcccatcagcaagcaataataacaactctacacgtaaagagtctaatttgataatttagtcgactgtttaaaatgatatctctagttgacctttattcagttttctcttttgtcttaccgtctgaatttttgtcccattaattttgtcaaaattttataatcctagtactatctattaattttgctttttcaattttcccacatttaacattaaaaacgaaagtgaaacgtagccactatggaatatgtttcattcatcgttagtgttggcagttgcaggtggggacaagctgcatttccatgttgcttccaaagtcaaacagatcaaagcagcctctttgaccaaaagaatccaacttttttcctcaactttcatggccgccaaaatcaatcactcactttccaccaccaaaaaacctcagattctccaaacccatatcttcgatttcaccataatccaacataaac

SEQ ID NO: 3508 - DNA, 1449 bp, Arabidopsis thaliana
tattcaatactcttttcacgagatgcatctaattattttctagtatagcacgttacttttcgtttttaacttagttgatctatatatgttgtggtctggatttgctacacatgtagcactggtgtactagttatgaaagatgataaacgtcaagagtttaatttgtaagaaataaattttgtgtatctatttgcgttttctctcgaacctgatttattgacggttttggttcagtccggattttttgatcatataaatactgcaatatatgattgagtacagcggacaacaaatattaaaacgtatgatcgttaaagtttatattggtgctgtgctcaaatccgttaaaatttcttattttatcatcttcttctcttctacgtgtactaagaaaaaagattttactacgtccgtctgtaggaatggatcagacacgagaggttacttcgtatggtcatttatggatttatacgagatagtaaagggatacgagtttagttttggattatactctgcgaatttcagtgattttcatcgtaagagaactcccaaactctctgctcattgttactctgcttttctcagtggcaacatcacttttcttggttctcaaggcatcacgcaattgcagaggaacttctcttcttcatcttcttcgtagtaatcttttgaatttagtttattctcatgaatctgattccttcagatttagcgaaaaccatgtgaattgtgccgaacgaaatctcatcttttagggagaaccctcagacctctctgttttactgtgtttgaattgcttgccgttttaaagtctatcatcctaattttgtttttccttaaaacggtatgctttccttgatctcacgtaatagtgggatttcttttttcttttttcacactgtgaccctaatgtattacataattttcaacacaccactcgctcatataaaattatttgtaattctgtttaatttaggtttggtatgattccatttttggcttgataccggttcggtttttgcttaaaagaaaactaaaaaaaaaaaaaaaagcaaacataagaaatggagtgtttgaagtaaaagaaacaaaaaatagtaatggattggtacacgtacataaaacaccccatcagataaacattatactaattaatgtaatgtaatacaattaactaaacaaaatacattaagactttggaattttccatccaacaagtcggcttgagaaatgttcgtggggaagcacgaacatgtgatcttgtgcaacaacaccaaagtctcaccaatacaactttgatctttaggccaatattaggaaaagatcgtgtttaccacaccttctaatctttccgacacaatctctcatctaaacacttccttaagtacttgcccatcttttctcttttcttagtatcgatccctactcaaaccataaacccacccaacc

SEQ ID NO: 3509 - DNA, 317 bp, Arabidopsis thaliana
cttcagattcaggtgaaagaaaatctagggttcggtgtttttgttactgagaaaagtctaaagagttgtctcgatgtgaaacaagttccgagggttttagcctacaagtcgggtgttaccagcacataattgggctttttaagcctacttatcaagataagtggcccagaaggcccatatgaacaaatagtactttaatacactagttcaactaatgtattcgccgattagggtttcttctgtttcactatatattaagtgtctccaactactgagatctctatcctctccgtcctctgttcttctcattggccgcc

SEQ ID NO: 3510 - DNA, 2000 bp, Arabidopsis thaliana
agtcgataccatttatggtttggattaaaatttataactaaattaaatggtaaaataaattattttattaatattaacaatctcaatgaataccttcgaggattaccgctttttctttgtaaagtatatattttatttataataatcgttaggtgtaatagaatcttaatttgattcatattcggtttgtaattaatcacagatatcttacgctatttacagtgtggattgaaaattataaaacaaaatggataaatttcgatttttattgatatgtgccactaaataattttgatttaataaagtttaaatacccataataaaaatttatcttcaaaatagatttttacttatcatctctttactctccatcaaaagtcataagattgaaatcttcactaccccatcttagcatattgatttaataagtctaaaccaaaaaaaaatttcttcaacataaatcttcattacttcgacattgcaacttcatataaagatagtatttagtttttctaagagcatgggttgttgccctaaaccaaatttgatgtagtggtagaaatatctaaaggctagtgcacagaatgtacatgtgggcattgacaaacaatctttgataaatctttcaattgtgccgagagtggcttcctttgatagcattacctttttattctttcccaatcaaaaatccaaaactccaaaaactaaaatcaagattaaatacccacaataaaggtttatcttcaaaataaatttacttatcatttcttattaacgaatagaaatcttagattttcggtttttcaatacataccttcatggcttctacatcgcaagccaatatagaagtgttaaatcttttgagagtaagaaaagcacgcaatcggagctcgtcagattcctcaagaaacttcatcagctgtccagcaatatttaatagcacgctcactaatttctttactcttctcggacttaagaagaagctcaacatccaaatttgatgtaggtatcgaaatatctaaagattaccacataatgtacatgtgaacatcgacaaataatatttaataaatcttttaatagtatttacctttttattcttctcccaactaaaattcgaaaactcaaaaaaccaaaatcgagattaaatatctataaataaaaattagttttcaaaatatatttatttatcatctcttgttaaagaatataaatcttattaaaaataaaaaaacaaatgtagatcttaaaaagtttgaaagattagaaatatatttctacaaccagatgacaaattctactttttcgacacaaaaataataatatatatattccacagtcatgctatcacacagacagccgacatgtttttttatacttttaaattagatgttttttaacatgtttttaaatacaatattttcttaaaaaaaatgctattcatttatttgacccactttgaacaataatgtcgagttctataattttgtaaacaggacgatattatttatttgaccagtttgaacaaagtaaacatcatctagtcagattttaatataaaccaagtatcgtggaagttctttgatttgtttaatcctcctctagttagattttaatatataaaccgagagagactcgtcactcagctcgtggaagttcctttgatgagcatgaggtcaattattgcgttagaaaagacttgaaaagtcaaagaaagctcgtcgaaaccatccttgtcttcacatattattttttattttattttcagaattaaacattacaattgtcggacttttcaaattagctagcaaccaaagtctgaccatttccacttgaaattaaataagatacaacaaccataaaatctcatcacatctctctaagtataaattataacacattgatcaaactctctctcattccaacaaacaacaacaatcatctctttacttctctcttcacatcatctttcttgaattctttatatacacagtttaaag

SEQ ID NO: 3511 - DNA, 2000 bp, Arabidopsis thaliana
atatctttcatgacaatcataagcctaaacccatttgtagaaattttaggaaagtattaaaggatccacttgtgaaacaaagtgaaatggttgggtccactttcatatgtaaaaaactacactttgcggccaactaaaacctgtcaatcaatcatctaaggtcggggcataacgcataaaccaccatgctatggttcggtttaaacacctctttaagcaatcctctcacatttcaattgatatttcagattagtttttgctttggtttagttaggttcggttagtttgatttccgtaaattgtaaataaaatttaatcaagtcattttgatccggttttggttcggtattgttagcgcttgttagattacggttgtcttttcttttatataacatgtgttagatttcatagcatagaataatgaattaatgtggttagttagatgattgattaacactgaatgagtgaggtatgtaagatgcttgtttgcaatgaaatttgttgcagttaaaatcaagctaaattgacataatatagtatacattgattgaccttaataaataaaaacattcatattcacgaaaaaggattaaaagataaattttcgtaattataaatcataaataagatttttgtgatgaaacttacctatttatttctactgtatttataaactcttaacagaaagagaataacaagtgggtatgtgattggaaagtattttcactctagtgttgctaatttgctggatggcacacttcattaccaatgccaaaacactaataatgagaatttcacatggccttttaattctaaataaaaaattcatcttttcttcttgataatgaaaaatgtatagacattaatctaaaaagacaactaactggaggtcatatatttgtgtaatcacgtttatatcatttgccttgtaaaattattagaggagcactaataaacaaaagttgttaggaattgattttaaattctgaaagttagtgtagacataggagtgagtcagatatccatagagaacaatatgataatatgtgaaaattaggtctgattcattatatttacagtaattagttgattgaatatgtcatttatgcaatatgggagacaaccaaacatacacacacaagtggctacttagtgattagtgatctgaaattagtagtgaattcgtatgttttatattcaatcacgcatatatatacgtgatacagtagtaaaaccccataaaccatatatgtggataaacgggaagtactgttgttaactagtggtcgatatcttattcaaacttcgtaagactttaactcacggatgattgaatatgttcatattgtagcttactagcttagtatctcactcatgcaccattccataatttttgttttctttgtaaccatctcattacaactctaagctgatcaaaactcgtttttaattaaaaatatacatgaatacaaattcagtctagtgatttatgttagtgtcgtccatgtgttaccaattgtatataaatctcatataatacattcttttaaaagaaaaattgtactatcatatatatataaacgaaatgatattttgtagttaaaataccatttcatttcaaatttagcaaaaaaaaaaaaaaaaaccatttcagaggaaaacgtcccaagaacataaatatttagcactaacacacaaaccacaaacaacttattgttgttccaccgtgttgtgatttatccaccaaaaagtttaaaaccaatacctataacagtgtttgtagttgtatattacctataatcatgacattcctatagataaaaacacataagataaacaaatgaaattgataggttaggtgtgggcctcaacgtgtgaaattttggacatccatcctatttgctacaaacgcggttgggtctcatgaaatgcctataaatacggacacattctcaagcaaactcatctcacaactaaatcttaagtagaaagagtgaaac

SEQ ID NO: 3512 - DNA, 2000 bp, Arabidopsis thaliana
aacgtaatacaaatctggctttacaaagcaataattcatgtttgtttgtctaatttaaatttccctgttttttttcccctctttctgtttcccatttgaaagtaaaagatcatttaagcacctaactcaattttattttattttaaacacctaatgtcatgctccttggctccttgtaattagttgatcgtttcaatttagaccagcaaaacattttagtatgttcgtaaatattgcgtacatgccatttcgtttgtcatgcaaacggtgtgtgtttctttacttagcttctagttggtgtatattgcgtcgcattaatatcggtttaccttcctcctgtctacgtaatgatatattctccaccacaaatttaaattcttattgaaatttcctaattttttaggtagctcaaggtctcaagtatactacgtaccctatttttttgaatatctatctatattataacaagagtttttctgagctagttaatgagatgacaatattctacataaataaatgaccctcgaaagtttcaagtactttaggatctgaccaaatcggggtaaaacattttgaaactaattacgttcacatctaccatcgatgattgacaagcttattgtcaccttttatgttaaagtgacatggtcttgacgttaatttgcatgttattctacatctatagtccaaagatagcaaaccaaagaaaaaaattgtcacagagggttcaatgttacttagatagaaatggttctttacaataataaatttatgttccattcttcatggaccgatggtatatatatgactatatatatgttacaagaaaaacaaaaacttatattttctaaatatgtcttcatccatgtcactagctcattgtgtatacatttacttgcttctttttgttctatttcatttcctctaacaaattattccttatattttgtgatgtactgaattattatgaaaaaaaacctttacacttgatagagaagcatatttggaaacgtatataatttgtttaattggagtcaccaaaattatacaaatcttgtaatatcattaacataatagcaaactaattaaatatatgttttgaggtcaaatgttcggtttagtgttgaaactgaaaaaaattattggttaataaaatttcaaataaaaggacaggtctttctcaccaaaacaaatttcaagtatagataagaaaaatataataagataaacaattcatgctggtttggttcgacttcaactagttagttgtataagaatatatttttttaatacatttttttagcaacttttgtttttgatacatataaacaaatattcacaataaaaccaaactacaaatagcaactaaaataattttttgaaaacgaaattagtggggacgaccttgaattgactgaactacattcctacgttccacaactactcccatttcattcccaaaccataatcaatcactcgtataaacatttttgtctccaaaaagtctcaccaaccgcaaaacgcttattagttattaccttctcaattcctcagccaccagccacgactaccttttcgatgcttgaggttgatatttgacggaacacacaaatttaaccaaaccaaaccaaaaccaaacgcgttttaaatctaaaaactaattgacaaactctttttgcgactcaaaccaaattcacgttttccattatccaccattagatcaccaatcttcatccaacggtcatcattaaactctcacccacccctcatacttcactttttttctccaaaaaatcaaaacttgtgttctctcttctctcttctcttgtccttacctaacaacaacactaacattgtccttcttatttaaacgtctcttctctcttcttcctcctcagaaaaccaaaaaccaccaacaattcaaactctctctttctcctttcaccaaacaatacaagagatctgatctcattcacctaaacacaacttcttgaaaacca

SEQ ID NO: 3513 - DNA, 582 bp, Arabidopsis thaliana
atgtgttttggttatggaatgtttgtactacactaagcttgattctaaattaataacatcttacaagtactgaaaatagtagacagtagacactatggtttatcttccattagaaacaattaaattataaaatcatttttgttaaaacagattaaattctctctttacacaagccataatactaattaattaagaatagggttacgctacgttgggagttgtttaaaagtacatattttcgtcctttttgcttctcccactaccatcaattagtggttgaaacagaaagcttatcagacagaaattggcattttcggatatgttggatgcacaaagtggtatataatacgtaagacttattcgtgtcaatcatgattcatgaagctatctaacctctacaagactacaaacacgtagaagtttggactactcatttaataatcgacaacaacccatgagctgaccataatgaatattattaaacaacccaagttgtttattttctcttaatcgttaagcacttcatctgaaatacaaaacccaaagaagaaagagattaaaaaaaactagagggcaacaaaa

SEQ ID NO: 3514 - DNA, 12 bp, Arabidopsis thaliana
ggtttcaagctt

SEQ ID NO: 3515 - DNA, 2000 bp, Arabidopsis thaliana
tttatataaaattaccgaaattcaatctacaaattcaaatttaaattaggttctctacatatcttaaaaagataaataagtgaaattcataatgataaagccaattttgttttgtaactattattagcttcttttttcttttttttgaagcaatgtatctaatctattctcttctaacgaaagagtattaattattatagacaaaaaaaaatagtattaaacaagcctacgcaaaacacgttcagtattaggttatagtttttagtactaattaaaatatgagatatgagtttttttgttctattagaacttaagaagataaagaatttataagttggtgcgactccgaattactcaaaagacaccaatcatcgcgttatcatcctaatctacaaaacaagaggtcaaattttgcatgtcacgtcacaatattgtacattatcatcacgtttttttacaaagctttagtatatcaacgtatacatttcaatgtacgagttttcattgtactatctatccctaagtttgaattaggtttatcgaatctctttctttatttatatgcaaattttaatgatgtcattttaaattattataagaaaatatccccatacaaaacatggtgaggcttatctcatgcgataatactttaaaataggttatgaatataatcatgtaattataaaaaaagtttttaattaatggggagaaaacaattagaaaactacaaacacatgatgatagaaaagtaggttaaaagtccatcacatggtgctctctcacagaacgagaccctttttgttgaacgttactgttgggcatgagattcacgcaaatcctatgcgacaaataattttctttccataaaaatctaaataaagaaagaacgtaccattttttatatcgaagttaaggactatatatatactattgataagaataatatactcagactatactattaattaaatggacccacgttaataacgatgtctgaaataaccaaaaccccaccagacaattcagacaatatttctttgtttctttatgcatgtgagttatttttattggtagagaaaaaaataaaaacaaataattaatttagtactatttagtacataataaattttaaaatatttcgaccatgtgatctatacttcttaagtacattactataatttgaatctctcacgtaggtacatacacacgtgtgtacacaaaacactattttctctaaaatttaccaagtgcaaatatcgttgtttcactaaaatcaccatcaagtatgtattacttttacgaaattaatcggatttggagacaaattcaaagactagccagatttaggggtgagataatccatttgcaaaatagatttgaaaagagattttagattttctatctttattcggagagaaacaatcaaagtaagtgaacttaaaatcaggaaacagagttaataatcagagtaattattaaccatggttaagttgaataaccaaagtaattaacgtgcataagtaaccatggttgggtttttaaaaagagctttcatacaaacttcaattaccccagcaagtcttgtctccttctctctctctctccctctctaactgtatcttcttcttcttcttcaaccttcagacttttctagttgcaactctcattcaattgttcaatttctctgtaaaaatcaaagctttttggaatctttcttcggcgagatatttcttcaccggcgcaagcttctcttgagcgtgattcatcactgggtttgcattttttcctggtgggtattcttcaaattgttcaaagctccgaccttttcttccttagaatctgattactggaatcttgaagctggagagactcgagtttatatggtttcaagcatcgttgagtcaatcattgagttgtgtagaagaaaggtttggttttcttctccgtttaagtggttttgggtttggtaggatttggtgtaatctgggagataaagaaag

SEQ ID NO: 3516 - DNA, 2000 bp, Arabidopsis thaliana
ttcactatatagcattactttcttttttcttgtttatatatcgctaaacaaaatgtatttttaatttgttttgaacaagtgtagttataacgccgaaaaacgattggaagaagtagcatataacaaaacaagcttatattctatccgaagtaggaagagaaaaagaactatatatggattgtgatcatgacccctcctcatatataaacaatgctatgcttacattcttaaacatgtgattttagtccagtggtttcatctttactgtcatgacatatgatcataaatatttttgcaagaggcacacatttaaatttactatgtatatagttattcctacaactaggttagtgaatggagatgccgtgatggttaaggtaattaataagatcaaattaaccgcgactaaaacacaataccattatttttggtcccaaacccaaatcatatttttatacatccatgagacctagatatgaagatcagatccggtctagccttgtataaaaagtaccactatactaattattcttcttcctcttcctcttgtgtttgttcttgttcacgtcttccgttagtagccttttttttttctctacaaggttttagatcttattagggaaagtgggaaacgaaaccccatgattctagagattagaaatcacaacgttatcagatatataaaactgagggttcacaggaaaccatttcgacatctgcttggaacaaaaaatgcataaggggtcaaaattacccaaacaaaactacaagtgagaaagggaaactacttgtggctagaggttgttaaaagacaatgacaaaatctattgaaggggttcgttttaatgggcctggtgaaatctcaaacccatcttccccggcccggtattacccaaaagaaaaaaaacagagagggcaatgagccgttctggttttcgatagagcgagagagaagatagaaggattcagaaggaaagtgttcgaaatgccgatgatcacattcacgttattgatggttgcatagaacagaagatcacaatgaacatacaatgttaagtcacatataagcaaacaacaagttttaaagcagcttcattacccatagtagttgattttaaatatatttcttgaatacttgataacttaagaatcaaaccgtgacaaaggaaatgttattttgaatcctgtttcaaatttaagtcaatgtactgtattctttttttttggaataataaatggataaaaatgtctacaactccaacatttgatgaagcaaatgttcctttttcatttttggtgatctacaatacctaaaagtttatttagatttttataaaattttgaaaaataagaagataaagattgaacaattacttaccactcaatggggatgcggttgctttggccttttcttcgtttggctgatgatgattcctcttccatcaccaaccccatctctttcttcacttttttaattcacaaatctctatttttaaatctcattaatcctacctaaatataaatatataaagtcccttttgccattgatagcaacaaaatcatcaattaatttgcaatataacacacacttactactacatagtagtttgaggaatctgggaagaagctccagtggcaaagactcaacatttgtaagatttctacacaacccatttcagtttttatgttttctattcacagattatttcgattgcagacaacatttgttttcttcttctttctgataatacgattttcgattcgatctcattgcgattattaagttttctgattgtttcagatgctatattatgaatcttaatctgatggttgaagattcatagatttaaaaatgctatctttttgcctatagagcctttatatgaatctcctttcttcattccatagcttaagagtttatcgaatccagttgaatttgaaaagatgcatttttggttattgattttgagtgttcttgtatcaaacttgttgtgtagaag

SEQ ID NO: 3517 - DNA, 2000 bp, Arabidopsis thaliana
ggtgaaacctttgagttttccgattcagcagatatatatcgtgaggagacgattgagcacttttgtgttcttcttgtcgtgattttgattttgattttgatttcagcaaaactcggaaatgcagagagactctcgtgcgaaacaaataaaattagaaaagtagtattagcctattagatctttcaagcgaaatttactatctctactgcttccaatcgcatagatgtagatagttaagatatttcaagtgtttttagatacatttccttagatttataaaatattaaaaacttgttatataaaatatttcaaaatttttattagaaatatatgactttagacaatctaaaatcttttgtccaaaaaaaaaaaaaaaaaagacaatctaaaatcacgtaatagtaatgttttaaatttttatcatcttgtaattttgttttggacaaaaaatatgtatgaagagatgatagcaaaatgaattcggcactacaaaatttgttttgttttgatatatgttaaaagtttaaatgtattcacctgtgaaaaaaatatctttcaaatcgagagaatgattagttatcttaaccggtgttccaaagaaaaaaaaagattagtaatcttaacctttaaaaatggatattatgactatccatatcaaaaataatatatagttcaaagattaaaaaaagtatgaataactctagattatgatgttaaaaacgatgatatagtatatttggaacacataatgcctataaaaatacttatacgtgtctaaaatgattatttagttcaaaaacaacaccaaaaattgtgtaagagtacaattgaaaacgttaacgaaaatttaaatatactaaatataaacatcattgaaattatatattattgatataccttacatatatttgggaaagtttataaaatatgtaaaagaaaaaaagggtttataaccggattatatctaaccgaattatgttaaatatctaaccgaattatgttaaattttataatagcctaactagagactggaagcaatgatatcgagcttaaaggagtgctattgatttataaatttatatagaatttgaaaatctttattaattataaaattaaaatatatgaattttaaaataatatgtgtttatccatggatttgaatccttctattttctctttcaaatccatttaattttatttaaaacataatttggattctcaaatccaaaaacaaatgactaaacgaataacaaaggattttaactagtatttataaatcattgaatcaataacacatgatattaattaaaattttaaaatcaataattaaattacaaatgatttttgttcggattttcaattcattataaatctataaaccaataacccttcctaaacaaaaaggtaatgaaaatatatttttaaaaaaagcttattttacattcaaaatcttgttttaaaatctgtaagaaaaaaatgaaagcaacactatcaattgtttcctacaacactttttaatcgatattaaaaaaaaaaaaaagatagttagagcattttcattggaagtatctcaatgagatacccaacaaaaaaaaaatatgagaggaaggagaaaaaataggagagaaggagagttgagtttctcttccgagaaactttgagaaactattctcatccaatttggacaaatgtcatcatactattagttcaattattaaataataattaatatatttgttttagttaaaatattaatatatattttttttagaaacttttcttgtttttagatagagatggtcttagaagccttcattttcaaaggttgattaaaaataaaataaaaatttggaatatccacttgcgatcctttcttggaaaaaaaaaaaaaaatcatatgattgtgtctggccagacaagctagctatctcatttaatttcccaaaaagaaaatataaagcacgttcttcgtctcggattcagagaaactaatcttgaag

SEQ ID NO: 3518 - DNA, 2000 bp, Arabidopsis thaliana
gaagaatttattacaattttggatgcttttaagtttttgaacagaaaatataggaaaaataaatgaaactagagcctaaaagtcagcaagtttatgtagtcatgattataaccattaaccaataagagtatgagaccaataaaagagagatgattaaaacacagaacctagctaagcaataacaaacaaacaaataagcaaaatggtctgtgaactgtgaagtgtgaacacgaaccggatcggtcaacaaaatcaggtatgactatttactccacaaagcacaaataatatgaagacacgtgtttttgaattatgtattcctatttgtataatacacgcgtcattcactcattagctgcatgtcatttttctcatccgctcgcaggtaggaaaaatacagtgtacctcgcgccgattatatgaatttatcagcctcatcataattcataaataataaatagacgaaatgaaacaattctggaatagaaatatgctgatctaaacaaaatggatgattataaaaatatataaacaattttaagaaaatttggtggatacttttcttatttttgaaaaatttcatgaaaagagagaatgtaaaaatagacttgttatcttacaattgttttctacattgcgctacataaaaaattaagagtacataatatatttcgtttgaacatttattccttttataaaattatgttaatgtagtcatgtttctaaattaaattaacaaaatgttaatgtagattaaatatcttacttttttttgaaatttcaattagtttccaaaatataaatatttctatatatagtataaaataattcataatcaaatcctaattgaaaagaagtaaagattattttaacaaaaaaggggtttgacattagagggtaaagacgataactttaacgacaagttttaggtggattaaaaaaagaaaagttaggttgtatcattaaatattccatatgcatcattttaagaggtgtttaaaattttaaacacaaatttaaagaaaaacacgatatttttatttaatttactattttatataaaacgccagaaaataaaataaatacaagtattcaactaataaaaacatattataaaatatgattggtcagaaaaaagtaaagtgaaagatcgctaaaacatcacttaaagtaattctgaggaagtattagtatttatggtaatcatttatcattacatattttttttactaacacagtctaatattattttttctaacactactacagttttatttactgtcaaaaagtttttaccatcttgtgtgtcatcaaacaaatctactcgcttaggtattttgaaatataaaattgcctaagaaacggaaaatatcgttggaaaaaacccggaaaatatgaaaatagtgtgaggagactacacccactatataaacaagagccaagcaggtgaggttagttcatcggtgaggttgagagtaattcactacacacacacaaaaaataaattgagtgcctcccccaaaaacaaaattggtagataacgagcaattgttttttttcagatttgatcctgaatttttacatttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaa

SEQ ID NO: 3519 - DNA, 1970 bp, Arabidopsis thaliana
gaatacactaatagctgatcacaaagttggatttacgaaacatgtcagtgttgatatacatatgtttgtgtacagacgtttcaaatcgtctacaaaaaaacggagattaagaattagagtttgtgctttagattcacttctgtgaataaaaaacgagacaaaactgataatttttcttctagatgttttaattttggtaattcttgtttataggttattttaggagtgttttaaagctggggtttcaatttgggtttgattcagttttttcttgagtttaagaaaaatattaatcaaactgaaattgagagtttgttatgtatggattgggtttattacggttcgattttagtttggtttagtgcttatttattttctttatgttgttctgtgatatgtaatatgaaaattgtttatacttactagtttgtagtgtttatgttttagatttcttagttcttcacattttcgaaacttggtttgtttagttgtctcattagttgaatatgtgatgtcgtattgtcgtacatcttacttacatgagtacgtcaaattaaatgagacttatctagtaaatgatattgttacatgtagatgcaatattagtcattgctttgtttaataaataatatttgtcacaagtgagtaagtgacagatgaatagttgctaattatagtgaatcatgctaatggtatattggacaaatatttttattttttaaaaaatttcctgtctaatttgttttttctagttaaatacttatacagattcatgtttttagactgtaatcgggcatgaccatccaactatttttgtcgaccaacaacttcaacgcgccagaaaagcgttttgagtgaccattactgtgtaaaacagtataaaatagaggtttttttgtcacgccattggtttaaatgaaaaattaaatttaacaaaattgaaaactttaaaaataataaaatcagataaacataagcgaacaacgaataaaatgtgcaaaaaaaatcaccaagtaaagtaatttgtataaaaatattcttagggttctagttactaatttgtatacaaaacataacaccaagtaaagtaattgctgtaaaaaacactaattaacatattcttaagaattataaacactaatacttagagatactttaggtacttatatcgagtaatattttgactgaaaatttactatttgactattcaaatatgttatcttaagccattacaatctcaaatacaaaagaaaaagaaacaaaaaagaggaaaaattagggaagtaataatgagagtttaatattcttagttaaatagattatactaataaataatgaggtatacaaatagttactgattttaatgaatcatcataaatagtatattaaacgttttttaaaaatttcttaaaaattatttttttgaactaaatactttacagattcaagttttataaaatatattccgaaaatatctacgtgttcgaaaaatatttattttacgttcaattgattcattgtttcaatgtcatttattattagactataaatatagtttaactatgtgattaaaaaccttttctaaaatttaataataattactataaaactttatagatttaaaagaaataacaaaaatatgatctaactttgggagaaaataattaaaaatttttagggagaaagtaattgaaaaagcaaaacaaaatcacaaaatttattactagtgaagggagtgagattcttatttctaacaaaggatatatatttagagatacgatctccttcggtggttcactcccatcatcgatgtacgtgaaaatatataaataaaaaatcaataaacgaaaatctttcctttttctctcacacatttttcttcatctccactcgaatccggaagaagaacaaaaaccaaaaaaaaaacccagaaaatcagagaaacataagcgaaccgacagagaaaaaaa

SEQ ID NO: 3520 - DNA, 1837 bp, Arabidopsis thaliana
tttttgctatgtgtgtatgttttggttcgagtgaagaatgtggtgaaggtgtggttggtatttataggtgagaaaagagacttgcatggagttcacgtgtaagaatacatgcatatgtttgtttgtatgcgagagctatatgattgttgtcgtgattaggtgttggaaactcaaatgtaaaggaagtgacaagtttccgcgtctacttgcaatatgcaaccatgtgtaactcatgttctgacatgtcaattattttgaaatgactagttgagagtcaatacggaaagagtagtagtgtgtcaataaatgtttttggaggttaattctgaaatacataaaagttttagcatcttgaaaaattacttatacacgcaggtcaccggtccattggatattgtctattgatggtaagacaatatatggataaagataagcttaatgtttttcactcccaaagtaatgtatgtctaagaatgttatggacgggtgacaaaaactagtcctctcacgtttcaccgtgacaaaacatacggacacgagtagttaggatatttagaattattattccaagtgtctcttaaaatacatatgttggttattcaggtatcatatacatgaaaccactttatgaactaccactaaatcggataaaagtgagattttgattaagaaatctcatatatataacactaatttttccaaaaatgcttaaaaatcaaattttgtttttaccgaaaacgaatcttggtttaatttggtaccaaatatatatcactctaaaccgaaccaaaatccaccgcatcgtaaccaaaacaaagctctgtttcgttcaaattgataaaataaaataaaataccaaaccgcaaaattgaaattccaaaatctccaaataaccggaatgcctagctctctctatccatggaaaaaataaaataaatatctaaagaaaagctgctaaagagactgtgagacaaaaacgacgatattttcctcttcctctcattatttttgttctcgccaccgaaacaacagaagttgcagactttatccgaatttagggtttcagctcgttctctcttctccaattatcagatccacgaaactctacttttcggatcaggtaaaatcttatcttcttctgattgcgtttgtcatcttcttaagcagatttcacaaattgcgttttgctatttctttgatttcggtaatttcgaggtgaagtttgttttcattgcccgatccatataattttggagtttgttgatttgttttcgttcgtcagattggtatatcgtctttcgtatgtccctgaagattgtacgctagcttttgtttaggatctgtcgaatttgctgctgactttagaaaattggatcttcctttgatctgctgtggattgatgtaatttgtttagatcatatcctgtaattgagctggacctgcttaactaggttcctgggactaggatacagaacatacaatttatttatgaagatggcatcttgctcatttcgaatcttatgttgcaaatgataattctggagttggtttcttagctgaggttttagtttccccatctggtttatatatcactaatctctagatgaacatggcttgtatttggattgtgtgttttatcttgctatgtgtattatgcgttccctgtgttctttaactgttttctaagaccttattaatacttattttgcttttctcgattgtggtgtagcacttgtttattatttgtttatgagtgtgccaaattcttatcctccgatggccttcatgttcaggtctcagcttctctatcgtttgcccctcagatcaacaaagtttc

SEQ ID NO: 3521 - DNA, 2000 bp, Arabidopsis thaliana
ctcggatttttaccctcaaattactttttttttacttgttggcctcggctagttattgggccaattgtttctatagtgggccgtgtattacagacagacacacctaaacgacgacgggtcgagaggataaataaatgggaatattctcggaaacattgatgtgattccaaatattttattcccaatttggtattcttcttcatcatagctcgaaaccctaactccccacttccatcgaccatcgacatgttttaatcttagaattgtgaccaataaggtgatggatacatttcaaggcaagtccgaaggcctggaaccacaattggcatcgaaggatcttcaggcgtcgaagccgataatttcatcatcttcttcgttatcagagcgtcgatacaagagtggtacttttcttttctccaattctcgatcatacttgaatcatatgtgtttcgttttgctccgaatttctaaatcaatcagaattacgtggttatgtatggctgatttgttagaattattagtgtagctatagaccaagattttttcttactcaagagttgtgattttctctcgcaggcagaaagatacctattattgctattgaatgccgtagatgcttatcagtctcttctccggtagttattgccgacccttgcatgcacagattctgcggttaggttcttctttactctttctttaacccactagctaatgtgtgtgactgaaaacaatcagggtgtttagctttgtcttattttaacacaaacccctgattctggactaacttattaccctaacaaaattgtctttttttctttcttaatgcaacagtgaaatgtatcttattcctctggggacgccagaaacgtagagaaccttgtgtatgcccccttgatggagaaaagatgatttgcttacatcctcctatgaacattgccgaatctgcggctgaggagattactggccttgtcgacgtttataatcctatgttcaatccacgccattacatggtaattaatcagttcacctcctaatcaattgaacatgctctaatattcttagtaagggagtagttattaatatcttttctaactctctgcttacgaacattatgttgtttcttctttgaacggaaaatcattatgcatttttaggacatggccgagacacaacttggtaagttccttgatatatgctttatgtatagatgtttttagactttgttttgttgaacctaactcttttagttacacgttttttttgtagcgcggacatttacacggttttactgtttggatctcactctcctactcatgggggcacttgcgtactgcttcaagtgttctaaagcctcccgcacttagaagtctctattttaattctcttggaacgactttatgagtatgttataattaaactattttaatcctgaattctggttatggatctgtgtcattttggtcaaactcatcatgtctttttctccgatatccatccattcctaaccttgttactattatctatcagtctttttgataattaatacaaatgttgatatgtagagtacgacgaatcgtaaattgtaataattgtttcgttttgctgtaatttggctctatctttatacattagaagagataatcaaaaaagagataaaaataaagccaaaataaatgtgttttttttgcgctggtcaaagaaaaaaaaagaagtccaaatgacagttatacccctaataacgcaccatgagaactcagacgattaagggtgtaatagtaataacaagaagtgagtctccggtctgaaactaattaaggagacggcaagagaaacaagacatacgtttgctgtcccacgttgatcttgttgtttactctctctctctcctccatcggcgacgaccaccggagatcagcgtcaccgtaccaaaacatcatttaccttcttttagatttgttgttttttaatcagttgaatcggaataaaatatcgcatcagag

SEQ ID NO: 3522 - DNA, 1392 bp, Arabidopsis thaliana
acaaagcttaagaagaaggaagagcttttgattaagagcaagaaatagaaaacgcaagtggctatttttgtctgtccatatattatgttagtatattagtccattgttttttttttaggctttctctctatttccttagattttgttaaaaatagttgcaaactctcaaatattagtagttgatatttgctatccatttttataagatgagaaaattacataactgctggtcattattttgaatacttcctttctgtcacgcgtattggcatattcctcaaccaacatacgaaggccagtttgttatcacaagtttgcaagcccattgtcttaatatctcaactgtctccagaagcaagtctcataacatctagaagaggttgttgagcataccaagtgtgttccgaggaggataaacatgggagactccactccaaactccattaccttcaccacctgcctattcagcaaatgaagaatcagagtgtgtgcatggcatctctccgaaaatcccacacagggtcttgatctttgtcctccacgttcatcatcattttcatccattattgcttactcgccttgtccttgacgttccacatttgtctccagccaacaagtattgctggtataagctttgatagtttgtaaaataaacattagctaacataaatactcttttgcctcttatcaaaaaaaaaaaatgatgcttcacaagttaacacaccttcaaattttcttaaaaaacatctatatgcaataacagaattcaaattataatgcaataatgataagaaaacatttctcctccatcaaccaaaacgtgaattaacatctatcgaaaataggtgcttcacaagttgacacacttgacacacaaaatctacaagtgtgagagcgcttgttcataacgagtttaaagaatcgcaaaacacactcatattaataataatcaatcaacttttggaaatattcaatactcttttgttgatacatgtagtcttctaagataaaataaaaacgtatacactaaacagttttttttttttttttttggggtcaataacagaatctaaaaattaaagttaaaatttaaacgataaaagtatttaattgggacgtttatcaaaatgaaacaatgcattggatcggctttaaaaagcaaccaaaaaaaaaagagctgtcatgattgatattcatcatcacaaaataatgaaaattgccttattcacgtaataacaaaaagaaaatgattttataacagtcgaatcgtacggcagatatttgttggcccctcctcttatatgatatcatagtcaacaagagaacaaagccacagagagagagagacactaaaaccctaatctcttactcactgtctctcttcttcaatcc

SEQ ID NO: 3523 - DNA, 1464 bp, Arabidopsis thaliana
cgctcaagagtttatttttgatttttttttatggttcaatattcttttggttgtctttaaagcagtttttataagagagaaggggttaagcttttctaaaggtaggtccgtatagattttgtttccttgccgggaaagacttgaataaacgttttaaccaaaaaagaaaaatgcaaaagatttacgtagtaagacacggattacttttaccattttactccttctcgaatcaccattactaagcatcaaatattttcagtcatttcaaacatcagtttttgcgtttatatttgagtaaaattgaaaattttccatagagatacacaactatttagcgcaacatacaataacattttccaaatagaagaaaaaagaaaaaatttacttgtttcttaacgttcctactcaatacacaaactaacaaacaagttaaaacgagtaaagattcttggcgaaaacaacaacaaataatgattcaatattttaaaataacacataaacagttggtctaaatttataaataatctctaaaaaatatcataaaaatcacatggtttcattctcatatacaaagacagtaagaagattttctttttttccgaagtggtcttcaatgaatatcgagttagaaaatggatttttttttcctactaattacttacaaaattttgatgaaaaaatagagtagacgaaatttggtagaaaatttcttgcgaaaagatacaagaaattcactaccaatttatgtaacatttggtaggcaattcagaagaatcaaactagattcatgacatatggggagaaatgcaagaaacaaaaacaaccgaggatgagtcttatgctcttagctaaaaacatttatttagattttaggtgtggttgcgacaaccaaaaaaaaaaatacattacaaacgattgacgtgctgagcgagaaattaagaagtcgagtccctaaacccgtaggaaccaaccatatatggtgagaccactgtggaatctgccagacaacacccaagcatattaaccataaccacagtggctgagcaggaaactgtttgactggtaatgactcattaacagaaaaattaacattgcagaaaaaaaagttataataaggtaaatggatcgtcccaagatcattattggataattaaaatcactggccagtggaattaaagcccaaacaagcccatgataactcaaaactagatcaaccagtaatggcccatgatgtcgtacttgaggtgacgtggcaaattctgaattcgcgcaccggtagattcttttctttttccgtataacacctttcaatacttgaggtgacgtggcaaattcacaaccactttttatatgatataccgcttttaccccttaagcctctccgcgtaaaaccgagaacaaaatcttaagcaccgttgttccgattcagagatcatcgtcgtcgtcgttcagaaaccttcaaaa

SEQ ID NO: 3524 - DNA, 648 bp, Arabidopsis thaliana
tgcgtttacattttttttctctttcttttgtattttttcgagaaatttacattgaaacgattactatattctttgctggatttacttggggaagtttcgctgaaatttagagctttaaaagctttctttatcgtagagaatcttgtggttccctgaccatgtaatatttttcaattgtcctatctatgacaatgtaactaaacaaacaatttcgttcgtacacttatacactaaacaaaaaaaagtctttgatatagttttatttttctgttatgccaactatgtttgtgttcttaaaattctacatctctaaaaacagatatattttccttatattacataaaaatggtttacccataaattgatgagttttatcaagagacttgcaaaatattgtggagatcacgaaaatgccttgaggcccagatattaatgggcttttaggcccatatgttaatgagatccaaatatttccaagttaagtaattggtaatgacggtgaaggtgcctttgactatcttaacgcgtacgggacggtcgataaatttagttaaagtctctttcttcttctttactttttcttcttcttttagatcaaagaaatcgttttgtgcagatttgatcttgcgttaattttctaagcaaaat

SEQ ID NO: 3525 - DNA, 1498 bp, Arabidopsis thaliana
atcgcacattgtaattctattcactgaagcataatgtcatattacatgagtatacatatatgcatggagacgtgcacagagtttgtctttgattatttcgatgatttttttttttcgtctattatttcgatgatttaagtaatgatatatatattgtattcagttagtcttgattgtatacttttatagtagacgatgaatttgtacgcaaactatattaaaatatatttataaaactgatgtcattttggtttactatatatcatcttcaagtcataatgctagaaccaaattgcagctagcttcttgtgagtgatatagtagatgatgaatttgtacgcaaattatatacatgactctgagcttctttggcagttttcctagggtgtcatatacatgactctgagctacaagcctttgttgttgtcatatttcaagcaattcgtttttttcttttttttcttttgaaccaaaaacccaataatgagttaagtagaagtttataattcacttatgggtacaatccaatataatttagaattttcctattggtttgagaatccaatttgcttgaagagaaaatcagagacatggaagctaaagaagagagattagaagtttatgatgtggagagtaaattgaatcggttgcaattcggtttattatactagatttttggtttggcattaggtttatgacgttaacctaataataaactacaaaatttggttttgtggagactaaattctctaactttcgatttaggaggatataataatttaccttctattttgtgttgactgtaaacgaagttctaaatctgtgtagttgtggtactatgtgaaactgcgtaggggaatagaggtcgttcactcaagtttataagatggcacaaatagaaagaaatcaatttagttgttctctcatttgaaaggaattcaagcaatatggttgttctcgtctttccaagatgcattgaatagtaaagcatctaattagtaaagttctcataatgctcagttgctcacattgatctttttaccccttttaattagagtacagtcttgtaaattacgttgttttagccaagtttggcctatgtaataatttatttgggctttaaaaagcctcttcaaattagagtattgctgctgcagaaaaagaaaagaatatttgcgtggagaaaataaaggaaaacaaatccataattagtagtcggtgtatacatacctaaaaaggcagagagacgttaagattcaaatttcaaaaaagaaaaaaaatatgagtggcaggttcgttattaatgataaaacttaggggcaatattggattaacaacaagtctcctgaatcgtggcctcctaagtacacgctcttgtataaatacactcgcatcaaactccaaaacccttatcactctctcattaatcgaacttggcgtgtttaaataatcttccgatcgttaattctcttccgatttcgattcgattttagcggcg

SEQ ID NO: 3526 - DNA, 1245 bp, Arabidopsis thaliana
gtaatgaaatgattattaaaggtttatctacatccggattcataggcattagttttgtggagaagagaaatatgagttttgattcgaatctctttaccttaacactacattagaatagaaaaatctctggaaccggaagctctttgaggaaaaggaaaaggaaaaatatgaggtttatacgtaaatgctttgtatgctttattgttcatgaagtttttccttatctttattgtacactgatttgttttgtattatgatgttaaatttctttgaaataaagactaaacatgtctaaatctttctggtttccttccaagacctgttccaacatttttgaccctcccataaattatgtacacagcttgtttgtaagataagggagcttcctgaatccttttggttagacaaagagacatgaatcaatcataaatacctcttgattcttcgttgtggacttggcttatcagatattgttcgaatcacaagatttggccaaagtttcctgaagttgacatcaacaaaaagcatctgctgatttcaggctggaaagggccttttaaaaaaaatccccgggccatatgaccatatctgtctgacgtggcatcaccaagggctttcctaattcagtatctcagtgccaaaacgacaaaagatcacagtgaggccgactaatcatgggcctgaccgttgatccacgtgtctttgtattccacgtccaaatctcaacccttcctttacatatgccatgtcatcatctttttcaccatttttttgtgagttttatgtgtgagttttttttttgctgtcattaatttagaaacaataatctcgttgtatcagtatctctatttaatatgcaaaaatcagtcattagttttattttaataccgttgaaaaaatgcaataattcataggtgtgccgcagcagattttaacccatcaattttataggaacagagtgtgtcgtctctctacaacagtcgtaggcacattaatactataattgccttaaaaactccgttgagtagacaaaaagagtgcaattccaaagcatttcttattcttatagattttaaaaataggaaaaaggtgtaaatctgcgaacattttggattcttcacgtttgtttatattttgggttggctctacacctactctcagaagtcataagccaagcaaagggggttttagggtttttgaccgcgagccagatctctttcttttgtttctcccacttccgaatca

SEQ ID NO: 3527 - DNA, 2000 bp, Arabidopsis thaliana
actaacaaaacttttaacagaaacattcattacagaataaagaaactagatgaattgttgtgctatatagtcacaactctagcatgatagtcaactagattagaacgaaaaccataaccaaaagcttcaagatttcaatccatgctatcacatatccatcacatgagaaccggacaagtgaatgccaatgccaaatattataagaaaatctaacaaagctataatctgaaatatcctcataagcctcatgagtcaatgatataacagagacataaattgttcgaaaagccacaagtaggaacgtataacctgagcatagaagtgcatacaaagcaattttcaatcgccttttatcacatgaaagcatgcaattctgagctgctgaaaagggaaacaaaagataacctggtaaaagccaatgacaaacaatatgatgattattttagtaaaaactggactagtgaatgccaatgacaaactataggacgattagtataagaaaagcattctgttagaaatattaacaggtgcagagagctctcagttctttcacttcgtattaacacagcaaaaacttccactgccaatgagaaaagcaaaaacgtgccataagatttcaggtgtgtgtcaagcagcttttggttttcatttcacaatgaccaatgcatacactttcataacgaattcaactccatttataaatcttgttttccaacagcatagatcaaaggctaacatcaaattattgaaaacaaggaaaccaaagccaacaaagttataatctgaaacatcctcatagcctcatgaggctgtcatatgactttgaaaagacacaagcaggaacgtataacctgagtataataaaactgcatacaaagcaatttccaattgcaatttatcacagggaaagtatgcaactcagagatgttgaaaagggggaaaacaaatgatcacctgataaaagcagcgtccttagacaacattgaaaagaagaactagtaagatggcttataagcccaatgcgtagaagagaccactcaccctcaagatccagcttataagcaatcttaccattccttctcttcaatgtaaaagattcattaaaccaactgcaaacatctccttcctaaccatcatgaactcactcatcaacactctactactccactttattgcttgcacataacaatcaccatagcttaaactaactttccacattaaacctctagaactaaaaatgctcaatttcaatactcaataaccagaaaagttacaaacttaacaaaccaaatcagatgtagtttcacctatcatcaaatgaaaaacagagacagagaatttgggtttctactctaacaactagaattctcgataacaagaaaagttacaaactttacaaaccaaaccagatatagtatcacctatcatcaaattcaacacatttttagatagttactctcacactcgtaatcattgtacataatcgaaaaagagattagaaacaaaaatactcgaattcaaacttaagcagtcacagtaacttcgtgcaggagcttaccggagatgaattcatcataaaccggcgacggtagcggcggagcaaagcaaaaatgcgatgattcatggaataggtctcaaaagtcacgagaggatcacgtgagatatcttgaaaagaatcggacggctaagaataaagcagactaattctcttatctatctctaaccgttaaataaaaactaaagttttaaccttttaacctgggactagggttttcagatttcactactcttgtcgtgtaagacttgagcaactatataatctcaacttttctcaatcactatccgctgcggtctcgccgtgctgcccacaacaatctccgacttcgtcttcctcatctatcatcgtcgtcgtcaaccttatttatctcttaatttatcattaaaaccaaaaaaccaaaaaaaaagccttagctttcgtttcttcaatcccagcaaaaaaa

SEQ ID NO: 3528 - DNA, 953 bp, Arabidopsis thaliana
taaaaaataaatataatcttgtatggtgttagaaataaaataaaaattagaaacaatgatagctatatgccatactttccaaaataaatttagaaccaaattcttaccatgatgaattctttgattttcaacccatataacaatataagatatatatatatatatatatacatgaatatagtggaagatgatgagagaattactatatataagatgtaattaaaaatagacagtgcagatttattttaaaacaaaaaaaaaaaccaaaaaaacaatgtaaatttcatagtctaaaattaaaatttagaactaagcttttacaatgatatttttaaactcatactacgacaacaataaaaaaaaaacttaaaactaaacaaaaaaataatatttgagatttgagatatgtggaaggggatgagaaaataaatgaacgagaaaatgagtattttttattttattttagaaatgtttcattttttttgacacaagttaatttttttatagaaaatgtttaaaaaaatatttaagatttgagatatgtggaaggggacgaaagaataaataaactttacatgtgatacaatgttatgagttactgattttaaaaattatactttatttaacaggatgatttcaattggaaaatttaaaagttttttttttaactaaatgttttaaaagttttatgggggaaaaaagaagaaaacagaaatggaatggattaaaatccaaaaaagaaaatatcgacccaggattggtgaattctttaattaggcatttcgagcggaagagacttttcggggccggcccctttttaagttcgtccagtccattccagctttttgtcctttcacatctaaaagcgggagagccaacaaaacaaccttcttcctcgcgaaaacagagagaaagaggaagaagaagaagaagtctctgagaaattttcgaac

SEQ ID NO: 3529 - DNA, 2000 bp, Arabidopsis thaliana
ctgttgaaccatttctaaaaaaacattgtttctgttcgatttaaatgtgggggaaaaaaaataaaatacatgaaatataatcttagaatctaaggaaacttattattgggcaataaataagaatttgctgaaaagttttaggggcatcttttggaactctcaagtttcaaacaatggtgagtctaattttaaataattgtttggtgtgtttagtaaaaaaataaaataaaattaatacacatgaccaatttacgtatttgttattagggaaattttttaaaggtttatacaattttggaatgtttagttatttttaaaaacttaaaagatttttttttattgattttggtaaatgacaaaaactttcactaaaaatttgaaaacagaatgtttgacggatgctaacaagcttttagaaagtattatttcgaccataaaattggatgaacactggatgtaaatggaattgataacaaaagaaatcgagatataaaatatctattgttatgtcttcattcagcttataagatttatcatctattggcaatccgaaaagatgcaaaactctttgtgatatggtatgcgctaatgttcatttaatgcctcaagtttcacccattagaacacaagaagaaacttccgaagatgctgcatgatgacgaaaacatacgcttaggacgatgttttccaaaccgcataaataaaacagaaaattatagtttggtggcacgcatatgggattgtccttctaacaaaaatgtgcattcacaatagttcttacttagaattgctaaactgaaaaactcgtgtgaaaacttaagctaaatatgtaaaatccataaatttatgcatagaggtaaacatcaattttttttatcatcaagtaaaaggcacatgacagattcatgagaatagatgaaagataagaatgttgaattttaataatttaaattgatgtgtttaataatttaaagaatcaaaaaggaatttttttggtaaatatatataaaaatttctatagacaattatttagaaaatcaaaatataaagtaaacatgtaggaaatatacaataacatgtatcaataaaaatttggttgccctaaaaagcctaaaattattaacagctcgcgagagcattcttgatgtaaacatatgtcttccattttggagaaaacaaaaaaaaatacattgaaataattgaaattccctcaaaataaaaaaaataaaaaaaagtattcaactttttatttgaccctctctctcctcttccctcttttcatggtagacccaattctctctctctcttaacaacactctctcctctctctccctctctctatctatccccatttccatggaagcaagcagatgtgttcttacatctctttctctctctacagccttacatgaacagtgactgttctctctctttccctctccttccttttttcttctacttctccttccctttgcttcgaaaagggtatctcgtgatctttatcgctcaaaaatcttcactttcaggtaacgatttattgggtctctctctctctctctctctctctctaaagctctgttctttttatttcttctttttctgggttttattctctgattcttgctagatccaaaagttctttattttgcctcttcttcttctttactttaacgagatctgtttttacccttaaagactcaaaataaaaatccaaactttttgcatgaagagctttaattgatttgtcacttagatttgatatttcaatttgggtaaaattttgtgcatctacttaaactttcatctgtagtaagatccgtgattgttgtttctgagtcttctcaatccagctttaaactgatgctattgttttgttttgatgactatagatcaggccactcgttgatggaatctgtgacagtattgattactagagagtaaagacaagttctttaaatctcagggaagaaggaattggtgtttaagattgctctgtgtta

SEQ ID NO: 3530 - DNA, 687 bp, Arabidopsis thaliana
cgccaatcgccactaacgcctgtcgtcaatttgggcttcttcgggagtaatgtttttgtcacgtaaattagtttatggcctttaattggataattcacggtccacacgttcaatactaattgcgattatttatctcttcacttttaatcaaaatttccaaggcagagacacatgtaagggttgatgtatatagtcatcaattcacgagattattggaatctttattgcataaacaatatcaaaattgtgtttttatatataccctttcaaaacgttatgggattcaaaattacacccacacccaccacttattgattggacataacatcattcaatgtaaaattacacccacctcttattcatgttttaattttcacttctgtatatatttttcgaatttcatgtattctgtttgtacttttttgggtcttatgttaagcccatttgtgggtttgtaaaagtctttgacaatatccaataaatcagtgaaaaaaaaaagaaaaaaaaaattattatcactgtaaacttcaaatcaattcaacttgtgctttacatgggtcttcgctggaccaatatgttttgtgggcctttcaagcccaacaatagttatctaccctagctcaaaaagagttatcttattctcattctctctctctctgccgcagctatcaatttactggagaagag

SEQ ID NO: 3531 - DNA, 557 bp, Arabidopsis thaliana
ctatctcactaagctgaagatacgataatgggagttacagagaaaaagctaagaatcctccattgatttggtttcccgcctgtttttctttgtcgtagttaccgaactgttgataaagcaagagatagagactcggaaaatgaaagagaagaagaagatgattcagcgttctctgttccctggtcgatgagaaaatgtttaatgggccttagtgataagttttttcattaggcccattatgtaaatacaattcttttttctttttctttttgttgtatcgtattgaaactttctcgtccacgcatcttctgggttggcgaagacacgtcagcaatgcaaccaaaaaaaagaagcatttaaaaacaatagttgtagtgtggccctttctcatttcttaaccacgtcgtcgacacaacaaaccgatcgtgttacgtctctctctctctcagtctctcatcaccgacgaagatcacggctcttttctctgtttaatcggcggaatctctcttcttattttatttttcttccggtagatcgatccagctccgagatcaatc

SEQ ID NO: 3532 - DNA, 2000 bp, Arabidopsis thaliana
tattctttcacaaatatacacatttctattataagtttataactattagacttctaaaactgttaaaattatttgttatcagcaaaatcaaactatttatataaataaaacattaataaatgatgcaaaaatcgttaaatctttaaataaccaaaatttctattcaaaaattaaaactaatcaaacaaaaataaaagtatgtactaaagtaattttaagaacaaaataaaaatttccaatgaaatgttactacattatggctctgattggtgatgacaaaaagaacaataggaatatgaatgaaaaagaacaaaaaggaacaaaaaaaaggaaaatagtcataagtaggaaccaagaggaacataagaattgaacaaaatgattatggtaaatggtaaccaaaaaggtgaactaatatttaacataagaattactaaaaaaatcatttattgaattttgtttattaatttcatttaaaattaaagttctgtatgaatttaaaataaattaaattataaatttctcttcaaaacatttatttattttatagtaaaaatttaaattatattacaaatttaaaataaatttcactttaaaacatttatttatactaatttaaaataaattcataacattcattaaattgaaagtttgataaaaaagtatatatatatatatatatcaatatatactaaagatatagaaaatattatatatagaaatataaatattatcataaagctattttaaattgatttaataaataaaacgaattttatttttttgctcctcttggttcctgtacaattttggggtggaacaattttgttctatcattcctttttttttgaaaaatgatgatgaaaaatgtaggacccacatgtctgaaaatggaacaaaaatacgttgtaaatggtaaaaaaactaaggaacaaagaagaacaccactttcctactcattcttttcctcaaaagtggttatcaatcggaacctatgatatatatgtttttatataattcactaacaaaaaaaacaatcttaactaaaactttttgcaaacactattatttttacattaccttccacacatcttatatttttaaatataatgataagtgacaagtttatgatatatatatatatatatatatatactataatttaattcactaacacaaaaaaacatatacaaactttaataaaaaaccatacgataatacttacaacccgcataatatgcggtacacaacattagctattgtgtcataaataacactatacatttttctatgtacattataatttatacactacaatatatatatcactaaaaattattctaatatgtttattagaatataaaatctccaagtacgtgcgggtcagaatctagtttgttatataaaaataaaaaaccaaaatgtaataaaaaaatttataataaactctcataaaaacgaattaaaaaacattactacgttaaaataatcttaaacttcaacagtcaaattataataatgtttataaatatatatgatgatattcttagaatcaaatctcgattttggtagatttcgattcggttggattctcaacatttctttcaaattatctatgattttttttctttctttctttttttaaacatatctgaactctagaacaagcgaccgtgagtcataaataaaaggaaagagatccaaaaatataaatgcaactacttgaaatcgactaaatatatcgaaatcacgtgacaaatcagcattttatttattctattaactttatagttggttccacatcctttcactctattcgatgtattgtacacatctggcacaaatctgcatctctgtcttcttcttcgatcctcgatttcatccacaatatacaatagccaaatttccgattttctcctcactgaatctctagaatccatcgttgattcaaactcattttccgatcaaacggcatatttttccctctcgagagagcgata

SEQ ID NO: 3533 - DNA, 1911 bp, Arabidopsis thaliana
tgatggtgatgataacccagaagaagaagaagagattgcgtgagtttggggaatttctaaagcatcggtggcgataagcgtgatagctcacaaacggcgtgaccgagttttttttatttaattttaaatttatttatatacgtcactctttggcctttgcagtcaataaccggagcggaccatcaaaccggataattgagaaccgaagataaaaatgaaactaaccctagggaagttactatttttttttttggtcaaacaggaagttactattaatttctactaatgaatacagatacaaggtatctgaatctgagagctgagattagaaagtgattgtttggtgggttagttagatagtcttccacaaagatatgagtgttggactgaaatttatctcactaatcaacttttagtgataaaataataaaatagtttacaacgtttatataaatgtttgttctttacttattttcccattcaatcatagcaatatactttacttattattttttaattaattaattattttacttaactatttatgacaatgttactgttgatagagattgttttgtgttactttatatttaatttcttttcttaaattaaataaaataacagattttttttataggattagtcattaatcgaaacaaatctttgggggatgtattatggcctatattttgcgtgggcgagacggatacctcagttggagttagaggtggattcagagatagtggtgggttttctcaagaccgggataagcaacacacatcccttgtctttcctagtacgtttgtgttatggctttctttcgaaggactagagagtctgaattacacatgtgtatagagaagttaatcatcttgctgatgggttagctaactatgcattttcgctccctttaggtttgcatttttatgatgtatgtcctgacggtttgtcgtcttgtttatctgacgatgctcgagggtctgcgtacccgcgtaaagttcttttgtaatatttttttgttcttttcataaatttgtagggggcattgccccctcaccttaccaaaaaaaaattaatcgaaacaaatagggttggtctagcggttaagcggaaattaatcggactagatgaagattttcaaaaaggagaactatatggtttttaaactatataaaaaaatatgatttacctaaactatgtatcctttaatttatgttacacttgttgacaacaagttcaaagaggaaatatcaaagagcggatatgtatgggttaagcttacttttgctaatgtcaatttgtttttttgttttccagtgtcaatttcattttgaattgtcttttgtcatacacattttgtcttcaattaatgtaagataatctacgttttctttaaagaaatgtcgtaaatcgtaatgaataattgtctacttcaaaaaaaagtttgaaaaattgttctttgactattttgtgcaactattttggtcttcaaaattaacaaagcattcacacaatgaaaaagcgggtaatttctctaaacagatatctactatttttgatttacgtcgctttttacctctaatggattatttgttcaacttttgtagggtttgtggtttttctcattgtgggattgtaccattcttttttttttcagtcaaattcaaaatttgactaataataatatacgctgtatagaaatttttttcactaggaagttaaaaaaagaaataaccagaaaaacgaagggaggaaaaaagcacagttcgtagattctctgtcataattctacgaatccactaaatcatcacacttgcctaaccaacccagaaaaaaaattcagatcttcttcttccctaacgatttatcattttcgatgagacattgttttacagagatatttttgttgca

SEQ ID NO: 3534 - DNA, 2000 bp, Arabidopsis thaliana
gtgcagctgcgagttggcagctctcggcgacggctagggttcgtttgtgatgaaggcacacctagagttagggcttagaacaagtatttatacttgagggccaggaattaggtttaggggtaagaacgtcattcccccgggtaagtaagtgatcgggccgaatagtgggcttcaggaaaggagcctaatgacggtggcgcaaagagggaaggacttgggcgtgaactagtgttcggtggtgagtttctcggagctgcccaggttcaagtctccttggccagatgctttttggacttattatttctaaacggccggttcttgacatgtcttcactctttgtgtcatatcttccaaacggctttatagattgttttgattcgacttctacgttaatcttgactcttctatcattccatacataccaaaatatctcgtttccgtgatagggaagacctcagacagatgctaaacttctgaagtactggaatgatcaccttttgatacttttaggttcaaaactcttaaaaaccttcttggcacctagaatacgtgtttctcctcttattggttctagaatggcatcaaatgctctctgaaatataagaaaacaatagctaaaacgggataaaaagtcgtgttatcaagtgcagagaagggaacccttacttttcaataattggtttgttgcaactcatatatgggagcctgctcctgcctttaattttgtgactaccatagacctttgggtgcagatgaggggcattcctattctgtatgtttgtgaggagactgctttggagattgctcaagaacttggagagatcatcactttggactttcatgatgccaccacgactcaaattgcttatattcgagtccgagtgaggtttggaatcactgacagacttaggtttttccaacgcatcatttttgattctggggaaactgctctcatcaggtttcaatatgagcggctaaggaggatatgcagtagttgttttagagttacacatcacatgaactattgtccatatcgacaacgcttacctaactatggaagggaaagacctgtcttccatgatgaaaggttcagatcgagtatgaattctcagtctcaaatgaatgataattcctttccagttcctatgaccccacctccaaggattgctacaccacagttgaatcatggaaagtttgttgcagcgcatccgtattttcctactacaagagaaggacttaaccaccatggtagaggcactagtcaacatggtctctgtcaaggacaacaagtctcaatagattctaatatcactccatcagtgggaacaacaatcacagctggaactcaacgtgtttatgaaattggccaatcttcaagaaggtttgaaacaagggaatcaaggaaacgtcaagaggagaaaggaccttacaatgaccaagatcaagcgcacatgaagagagggattctgaaacctccaaagaaaagataagcactctactaattctgtcaactctttttggtttaggacagcattggtttcaacaagtgcatatccaagctctgaaataatgcgtcgaaggggtatggccttcataacactttttgggttaaagagtactatatggctgcagttagtgtttttacgttcgctctgtaactttttgagtatacaacatggttaaccttgttggtttctgatgccatggttgttagtttacttgttttatgtgtatgtcttcaagctgtaagtggtagatctactattgtacaattatgatctaaaagaagacaacacttagtgaaaaaaaaaaaaagttcatacatcttatttagtctcatcccgtcacgatccttatttttaattattaaatcctaattaccaaacgtgtcgaaattcgaataatataaccaactttttgatttttgatttttctaaacttcatcatataaacaactttactaaagaggacaagaaaaaaaagaagaagcaaacagtcaa

SEQ ID NO: 3535 - DNA, 2000 bp, Arabidopsis thaliana
ttatgacatcgcaatttctctgtcggtggattacaaactgcaatcaaaagaaaagcatatgttaatctgtcaagtgaatattcgtttttattttctttctatacataatgtatatggataattcaaacaaaaagatgtgtaaaatgataaatatgggtgtttatcgtattttatatagtattaggattcatgcaaaaatgcatggattgtctatgatagtaattttggtaactattatttttttattttttttattttttttttcagctggtaactattaaattagtagaatttaaaataatttatacttttaggattcctatgatagtataggatttctatactattttgatattaggagtttaaaataaattactaacttattattattttaaattattagatttatacttttaaaagtattagatattatatggatttttgttgtttacagctctttttttttttggtatttgaactcgtattataatcggttactggcattgattgatacaagtcaccaattaccatcaccgtaagcaccgttttatgattaatttttatgataaatatacacgtgcatttcaaataattaccattttcatatcggaaggttttggataatctttctgactttttgtatggtaagagtttaatgagattgggataaaattggataaacatgaatctcattgtaaattggagttaaaagcattaataagacgatcacattaacgtaataattgcagtctacattcaaaacaaatctgagaatgtatgctttaactttttcctttaatgtcaatggaatcactcttcgtatccatttagaaaaggaaactagatcgtataatttaggaaaggcttacgtcgtgtcgtgtcattccctaatttttttggataatagttagatatcggaaataattggataaatttggattaacatagaactaaatagtgtaagagtaaaaaaaaaacattaaataagacagtataggggcttaaacttttttgttacctcaaggacgatattttaagtaaagttagctttcctttaatgtcaatggaaacactcttcgtatccatttagaaaaggaaatggatcgtgtaattttaggaaaggctttcgtcgtggcattacctcattggtcgtgaagaagtgaagatgtggacttgtccgcagcggatgatcggtggatggggttgagtaaacgaatgctcatgcagtacattagatgctacgtaggatcattgtagattcctatccacgctttattctttggatgattatttgcttaacaccgacgacaatatattcaaatttcctcaatttgtcaatcgctctctttttgcctaactcttattattattattattattttgcctaacctttgcgtccccttggagttaaataattgagtttatttacaagtgaagggattgaaacaactttttttttcccagagcttaatcgcaacgcaactcagaacgaaatatagaaaaatacatatactgtatgaatatacttcatcaattctgtaacctgttgggttggatcagtaagaataaactaaacatttagtggacaccaaatcataaatttagcacacaaaaataaaactagcccaaggcccatggttcgaaatttatcaaaccgtaaccgaagaccacgcgccggaccaacacagatctccacgaacaagatccaacggtccagatccattccctctccttctccctcttctctctaaccaaaaaaaaaaaaaaaacttctgaatctccgaaaaaagccaatcgggggaagaaaaaaattcaacggccgtctggttactgtcttgcttgcttccgacgatctatcttccccgagtagatttggtacttccttctttcgatttttaggttctacacaattgattctcgatttaaattttgtctccagtttttgctctctttgcttaccagtgatccgtttctcggaaattacttgattttgttaagaa

SEQ ID NO: 3536 - DNA, 790 bp, Arabidopsis thaliana
ctaagtgatcatgtgagtagtgtgtgtgggtctcaatctaatgtaatgatggaatctatggagatagagacatttttttgttccatctttgtctgtttttccagctgttccccacttgcctctgataaaaattgtacattttgatttcaagtaaggagacggaaatatatttatttaaggttacgttaccttcaccggaattgttatgaccggagataatcaaatctgaatttctgattgtctgaattgaccccaaacacaaccaatcaaaacaaaacacaaaggataaaaatgtcattttgacgggttaatgtatataactaataaagggtaaaattgtcatttgacttcaccaaccaacaaacactcttctcagtggctttttttttaattgatcggatcctccaagcagcagccgaagacgaccgccggcgatttccggttggcaattgttctcatctgatctgctttctcgcggtactgatctctgatcccaatcttacatcgtaaaatctctgctttcgttcgggttttgatgatatagatcacgtggattccttcttttcacaattgactgttacaaaatcacaacattacatttaatctctttcacgtccccaattgttgtatgaaatttgatgtatgtgaggtagaaggtcatgttctataagctcattcgaccaaatttgtgtgtttgtaaacttaactttgatttgttcatctccaaggttctctcaaaatgaacgtcagacttattgggcactcttgttttcttgtagctccaagttta

SEQ ID NO: 3537 - DNA, 2000 bp, Arabidopsis thaliana
attgatcacttgtctccttccaatttccctgtgggggcagtgcatgcacaaaagatggaatccatcctatagctcctcctttcttcactatcttttcaagtttctctttttgaatatattttttttaaattgattttgatttaactcaaagcccacacttcttaatccatcttctctataattagtatgccaacaaatatatatgcttgttctgtctcaaatttcaacaataaagcgtgtatagctcccaaaaagctatgttgatgagttatcactctttttatggattggactaatagtttgtctcatgtcaaaatgattatacataactcagaatccagcagtatagagaacttaacttttatatatatgttaaccctcataacctcaaacagaaaatttgtagtgcagtgtagaaaacatccttaaacataaagtaaatcctttaacaaaaaaaataaatataagtggcaaatcaagagattctgcttttgagtccaatgtatgtatagttggatgttctgaagaagatccattgttttggttgtttctctacagttaaacgatttttatatttaacttattaatgcaattgagtgaaaatttcacgatgaagaaaaaagttgtgaatcatgacaagttttgtcctcagttttgcagtgaaatcattttgcgtgaaaattttatgagagaaacaaaaaaaaaaaaaactgatcaaaagatcaggaaaggaccattcttaatttataacatgtgggcaagtcaaggcttgctggcatcaaacttgaataaatgtaatcatattcacaccatgtattgtttaatatataattttaatatcttaattggtcatctatttttgtctttttgcatcgcatatgtgtcataattaatatctgtacgatgtagaggctagtgaatataaagtgaaaacatagatatatcgatcttaaaccaatggtatcttacaccatatgtatatgcttgtttgaaaatatttattctacgaaagtattaattggattgattgttttcactctcttgagtaattttggataagttaatagttattatttttattacacatgattaaggtgtattgttaattataaatcatatttatacgaagacatggttgaataatgtccaacacagcttattttagcaaaaactaatgtacgaggagtgacatttagggtcttgatatttttgaagcaaaattaaatacgtctgcaagattttgcagagggaggcatgtactatatcatctgcaatagtagcaacatagataaaagtcataaacccctagatccggtccctttaatttaattcatatatatgatttgacataaaattacttttgttaaaaagtttgtttttacattaaattcttctatcttttttctaaatatcagtttaatatacatttgtaatttttcttgcaatccctagccagcttaatgatatcattttttttccttctttatatccagagaaattttatgcggaaacgtagattaatatcatcgaacttgttgatccaatttgttttatcttttaaaacatttacagtgattacaaaatagaatatatagcaagtaaatatccaacgaaaacacataatgtctttaacaaaaaaaaagaacgaaaaaaaaaagaaaacacataatgtcaccattagaaactcgtgtctacaccagaagtcattagtttaagatattcattttttttttttttgataagatgatattaaatgttgttaaaataaacaataaaaatgcaattatggactgcatatacacgtccaacactttgacaatctgtatcgctctctctctctctctatatatatatatgtcatggtctcactatgattgttctataaatacaagcctcctaactcataaaataagcataaccctaactctacaaagttcttctgattctttctctctctctctttctttcaagagcggttttcaatccattcgctaaagacc

SEQ ID NO: 3538 - DNA, 2000 bp, Arabidopsis thaliana
tttttgatattttgataataagagaaatagagctagatcaaaaacagagtaaatagaattgagagagcaaaaacagagtcttctttcttagaggatgctatggacgcatgtcaaaccatacttgcagccccttctcgagtcgaagatcccctttctttttgattgtcgatagctggtttctaatagtcttgtctatctgtcggatgaggtttgaagctgaacgtgacttctctccgtgacgacgagaatttctctccctccaaatggaatgaatagagacttggaatgtgtacctggataagaaactttggatgcgatcaggctgagaatcagatatgtaattcaccacagcagaccattttgtggaaaatctatctttgtacacattctttgcgattgatgtccagatttcagaagaatagcagcattggatattgatgaacattgttgtgtaacagctgtagaggatttcatatatgtaatatatgttatagttaactcatttaactcgataaataaaacaaatttagaattatattaacttttattgaataagtattttactttaacacatgaataatggatacgtctaacgttattgtcaaatgttaatccacacaaaagtcacaatttttttgatcctacaacataacacaaaaaaagagaaaaaatggtatttgaatcccgttacgttacagatacacgtatgtatgttagagtatcttcagtgaatctctcaaaaatgagtattggagtaataaaaagtgatctggagggaacaccatagtagattatgaagcttcaacacagatttaacgagagctttaacttcgaaaatgagtcacctaaaccaccgcttacaacaacgagaaataactatttctatgtctcctcagcaaagttccttatatgattttcttgtccttaaagaggtattttcttaaaacattactttgaagatatcttcataggcaaaaatctagaaattagaaataaaggatgtttaaaaatataaaatttaaggtttgctaatgctgaactgtgaaattaaaaccaacaaccacaacaaaccaaaccggaatatcatttaaaccaaattaaaactaaagggcgttcagtattcggatcgaatatttcgagtttgtgtatttcagatttagaagtttaagacccgttcgggtattttaaaattttaaaccgttcgagttcaggtttatttaaatattaaaatatcaaaattttgtatgtaaatttatcaaattacttgaaaatttcaaaaactctcaaaacaacacgaatagttttactttaatatatccaaagtaacctaaaatacacaaaataactaaaatatccaaatatccaaatattttctgtatttaagtatgaatataaataatatatcaaatatttgaggtatgtttggatatttgttcagatcgggtttgggttagagtttttcgggttttgaagtttaggacccgttgaatatttgaaatttttggatttggatcagggttttcggtcgggtttgggttggttcgtagggttcgattattatgtcgagacctaactaaattgaattacaaattggttttatggtttaaacaaataaagcgaaaccgaaataattgaaccgaaaccaaaccggaattgttatttgattgaacattttagatgcaaaaaatttgggttttttatttgttttaatattaaattaataccaacaataatatttgtgaattaattgtaactttgtaaggtttcgtaaggtgggccatgaaaccggatactcgagagtcgccggagtgtccttgccttcttctatcagttctgcttctgctttagaaattagggttccctttttgaagaagacgagtgtaagtgtctctccttctcgatttctcgctcatcttcttcttctttcaccccgcatagacctaatttaagctatcctcctctctcatcatcgcagattcacttcttctcaccgtgaagcg

SEQ ID NO: 3539 - DNA, 2000 bp, Arabidopsis thaliana
ttcaatttcatatatcgctttccattctaattttttaagatttggcataggtgtactaatcatttgcttcatctgccgaacaaattttcataattacttttttaaagaacgcatatgcggttataatttgtaccactcttaactttgcatatgaatttacttaattacttatgcacccattaatcaatggaagcccgaggtaatatgcaacctgattaaaaaatattacgttattattctgatggtccgtacatacaaatattactttttataattttcctatgtatcctttgtatatgaattgaaaagcattttagagaaataatttctatttagtaacaaattaatgagttattacccataaattattcttacgtctccatcaaaaagtgagtttagccttgaaagttctgtgtcgacgtcgttatgttataaaacaataaatacgaactcttaatcgttcgttgtcatataaaattaagaaaaaaatacaacatcatcattttttttattttttttgtcaaacttacaacatcatcatttctatcaaaaatttatgttaaaaaacaaattatgaaataaataattatttcacaacgaaaaataataataacaaatataattattttcaaaacaactttaaatttaatttctatatatagtatttggtataggtctatatatgatcgtgacgtgtgaaatataattgaggaacggtggatgattcttgaaaacaatgtggaagatatttaattcagtatgatgcttaaaaaaactcataacgttagctatgttttgttgaatattacatcacataaacgtatgggtgtgcacttagagcgagccggtgattataggtttgttttttttggtaaaaaattattgagagattattgattataggttttgaagctatcgatctgagctagagattaaggaacgaatccctctatgaacatttaaaccttgttctttttgcttattaactgagagattaggatcctaaaatctatacaacactagagatcattatccaaaagattttacttagtcccatttgcggtcacatttaattccctaaaagcatgaaaattctatcccatttgttttttccactagacttgggactcaaagcgtaatttataactatcttacgttagagagcattatttacgaccattatttaggctgaactcattatagacatcgatcaagctctagtgttaaatacattttctttgtgggattaatctttaaaggccttgtaatcacttactatttcgtaagttatgaagatttgggaaccggattatggctttgggaagttaagtcctatgactcaagcttacctttttagggttgtgtataggttctcgataaatgtttcagattagttcatttgtttttttgtttataaaaactacataatataaaacgtggaaagaaagtgataatgacaagaaataaaagtaagaaaggtggtggtgtgagaatcagattcgatgtcaactaattgaaagagagtacgcagctttttcttcacaattatatatattttgtggaaaagcttaccatacattcacaaagcattcgagatttgatttttatagaaaagtatttacataaagtattttctaaatcggtttctattttgtatgctttcagttttattttgtgttggggaagtgatccatgcattgagcttggagattgatggattggtaattaagcctattaagttaagcaggcctgtttctaaaatgggccctaataagcccaaactacaaaaagcaccgatatatcccacgttagatacatgtccacgtggactcctatgactggatgtaatctccaccacgcgcgatcaccagcttcgtctctcattttcattttccaatttattttcaaaaaaagataaatccagaaaaaaatttacaaaataaaaaaataaaaatctctatcttcttcttcgtctcttctcatcctcctctcaagctcca

SEQ ID NO: 3540 - DNA, 2000 bp, Arabidopsis thaliana
ttagatggattcgattatttattttagctcgttttggacaaagtaagattcatgggttttgtattgagtttatgatgcttataagctataattttcatgggtttttgtatttgtcgagattcatgggtatgagctgattcatgagttttgtatctattgtgtatttagaaactgatatgctttagaattgtgtgtcagtttagggtataatttaggtcagtttatcactgtcaataaccatctttcagttatatcaatgctgtattttcatctagttcagtattagattgtttgatgaaaagtaacaaagtatcaatatgtcattactaaatcaggatttatatgctaacagagttaagcttagatttgggaattaacaataagctgcatcggtagacataagtcagagaattttgttatacttttaatgtcaacaattttgcttatggaatcagtcggataattttttgcttgtatacatgagtaggataaagctgatgatgttctgtatcttgattgtgcctttatttttttcggtattgttgctttacccatagaccaatccctggtttcaacttttgtggaagcagcacctgttatggtattgacagaatcttagaacaaaaattataataataggtcttgttataatgcattggcaaaaatcatatcttatgtttaattcatcaaaatcataaatgaaaatagcagtatttcatagcatagaatcaaaacatgatagttcagtgccaaagaaaacaaaaagttacaaatgaccttgagaagtttcacgacatcattttattacctgcataacattcaacagtggagaagaggtaatatgttttcatgtgtccactagttttcaatctaattatttcacttagaatacgaaattggtttttcttgagtttgatttctttctttatatgtttgtagagtagatatcataaaaatggaaatttaagggggatgtattcaatcaaacatttcaagtgatttgttttaaaataacaaatcctatgttattcaatcatgaatttttaaaagtttcatgaaatctaatgttattgaattagtgattttaaaatctacttaaaaatcctatgttattgaaaacatttgaaggattggatttttgatgactttaagagacttaattgaatacacttttagcggatttccttagttaaaaatacagaattttaaatcccatagttttaagtggaatttgagaggattttataataaatcataataacttccttaaattcaccaaattcttcaaaatcatataaaaactcaaaataactcaaaatatacgattgaatacacccccccccctaaatgtcaaatataataatttgaatttttttgattgtaaatatgtatttgattagtaaaataaaaaattaatatggttagaataagaattaaaatatagttagatgaaaacatggacattttaatcgtttttcatattagaagtaactagatggatcattcagctgaacaaacaaacaaagttttaatgaaaaacagttagatgaatcatccagctgaactaccaaaaatggaaccgaacatcattcagataaattagtcaaatgtacgatttggatagattatctagatgtacatccgagagcaaacgaacaggacctaaaattgggctagtgtaataaacaatgtggggtggccggccagattaatgcagagaaattataagccttaaaagtttttctttctcgtcattttttttttattggagtccaaaactcagtataaatgggcttgtattgggcttaactaaatcttgaggaatcagcccagagcttggccacagctctcctctgcatctgagcattgctctcgtttcagattaacaacaacaggtttgctggttttaagacaagatctttgtcttctgatttaaaaattgcaactttaactttatacgaatagcagcaagatgattgatttggctactttatagttta

SEQ ID NO: 3541 - DNA, 2000 bp, Arabidopsis thaliana
aaaccacacatgtctgattttgtacgtatatgagtattagttgaattaatatttaaaattagtgactgaaaaaaaaatagagtagatatgaaaaacaacatagattaacgatgcattaaaacatttttcaaaatagtaattcatttgtttcagttttatccattatattctacaactcattgttcgtttagatatccataataattttttgcatccagtttagggttgttactcgaggacttgttcaatccggtgtcgttcttgttgctcatgtagcctaatgttgagaaaaccattgtctcgagccaaatttactccaatgtgtgccaaagttggtctctagagaagacatgttggagtacttagattaaagatctcatgtatatcaattcatattacttgtaatctttagattctccaaacataggatctcaacttaaaataattatggttggaaagcttgatcctaatttacaaacaacaaaagttgaattagttctcgaaatcacattgcagtgatatttacgtgtgaattttttagggcgtatcaaactttgattcacgaagtttgataattgttattaatttagcttccaagtaacatacacgtacggtacgtgacgtaccctctctctatttttttcttatgtccgttacgtacggaggaccaatcatgtatcttgcaacaaaggggaaattatgcttaagaaaggtattaggtgtgatactaaaacaataattttgtctttgattttaatttaaggtactataacaacttctttatgctaatgtatattttttaagtagcgggacttttccatgagtatttttcactgtatcaagtagaaaactcgtacacccgtgaacactataaaatatttcatcataattacgtaatatctacatcattagaacattataaatacaaaaataaaatatttccaattctttgataataccgaaaaatatatacttatgttatttttagtagttaagtgtccatattcagttattcacttcgaactcttctactgcatttaattatttttggccatccataaacgttttcagacaagaaacttcaaaattctatgatctcgaaaaaataatatgaatttccacctacaattctcttttgagcaaagaaaaaaaaaagtgaattgaggtctagctttttgcgtatataaaaattgaataatttggcgaaagataatgtaaaatttaccaaattgcattaaatatatgataaagaaaatattatttttactgtacataagtccaatagccgaaatgatgatataaactaataaccatgatcataagctataaccgtttctttagaaactaaaattaacatagccattactagaataccaaattcgtattacttaaattcaatacacatcaatagttatcataggtccatagccagagacgatatagcaattttaaagggcgcaaaaattttgatagcaactaaagagtggtcgtcccaacgcgcttcaatggagcgtggtaacatctttatcagattttagtggtgatataacatcatctttatccgtacactatgaactatgattgggcagtgtgaaccacacgttactaaacgcaagtggtcttagcaataactatattttggtagagacacattgagggaaagggcatacaccaaacatttaattatggatttgtacgcatgactttttttacacatacaaataattgtaaaacttttgtcaaaaacccaaatcgtgtttagtaatctctattcataagctagagaactatgacccctagaggttaaacttttgtaatgataaagaaagagaataatacaaagcaagagaaataaataaatgcttaagtcccaatttatatatagtcacctctctatacccttccctacacacatggagacactccaataaactcttcttctgcctcctctgcccatttctcccaatctctctctattttctcagtctctctctcagata

SEQ ID NO: 3542 - DNA, 779 bp, Arabidopsis thaliana
gcataagcattctttatttctttacttttgctttcagcattactcactccacatagctgtttgatttgcgagattggctcttttaagttttagaatttaggacttctgtccgaggtttgaggtctgtcggaccaaaatttggtagcaaatatttacaaataatatcatatgatcgatcatacaagtatagtttgaactactgataaaggctgtgattgataccagaccaaccacacctattggcagctaaccgcgttagtgatcaccaattgatgaaaccttaatcctagacggttaataaaaattggttcagatggacggtaaaaataaacagtttgacattattttgtgttcttgttcagttgactttttattattattgttttaccgctataatgttaccgacagagaaaagctaaaccgttaatgtaataatttgtttttcaaaaatcctacatacttttacttactttgtaatctcggtttgatattagtgaattcaggtggggaattttttgactaaaccggtttaaccatatcggtttaatcttacctactggacccaacacctcttacgtgaccccataaaacgcagagagccagcataatcgcgaccgacctcactgaacgagcgaccaaaacgcagagttttgacagcaattgagtggataccgaatcacaataatacagaaagacattaaaagcaacaaggaatcgcgcgattgggggcagttggagagacgaacaagtcgtggtgagattttaggaagacgaagaag

SEQ ID NO: 3543 - DNA, 931 bp, Arabidopsis thaliana
atctctttttcatcttttgtttctttggatatgttcattaaagatgtaacattgtgtagaattttccagctttatcaatggatacttttgaatcggttcatgttttggtttagatcagattagttaaaccggaatagaaaaatatcaaaacacaaaacgcgaagaagcacgtttggtgaaacgaaacgccaaagacgccctagacgtgtctctcttccagacccgttcgtggcggcagtgacaaaatcctctttattgataaaaacgtttgcaaagttgcaacctttttgggtttagtacttgaagagaatcaatctgacagcaaatagttttggcgtctttctaactcaacccatcatctctgttgcattttatcgagagaatatttgaggtggatatggcctcgacccttttctccagaactttcttggctgctagtcaccgactgattactccttctcttccgcaaaagatctttaatccagccacctttctcagtgtaagtcgatatctgattcgcgatctgttctcaattagccattcgtttgaccactcgttagcttctgggtttgagagtgtctggattgatttcgagcgtttggattgtttctatgatttgacagtggttctactgggttttcgagcttttgaaatgttgaatagactatagagaattgcttaattgttgatgaggtctatgtcaatcgatgcttttcttatcaaagtttgaaattggacttatgagttttgtaatcataaattaggtagtgaagttttatgtgaattgctcagtttcgcctctctgtatatgattctgactttttggttggtcttcctcttcttgtgttggtaattgctgaagaggtcactccactctcagttaggctccgcttctacagcctataaatcaactacttgggctcgtcgagct

SEQ ID NO: 3544 - DNA, 1140 bp, Arabidopsis thaliana
agctccttaagcaaattagcgaaagctgtgaacaacacaaacgagtaggatcaatttccccggaattcagggtttcaacgtcaccgggatcaaacgattcaggttttggtttggttaaatcattagagtcttaaaaacaatttgatagaatgggatttttgagatcgacacgaatcttcggaaaagaactagcgctgtgaagagaatagcttacctttagcttcagcttcgagatcgaacaagtgattagttgcagagagagagagagagaggtgaaataaataggcttttaggtttcttgcagagaagagaaggttgaagtgagattttacgaattcttttctggaagaagaaaagggaagtaaaaccaaacgactgcgttttatcagaaacgcgatttttaataaagagaacgcgaacgcgaattatatcaaagagaaggcaaacgtgaattttatataattaaacatgcgttagtcgcgtcacttatcctgatcactagtgatcagtgataatctattaatcatctaggtggcagaagcagcatcgttgagaacgaagaagcttgaaaaagttgcgagctcagagaatctggaagtagcaaaatttggcggctttaactcagcaatttgttctgtacatggtattttgaggtgatttggcttcgacacttttctcaacaactttattggtttctggtcactgccagattaatccctctctatctgctgttcctcatcacaagactcgtaattgcgcaacctttttgaatttaagttgtttcttaattcgatttcgaccttctctgagcttagatattcacttctagttactgtttaaattgtttgtataatttgggtactactagtagtgggctttcgagtttagaaaggtttcacattgggagttatagttagctgtgtgtagatatccgataatatctgagtcacatgattcaaatctgagtttaactttctcttgtataattcactctactgaattgtgttcaaagtttcgatttttttatatcttctgttttgtaattccgagattgtaaatgattacttgcagaagagagcattcagctcacagttacgctctgcctatccagcttctaaatctactcactttggtcgagtc

SEQ ID NO: 3545 - DNA, 1677 bp, Arabidopsis thaliana
ggtgagtgtgtggggattgggtgaatctagaaagcataaatttcaatcaaaaaaagaaaagaaaagaaagaagaaagcttcacttgaatatttctcttgtaaggcctcttcattagtgatcctcattgtcattgatagtcgtaggcatttttgttgttcacttgtgttgttgaagtcttcccctccatttaaaaatatgagtaaaattgggctgttattttagttgtggtaaccaactcacatttagaatttcagaaagctaagatttcaataatgatgtgtattgtaaaaggtttatatactcggctctcccaaatgttctaaacaatagtttgggtttcgtttttcccaattaccaaacaaaattttagatatatgtccatttcggaacgagaccttgtctttaccgtattcgtctcgggtttctagtcccatatccgctcgtataattaattgttttgagacaatgtaatgcattgaatatatatcaacttttatatatactaggtgatcatccgcactgcgctacagagttttctatatatttgtacatacaaacaaacgtgttggtcattatatgccattgtttcttctaatagttctcacaaatgtttaggcattggaggatagaagaacaaacgaattagagatatctaacacaacaatggtgtggtcatctgatcaggttgattagaatattcatgtggctgttcatacggtagctcgtgctcgcttccttcttctcctccatggccattggtgagatcttcaacttcgagaatctcaaccctccgtttcatcttcctttgcagttttaatgcaacatcggatggtcgaaaccgtccgcaaaggattacttgacgttcctttttgttgatcatgtgtgtatcaacttcttcataaaaaagtatccaaaacatgtgttagtattgaattttctataaatccaccacgactaaacctacataaaatggtgcatatagtaacatcgataaaatttaacgatgtctttctaaaattttcagattttccactcaaaaaatcctccttgaactttaaatcttattttcataacatccttctttgctcatttcatccacatattattttatataaccaatataaaccaacctttcatattgatgataatcctcctagcttttctacaacaagcattgcaatccaagttaatcctcatcacaacacaacattgcttctgcatttcaccaccccaaaaaaaaaaaaaattatcacaaatccaagaaaattattgttcaaacaaataaaagaaaacacaaaaccttttccgacatgagacgaaagagcaatattgtatgatatgtttttggttaagaaaacaaaagtatacttataaattaagattttggaatctgattctctaacttaggtagagcagagaagatatataagaaaactggttttgttatgttacctaatatccattgagaagcatctaaattttctttgtttctagatggtttaacctaaaccgaagtttcagataaattaatccggtttaattatatatccggttattaaactggtaactgatacaaatgtaggcgaagacgctcaacgaacttcaacctcgtcttctccgtccacttcactctctctaaactctctctcagatctctctctctctgtgattcaaca

SEQ ID NO: 3546 - DNA, 2000 bp, Arabidopsis thaliana
aaatcttttgccgatatctaggattatttattttgttaattgaatgtcaattgagtgaaaatattaagatataataataggttgattcgattatgataaatagttgaataaagtgtataatatggttttgtaaggacggcagattttatcttagcttaaatcacaattaatcattcatgtttggacttattcgaggaagttgtgtcaagtaatattttatgcaatcagaaagatacagcaacactaagtcacaagaaggtcacgacattctctgtctcagccatttactcatgtgaaactttggctctgtactaaaaaggtagtaatgcccatatcgggaaaaaaaattataagaataaaatacaggaaaatatttttttctactatataagtgatttaatgatatattaactaaatttatacaataaattgagctatttggttttgtaaaactcataaataaaaatgacatatattaactatactcataagtactacattgtgatgataatattttaaaactcaaatatcaaatcaataaatgtctaatatcaatttcattgataattcatttttgaattttatttctctattaatctatttaaaaagatatgtttaccgctagcctccaaccactagttagaggttaaccactgtagttctaatttcagttcatctcaatttttgttttggttaaaaagtttaaaccgatcatctctacactaaattcagattttagtttatgtgaacaaataattccgaagcgacgtgttaactaatatcatgaaggggaattagacagaagcttaacgatgagaatataggctaaaatttatgtcgtccaaggagtaattgagtgttgcctacttcacgagacaaataagtaaacctaacaataacacatagacacactcgacgccattagccaaattccatttgagccatccaattccttagtggatcttctttgtctccagcccatcttgtctccttatttttctaatgattactttataaaaagtgttttatcaaacatcacaaaatataaaaagaatttccaaatacttttgatatttaactattgcttttttgattattagccggggtaccaagatattagtttttaatttagtaatatacccatatgtttaatattgatatcgatattgatttattcatattacgaaaatggattagttagagaatgtgaaagaaaggtaaagtaaaatattgaaaagcaaagattaggggacagaagagaaaaggtatgtctctgccatgcccatccccaaaagtagagtgccacatgtagaccttcttcttaagatctaactcagatgctatttgtacaagtaaaaaatgtggcagactcagtttctatttttccatattttactttaatcttcatgaatcataaaaaatgaaaaatcaagcacatgaatgtcactgaaattattcaacaatattcttatttatcagttattttaattatttgactatttatgtgtatgttgttatctacaatatgtccgtttcaatcagtcgaacaaaaaatactagattttagttatgtagtataaaatataaaaatgttgaaaaacactctaaccattaatttgtattattttaaactttccatatgatgagatgtattattcaatataataataaaaagaatattatttaataattaaacaaaaacataataaatcttataaacaatatcttaaaagaaaagaactatattgttatttttttgataagatcgataaaaaatgtaacatactaaagaataaataaaataaaataaattagtaaaaaggaacttgggtggtcacgtatttgctgtataaagaggtgtaaagtggcatccttccttaaattatatcctcaaaaaccaaacttgctcactccacacacacactgctcccaagtcctctcacttcttcttcttcctccgacaccgttgcttaacggttttccatttttgtcccttcaag

SEQ ID NO: 3547 - DNA, 1831 bp, Arabidopsis thaliana
ctataattttttgtatcggtccaatattgatatttaaccgatggttaaatttttctttttgtctctttttcatcttttaatttcagtacagatgtaatattacgttcttctctctctttcttcagtgatgattttggtcaagatatgtttgtatgatttcgccattttgtagtttactaggccatgtttagtctccgagaataaaattgatctagaatcgaattgatatcttagctagatcaaacggatgtatatccaaattatttatgaaataaactgattaaataaaaaaataaaaataatatttttatttaagataattatgttttataatattagaaaatatgaccaaaccatgagcagaattgtgttaagaactttgccaagttagagcttacattatatatcaaaagtcaatgtgtaattgtcaagagggataaaccgacgcggatgaatcgaagaagcaattgctttcaagaagacttcaaatcagctatgtgtctgcgattataattgtgtaaacgttataagcaagaaatttatctcaaaataaaactggtctataaatcaaatcgaattgaaaatttagctagattaaaagatgaaatgaactgataacataaactaatagatatttttaataagatgttactacttttgtgaaatgataaaatatttctgaagttaatcgaattcattcaaagctatgataacattgtgacttctaggaaaaaacaattcttgatacggtcgcggaaagatcttgataacattgtgacttccagtcttccatatggcataaggtattcttttacactaatactttcccgacaacaacaacgaaaaactccaacctttttttaaaaggccacatagaatgcatgatagaccatctgaaagaaaatggacagggtggcttaaaagtgagatttcttgggattgcataggatgttataattaaccctagcttgaaaaaaaaaagacgattagacaataagaaatagaatttaggtcaacttagttcggcgaatatgatcttgcattgcaccttctttaccaatttatagtgatcttttgctccttataagcacatgtttaaatcaccactacgacattgtttctgtttgggccaaatgcacacttgtattttatctcacaacgagcttatgagaaatcaatcctagtaatacgttaagtggcccaagaagttttggaccggcatttacgtgtatataaaaaaatattatgattacttttagatgaaaccacacttaatttcttcttttttcttggtaaaccacaatatctctttattgtttttatcaaggattcacaaaattcattgaatggaaattttcatttatgtgtgacatgtagacagtcagtccactctaaaaaatctcagtcaatttcgtaacaaattcataacctatttcaaacacaattcataaccataacttataaatactacataaatgatatttctttatatcatcttaaatggtacataaattaggggaaagctaagatatatatagtattaaaaagtacaaaaatagataaggtttataaatgtttaaagaagtaataaaatagaaataagaactaattaggtcgtcatgtgtttgctgtataaaaagctgtaaagggacatctctcgtaaatctaaaaatcatcaaatcttctccttctctctctctctctcacacactcactagcttctctgttaaaagcttccgtcatcacatagagaacagagactgacactaactcacttcctaacggtttccacactcaaaattacacttttgccactccggcgaacaacaat

SEQ ID NO: 3548 - DNA, 1422 bp, Arabidopsis thaliana
ggaaaataaaacaattgggagaataccggtcagattcttcaccggtttgggctgtagaaagattcacaaagctgttccattctaaaataaggagaccaacaacaacaaaaagtcaaaagtctccttgtcattgtttagatccacacgcttattttacagatttgtgcgacgtaacttttctcttttatgttcataaatcattcagactctcttccggtttagaaacatttatgattacatggctggtttagtttggtttattatcggttcactctctattctggttctgatttctgacaacaaatcaaaggcaaaagttgtggatttccatccacaaaatttgggaattgggcctcaaaatttctttccaagggtggaagaaatctcaagcgagatctttcgacatttggtagtgttactgcgaaaaggaattgggcctggctaaggcccaactgtatactcttgctgaggcctgaccataaaagaagaagttatttacaaattaaatcagccaaacatgttggaccaggactcaccaactgtatataaagcctaacaacattttctccaaactgtaaatagatcaagactctgctgtgttgcaattttgttcccagtttcggtctacagttaaaaactactgattccctttgccataagagtgatcctaattaaactgattgagtaactcttaaaatggtggtggtgtgttttcagggatgtgaagacaactgatagtggaaatgcttcaagctgcgaagtctgttgtttccaactaagattaagaaaatggttccattctcaaataaggagaacaaaaaaggaataaaaaataatgtctgttacctctatcacactcttctctgctagtttcggtttagtaacgtctagattatcaatgtctggtttagtttggttctttccggtatgttcctaattttggtaggatttgtttggcttggttttatagcaagtatttaattaacattagctcaaattgcccttaatttattgaattttgttaaaaagttttgtctaaactttacactaaaatcagcttttcgtggatgttacccatttctcttccgtaatcgttaaattatgacataacgtctttgttttggtcgtatcgttcacgcaaaacttcacgattcagatctgtgtgtggcagaatttgaatcgaagcataggatcaatccggtaagcagccgtaacttgcaatcgatcgccgatctggatccgttaaaggatccctcgcagtccttgaagatatcggcgtcctccgccaccgggaacaggatccgttaccgttcaccttccgcttctgagctattggagtctggactagccaccggattatccggtaaccattctcctacttccgactctcatcagggacttgtgtctatcgacggaggaaaa

SEQ ID NO: 3549 - DNA, 969 bp, Arabidopsis thaliana
cttctctcttggacagggaagtaaagtagacatgaacaggtcaggttctctttggtatcgtgtcttaaactgcttattttgtcggtagcagctctgtactacattaaagttttggaaaacctttcctgaaaacaaaaaaaaaaccccactttctctcaatttcaaacataaaacttcccggaaattttcaagtcaacagatgaaaaaattgattgctaaaaaggtgaaattgagtaagaagctagcaggtttggtaatccaaaaaggaaaacttcaaaatgagacagcagaacagagtctacctttctatagaaaatttcccattctagaatcactcttatttgagtttttacatcatcgaactgaatcaaacaccaacactaaggaattttgaaggatccagctttggaagctcgactacacaatcgactaatgaaaactgaaaattatcaaaagcaattcatttaagaaagtctaccttccattgaagacgataaagagctcacaagattataggcgacagtagcgatgatgttagtttatttctgtttctctttggtatcaagattgaatcctgagagttcgacttcgattgtgtagttgttgagaattgtgtttttggcaaaagacgtttgtgagataatgggcttacacaacataatggacttttctctagccaaagctattgggtttcaagccatttcaaaagatattcgtgtttttgaatttttcttctagttttgactcaatttttatatcctctgttaccgaaacttgaagaaaacaaaatctaggatcaatacaaaagagcacatgatcattgctacaattaacgataataccaaccgtccacgtgcatctctttcccggcccaagaacactctcacttacatgatttcactgatgtacccttcttcttcctcctctctgttccaaacccaagtactacaataattctctcacattccc

SEQ ID NO: 3550 - DNA, 2000 bp, Arabidopsis thaliana
agtatattgcatgttttgtctttagagggttccaacaaggtaataaagtatatattctttaacaatgataatacatcataattatatttctctatgttaggtttatatttacaattgtatttagaatctctttacttgtgtctttatcttaaggagatgctaacaataaataaaacatattatccatcaaccataaaaatatatttataaaccctaattttgaaatatccaacgtctttaccatttacaaaaatgacgctttagtctttagagaatgtcaacaagttaataaacttttatctatcaacaatacaaacaaattttttatataccaacgttaattatatattcgtaacgtctttattatttgtaaaaatcatgagataagaaaatatttatctatcaatgactatacaacaaaattttgtacatcaacgttaactataaatctgtaacgtctttatttatttgtaaaaatcatgagataagaaaacatttatctatcaatgactataaaacaaaattttgtatctcaacgttaactatatatttgtaacgtttttatttgtttgtaaaaatcatgcatgatgtcggtcaaatatctaatttatcgttttgatatttaacattgtatttgtaatcttttttactgatgtttttatctttaggcgatatcaacaaagtaattaaaagaaacacacaattttctctttttaaagttaagtacaaatgaaaaatgcagtagaattttttttttttatagactactaacttgcattaaacaaacaaaataactactctatttttttttctttttcacattcaaccatctacttcattgatcgtacatgcactatgtattatatccattgaattttgaaaatttattagtatttatttttttagtcaaagcagactatagccaaacgaagcaactattcgtacagataaaaactcaactgcgactaaacatctcttttcttaattagtaaaactaaccatattagaataaaatccttttacttcttgtttcagtgttcttaagttcatagaaaattgtaactttttcaaaagtctatagtcttcttgtcaaaattctatagtcttattgcagtgaaaaaaaagtgaatactcaatattgttttgtcttttagatatgtaaacagatttaacggtcaagaccaaataaaaaatagagaaaaaatggtctgaaacaaatatattttataatttagtttaaaaaaaacttaaaaaaaaaattagaatagtagaaaaaaagaaaagtggagcccacaggttttaaattaataaaaaggatatattattctcttcttcctctcttcttcaaacttcgtctccaatctttctctccaccgtcgatactcgttttccatttctctgtaagaaaaattcaatttctctctttgtttcaacagtgaaggcaaaaaaccccacaaaagaaatctgtcaaatgttctaagttttcttcaacctcttaaactcaatttcttcctcttttgcttccgtggtgagtcattctctcaacgatcttcttcttcttcttcttcttcttcttcttcttcttgttgctttctccggtgatttttttcttctccggtgataatcgattttcgttgaactgaaattttgaaaatcgattttactattcgacttgacttcgagtcttcgattgttgattttcgtcgtctctgttcttcattgtttcgtactgtagtagagttgttgacagagattcaaaatccgaatcgtaaattcttagatcttcgccggaatttgtgcgtatttgattttggcatatcaaatctccgtcggtcgatattttattttccttatttctggatttttatgatttggtagatttaatgatgatgatgatgatgatgatttatgatgcttaacgcgttttctttggttttaaacaggtggctacttctcgtgttcttggtcctgtggaccttggtgttacagaatctccattg

SEQ ID NO: 3551 - DNA, 519 bp, Arabidopsis thaliana
ataaatcactttctcttttgttagattctagttgttttatgtaatttgtatttttcctttcttgttgaatattattgtctctttgaagtttgaactatgaagactttttattttcttaccttgtattcaaaccaaactgaaccgactatatatgtatgttttctcgtttcgattctggtacatttcgatcgctctttttatatgacttcggttttcatttcaattcggttcatctattacccgagtaaaccaaattgttattattattggttcattcattcattgtatttcaaattttgattctttatatttagtactctgccaattttcatcaaaattgcactaaaacaaaaacaaaaaaattagccaaattgtaaacgaatttgaaccaatatttggtaaaactgaaccgcaattccattcccagaattataccgaaccgttataaatacggttcaaagttcaatctcttcaactaaaaccgaacttttatctattcgaaccgaaccaacagaccca

SEQ ID NO: 3552 - DNA, 2000 bp, Arabidopsis thaliana
atgcatgacacataatatatagatttgcaaatcataaacatataaaatcttttcctctgctaagaaaataaaaataaattcatcagccaatcaaaaataaaaataaaatcttttcctttcatgagtttttagagcatctctaatgaaatatctaatcaaaatagtttctctaaaataatgataaaatattaaaatgttggagatagaaggtgagagaggttcttaaagttcttatttttgagaacccatgaattctttattagacacactcatgataatgccaaccttgaatgattatagtttttgtttacatatttaatttaaatagataattgaattatattaaaatattaatatttgttagcttaaaattccaaattaagagtcttacccagggccggtccaaccaaatattaatacttgacaaaattttcaaatttatctctatttttaagtttattaattgatgatattaaataaaacaatacattaattagaggtaaaaaaatattgaatattttcttaatatttatgaaaaaattttaaccgacaactaatataaaatagaaataatattatttttatattatggttttagtggaattagctagttaagatacccacaataaaaaaaactcgaattataaataatatgttattgtataaaacatttatgcatagtcctgttttatcaaaaggcttttaccctttcgaaaatatttagtttttttttttgaatcatttgagttaaatgtttgagtcttttttttttttgagttaataacccatgcttatatgtttatatctttgcaaatctgaaccccccaccccacccccaaacaaaaaaaggtttgcacatcatgtcagaggtgtagtggaaattactaaaaagggtaaaagcataacttttttaacagttcccaaaatggataaaatgcttaagatgagatgtcacctagattccctacatcagctacttctgtatatttagtgaattttaatattttttcaaataaattttatttttaaaaaatctcagttaaaaaaaaaatgctcttatgctcttcgataactagagtttgaagaaaaaatgaatttagataaaatacgatcagatacttagaaataaacaagttttgttttgatttttataaaatagaattatttaaaatttcatctacatttgagtcaatcctgttaaaaaccaaagttttcaactttaaagcgtttttttttgtgtggcagtgttcaactttaaggcgattagaattactaatatgaaaacaatcaaattgatgacctcgccaactagagtgcattacataccacttaccactatggtaacaaaaattcaatgttatcactcttttgattaaattgtatgtattcttattcgattttgtctatgttgttttttgatagctagaaagtaaagtttattcatttcatttataaactgtagataacagaataagaataattaaacgtgagggatagcaaagttagaactcaacttaccattatagtttgttctgttcgtataaaaatagaatgtatacttgtttcatctttcttgaagatgtatagtttcactttagtaaagaattaacgcactgcatgaagcatatgaactagcggttaccagaagagataaatattcttttaaaaaaaatggtcatcatctacgtcaatgtcatgatctgtctaattcatcgagaaacttgtggcaatcaaaagagaaacagaagaagctttagttttataaattcgtactttattctaaaattaaataaaatttaaaaaatatatatatatgactagtgaacaaagtctctatatatacaagtttcttctgccttcaatcattcatatacacaaaccccttagagaaacaaaaagaatacaaaaagaagagagagattagttattaacttattcataataagtgtaattacttcgtatttacttttttttggttagcagtcgactagtaatcaata

SEQ ID NO: 3553 - DNA, 334 bp, Arabidopsis thaliana
cactcctatgtaaagttgcgttttcttctgtcgtccttaacttcttacaagtcatccgcatagagaaaaaaaatatttgtacaggtcacattgtgatcacaccattttttgctaacgaatcctctctcgcgagaggtatccatgtagatagtctactgatgtatcaggttatatatatgaaacctcacttttcagtacaaaaacagagtcgacaattcttgaaaactctgtttgacatctgtttattttgacggtcgattcacaggtggaccaattctagtggataaaactagtgccacgtagtatgaataaatactatataataatacttaaa

SEQ ID NO: 3554 - DNA, 443 bp, Arabidopsis thaliana
cggaggcaccacaatcaccggtgaacaattcttccaagttcgttacttataaataaagctaatggaacattgaaaattaatcaaattggtaaatctaattatgtagattttgtaaagtagacatctttatattttataactgatttattaattataaggattaaaattaaaataaatacgataaaaaaataaataaagaaaagaaaaaaagacaggtggagggagagatgaacggctaaaccctaattgagagggaagtggcaccaccaagagagccaaagccaagtactctctgctcttaaaaccctaacgtatctgcgataaaccctcgcgcctttgctaaaatagctgcctttatataacttagccgccactttaattctcgaaagtcatgttctttcacttttcttcgctggttcttcttcgcgctctctcttcttgcc

SEQ ID NO: 3555 - DNA, 837 bp, Arabidopsis thaliana
ttggtgattaccagtgagatcattgatcctatatatgaatttgataatcggtaagaataaagacacccgagagtagttcagatttcgtgtgtgtagctgctatttaccacttggctcattgaagaatagacaacaaattgtacttacaattgtgctgatatatataccacagtgattttcacaaaatgggaagtgaatttattttaccgattgcttcaaacccttaattctatatacttgatctctaaacattgtgtaaattgtgtaaatttcaaccaaaatctctgaaatgtgtttttaacgtttttgatcatataagtggacaatatgaaccggccgattttgctcttaaccagtcgttattttccatagacggtcggtttttcttgaaccgggaatttccacatgattttattgacagaacgacgtcgtattaaaatagaaggaaagaagaaccgacgtccgaatgacgaaaatctccctgaaacttaataaatcttaaccctcctttgctcgatccattatcggggaggagaaaatcctaccgccttcaccaccgtcgcgcagacgccgcaatcaccaacactcatcgtcactgactccagatcttcctctccaactaggtttgcaattctcttctccttccgctgtttattggtttcaatttctgcttagattctcttactgctggtgaaacttgaatttggagcttctcttttcgctcatttaaccacttcgtgtgttcttagggtttagatgttggtcttttagggactctctttgaatacttgtttattgcactttaagaatgattcaatttatcttcgacagagagat

SEQ ID NO: 3556 - DNA, 1134 bp, Arabidopsis thaliana
tttttgatgattctttcttctttcttatcttgatctgctgctttcacgcttttgctgtttatgtgtgtgtattactatatatatatatagagaaagttggaaacgtaacgtatgcgtatgtgtgatgaaataattggtgtttctgcatagcacacatttgatggctataattgagtgtaaatttgtgtatattattgacaaaattagtcaaaagcttaaaatcttttttagtcgttgaaagatccttctagaaaaagacattttttttcttcttcttttcatacgatggctcatggctgtgtagtttattagaattttaggtgaaaaaaatattagaagccaacaaaacttaaatgaaatttatttgcattcataattcattttaccagtttataacaacaacgtaatccaaaaagtaaaatgagaaagaatggaatttgtgtactttgaaaggaagaaaaaccactattgacgtggacacgtcggctaaaggagggtccacgggggttggtgaacaaacaatgtggggtctaatcgtgtgtttgctttggtttaaaatcatggttggccacgtgttgattcttgacctctctctgacatgaaactgtagcattgacggcccagatcagctgcgagaatacttcccacaaccatggaaattttacggcccagatcaacaaagaatcgatttgctctttactatttcgaagaacaaagagtgacagttatgaataatagaaaagaaggacaaagagtgtgtgaatggcttcacattaaaacaaaagcccattatgaatgacccattcacatttcacacccagtttgaaaaatcgaccgtccaattaagtaacattcaaaaacccaaaagataaacctctaattcacgaatcacaacagcagcatgagccgtttcatcacgacgttatctcagagtttcttggaaataatttgttgtagcggacttgtggctgtaaatggggccaatgcttaaatttacttgtctcgtctcttctacacgtcttctcttccgaccacacccttcattcaattcaacgtctcctctctggctctctctctcaaatatataaacaccaataatgtctccaatttgagatttttaactgaacccaagtc

SEQ ID NO: 3557 - DNA, 715 bp, Arabidopsis thaliana
ttttatggtatgaatacggtgaaattcaaagaaactatgaagatatgcacagttctctggaaatctcagatttagaaccctaaccggaaacgaagccggctcgagatttcgtgggtaacttggttcgacggtccaaaccggattttagtaatttcgctttttctgaaccaataataatgggctggtccagagtctaaaatttccggattactcgacctgacttctaaactaaaccaatgttcaatggacttcacctagtactgtttagtatttacatatatatatttttgttctaccacagttatgtttaacatggcaaattacatgaacacattattattgatccttttagaaaatgtgtaatagtcacaggaacacattattacgcattctactcgaaagattctataaagattttttttttattgtcggcagtagatctataaagttaatataagccatgattgcttccacattttagactaaaatacacagaaaaaaatgagatcttaacccatgtttcacaaatttcctgtcactctttgttttttgtctcacaaaagtattttgtgttataacaaaatcaacttgtttgtcactgatatgagatttgacttaggttgttttgttgtcattattttgaaccgtacaaaaaactgtaaactatttataagttggtccagactcacagtatctcacaagtcacaaccccacc

SEQ ID NO: 3558 - DNA, 759 bp, Arabidopsis thaliana
ttttgttctgtttctgcattttgccccacttttgaaacgaattcggattctgatcaaaataacaaaattggggattgaaagcgtttctgggtatcttatgatccgtgatttctcagatgggtttttcataaagcagagaaatttcgatcaaagtcgatgactttaacatagactctttctacatttttgttgctctgtttttgttctgttctgtgacaaacatgctctctgcctttttttctctttccaattaacatgtagattaataaataattgaactttgatcttatttttttcataaatgtaattcaaacttttgtctgtctttttccttgtttttgattctttcattaaggtcccacttcccaaccaaatattattttattttgcttatatatggttttgactttgtattcattcatcttttactctaaacagcaatctgcagctaacttgatgattgctggctactgaatcttgagtttgtgtctggagttttgtctcaacaataccaaagaccataaagactttgaggtgatttgagttcagattcttctgaatctccaatgctaagtttctctagagctagaagtcaaggaagaaacacaagacctcttggaggaggttagtcttgaatcacgatatttatatattttaagtataatgagtctctgcaacattttagatgatcaatcattttcttttgattttgataattcagggatggaatacttagaacctaaaaggaagagcaatgta

SEQ ID NO: 3559 - DNA, 2000 bp, Arabidopsis thaliana
acccaaataaaagaaataataatattagcctcatccaatgatccaaggataaaagcaaattaaatgaaagtaaaaatcatcgtgaaaaccgtaattctgaatggtagaagacatatttcagagttttattgtcatatacaaaatgatagatgctgatcaaccacattaatcttttttttttttgaaagaatgtaaaattttgttccatcaaaaagcttttcaaccacattaatctttacttgatgtgtttcgaacgtgtgtctaaaagtgattggttattgcacacaccgtgtagggtacggacacgtgttgtaatatcttttggcagttagactttttttttttaatttaacaaatataagtatataactcatggtttatcttcactttgaaactcaagttcttcttgcaaactagaggcgaacaaagttttagcttcatttttctagttttggtcaatttctgtatttttaactatttgagcattttatgaaactttttttttttcttttactattaaatcatctatatgtcacatgaataattctatactctttataacactggtatatatttttaaatatataataatatatatgaaaatttaataaaaccaaaccatttttcggaattatccaccggcttgaaagttgtagtaaggaagttagtaggaaactttttgttgtactcttgatttctaacaactcaaatcgtaaagttagctaagaaactgaagcttgaattttgctatcgacggtgcgaaaccataatggttgtatggattttgataaccacaaggtcccatactacattgtacgtatcactggcctggacttgtatcataacaaaaaatagttttaacagaagaaaaaaaatcggaacgaaaaatagggttgttagtccactgtccaaagtataggatcctttaatgttctgtgtatacgcgacctgtctcagtagaaaaaagttagacccatttatttttgtaaagcctcattttcagtttaattatagctttagctttaaacaaacaaagagtacaaatttgaaatctaatcctaataattgtgaacgcattaaatgtagttggttacatttgccacaattgatcgcaattatgatttttgcgtctgccctatattagtactctgccgtactgatgtgatcacaaattactacacttgatcatgtggcagaaagtggttggctcgtttttaaaacaacatgcgaaaccacattatgtcaattcaattctatatcttgtgttttattcctctttattcgataaaacattctatacttgtgttgccttatttttagtatgaaacaattatgctcgcatattatccatatatgaacatacattataatgcaacatcactcattaatctcttattaaatttactgaaaatacaaggcagtatatttatttatttttaactctttatctaaaataatgttattatcataatatatgaaatgacatatattgtacatatgataatcttattagacataattggtaaaaggaataacaattttatagaatcacgtacgtaattctttgcgcaagcgaaatcttgagctgaacgtgctttgatatagatgagtgagatatataaacaaaatatatgattaagaaacaactattgtataatgatacaaacattttcatggaaaacaactatacacaacattttacaaaaatcttattatgatcaagaaactaacacgtcaattttgcaacaaaagaagaaaatctcacataatgcaaactgagacgtacgtggatggtaagtaagatgtgtggtcgagagagagtgagcaagtaggtgttgaataaatgcgttgacgctttatatatattaagaacctttgtatttgaataaatgcgttgacgctttatataaattaagaacctttgtatgtgagaatatcacaaacatacaaataattctttacttcaccaaaagaaaaaaaaaatgggatccatatcagaa

SEQ ID NO: 3560 - DNA, 2000 bp, Arabidopsis thaliana
taatttaaaagtttactaaaagtttcaattttttcaacattttttcaaaaaaagatattataccacaactattacgagtaactaacctacttgcatgaccatttctttactcattttgtttccgtagtagaaataattttttgttagttcgatactccctccgtttcacaatataagttgttttagctaaaaacatgcagattaagaatatttacttttaaaaagttcagataatcatagaagaaacagcataatataaataatcataaaatattaaaataatatataatttgcataaaaactagaaaacaacttaaattgtgatacaaaaaatttgatccaaaacaacttatattatgaaacggaatgagtaggtttaaataaaacatatctaacgcttttgttaaagtgttaaacgttgactaatttatgtcttaaattatgacgtcaatattaaattgaggaattattgtgtatacatgatatttacagaataaatttgtcaattataaatacttatagatttaattgactattttcccttgaaagttcatattttttttcatttttcatttaaaaatttactaaaagtttcaatttttttgacatttttttcaaaaaaaaatatattataccacaactattaaaagtaattaacttacttgccaacaaatgacgatttctttactcattttgtttccgtagtagaaataagtgtttttttagcagagtttctttttgccccaaaaaaaaaggctttattgtcgaaaaaaaaaaagagaggctatggtgtaaccatttattaatagccttcattcacactaacagtacaggcacgaccgcacgagcacacacgtgtggaaggagacaagagcaatgaggttaatgggccctttatgaacagtgagactacgtgagtccaaggcatgaggcatcgtggtccgcaaacggctcattttctgtcatgtgggtgccactcttttttgctcactttctcgatcccttcaaaattaagcaaattcaaagtctactattatttcttaaattttgtgtagctatcgtcaggaatctttagacatttttacacaactaacatttgtcttctcaaccaaagtctacaagaaataaaaatacttttatcttttacttgtatatatgttatcaaaaaaaaaaagtgataaattgacactaaattatgaattaatttaagtgattgactcattttttttcttattccaacttgcattttggattaataataaagttatatgttttataaaacacctaaaaattaagttttaatcttggttttggttttttctacagttagagaaaagccagcaaatataggtttttgttttttttaacccaaacttggtggggtcggcgtgcaatgttacctctattattgttttacttatttatttttgaacttattcatagtcatatactcattgatatgaacaaatgactaaaacttaaaagaatctagaagaaatttcatgaccatcacactattatctaaacacagctacactattatctacatactgctaccaataataaaataatcagaaatgaactttactcataaacaatatcattctctctaaacaaagagtagtaaacaaataatctatctatcaattagtttagtttgaacaactaaaaaaaaaaaatgattcagatccataaaaaccccatcaattccactcatgattacctgtaaactctaagcatatatacaaactgcaacaacatgtgaaaatatgggataatggagaaagatgatacacattatttgacatgtcacatgtgaaaaaaaaaaaatctcaatactaaaataagtacctaatcaattattcacttattaatttcttctggataataataagacccagtcttctttaccactctccacaacaccactctctctttctctgtgtctccttcaaatcttcatctctctctccatctctcttctccacaagaagctgagt

SEQ ID NO: 3561 - DNA, 2000 bp, Arabidopsis thaliana
tttcattttctcctaattttttatgttgaattttaaaataaatgaatatataatagtaaatgaaattttaaaattaatgtacataaaattaatttctttatccaaaagtgtaaaattaatgccacgtcatcttaaaaactaataattaattgagatagtacgtgcataattatcatatttttttatgatatcgttattatgaaaataaccacatttaaatgtttaaatattaaactacacagtttattaatctttttcatccaaccaaaaactattagatattaaacgtccaaataaaaaatgagattttttcctttcaaaatatgtttacaaaattgggctttttttcttttgaattttgattttatacttctcaacctagcaaaaattcgatgtcggttataaaaataaatctctatcaaaaatttgttacgtagaggaatacgactaaaggaagagaagaaaatagggctatattaatttatatacccagaaaacataaaaataaaaaataaacttataattttttttataattagttctctttccacaacttctataagttggactaaaataccctttcgctcataataaactaattaacaacataagaaaattgttaccgacatcttttatatgattcagatgatattgtttatcaaatatataagtaagaatatattatgaattaactgataactgttatgttaacaagataacaaaatatatagcaataagtttataactatattgtgttaaaccatattgtatcgcgataagtttataaatatattatgttaaattatcttgtaccaataattttttgttgttcattatgttttgttatttgttaattattttaatatgatgtaattatattgatttgatatgatatacatattattttgatataaaatttaatacttatccattaaaataacgtgtgcataatcaaaatccggattattatgattaaatcctcttattattaaaagagaagtacaaattgaatttttgtctaatttgacctcaattttgatttcaattttggattttcttctttgctattcaaaatcattaagggtaatttggtcttaacaatctattaaactttatatgatccgattcaatctaaaccgttcaataaaattaattcccttcaatctaaaccgttcaacaaaaataagtaaataacaaaaaaaaatcccaattattatttagttatgtttgttttaaaaatttttatttataagtttaagatatcaaatttattcaaatatttagtataaaaaccaaataaaccgattgtccgcggtaaaccgcgggttaaatcctagtagatagttaaaatgtatagcaaaatagaatgcgtaagattaaaattttagtttttagaaatttactaaacaaaatacagaaaaggtgtgttgacaactatttaaaatttaaatataatcaataagatatagttaaagttattaagtgtatagcaaaataaaaattgtaagaataaaattggatttaaaatttttttagtaaattaaatattttaaaaatagggattatcatttactgtttagaattcaaatatcatcgataaaaatttatactattgttttataaatccgcttatctagacgggcctaacctagtaaatatataatacacatcttatcattcggtcaaaatattatgaaaacatcattaaaatttgatgattacattccataagtaatttgttaaagcattatgcattttcctgttctatggacattaatttgaaccatacgactccatctaattcacttgttctcggcagctagcattcgaatcctgacttttcaaatacaaattatcggtcaagatgggtgtgcgttacgttcatttacaaatcactaaaaatgagtggtgaataatcatttggacaatacggatacattcatcgaagttgactccattatcctaccgtcgtctcctaacaatcgaagcacaactttgca

SEQ ID NO: 3562 - DNA, 953 bp, Arabidopsis thaliana
ttttcgttgttgagaactcttcttcgatctcgtttgttagtttatttggaagagtatgaagttcgtcgtctatttatatgtgcttcagtatgattcgtatttagcctcggtagagtgtcctctccaatcacttcttgacacgtaagcttaatgggttattttgtgttggcgcgctccttactttttacacacgtaaagtacccaatcacaagcagacacgtgacattaaatcgtcatcgcaaaatctttcaaaggttttacgacttcttcgtatgtatgtatagttatccaaaacaattatcattataatcaaaattaaattattaacaatgtttttatcacatgcatgaattattaaaagatttttttcgtgtaccgattaataaaataaaaagatttgcgtcataatttacataaggataatttcttttgttattaatgaattagtgtaatgccaaaactactgcatatgcggtgaggtgtaatatttggaagaacatgactaatgcttaaccactccatttatttatcacgcagacatatatataagaaatatgccattttctaattactctcagtgttgtatttgtattggaatcaatgcacaataagaattggatattggataacaacaaaacaggcaaaccaaccctaatggcggccctaggtttttggcttctaatattaattcactttcaaaactaaataattgaccatatatcatttgatttttaaaatatgtcgttggagtaaatcaatattttaatactaagttataattcatatggtatactcgaaattgtcaaagggtaatatggatattattattttattttattttttgttagaagggtaatatgggcattataatccgtcttttttgacattatataaattacatagtatacaaaacagcgtgaataatgtaattgtagtgaatgcgggaggaagaa

SEQ ID NO: 3563 - DNA, 2000 bp, Arabidopsis thaliana
gaattatgcacctaaattcagactaatcccccaaatttcagaaatttatgtatttttgcgatttaatattgtgttcacaatcataatggccaactaactaattgaaaagacaatggaatgactgaaaccatgcataatctctcaagtctcaacctatgaagaatcatgtaaccaatagactatcatcatgattagttaatgcatgatctataatgtattctttgaacatagatatgtcatttatctggatataaagatggcgttttaacctactttgcaatttttgttatatctttcttctaatacatatgatcaatacacttttgtttttaaaagaaattaaaaacttatttcaaacatcgatcacaacatgacatagggtgaatctacacctaaattgactacagtagttagatatatatacttcaaattttaaatatagtgatgtacgtatgtaattggtacttcatattattattatgatgtatgtaattggtacctatattttggaacagaacaaaaaaagaagacactaaacgagctaaagaacaatggaaatttcagttataaggaattgtgggataagggacaaattaaactaacgtaagactagcgcgcaggtctatatatgtgtcaaaagcacggacttatataggtacatacatgagatacaccccccatacacacttatacaacacattcatgaagagagtcatatttcattttcttttaacgtattttttgggccaatccattttgttttcgctattattcggattctatatttctagctccctattaatatgaaattcattaatcaataaaaacgttatttgtaaagatagaaacgttttcgaggaatttctcccgcgacatcaagtttacatattgcggtatcaatacacattttctgaaaatagagaaatgaatttttatcaaaagctgaaagaaacagaagttttttattgctaattacaaactgatttataagcgttaaaagtgaaccgaatttgagtgtgagtggtagcctaatgagtggtgatctccaagggattgtggaatctggacctttaggatctgcttttgcaaaaaccaatgccctcaaaagaaagcgtttatttcccaaaatcatatcactctcttccccattagcattagagttaagagaagcatatgtttaagtctcgtcctcaatacatatcaacgcaactttaggcccaaaggtcatctttcaattagtgcaacttctttttttccttgctctattctgtttttgaatgtacgtttttcatattacggtctatccgaaatagtcgctcacgttcttccacatgccctcaaaccatgacctcactatcttctttttcacatgataattttatgagatattacctttctctaatgaataaactttattctaattcacttttgattcttttccttaaaccaagtgcgatcggtttctgaattattttattggaaatttggcaaagatagagctttgttttgggcttgtttccatatgatctctagtgttcttgggctccttccaagattaggcaagtccagtctcctgctcatgtagtagttggatatatctcttctctgggatacatacctaatcggttttgatcttttgttggagattgttcgggtccggtcttcggcttcttcttttgtatgtaaccaaaccgaaattgaaattgtacatctctctctctctaactggtatattggatattttcctctaattcattatttccattgacaagatttttcccttaatatgaacaaacatattccattttagctttaaatcacaaaaaaaagagataaatttctcaaaagaaattataagtagacaccgccctttttataaacaaccctaaaagtagtaaaaataatatcgagacgagacgggtttgtttcttctctctatctctatatctaccaaaatcctttgccccccgaatctagttctctcgatcgaccctgtgacg

SEQ ID NO: 3564 - DNA, 2000 bp, Arabidopsis thaliana
tcatttttttgtgtgatgatgtgtcattcatatggaaagagttggccaactttcatatatatgattagatttctaaatgatcattgccgtaatattagtaaagatgtgtccagtgttttagcaatttttaccaaactaattttgatttacatctttaattaaatatttcatttattaataattaatgtcaatagcatgacattgtaaataagttcaagtacaagatttatttgttaaagtagctgaaaaatgtatatgtagattttagatctctaaataagattaacataagaaatctgtatcggtctaactaatgatgaatcgcgaaggacaacgttagaaaactaatgacgaaaatatgttcatgagaataatatatactaaactaataagaggtttggtagcaaacaactacaacacaaaaaaaagtcattatctagtagtgattattgataataaaaatttaataaaataaagagtataatgaaagtagtgcttaatttattaacataatttttttttattttattttgaatcaattaagaataggattaatcatacatttaattttagagtatttataataaatgactatagatttgaaaagaatgtacaaactaaccttgagtcacagtatcttgtcggaaacatgttggagaacacttgttattttctcttattacatagtatttataaaaagcacatgctattttttggaaaaaacattgtattcagtttaatatatctttttatcatgatattttgtagtaatacacgttttttattgagatcacacgtgatttctttaaaaatattcttattttttagtaatacatggtttttattaaaatcacatataatttttgttttaagattctgttcatgtaaaagaatttcataataatgttttaaaaaaaaaaattcataacgtattatgaaatagcatgtttttaaactaaatataacatgtgaaattttaatgttacatgatattttgaaaaattacacggatgtgtttcgtttacttttcatcttacaacaaataaaggatagctttattatttcctttcttccgacaacgtgggtccatggttattttgtaacaaaaaactttatctctgctagtttcttaatttgtatgttttatttggttatctactaatattacctttaattttattattttttaaatttaaaaatatagaatgatatatgtcaaacttttgtgtgatgcttttgtgtgatggtgtgtcattcatatggagagtgttgaccaattttcatatatatatgattatatattaagaaactatatattacgttgtctttttcaaacaggtaaaaatgttatgagatttatttgatttttaagtaattatttaaattaaaataaataaaaatatatattattttaataataggggctaaatagaaattatgtggaggagaggggctgcgtagattaaaatccaaaaaataccgtaaacaaaaaaaaatattcccttgcgagagagggaagattgacttattggcacgcagccctaggcattttcgtttcgtctccacacgcctctctctctctctcgcttcttcaatcattcatcactccgacgtcagattcaaaatcctccatgatcgatcccaattgatcaatcaataaccttatcttcttcatcttctctgtcagtatctgaatctgcatctggaagcgtgatttcatcatcatgtatttaaccgcttcatcttccgcttcttcctccatcatccgagctgcttcttctcgctcttcttctcttttctctttccgatcggttttatctccctccgtttcatctacttctccgtcgtctcttctcgctcgtagatcttttggtaccatttcccctgctttccgtcgctggagccattcctttcactcgaaaccatctccgtttcgcttcacctctcagatcagagctgtttctccagtcttagatcgtctccagagaaccttctcttcc

SEQ ID NO: 3565 - DNA, 792 bp, Arabidopsis thaliana
cgatctttcttcgattttttagaaaacttatcccacggagtcgaagaattataattctcgttttaaaagcaaaatatgaatgaaataggcaaaaatgtctttcaaataaaatacaaggaaaacgaaatctttggtctttaaatatgttcatgaaatttgtgacgtcattgatgaagtggctgttacgatatattcgaaccttctccaattggttagtctccttcttttttttgcaccaatcaaatggtcaaatcattgtccaagtgttaccaatacaaaccaaaattgatgttagaatgtatttgtcaatgaatttgatctatattgtgtccagattccatatataagtacactataaaccagtctactaattcctttctctcttctggtttaaggcttcggtttgctatgtaccagtttagtttgcgtatgaccaaacccccttaagctcactaacgatcctgttgggggctaagggttggggacctggggtcaatcgattaagtttatttaaataatggttacgatcatagttataaggttttaaccttccggttaaccagtgattattttagctaattaggattttaataagaattttgatggggaggcacgaacaagaaatgaatatcttagaattgaagtaaggttcagtaagggtattatcgtaaatcaaccaaacaatgtctggtccataaattgcggtgcccaaaccattccttcaagcacattccaaatcattttcttaccactcaaagagtgcgcactcattatcatcgtttgaaactaaac

SEQ ID NO: 3566 - DNA, 830 bp, Arabidopsis thaliana
attgcaagtaatgtatattttgttcatcactttccaacttactactacttgagacattaatatgagtttgtgtttgtcctttgagaaccaaagaaagctatacaactttttcaattgaggagctaggtgatgtgtgttacaatttccaaatgttatattgtaccaatgtcaagggagaggagtgtattcaaccacatcttttagaattaatgattttgtgttaaaaggacaaattctatgtatacaatccatgaatgttaaaagtccaatgatatctggtattcttggttatagatgtacacgtctctcaaggttattctggtgtacttgatcttgacttgtcttttaaatggttaggtgtatataggaatattttgactcaaaacacaaaggtgtgtacatgttatagatctatggttttgattgaaaatctcaaaaagcttttaaaaatcatatcaatttctatatattcattcatttgaaatcactaaaattttaaaatcattttaaaactcaccaaaacctgatgttatccaagatcaagaagggaatgttactcagctagtgcctagtgccatagccgtttaaaatgggctttggtcaaaaaaagcaacgcgagcccactatagttttgactttgctgacatggcacaactccgtggaggatcggtctgtgattggttcttcaatatccatgtgacgttccctctctctctctttttctatatatcttctttgccgtaatttttccgaagactcacaatttgtttttcattcagaacaaataataaaaacgaaacacacaaaaaaaaaaaaaaaaaagaagggac

SEQ ID NO: 3567 - DNA, 922 bp, Arabidopsis thaliana
ggttgccgctaaccggttccatacagaaatcaggtttttcccaaaataagtttacatgcttatctcctccctcacaaatttgattagttttgtgtatttaaaaccttatttgagaggtatcatctcttcgaaacctattgagagtcccggatgtagtttgtttgattggttattttcatgaagtttacggttattatcttgaccggttaaatgagtcaatttcacataagattatgaccttttaagtttggtttatggatgaagaatggcgataattgaattgttttgtaacccttggaactttgaaagtaaaacagtttataggaaaatctgggctttgtcggtttttgtagtgcaaagaagcttgatgaaaaagacttggtcatgttgttggcgttgtcgttgtaaggcctcaaattcaattacttgtggaacttacctttgtccatgaacggagacaaagttagcgaaaatgtcagcaaattatggacatgcattttgttcctcgaaggtcgataatcttatgatctcacgcaatttccacctttttaaaattgttggaacgcatattcaaatgttgattaagaaaattaaattataacgacatagaagaaacagttccatacttaaagattttaaacttttttttaattcctcctggtcagaggggtaatatcgtaattttctaaaggcaaagaacaccgctataaatagtggctgttgaagtcgtcttctctctcaaacaaaattcaagagtcagctttatcagagaaagtttcccccattggtacagtttgattctctcttattcaaactttttcaaaagcgtgttcttttgcaagataagaagataaagaccaaaactttgggtcaattatatagacttttcattttgtattttgcaggtgaaaatttgtaagag

SEQ ID NO: 3568 - DNA, 2000 bp, Arabidopsis thaliana
cctatcatgttcaggatacttttcttatacttctgtcttttttttttttttttttttttggatattccctttccgcttaggttttccttttttcctcctctgtaactaagaagaagtaaactcggattcagacagaacatggatatgggttcacttgtttttcttcttttctttatttttgtttcagtgtggtgttttttgattcaaaagtggatccccattgtacagttaccaaatatggatataaacaaacaaaagttaagggaaatatgtatacaaatttcaaatttaaaatattttgatatgttgtcaaagaattatatataaatatattaatattgcaattttattaaagtaaacttaccaattgatgaaacacaaaaaaaaaagtccttgataaggttgttttacagtaatttgattctaaacctgttgacttgtaatgcatccggaatttggatttcggatagtttcatagaaagaattatttggttctaatgtaaattatgttcatttcgtatttgctaatggtaattaacattaatgactatgtcatattcgttttctaattttcagcgactaacgattaaattgtgttcattttgtagttactgaaaataacgatgagcaactgaacgtgattcaaaatactcaacgctaaaattttcattggtcaaaaacttttaagtcattggcaatggtgtcgtttgaaatatgatcgtgtatgtttgttgggtttttagttatcattgagtgatttttttgctaaacaaattctgaatggtgagttgatgattagtttcaagacttgcaagtagttgagtgatgagatcaagtactagaagaaaaatcaggtaaactttttttgtgttatatatcaaaatttgtgaatatggtctcctccaatatatggactaacgtgtatatttgcgtttaacttaaatgttccgtgaaggagaataaagtggcaaagaatatggatagtgcgtcaggaccacgcgacgtgaggctatcgttgaattaaaaggatgattcgatcgagaaaatgagaaccaatcgccttcgagaataagcaaaaatagaaaacgtatgggttattccacgcgtattgctcttgactactgaagaagaaaccaagaaagatgcttgagattattctacatttcaaaagattccaccttatatgctcattcattatcgcaatacatgcatggttccaagttttaagttagtaacttttttccgaagacaactaatcttcaactaattaccatcatatataccaccattagttggttttgttaaactgtaattcaatgtaaatttattaaaacattttcatttagagtttacggtaaactttcgaatggtaaagttgtagaattcgtactcgtccacttgatattctttttcgaatatgttagtgatgttgatcatatccaatcctagcagagtaaaatgcgatatgattactacatatcatgatatcaacatcaaacaataataagtctaactctccggcgtgtctttgtcctattttacgtacctgattacgttgtcaagtaaccaggcttacggagaacaccgaattgatcatggtcttatcatttgagacattctttaaaacgtttataatttccatatctttgaacgtttacattgccattatcactaaactcttagatacacatgagtttattatttgaaccatggtcaaataataatttactaaaaacagcaagataattaaacttcagataagaagaaactaatattagaaggaaaaaagctatttgcatttaaagaaaccgcgtccttaacaaaaaaaatctcgtgcgtgtccctcccgtgtgtaaaaaaaaaactctttgttccttaaaccgactttatcataaatgcatatatatcctttgccctctccacttttcttttcctcatcataaaaaacattctcagagcaaatttcaagtttatttcattcaatttcgatccgagtaacc

SEQ ID NO: 3569 - DNA, 926 bp, Arabidopsis thaliana
tgctaaacaatcgaataagctttaccttatatgggagatgacttgatcgacaaggttgagacagaaaacgagaattagctatgattttttctttgtgaaacttcctatacggtggagcaaacacgttgtgtagatatataccgattctaagtatgtaacgatgctgcttaaataatttctagaccatgcaagatataattgttttttctcggattaagattcatttacataaatgattttaaatggaatgaaatctactatatattaaaaggtaaatttttgtaaatctttaattattattcatatccaatgccattaatgtttttatataatacattttaaagatttttctaacttacttaaaaggataaaaaataaaaaagattacacatatagacacaatctagctactgcaaaaaagatttttttaaaaagcataaatctactttatttactaattataaatttaatttgtttcacttttattagtgataacaagattaattgttttgtttacacaaacaatattgttttatgatttcacttatatgaacattattatcaagagttataaagtttgcaaaagaaataggtttttattgactgaagaattgagaaattttctcatcacctttaaaattaatattgggcctagcgatgaaccgggccaacgcccattaaacatatccgataatagtttaaacccggagagactcaaagtagagaaaaccctaattgtatataaactaaaaatacttccttaattcttcacttcttcatcgccgtctgcacaaaaccctaatctcacaatctcctacgagatctatcagtctccacggtaaacgacactaatccatttcaatttctccatcgtcttctccgatcaaattctccatttacttatctgttcactatttttccagaag

SEQ ID NO: 3570 - DNA, 1223 bp, Arabidopsis thaliana
ttaaacagttgttctttttttttttttgaaaaaaggtttgttgtaattttgtttcctttttctttcaattatataattgtatgtccttgctatatttaatcgattaattaaagaataataaagtcataatttatgaaatgaaaaataccggtgatatttatatatcttcattctttttattctgtaaaaaatgaaagtgctttaggaaaaaaaaatgctaaatgttaaaaaaaaaacagaaaataaaaatctaagctaattgctattagtatttctttaataacaaaataggattataggcggactttgatttgttcatcaaagaatagtttataacatgaattggtaaacggtaaaatttatcctagaaggtagaagatagatgtcataaactatgcataaatagatagatgtcataacaaatctgatcacttttagatgttgtaagtttttaaagattagaggatccaatttgttataatgaatttgcataactagatatatagtttagtctggataactcattactattagtctttaagcaaatgtgatcagagtgtgcaacatagaagaataccgagacatacaaaacttgcaatttgtaaaccaccattcttattttacaatttacacaaattaaatgggccttattaatataaggcccaacagattgcaaaatggtgaatatggcaacatcgattcttatctctttttaaagatatttaccgttggtttaggacacaacaccaaattattaccgttggatttagtcggttctgtctgaagcccatttttgtttttttctgtcagcgtctgaagcccatttataaacacttgaaaaccatactttagctaccttacgctgttcttcccctttccttccgaaattagggcttccgtgtttcgcagtgctctccttcaatccccaggtatcgaaactctgctcaattcgatgattcatattgaaatttagtgctttcactgctcggaattacgattttatattggttcgatgcatctgcggtgatggtttccttagcttctgtctttccgatttatcgcttccttgtctctgaattaactaaatggcgtcttctttggggcttttttataggtcttgagttagtgaatttttgttacgttcttgttttatagtttctaacaggttatgctcaaaaatctgtggtttctttgtcccttttttttgattttgtagcttgaca

SEQ ID NO: 3571 - DNA, 1142 bp, Arabidopsis thaliana
aggaagatgaagaagcttacgtattattacagcctttcatagaactcttgcttgtatcctaagttacagagtcactttttggtttattattatttgtttcatttttttaaagaagtattgttattttattttactttttgtcaactattgttatttggttttaaatatatataattttttccaaatagaaaattacctgacataaatagatattgtggatactttttttttttttttttgatattgtggatattgattgatataaattttgttttttgaaaatgttgtgatccatgtaatgtatagtctcttaaacttgaaaatctgctcagtgctgctcatatatatcttgaaattagagttcataacaaaacttttgccaagaattgttcttcctccaagcgtaatatataattatcaccgaagcatccactttcaatgtacgattaagagataaacaagagatactttgtcaattggttattggttaaaaaaaaaaagtaacgtacgtacgttaaagatctgtttatgtttttgtaacgcttagttgttgccatgtaagttgctgaggatatctcaaaacggtgaaatccaaacaaaaaacataaaaaaaaattcctttcattagattgttatcctacgttaacaatccaagccaactctgaattattttttatattcttaaacagaaaaatcaaaaatggaaataccatagaagagcaaatagacattacaaaaataaatcgtactgttgaatgtacataaaaaatttcttacgcgtaatgctatgatagcttggcgatggtctcgtgacgcaagatttttggtcatataaattttggaccgttaattttaaaaaccatataataaattaataatcatagaagaagaaaaagttaaaatggacgatgggaattgcaactcgggtggaccccactcagacactgatctttaagcaatcgcttcgtttcgatttcgcaatcacaaaagtagcaaaaatcgaaaataaaaaaaacttagtagcgaacgaacgaacccgcccactcatttagtttccagatttttcttccggatctctctgctctccgaatctcccgagttttttttttttaatttttgtttctcaccggcggcgagaggat

SEQ ID NO: 3572 - DNA, 1268 bp, Arabidopsis thaliana
ctgggcagttaaagtatgctatgactctctgcttcagagtctttctggagtcttaagcactcagattggatcgggaagccatctgggacgaaagcattcagcagcaagggtaaaattacactgcgggtagtagctttgtagtctaccttgagattgctcctgcctgtgttattcttgagtcaggaacatgaagtggtttgctgtcaactttacttactcaagccatctccgcaaggtagaaactatggttcgcgttatttcgtatgtaccatgtttttggtcgtttgtgtagtttctaaccttccacacccttggcttgcgattctttccaaagcagagatgttagatcagaggatggagtgggttctcaagtagaatgcacttgcgaatccctcagatcagatttttcataggtaaagttcgttaacttcaacaacaccactttagtaaacatgtgataatcaatcgtcataagcatcttcgattcatttttatcttatgcaagtgtttgctttattatgatttgttaagttttgcataaatacggacgttgaagcacttcccagaactcatgagtgtttttataaactatttattaaaagttagtataagaaaactataacataaaagtaaaatataatttagacaaatgtagcgattggtccagttactcatccaaaattccaaatgaatcttccaccgttgataattctattccattgttttcttctgtagaagaccatatattattaagtctctagtccattgtcaataaatggaaatacaaaaaaaaaaaaaaaaaaaaaaagaagaagaagaaaaagacagcatttaatgaacgaaaataatattaatgaatttggaagaaggaacgaaccaacgagaaaaatcaacgaaataatttagacaaatgtagcgattggtccactacccatccaaaagtccaaatgaatacttcaccgttgataattctattcaattgttttcttctgtagaagaccatatattattaagtctctagtccattgtaaataaatgtttctttcaaataaatggaaatacaaaaaagaaaagaaaaaaaagacagcatttaatgatgataacgatttggaagaaggaaccaaccaattagagtaacaaaccaaggaggcgactcacatgaaagcaaaagctgacatggcagtgaattcagttttataaaaaaggcttcaaggccgagagttcgtagtacaaactcttctctcagtcatcacagaaaataaaaaaca

SEQ ID NO: 3573 - DNA, 430 bp, Arabidopsis thaliana
gacatttttacagattattgtcatgtaaaattttggaatcaattagaataatataatgtatgatttgtcatgtgagacgaatatacgaaaagttaattacattaagataatcggattacgtagcacgtatattactattaccatattctagagattacacatgatcaatcaaatatttaatctttgaaatgttacgcaagcaaaaatgaatttaaaatctgaaaatacaatccaacggctgagattttcttactgtgtcagtgaaaacgagagaaacgttctagttcactcacttggttacacgtgtcttgggatcgtttagcttttaagcaagcttctcttttgcgtaatttatttaagagctgcttgcttttatcatcatcactctctctgcgtccaaattttgatctttgttcttctcaaagcgaat

SEQ ID NO: 3574 - DNA, 2000 bp, Arabidopsis thaliana
tttcatttctttttgccgacggttggctgttagttaggaaaaagaatttttgttataggattttctcttccgtttcgtacaaacccaatcattattctcgtctttatacttaactttgcctctcattttcatgttatcaatcttttaaattaaatatatcgtcaatgactgttatgaataattagttcttcattctctgccttggttcgaacctcagtcacatggtgcacgttattgtgatttcccatacctcaagagttattcaagatcccttacagaaatatatttatataatcttttatctaatgtagttatttacaaacatgtattatctaccaaaataaaaagggctaaaagcttcttgagtgagaccgcttttggttcgattcattttcctacactccaatagtattacactattgtatataacaagaatcgtgggatttgtttaatccgtacaatgaaacaagaaagatatacaataacttaatatcatttttttttggggacaatcttaatatcatttctaatttctatagaaccaaaaacactcataacaacttaaactttgttttttgtgagaaaaataacaacttaattactagttactacattgacaatttaacatcttcagctaaaaccgaatgtatatgaacatttataatctagttgctattgtatatacgattggataatacgcatatcgacatttaaataattgagcctgaagataattcacaaatatgcaatgtaaatccgtccatacagccaaaagtatgtatgtcccatgcataattgaacaaaaagaaattatattaatattatttttgttgtcttctgcaaatgctaggactgctatcattatcatcattgattttaatattgatgtttccagaaaaataaataaacaaatataaagaaaaaaacaaacacaataagtaaagctacactattaggtaataattaaagctcatttttaagtctaaaattttaattataaaataaaaacattaaaaagttaagacccaaagaaacataaatgcttttttctttcatcaatgtcaaaaaagaagttttcccaccaaatggtcaaacttggatctttgacaatattgttccaatttcatcatgccctatcttttctatttatacacataccttagatataattattaaacccaaaatttgtgttaagaaaaaaaatagacccaaaatttgtgttaagaaaaaaaatagacccaaaatttggaatatatatataagtcaccgctggaaaaaaaattattgcaagtaatttcttatatgaaattggaatgataatattttgatcaagtatccattactaaaattttacaacgctagataacgagattgcttgaagtcgaacttgtgaacaaattataataatgtaaaactaacttgtattgactaatctttgattttttttacaataatgagtgatattacattcattttattaactaaatacaacgaatatgataaatattcagtcctcttataaactttatgatagtgaaaatttgagacattgacaattctagcattctaacattttatgagattacatgaaatgtcaatttagaccttaaaccaaacgaatacatgattcaaatttgaccgacaagtacatgatgccttccctttgatcacgaaatttccacaaagagtccgtgtctgcgtaattaaccagcaatttcaagggtgtttacgtaattgtagcttaacaaataaaaaacacgaaagaagatggcgaagaaaacggaaagtagtagatagataaagaaagagaaagagaagagctggattcacatggtcttgttctttctctctccttcttttctcatcttgcggcttccctttttctctctatcgccacaatgatcattaccaaccaaactgattgaaactcatttgttctctctctctcaaatccactctctctctttcttttctcttctcctctctgtgtctctatcgcc

SEQ ID NO: 3575 - DNA, 589 bp, Arabidopsis thaliana
ggtaacgatttggttaagcttggtgaaagagattgaagaatctgatgatcgagagagcgagaaagagattgtgggagatatgtgattggagattggggatctacggatttttgtaattgagtgagagcggcgggaaaatcggcgttaggggggaaatacgagtctctttagggtttcgaaaagtcgccaagagcgggagtttctttttgagtcacgtggtattgacacgaaccgggtcggatcctatatccaatcgggtcctatgatgcccttgtgggctgcgcatgagagcaattattctctgcggactcacaactattctcaacgtgaactttctaacttgttctccaatatccaactatataaggacacgtgtcaatctcagagacacataaatatctgcggctaaaaatatcttattagccgcctatttcataccaccgtttgattactttagccaccgttgttttacgtctataattaagtatcttccactaatctcatatttcaaactgtacttttacctcgagctctctccaattttctcatagctctattgttcgaaaattctgaaacgaacgttaccact

SEQ ID NO: 3576 - DNA, 520 bp, Arabidopsis thaliana
gagctttgtagaagcaaagcaagtcccagtttcatagtaaaactaaatgctgtgatgtgggatctgcctgcttggaactaatgcctcttcatcaacccatacatgtttaggatgtacatgtttagctatcaccgtcctctggattcattgctattgtacgtacgttgtaagtcataacaaagatattgacaatgataaaaccaattcttgtatacaagtttttcaggctcttcttaacacttaacatgcaaatttgggtcatcatcagttgtatatgaaagaatatgtagagtttcatatatttccaaaaacgttagagaactattaacatgtgacccattgggcctgttttacacctttaggtccatttaagttgacgtgctccaactcgtaacctccgattaatgccacatgttctctcccgcctgaatcatgtcaatctcccacaaaagatctttgataaaaagaattgagccctaattccttgatgtttgttgaatcgcacagcagataaaaaaaa

SEQ ID NO: 3577 - DNA, 931 bp, Arabidopsis thaliana
atgcctgaaggaaggcgaaaggaaggatttggaaacataaaaagaatatgggtttttacagatggaggctgtgtaatgtttttcaattattttcagataaacttgttttctatatttggatttattgttggtttgctcattcagttcataaaactatttatgagaaagagagaaagagagagagagagactttgaaggtaattattcttcacaccttttattataattcaccaaaattgggatgtttgttctattcttgatcacacgcctctctgtcgcttccttttgacgttttctttcttttcttagctttttcttttatcttttgtgttttctgtcttttcttttccgtagttatttgggattccaaatttttttcattcctaaatttctccacgagctcatcacctcctttcgtctctgcctctcatttgtctacaaacattttttccttttgattcgtctctctggtttattgctcgttgatcgtttgtttctaaattgcattctgatttctgatggatcgtgattttcatcgtcgtggtcaagtggtaagcattacacgcaaacacagctttgatcattaaaaatgtcatcttatttaaatcatgtcttgagatcacgtaatggtcttaggtcaatcaagatcaacgcgcaacaaattctaatgtttttacaaaatttgaaaatacttatctacaaatgtatttataaagaaacctaatttgcctttgtgttgatcatgatagacaattgttgttattagcctgttgatttgaaggcagagtcctctgttttcctgcaacatgttagaacagctcatttatgtgttttggtgaaaacgcaggcgaatgatcgtacacaaagcaactttgttcgattggataaaccgagagctgtagacgatcttgatataggcaagagagggaag

SEQ ID NO: 3578 - DNA, 1721 bp, Arabidopsis thaliana
attcgtgcgcttttaaaatactatcttatattgtttttggacaacagagttagaatcttcattcatacaaaagagacattttactttgatttggaatatatatatatatatatatatatattaaaactactaagtcttgtgcatgattaggtatataatcattgatggataaataagagatgaggttacatattcaggcttcaaattttttatatttggtgatcaaaatttaaaaaaaaattaggtgagtttggtctttttaaagctaaaaaatattgaaacacaacaaagcaaaaaaatgagtgattgatttcaattataaggtgaaaatagaaagaaaataatacaaaaatattacttttaaaaacattattaatttaagaagaaaaagggcaaatgagaaaagtggactttccttttaggctgttttaataatcgtcttccccgcggtttgcccatctgtctccgtcttcatcatcaagcaaaaaaaaaactcatctttctccactctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctggttcatctacagagttaataatcattaagcgaagaagatccctagaaagattgatcagagaaagtctcagctgaagcacgtttttggaaaacccagatttgacgggtatatatctaatattttctttcaatttggatcaattctcttgattttctacctttatagagcttattgattcgtttccctttgacccaattttgctttctttatttagatttcaaatttcttactcgatttcgttttgtgccccatttgaggatcttcgttgtagacgcgattctcagtggttctgagtgttaattcgagtagaatctcttctgggtaacgtttctcatttgaaattcacagtaaagttttgatctttcattcttttcgtttttttcaatatccagtttatccatagtagttgactattgccaaccttatctgacggcagaattttgtccctttctgatttgtaattttgcagttcgactaatggaatgtggagttgttgattgagaattgcattttttattatgattagagaattaccaactcattgttccaaaagcttgtgcttatcatcattgctatcttgatgcaaatctgaatccagtttctggttttgactttactttgaagcttttttttttcagttatgtgaaaatgttgctgtgatttgttagatggtttcaatatgcctaaacaaatttgtacttgctagttacaatatttgaatcatgtctaggggacagttgctttacttgtttgcattttggaggtagtgatctgaagcattaacttaaattgaagtagcaggttgtgacattgtaacattagatgttaagtaatgccgctgccatggcagtgactatttcatttgttaaaattttgttctacttactttggcattgacatgtagtgtaacgagctaatagaggattgttacttttttctgcatctataatcagttgctttgaatggtttcaggtactaagaagctgtggaggatctatatttgaaagaagagaacaagg

SEQ ID NO: 3579 - DNA, 2000 bp, Arabidopsis thaliana
tactagaacaaaaagtacattctttatcgtcatgatatatattcttatggcaaaacaaaagaaaaattaaaatattctgatgtgtgattctttttcaagtttgtaactgggtgatgaaaataacatgggattattgtctgatttatatgaaagaaatgaagaactggctttaattatctttaatgaaactcgttcgagtatttatttgcctatttggtaattaatttgcggtttccaacattgaaaaagagttgaaaatgtaacgattgtctttcaaaaaacgcattatgaaaatggaaccatgtccatgttaatatcactctcaccattcttagtgttattaactaatatatattatggaagagttttctgttctcttaatgtgtacatatcatcatggtaaacatccaatcaaacaaagccatgtcaccattttttttttttaacactaaattataattacaatgttcatttaataaatatttatttctattaatattaattattaacaaaaaactaataaaataaaaaatgattttaaaatagtaaaagtcataatgtgaaattttattagtaacaataatattattaaaattttaacataaacacaattaaaaatgatcatacttcaaaatacaaaagaaaaaaagaagacaaaattcagaaaaagaatcaaaagatacatatgacatgtgaacaaatgggtagattagtatatattacatgttatacacataatcatgtagtcaactttttttaagttagttattgaattattaaatttttatggtcatacagcctaatttctcatgtatcaattagaccattgtcgacaaaacaaaatagaaaaaatagttgaattgattaggctccatgtttgactggtacgccgtgtacttgtcaatgttccggacggcgaatagtatttttgatattaggaaatggggtttaccttcaaaatattggtgtggacggatttgtggatacttgatcagatatcaaaggcggcacaaaatgaccaacgatcgacgaaacagtgcccaaaatcagagtcagaagtgactagctcgatagcatgatcgatgccctttcacccatttaaaccattccacctagaacacttcaacacgactgaagctaaaacttttgcatatctcatagagatatgtttgataaggttgctgaaaataacaacttctactataattttgtcttttattatttcgaccttctcttaagaaattcgcccaaaaaaatttccaaatcaaaaagttgttattatcctaacagatcttaaattatatgtttcgattttcggttatatactggtaaaatctgaaatccgaacattaaaaaaaaattgaaacccaaacggatactcaaaaacacctacaacccaaccattataccaaaaaataaaatccaaacgtaaacccaaaaaacacaaaacaatatatacacatatttttggattttaaggatcatttggagcgtttttctatatacatcgtttaggtttttggagtttttcgattcaaaaatcgaatcagaacatatttcgattctatggtcgcattttttttttttcgagaaccattccgaacccgtataaatccaaaacgaaccgatcgaaacatattcagtaccttccgaaatctccctatctaaaaaatccaaaaccatgtcttaccctacaaatccaaaacccgaattaccctaataaaatccgattcaaagtccgaatgtctaaaaaatccaaaaccctattttaccctacaaatccaaaacccgaattatcgtaataaaatccaatccgaagtccgaatgttcaagcctaattgagctactcactaacacacatcacacatgtgtaaatcacacctaacttctccttctatatatacgcctttgaaagaccaatcctaacttttcattgtttactctttcgtcttccttttcagagttcaatcacacaacacctctcttcaatagcaataacc

SEQ ID NO: 3580 - DNA, 2000 bp, Arabidopsis thaliana
ttggcaaaccatctacaagctatctgacatctacagactacgtacagttgtgttccatttgttacaattacaacaatcagcttgtttgtttttggcaaattaagagtcatgagtgtgtatacgaaattactttttggtggtctgaatttatgaatgcagttacactaacccttcttcaaaaataaaaatgaatgcggttatactaaactatcaaatatatctactagcaaatatgaaactacattcagtaacagtgatctctctttttggatacaagatgaaacattgttctcttctcatgctctaaatagaaaatactctacgaaatgaaaatgtatgtcatcttataagaactatacatttttactccgatggttaattctttgaaggattctcgacagtttagaagtctgcaaaaaatataatctcataagaaaaaaattctaagtctcttgatacaatgcatatagaaactgacaaataatcgaagaaattgtacttgagcccattacgactattgaaaattctgattttggatgaattcagcggaaactacaaatttaagagtactttatgtgtataatatgaagcctatatatatagaattactaatgtaataaaataagaaccggtgaaaagggggacaagatcacaaggttttcgcattcagtgcctttacagagttatatatttgatgatgttattgcttacttgcctaatagtactatactactatatatatctaaggtaacacatgtatatatatgtcacatagacattactagtatatattatgtacttctatcatatatttatgatattgcagttgcagcgtacacaagtcagctccttttgacttttacatctcatgaatgcattgccatgacatctaatcttactcgagatttgtgcatgcacattattcacttttgtcttttgcaatttttgttattgtaaaaaaaggaaaaacaaatgtaaaagagagagagaccagaaaggtctaactaaacctaaagagtcaatgaaatgtgtttctttcttgtgggattaatcaattcactctttaacacttctttataccattgaagaaattagatgaaagagtcacgagttgcttaccaaatccctcacaagaattgagaactgataaaccaaattgagaagattaaatatcacgtctccttttgatctctattataattaatcgaaaataaaaataagagttttcaacaaaacgtgatcattggtttacgatcacttgcaaagtcaaacctaaaacgtagcattagtacactaaccttaaatactaattatatcatgcaaaccctaatgtcattacctaactatacatgtgtaatgtgttcaacagatcttcttaacccacattagatcaatattaaacaataaaaagattcttatatattctactacttacttcttcttattcccatccatatttttctgtgcctttaggttctcaactaatctcatttaatttagctagcacacagagaaacacacacgtatataaataatatgataacacacaaaaagactcatatatataaataattagagtcattaaatgtggattcatcattaaatgaaacaactcttcttctctgtacaatttctcttcacaccttcaccaaattctttgacttcaaaaatcttataaaatttatatatctccaaaaccataaaaccaaaacgagttttcacaaataaattacttagttgaaatttcaaatctcattcaattagggtacactctctcaacaatccacattaatgagggttgctgcttctgatggctagcagtaacagttttatcgcctccacttcttaatgccatctttttcctcttccctctccttctctatatatattttctgactctgcaaaaccttaattcatccatctctcaaacaccatttttggaaacaccatttcatattccttaaacttttccattttagtatcatttcatattcattgat

SEQ ID NO: 3581 - DNA, 1302 bp, Arabidopsis thaliana
tgtttggagcagggagagggatagggtttatgattactcacctggtcagtatcgtggtcgtcgtattcgaggaagaaacgaagaatcctattttgtagagagaagaagaaaggagaggcaaagcgagtcgttggaactgatacaacgacgacgtttcattgggagtatcaaaacctcaatttggattttctctgtagtctttttagaatttttctaaaagggaaacacgtgagagatgggaagaggcacgtggtcgagcctcatgcaaaagaatggttgcgtttgttttccaaactgcgagagaatcgtgtgtgtaaatgctcccagttccaacactcgacatgttttttttgttttaggttattactgattattcttgaacttttagcaaaataatgaaacaattttgacttttataacacacaaaaaaagcaatacaatttcaaataataaatcgattaagagataaaaattgtgataatttggatattttaattagtttgtgcaatattcttttctcgttgatctctataaattagagaggcaaatgcgactgctaggagtagaaccttaccattggactacaaacgcttttgtgtttaagttgactattaaatttagatatctgattgtttaggatagtttaaaacgctaccgttttggaatctttatacgctaccgtgttattcttctttgaccaaaattctggagaatttgtcttcccttcgtatttctggcaacttttttaatactaaaattctctctaaagccgtcaaagaccaaaaaaaaaaaaaaaatacgaactcgaaatctctctcgtcttgttgttgcttaccattgaagctatcaatttctccgtttgatttctctcttctcaaaacctatttcgacggattattccgattcctgtttccccgaccttcacgcttcgtacttttgttttttgaaaaattcgtgtttcaggtacgttctcgatttctatttcgtttttttctgattcatcaatgaaacaaaatcgtttcttaatatacttgttgttctttgattcgattgatttttgttaggaagagcgcatgtgtagagttggtggtgtaattcagaaaactttccggagattttttggtgatgtgttgttcgtaggtaaattttgaaattttggatttaatggttgaggaagatagatggtgtttcttcaatggatctgtgaagacgagattgttggagattgatacttatcttattcgtctttatggctttgcttgattaagaaattgtgtgattgttttggggaggggtttaaac

SEQ ID NO: 3582 - DNA, 417 bp, Arabidopsis thaliana
tcgtagctactcttaggcagcttatggaaattaaaaacttgataagtaaaactcaataatacaacctttatttttgttaatgggaataaggaaaaattgcctgtgttttactaatcttgtacatgtagtttattttgtttcagtgtcttgtttgtgtggttggatattaaaccgattgaatgttcaagtggacagataaaatctaaccggtttggtgcttgtcgacgaaaaccgaaccggtacagaaaatatcttgagcacaattttagttctaatataaaattcattaacaagagagaaaaaaaaaacttcaaattaaaagcttcgtgtcttcataaaaccctaatctcgcgacttcgtctctatccccaaaaaccctttcctctcttccttcttgtgtgagaccgagaaaaaaag

SEQ ID NO: 3583 - DNA, 2000 bp, Arabidopsis thaliana
tgttatgtaaagtaaaaaaaacgagattactgatgcaattaaaaggtttattgggtaatgtgtcagcgaaagatcatcgtattactgtagactagagtgtaagtcgaaaatgtgctagtaattattcatttctgcgaatcaatttttttttcttccatttctgcgaatcattcttatttctcaagttggtttaaatttaaagaggaagttcactaattacgtaaaactctactatgagagttaatacgagcctatgaccatcaaaagtcaaattaatgaagagtaaatctaattggtcggtaaattgagagtcttcaggattcagttacagttgtctataaataatttctatagagttatttgattttgaggtttgctccagtaatttacgattttgctagtgggcattcaataaaagagacatgtgtattaaactaagtaataaataatcatgctccatattaccccataagttatggactttgaggggtcgacaattcaatggatgtattcacgaaaatggaggtgacaataaattagggctgcgtggtgtaagttgctaaaatttggaaatcgatgaatttcttatacttgtatcagaataattatttttatacagtatattagtatatggactctcatgtgctggttacaaagatcttgtcgatgcagtttcgtggttaaagatgatagtcaatgcaacattcaagagcaaagtaaaaattagaaagtgataaatatatcaggcacccaaaaatttaaatttaaatatttcttgtgttatatttagtttagatcttcacgccaagaaaaagcaaacacttatctgtatattgataaatcggaagagaatatttcgggcagacgcagcataaatgggttcagcattattcagaaaatcatttctcttaaataaaagaacttctaaaaaagcacatttttctattataaggtatttatctgataaaataaaaaaccacaagaaaaatcgaaataatagccttattttctctcctttaaattttgtcttctttcggtgccacctcctttatttctctcacacatcctgcattaataatcagcaccacacggttttgaatgtcaaaacttacatatatattcatacagtacatgaactcatgcttatcgtatacctatatgaatcttttgtcaaaactccgcatatatattcgctgtaaaatacgtgtgtaagtgattaaaactcgatggttcaaaaaaataactaaaacatatttattcatcagaattttctcacacaaacttaagattgatgatagatatcaacaagtacatgagttgaagcctgttataagttattatgaatccgattattattattgtgtgtttatatttttgcctttcacttgtgtaaaaaaactaatacttactacagtataatctaataatgtactgatatccattgatgtgtcattatttagattcaaatttggaattttgagtgtgtgaattgatagtataataaagacaaaaacgtaaagtacttgcgtttatgtttgttacttttaaataaaagacaacaaaatatcattgatatttgtttaattactaaacgtaaacgtccaaaaaaatatttgtgtttgaaaccgtgtagagtaatccaaagaaggagagagagatagaagaagaaggctgactttggagagaaagagagtaaatgcattttgctgtccatgttgactctttgaaagctagcctcttcattattgttgcttctcattccattattttattaattacttactaattaactcttcttgtttctctctcacacatcaatcttacttacttctttctataaatataaccaacatctctcctccacttcttcagacaaaaccaaacccatttggactttctttgtcttaaccctaagatttccaaaggttttccaacaaacccgcaacgattagcttttgttctaatatctcatcaaaaccctttcaaaaggtgaaaacaga

SEQ ID NO: 3584 - DNA, 586 bp, Arabidopsis thaliana
tgtagctgattttggagtgtttaacaagagatggttcttctttttgttttgaagttgtttgtttgttcgatgatgtttggagtcaaatggtgttgtaatttatagagtggagattgtagagtttggagaatgtgtaggagattcaacgttggatttctacttcttacctaaaatcatagtttcagaatcatgcttattgtcatgagcttgacttgtgaagatgaaccagaacatgcttattagtataacgtttgtatttttatatagaaagttgttaactttcatctaaattatgagaattagaatctcacaaagaacagaatcgtggaaatggtgtaatttgaaacataacaaaagtatggtttggtttgtttgaataagaatgtttcaaggagttaaaataaaatatttgattttattatatatctggaagataaagtccaataatttcaataataaaattaactaaaaatagaagatttgcaaattcctttgatcagatagtgaaaacgattctctctatattgccgatcgatctccaagtttgctaaatcgccgggaactttactgaaatttggagctagtc

SEQ ID NO: 3585 - DNA, 2000 bp, Arabidopsis thaliana
gacttgagtaccttagtagaatatataatgtgctgtttttttcttcttgataaataatggccgtagattgtggaggtcaaattaatcaaacattggcatattctcaatgcttcggtttttgggataatattaagtgcaatcaatggctcatatcttagatcgtacggcttaaaggtaataaaagcatctcatgagtcaactaaataaacagtgaaaacaactttattctttccatcttcaaaataaacattcctattcttacgtaaagctatagtagtattctttagcaccggctcaaacaatcgagaagccttaggacgacttacaaaaaggggtcttttcaaacatgctaaaacaaaaaccatttcatataatcatgtcttaagcttcattacaaaaagggatttttacaaattcaggaattaattttgtgtgacagttagaggagagagattagtaaagcaaaaagtactatttattttcttagttatcatttttctccgaaaaagaaaaactaagtataaaaattctatcacacataaaactgtaaaagacttttaccaaaaaaaataattttagcattttattttcttgggctggtggcggtcacacctctgccttacctatatgagccgtgtttggtgctcttaactgttagctcgctaaatcatgtttgacgtgtaaaaaagtcagatacctttgatttaatctttctaacagtaattttttaaaccatttatattaaaaagtaaacgcaactaaaaccgtaatgaaaatgcaagagttgacatagttcttgtatcaattcagagaactacaagaagtagttatcagaacagaactgaaatatagaaatcaactatagcgattctactttgtttaccaaaataaaataacaaagaaattttgggcaacgaagcacaatcctattgatatatagttaggttttaagtataagactttaatttgattgtatcaatgagcttcgacgaacaggatccactgtatgaaaactatgtttgtgttccaaatccatatttcaagcgaatctaatcttgataggaaaacaagaaagattggtgttgattagattaggggccaagaagagaagagaaagccgtccaaatgaaaaaaaaaaaaaaaacattttagagagaatctatctatgaataaaactgaaagtgtgagtaggacccaccttcgatcgcagtcgctgagatccaatcacgttttagcttcccattacagtggacccacccactcaacttgttcatttcctacttcaacgtcccctctgtgactgtgtctgtgtgtttttttttctctatttatttaatatctcaaacagacggaaacaaataaaaattttaatatctcaaactcttaatcaatcaactactagtttattaacaacactatccgattaaatttggtttaaactagtatacaataatcctatttatcttaaaataatatgaatttccacgatatttcgacttacctaccctacatttttttcttggcctggatcataactttgataaaacaactgagaaagaaaagaacatgcatgttgagacaaaaagagtatataaatattgtctttagtgtactttgaggaggacccaataaaaaaaaacacttggtttgaacttgctttttcagagatctctcactttttcgttttttctgctacacacacttttttttttttgcaacacattttgtttctgctacacacacttctatcactctgtttttattttcctcagagtccgaggtacgtacaaaaaaacagaaccaccatttttttttttttattatttatctaagaagaatcttcaataaaatgcacctataaattaacttatccccgagtaagaagaataaaagaaaaaaaaaataacttatcgaaaaagtcgcatccattatatgtatatatatcgttgtggagttgttgtatactaaacaagaaagagattaggaagagagagacggcg

SEQ ID NO: 3586 - DNA, 607 bp, Arabidopsis thaliana
ccagccaatcaataacccgaatttcactgagaaatccccacatttgttatgtttccatactacaaaatcatctattgacaccactagttagctgtgatcttataaagatgagtaagccaaccaaaccaataacccaaattggaaaatgtgagtcaagccgaataaacttgatgtaataacctattcgttctaacttgaaattgttattaaaatcatccttatcaattagcctttctcgtccgtcaattgacttagttctaaccattcgtttgatcgataatcaaacaaacagttgaatcttcttcaaccaattaaattagactacgagtaactaaatgccaatacacgagaaaactagactaagaggagaatttgtgttcgttaatatgttatccatactcattatcttattttggcggcccatctattctcttccctctttctgagtagtttagtgaaacagaagctgacaagaaaaaatagaaaatgccaggaaacacacagttagcagtaggaagactcttataggtcaacttctgtagtggtagtgcctataaatatccttgagttttttatttctatcactcattgagaatcaaaaatcaaa

SEQ ID NO: 3587 - DNA, 893 bp, Arabidopsis thaliana
ggatgtaactgtttgagtgtcaacgacttgtgaaattatgacgcagtaagaaactagaggactaaattattgtactattgaagccttggttgctttagcaaatattttaatgtctaattgtcttgttcatcccaattttccaaagcaattagccagctaacacagaaacaaaaagcccacattcaaatgtagaaattgaaattggtattgaaatttgaagatagtaatactaaaacacctctggagtcatagattaacaactatcaaatatccaataacacaatcaattttaacaccaagtctcaatccgacggaaaacttcaggcgaaaacgaaaaacaaaaacagagaagcgaaagagcaaacctcggattaatacgagtgacaaacgactctgattccagtttctcttcggcagtcgaattttttatcatcaccatcggttttgtgatttgaggttttcgaaattcatggcgcttaaaacccaaaagagagaagaaattaatggcgctcaataaaactctcaggatctgaacgctgaaggagagtgaactattgacaaggctctattttaagatcgaccaaataaactctcagagcttctcaccagtcggtgacataggcccaataataaaaaacaagcccagcccaaaatgaagctaaaccaagttaaccaatcaccacgtatttgctcttatccggttatcccaatgcaccacagagaataaccggaatttcccagacaaaaaaaagctgcggagctagcgacttcgcttctctctttctctcaaatctcttatccgtttgattttttctgtgtcgcaatctcttcttcttattaattcattcaaaacagaaaagtacgggaaaaaggaattgagacggtgggtttcg

SEQ ID NO: 3588 - DNA, 2000 bp, Arabidopsis thaliana
atttaatccggttaatggagtttataaaccgggaattagatttggatttaatgtaaagagggacgatgcttaagggcggtttcgtggcggccaatgggggatccagaaacggctttccgcatctcagattgagacgttagatttatgacacgtggtagttaccgtaccgaaagtagagccaattgtcctaatctatagcttggtctccaagcaacttttaactcttttacgcgcggtctgttttacgtttgctacacgcgccggctagtgggctccacgcgtgtgagattggtcacgagtatgtgtcaattcgcattgacccaatatggaaattgtgaagtttaatggtaatgaatctaacgatgtgtttgaaagagtaataaaatctcgtctttaatattaaaatatatttttaatttcggaaaaaatttatgatcttttgcttggagaccaagtctcttatcagaaactttattagaaaaagctactattaaaaaggtaactagaaattagatttccatagttaatggttgagctttgactagatttggtcctaaaataataattgaaaaataagcttttattatatcgataattctacaagttaatataccaaatcttgtaacttacagtaattctatattgttttattttgaaccttatataacttacacgaattcacctgtgattttataaaaagatacatgtgatttcaagactttttttttacgtgggattagtcaggtactcgtgttaaaagttagaccttaaaaataacagtcagtttgatttaataatagttagtagtatgtatatggaacattaagtcggagaggggttaaactctagtgtatcgggttgcttggcatggaacagatatcgcggaaccggtaagtcggagtggttagctttctgggagagttgtggtgggttggtgcgacggcggagataggtgcagatggaaaccggaatcttccagctgcgtttctcgatccgtcgtctgcggccgcaaagctgtgatgcttgagtccgccagatataaggctccgaccactctgcttccgaccagcagcaaggttcgaacctctttgtttgtcggtgactttttctgtttaacctattttgtaactggatttcatctgtgtattgggtcttagcccatgccctattgggttgtttttaatatattaaaaaaaaaaaaattgtatatggaacattaaattgcatgacattcgttaggatagtcgtagtaggtactacttttactaggtagagactagagagtggtctctcttaaattgtctaatatggttttgtatactttttgatccaaacatacatacataaaaaaagaagatgttagcaaaccttagtaaataattccatcatctcctccgtcaggaacccgtcattttcatatacctcactttgcattcatttgtcggcattgccacacgtaactcccgacacgttgatactactatcaatatactattgacttagaaattgatctagatactatattactattactaatacatacttgaaataacagagtcaacaagaaaagccttgataaaagaaaacaacaacaatttgagctatacttttgaagggatctcactcttaattctcttattgcatgcatgttcccgcaattttgagctttacttttctttgcaagcgaattaccaatttgcctggcttcataaactagaagttataaaaaaaaatcctcctgtgatttgacggttttacccttaaaatctcacttaattcacaaaaaggaaccaaaaagccctaatctttatgttgtcgacactctttcagttctctcgacgccgtccatcgccctccgtcatatcgccgccgctaaagtactggcagaggtaaattcgtctcttgttccctgttctgtgggatcagaaagtattaaacttgttctgtttctgtctttcattgctctcatccttgattatctctacctagagttcacaaca

SEQ ID NO: 3589 - DNA, 2000 bp, Arabidopsis thaliana
tccaaccaacttttcatttttgtgataaatactataaaattaacttatctaaatcagtttaagaacttgctcttaagctacgagcttgtattaaattaaactaaaacatatactaaagcatgggttgtcttgattttgacgctatttgatcttacgaaaatccacttttttcatattttaactcttcatattcaatttttttttttttctttttgttttaatttataatattttcttataaataataaatatttgctttttcctcggtaatgaaatgaatcgtccaaaaaagtggaagctgatgaaagtagtttgacccctccacatctcccaacttggtacttagcgtcgcacacaccacatgctctctctctctctctctctctctctctctttcttctcctttctctttgtatctcttctctcttatgctaagccaaaaatggaagctttactctattgaagacgagatccttctctaatttacaggtacccatcttttatttctgaataatagattttggttcttgcaaatcttatagcttaaagttgagatttttggtatttacttagcaacaaaaaaagtttgtgataatattaccataaatggtgagacatccatttgcggctgagattttgctactttactcttttctctctctctatttccatttgtattgtcactcactcacatacaaaaataacatcataatcagagataatgagtaaaagtgaaagaaaccctaataccaacttactctacaaggttaaaacaaatgttgctctttttcattagtcctatggatcttattcccaaaataaaagatgaaaactttagtgggtttggttcatcatctcttttgggtttttgtaaattactgattttggtagatgtgttaggcaaaaagtagagagaaatgttacggaatgtaatattaaagggatgattttgacagatgagaagtttaatcttacatctgtaaacagcttttgataatgaaatggtgtgaagagagggtcctactttcttgaagggttttgcccccacaatctctaatgaatgtgaattattggtgagccaaaaaaaaagttttctgatgaaagaatgagagagggtatcttttttgttggtcttgctataaatgtggatgaaaattgtgattgaaacttactcgtaaacttaaaaaaaaaaaaaaaaaaacagaacaatttcttcttcctctgggatccataagttttgaggtatgttgttgctgattttgtccttttatgtctgcaaataacagagaagataaatgaggattttctcctaggttgaagttttatgtgagtacttttattacccttaactttgcttgtagaaaactatggttctgttagtgaatagtggaagagagaaagcttcttagagatctgtttttggtaacttttatgaaaattatatggttatttattgatcagaaagcaaatctctcctttatgtcttcaaaaacaaaaggatgaagagtatagagatttgagcaaattacagaacctagagtgaagagtagatttggcatgaataagcagagggttttaatatagggaacacatgatagtttctctcagacactttaatatgcaaccttacatgcctattcatgccaaaacgctttgcttcatgactaagcacaattttgccttttttcttgagagatcatttttgctctggttttagtttggccttgagatatcattgtctggtttctagcagagttatagaaggagaacagatttaattttgtagattgtcattagcatctataagactgaaatatatatgctctttcatacataagtagctttctaacaaatatccattttcggttcttcatatgtttgatagtttacatagaaaaacattttgatcttttctctattttcttgtaagcaaaagttcaagttttgatttactctgtgtgatatttgaatgtttttcagattttggtggtcagtgtctg

SEQ ID NO: 3590 - DNA, 2000 bp, Arabidopsis thaliana
atttaatactacttaaatttaaacatacatcgccacatgacccatcactatcacggttacttatggatatccaacattaaagagtaccacccaacactaggactcttataaaacacataaactccaaaattttatacctaatatccctggacaatatcaataaagttttattggtttcttttttgcaacaaacgcaagagaaatttttattcgtcacggattgaggttttacgcacaccggtacaaaagtgtctatgaagaaaataacaaaccatgcaaacgtgtttaacgggctttacaaatatgttcagaaattactcgcatgcgagattaaagaaatacaaaaaacaagtttggaaccggaggattgcaattatcatctattctatatcgcgtgtgtgtgtgtgtaaaattatgatttataatgtatcgaggtcttagattttaccttgcgatcctagagtttcgtacatatatatcgactattcaagttcttctttcatctttttgtatcttaataagttccacaaatttcgacgatagagaccatacatttgttgttatcctctactcacgaagacaaccagtctaacgttattgcataagttccacgtaaattaaaattgtgtttcttttgttaatattgaaaataggttaaaatgtcgccaaaaaataagctttgaaaacttgaggtaggaaaaaatcatggttcttttgcacatgctccggaccaatcatgtttactactaaaattcttactgcttttataataatcatctcgactggcgcgtgtagaactctagatgaatgccaagtcttattttctaattataaacgcaaataataaaaaggtttaagaatatttaaatttcacatgacaatatgacacaataaatactacttgaaaaatgatctttgaaatttcatattttctaatcaaaaacaattccttcatattttgaaatataatcgatctctcatatttaatttccaattagagaattatatccacatgatttgctttcaaatatgtctatttaacgtgtacgttgaacttgaacctatttattatttaattcattcccaaactaaaaatattttattttctaaaaaatatagtcgtaagcgtacttgtgtaaatatgttctaaagttaataatgggtttagacatttagtagaaatatatattttttggtttttggtttggttggttcggataatcaaaattttcagtattcgactaaaatacatttttgagttatatttctttacttaattttcataattgtaagtatttaaccttgtgtacgattaaaaaaaaaaaagtattttaaccttgtgtatcattcataatgtaggttttctttccattttgaaaaaaagttttgatattggttcgcattcatcagttgaaaaccaagtcaaatttatggtagattggcaatggacaaacacaaaatatcatctccatttattgccaacctcataatgccaaatggtggaccaaaaggaaaaacatgcatttatttattctcttgacataagagaaaatgcatttaacttgtcaaataattgcaaggaaaaactctataaaaagatagaaatgtgaacagtataaagtaaataaagaaatatgtgtacatgaaagacctctccaatgttcacttgctccagtttctccaagattagaaactgctacgtctctctctatagctccctcgttttgctatgtggtaattaacaacagacaacagtttttgtttgtccgtaccgttttacttactctctcactgtctttgtctattaccactctcgtctctttcttttttccttctgttctgtttctctctctaaacccaaaacagtcaaaatcagggaagccgaaattttctttgctttcttctcctttggtcctttctttaaacccgagacagttaggtttgtgtgagagagagaatgatgagtaaaaccctttctgtctgagtaagaggaaaccaac

SEQ ID NO: 3591 - DNA, 476 bp, Arabidopsis thaliana
aggactgaaattttctagtttgtaatatgggcccagaagatatgtttctgtgtggggcccaaaaaatgttatccgtttcatttctacgtttcttgtcgggtcaaagtgttgactttctaacaatgatatcatcgttttcttatacgtaacttctctgctcttccatagccgatcgacctttgttcacaattcccaccgatttttatttgctagatcgatatattttcaggtatgatgatatatatatcatggtttgtttattcatctggaaagtttttgatgcatcatgatcaggacaaagttggcgtgaaatgaaaagttttaaataagttttttttttttgttgttgttgtaaacctataatcagatgatgagatgatcctatattaatcgaatattttgattaattatacatgatatttaacaattgcattcatcttttttcttttgtgaaatctaagcagtgagcttgaaac

SEQ ID NO: 3592 - DNA, 635 bp, Arabidopsis thaliana
ttcattatttcgattttgatttcgtgaccagcgaacgcagaataccttgttgtgtaatactttacccgtgtaaatcaaaaacaaaaaggcttttgagctttttgtagttgaatttctctggctgatcttttctgtacagattcatatatctgcagagacgatatcattgattatttgagcttcttttgaactatttcgtgtaatttgggatgagagctctatgtatgtgtgtaaactttgaagacaacaagaaaggtaacaagtgagggagggatgactccatgtcaaaatagatgtcataagaggcccatcaataagtgcttgagcccattagctagcccagtaactaccagattgtgagatggatgtgtgaacagttttttttttgatgtaggactgaaatgtgaacaacaggcgcatgaaaggctaaattaggacaatgataagcagaaataacttatcctctctaacacttggcctcacattgcccttcacacaatccacacacatccaatcacaacctcatcatatatctcccgctaatctttttttctttgatctttttttttttgcttattatttttttgactttgatctcccatcagttcatcttcttcttcttcttctgatcaacc

SEQ ID NO: 3593 - DNA, 428 bp, Arabidopsis thaliana
aaaaaagcactccttttctatcatttgattcttgtagagattttgatttcctaatcttggtgtttatatacaaacttggatgttgtgtgtgtgcaaaatgaataaggcattgtgtatttacgtttgtagtggatataattgcaaccttaccgtcttagccattttaaccttatctggtacagcgttcgcgtttgcgtttgcgtttgcgtttgtgtttgcgtttgtggccaaaacgcaatcatttactttttaattgattttccgctccattgattttaatctgacgaccacagcctttagcttatttgtgtggcgaagagaagagataacattcctaagcaaatctcttctctctcccattcgtctccaaagagattacagttttgagcatttctcatctctcgaagctcttctctgtgtgtgtggcg

SEQ ID NO: 3594 - DNA, 1177 bp, Arabidopsis thaliana
ttttccttcattttctcttctttgtctgtcttgcttgtctctattggaagatgcttttgtttgacttattgtgaattgttgtaacttgtaatcttttgattgtctttagttttcttgggatgaatttccttctttatttgtgtattttcctatctctttgatgtaaataagaaagctagtaatggtttacacattgattattctataagaaacatctagaaaagaaaaaaaaggaaaaaaaacatctagaaatatatcagaacttctttcacaaaagaataatatatatcagaactgcgtgttattaattcaacgagttcaaacttcaaagtatgatgtggtaacacaaccaaattctcctctcggatataattagaccaaaaaaaaaaagacgaaatatttttgctataaacaatatatatatgggtaaatgtgaagaaatttgtttcttctgccaggaaatagacagttaatacattgaaaaaatggtaaaactttaaagaaaagcatatcttaagagatgaaaccctaattaaggtgttgagacttcagagacagatcaagagatcttatcagaagatatctgtgaagcatttcaaacaaacattacaaaaaatgtagcctccttccggcggaatggtagaaggagttgtaattctgctaatgtttattttggtcatatatagatttaattctttgatattgcaaactcatgatcccattttcttattatgtggttaaccaataaaagactcaattttgcagtcttactaatcaggactatttgccaaaaaaaaaactaatcaggactaaaaaactacatctctttttttttttgctacatatatatatatatatgattattttcagtgtatatataatatgtatagatattaaaaataaataaaagataagtcgtgtgtagtccacatatcttgaacatcaaaatgacaaaactattaaaatccgcggcaaaatctcttatccagtgacatgttacttatcaaccaatcacaacacgccacctcatcaccccaagaccacttctcttatcttcctctccctccactaatcccctcaagaatctaaagctcctcccataagtcttctctccacacttcacccaaaactccagaaccctagaattcgaaatctccaaagaacccgacaaagcgcc

SEQ ID NO: 3595 - DNA, 296 bp, Arabidopsis thaliana
tctttaaaaaaataaaaagaacagaacaaaaaaattgaaactttagagattttgattcgattttggagacagagacgaagaaatttttggttatggattagagatagccttatctttttataatccacgtggcatttcctaagtggcatatcaaatctcaaagatgacaacccaattcgccacgtggcagaacaagatctatcaaatgagtgaagaagattctccactatacaaattacatcaatccactcacttactttggcaacaaacaaacaacaacaaagagagaaattaac

SEQ ID NO: 3596 - DNA, 708 bp, Arabidopsis thaliana
tctttacctgcacaaaaacggaacaacactaaaatcgacgattatcaacgagaaaatcataccaattcggactaacccagacaattttacagtacaattagctcagaaaactccgaaaaaataccatcattcatgttcatgttaacatcaacgaaccaaaaaaccataacctaactagaagcaaaccacagaaactatggaataaggagaattggaccagcgtgtgattgaaatctcaccggagctgaggaaagatatcggagaagacgagggttttagaggagcgggtaaggttttttcctcatcacacaacaaagtcactctctttctccattgaaatgatttatccgaattattgacgttctcccccttatttcttatatttcccattattgccctatactatctgaaattatcacattaaaccaatacgtatatgattactttggatgtgatataaattaataaaaaaactatatatcatcaaaactttctcttaatatttctaaaattaattaattccctccttttatcttcaacattggattatcgaaaatgaaaaatagtattttctgactcttttttatagtatcgggtttaattcagaaatatataaagctttggggtctgtttcgaagtatctttactcttttaacagttctgagacttctaaagagaggaaaattagttcgtcgaagcatcgagaaa

SEQ ID NO: 3597 - DNA, 1135 bp, Arabidopsis thaliana
gactaaagtttaggttttaagtatttaagatggaacaaatagtgataagtgtatctataattcgtacaacgtcagcgtatatattactaaagtgaaggttagatgtataaatcaatcatctttcaaaagtcgcaaacgcgtaatgcatctgtgtttcatactttcatatctgcgtttacatttttccaatatctaaaatattaatattttagttataaaggtatatatatatcatatatgtaagctagtaaacttaaactagtgtagtaaaccaggcaaaaaaaaactctaaattgcttttggttgaatgtgtgaacaatgagtgttgaatttctgtcatttattgtacttatacttattgtatgtttcatgcaaattataattgactaactaaacattctccctagttggatgtttagtttcttacattaacttcactttatcatcattctactataattctatgtttcatgcaaattggaattgactatctaaacattaatttctctgtagttggaattttatcaccgaaattatttattagtatatttaagatgactaagctatggtctcctcttattcttccctaattcctccggccatggtaattaggtcatactttgactaacgttagagaatacggcccttcaatttcatatgtgggaacatacagtatatagactattgattgttgttatattttgtgtttatatgattcaaagtaacttatttcgaagactgaaaattatgtctaatatattatcattgttaagccattcagaaatatacatcgtaatcatttacacattaaattaacaaagataataatcaaaatgtgttaaatactcattttagaccaaccgcactctagaggcctcagctacttaaacgctgatgaattatgggctgttttgggcttaatatacaatattttggcccattagtttttgacacgacaagaacttataattgcaccgaattacatggcacataattcaaaacaaataattaaaaccacttcatgcgcattatgtcttcttctctatcatttcctttgccagctccatctctctctctctctctctaaaaccagtctgcaactttctctctctcaaaatcagaaacaaaaaaaacg

SEQ ID NO: 3598 - DNA, 254 bp, Arabidopsis thaliana
gatttcgcgctttgatactttgaactaacctttgatttcgccggaatttttgtttatgccgacgatgctttttcattggacattcaaccactcaaatctcagttgtttttttacatttgatatttttccaacagcaaaaaataacaaaaaggtatttaaaaaaagagaaaagaatagtcaacaatacattcttgctactctaacgcacaccagtgaggaaaagtccaagtacaccgggaaaaagcttttgggcc

SEQ ID NO: 3599 - DNA, 2000 bp, Arabidopsis thaliana
tcaaagtgatcatctgacattgcgtttagtggttgaatctttaatatatcttggtacttggaacggggaataaataaattaataaacacatgtaataacatagtatattgcttcatgatatgaatatgatacatataaataaacatggcacgcaaccatactatagaccagtacttgttaattgttgatgtaaataaactaggatgtattgaaatactgatttacgaaattagtgttttgtttttacgtggcattagtgatgtgaagaaatgaccgatgtgagaaagaagggagaaataaatataatgggagtgtcgatggatggattgcagcaaactttaacggcgacaactcgccgcttacctggccgtcccagtttgtgacctttggtgagagtaaaagggcaaaaatccacgtgggctaaaaaatggagccatgtgccgccacatcatcggtcaattgggaccaaatacctctctatactacttattagtaacttgactatatatcttatgtttttttttataatactaataaaattatgggcgaccgaatcaaagtggtttattcctttttctggctgccgcatctttactctccctctctggtcaactcctacccgagatctatatggagtaccattttattaaagaaagaaaaacaaaaacgaaagtcagttaatttatctctccaaaatatatatatatgaccaaattaaatcgcattgcattaggaatgactgcatgcttaacatatatcgtgatatgcatggggtgtgttaatcataaaaaaatgccatataatttacaatgtacgtgtatattgtgagattaatttacaatttgcgtgtatatctctagtttaagagtatgttacttggaatgattttaaatactaaggaatagagattgcgttagaacgcgcataagacatgtttattaataatatacacgagcagccatacctgcaccacgtgttaccccattatatatgttttaggtttatgataatctcttttctataattttggttgactagcgtgctataagtttagttaattatggtaatgtagtatacaaagttttgatatatatcacacacaacataagagtaaagaatcgtgaatcctccagagatgaggggagtgagatgcgagagagagagagagagacgtttctatagttgggccctaagtttgtttttccaatctttaatgtgtggggatactagtttttactaggtgccaagcaaagcagaacaaaattgaacaaaagggatagattagagggaaagtaagtagggggttggaaaaaggataagtaagaaaacaaagggaccagaatagtaaaacatacaggtggaacctgatccggataagtgagtggggtctttatgaaagggggccacttgtaagaaaacgttttaattttgatcaaaaagggcgtatctgttggagggacaaatggagaatgtgttggattttcttggggatttgatctctcttcattattactacggtttaatatttgattatagtaataataatcacgatttttaaagtggcattaattaaggattaatccagagaagcttcttttgtccacctgcaatgactttaatacccattttagacgttaaaggatcagtatcgccacggcggcatgactcatccgctccttccaatacgccgtcgttttatacccccacctcgaattgaaaaaaaaaaaaccccaacaacaaagataaaaacgtaaaacgaaaaaagcatatcaatctctgtgcctctctcaattctcaaattctgaattctgatcgtatcttcttctctttaagattatcatttgaatatcttcttcatcttcttctccaagcccctctctctctgtatcgatcaatcatcaataggaggagctagcgaggggattcaataaagagatcttcttcttcttcttcgattcactttcctttcttttccattttccctttcgtcgtcgtcgtca

SEQ ID NO: 3600 - DNA, 1232 bp, Arabidopsis thaliana
agaattagaatgcaatgatttttttgttaaatggtttttttaaagagttaatgatgcatatttttcaaagtagatgattttctatgcgcaaataaaaaagttattggaaccagaggaaagatccaagcttttcaaattcaaggaacgtcattgttctaattcgtatttaacattcccaattatgtatagatcatcacaaaaattctatattgaccaaaatatgcgtttactctttcgaaaatgttagcttcttccttcgttgaaagttattgctttcaaaagatatatgaagaatacttaaaatggtatagcaaccctttgatgcaataattgaaaccaagattggagaaccatgcatttagccacttttgagaaaattttattatatttggagactagaaagtaaaacctcttagcatttttgttattattatctaaatctcaagacaaaacctacccaatggtgctcaaaaccaccaactcctatatctatctatatgagacaaaacaaaataaaacaagtttttcttggaattaatgtcatactctcagtaaatataaatgggattttaaccaaaaaaatactttttagtcaacagatttttaataataatttagatcacttatttagagttgttcagcaatgatgttatactaaccaataatcatggatgatgaagatgcaggtatgacttatgagtgataggtaaattttgtcaaagagaaattgaaagcctccgtaagaagtggagtctgagtgaaaacacggtgctaaactttgctaaagacagaataaatcaaatgaacttcatgtaacatataaaaacataagtaatagaccagctttgatttttatagatcaagcttgttcttgcaaaaattacaaaagtagatgctttgctatgcaaataaaaagctttcactttaattctcatacaaagagaaaatacgtaatggtttgagagttgttgatgtagcttgtgactttatcttcattaccacgtaattgatgtgtcaacctttatcttaacagctaaagtagttgacttgttggcatttaaaatctcttttagaagattatgttgaatagtcattggcgtgcgattattcttgctttgaaaaatgaacagttgactatagaaaatggtctcatttggaagattgtgggattttagttattacttggatcacgtataggattcagagacaagagaagagaaaagaggagagaa

SEQ ID NO: 3601 - DNA, 2000 bp, Arabidopsis thaliana
atatatccaacatgtctctctaactgtttgtgggatggatacgcacgtcaaatcgattttggaaatttttttttttttaatatttaatatacctaggataatgtaatgactaatgatacgttaattttaacagaaaataattgtgtttgtatctatacaacgtcattataatgtatggctgaaattaattttataagtataggtttagaaaaagagatagctgaaggtgtagttgtgaaactacagaaccataaaatttcgttttttccatgcattagttgtgtgtggatggtttacatattacaaacatcgatgatggtgaaaggctatcggccgaccgtgaaatcgtgcagaggattaatctttggattttagtaaatattttgtaaagatgatttggaggtttagtcatcaggcatgttgtcataacatcaaggttttttttaaaacaatggtatttttaaaaatattattgttaaagggatattttttaaaatgggtaatctaaaaagcaattttaaaaaaatttcaataatctttgagtgataaagttttattaattaatatagatataaaataatattttgaaagttgagagtatcgtttaacacagaatgagatatttcctaatcaattaacacaaaatgaaacaacctcgatttgcagctagatttttgctttatcatatcaagcttgaggtaatctctaatgcttttttttttacgatttcgtgatgatagatgtaatatagcggtttctgcaaagaaatttaaaataattgatttagccacatatgttaccaaaatgtaattataatttgatcgatttttatgtatttcatttgtttcatattataatttgatcgatttttgatatatcgtatgattagttaattgaataaatgtacatacatgaaaaagtagtctaaaatgacataggtctcccctaaacaacaaatacacacaatattaaagaataaaattagagagcatcataggaatattatataagtatttaatttgtcaaataagaatattttattttattttattttggctcgaaataagaatatattgaagcacaaaaatatgtggaagtatttatggtggtggtttggttcattgagatatgacctttggactcaccttatcttcctattctttttagtttgctttcataaattagtttccaaattaactcctttaaaatgttgatatcagccgacatttccgtgataaaaagtttttttttctcttataaataaataataacgttgacaaaaaaaaaagacaagaaaaaaaaacaaggataatttcgtaatttcaggatgtgtatagtttttttttgtctttcctcctcatcgttattgatatgaagaaacctttgccgattaaaattaaaaagaagatgtttataaaaatacttcattataaaaaaatgataaatcaagattttaataacaaaaaaatattaaagaagattggtgggttaaaaagggaggcgatgaagaaagaacagcgacctcttcttctctcttccctctctcttcctttctctttgggagagatttttttataagtttttggttttgcagaatttgctgaataaaaactctcactaacagagaaatataaaataaaaagagtactcaagaaaaagaaagctagagagagaggtatagaagaaaacgatagctataagctcatcatcaatcatttctttaattctctgcaactccaaggtacttcctctctctctctctctctctctctataccatatatgtagatgatgaccgaagctgaaagtgagaaccttaaaagagttacaagaaagagattggagaaaaactgtataatacctagttgactcctctctctctctctctctttctttttcttgtattttttttttgtatgtgttatataagattctctgtgtatgtctgaatccttacaggatccaagagctttggaaaaaagatataatgaataacaagat

SEQ ID NO: 3602 - DNA, 2000 bp, Arabidopsis thaliana
ggttacgttctacaatgtataagtatttttttatatatgaattcaaattttgtgttcatcataaaatttatcaactagaatagttactgaatttcaactggaaaacaatattatatcagtacaacattaaactctttttaattgtacatgtagaaaacataaaacaataagtattcattttgtaaaataatcatcatccgtaaaacaaaggctactcggaacttaatttgtctgtattatgaggtcattaataatccttatattattttttggcaaataagccattaacaatcttgtattaatttcttttaattaatactgttttgtttcttttaaatggcattttaggaaaaaaatatatggaccatagaagcgtgatgtgaattgtgaaccaaacccaaaagaaaattatttagaattcatttaaatgtcatgcatcacgcgcattcactaataaagtagtaatgtttgtaatatattatagctgtagtcgtttttttttttttttttgggggtagctgtaatcgatataaaaattgtgagttttagaatagccatctacgatctagacttaggaacgtagggatcattgatccccccctaacactattgtattgttactgttgtatagtcatcgagatgtgttttctataattaatagaatatataaatatcgaagtctcaaatcaccaatgtccataagaaatatactatactctaaaacaaattaattatttttgcttttatttttaaacgtggaattttggatctctctcatgcttctctaaaagttggtgaagtcacgatatcaattacacaaacgttaaatatgttttaaaaaaaactaaacgtaataccacattttgatccagattcttacaaaattgatggaatattcaaatactgtttcggataagtatttaacggattacaacaaaaaacaaattctttccctctctgcttctttttttgctatacaggggggaaaacgaaaactatcaaatcacataattgattagagttttttttttgttttttcttcatttgttactttttgtttatttttgttttttttgtggttgttggaagttgaactcttaactaattaatcatacaaaattaacaatacacacatatatctctatggaagaaatggaaataagtatttaacattaataattagaacacttatatagtatcattttcaaatggtaaatacgtctataagatcaaactcacctaatgtttgtttgctacatcgctcagatgacaaattcatactggtgattgaaaagcaatcttgaactgcgaacaataaacatcaatcgataacggaatttccttgcattagcaaattaattataatgataaaatttatcagtgaatggccgatccaaaaagttaaatcaattatataaaaaaagaaaagaaaaaggaagagagttcgcaacatcaacaaagcaaagtcccgagaaaaacggtagctttgtggagacacaaaattaagatagttgcatgatcatgtgccacgcctacgctttctattccattccatctcattcacgcgttttattttctctcattcatattaattatatattaatcacacaatcctaataatatcccttaatctatgcctagaacatgcatggtattataattaatacattcgacaccactagaagccaaaagtatagtagtaaaaaaaagaagaagaagctggtttgtacgtaagaatgaaaataacggaatccaataacaatgtttgtaataaacggacaaagaatgtgaattattcacataaatgatctgtaaaatgtgagcatttgattataacggatataataaaacaaaaattgtaataaagagagaagagggcaaaacggggaacatgtcacgcggataggtgtgagagagtaaatgacgtaggttccgttatttaagaacccttctagagaggttcccacacaccagaagagagagaaagagacagagagaaa

SEQ ID NO: 3603 - DNA, 2000 bp, Arabidopsis thaliana
ttggatatatcaaagagactgaatgggttgattttcactcaattcaacttctcatttaaaaactaaaaagttggtacgccattattgtaagatagcgaaacatgcatttagactacaagaaattcgtaatattgtatagcagcaaaagaagacttggaacctctgatatcgttgagtaatatgggttgtatgaattctttttgaagtcagtgttagtaattaactttgtaatgtttcctttgatatcgtgttaaacatataaagaagaaaactcacaaatcatctctctaattactatatatgtatagttagaaaatatatattttagcaacttcatgtaattaaaatatatgttttgtgctccaagagaggactaattagtattaaattgatggtattgatacttaatgattgcctctatctcttattttatgttttaaatcctcaatacctatgatgaatccctattgacaaatgcttgtttaatttgatttttaagtatataaaccgtctcgtttctctttagggcatatttgattaggttttttagttaatcatcatgtattttatttgcaattacaagtttcttggttcgctattaattattttaattattttttgtttaacctttgtaaaaatctaaaatctatattacccatcttagattagaaggattcatttcccgtatctttagcatgtgagaactagtccttatggttcactactatatataatgtttacacttcacggtgcacttgcatattagtaaaactcgatcagatcaatacgggaaatgtaaaattaaacgcactccaaaacagtaatttatttttaataaacatgaatcagtactggttatacttattacccaagatagtctgactactacttgaatcttcaagccaaatgattaccaaagagaacagagaacaaaacgctgaaatctttctttaagtagtcattggtctaggaactgtttatgttttctcttctttttttctttcagtaatttaatattccaagaaattgaagataatcaatcactcgatacaaattatttatacaaaactaagaaaagaaagtcaaaggaagtgatcgggttctacggtatgaatgtcaacaaatcatatatatgaaagttagtaaattttttttatatgattgacacatcatcattttaacatttgtcatatgtttattaaataattaatgtaatgaattattaattataggttagtgatacatttattattcaattttatatattattttattatatattcaatatactattactgaatttattttaatattaaaagatttttcaataaaatcattttaatagtttttttatacttaaagatttttttgtaatccaaactcaaagtatgattatataataatcgtggattagctaatgatttgagtaggttattctcttaaattgatatttatataataaatcactaagagtgcataatacgtacgaagctccatcatcaaattcttaggattgtagaatcgaacactaccctctgctagatgaacgttgtttaaaccgcgacgtagcgcggatgatcacctagtataagttaattcttggaactactttgagggacacagtggggaagcctattaggcactcttacctgtaaacgaagccaacctcattttgttgattttgactttatatgttttcttttatttttattatttttcttatgttaaaatatatcaaaaaagttacgcagttaaaacaattaatttcttattttagcaagacaagaaattaacatacgttaagaaaaaatagcgatatacttaaaattttctctaaactatagtttctgcatatagtgagacattatccaatatatatatttatatatataatatgatcgggactttatattcttctatatattttaaacattatgaaatttccccaaaaatagtactattcattagatgtttgtgcatataacaaagtgaaaccaaca

SEQ ID NO: 3604 - DNA, 1066 bp, Arabidopsis thaliana
gtgttttgggagttattaacttcacaattctttgaatttgttcgatttcattaccaaaaaacagaaacaaaaacttgtcaattctttaaaaaaaccacagatgtatagattggtttttactaatatggatggatatgtgatatccaacaacaattcttgtgaccaaccatgcctaattttgtattggtgtcttttaggatcattctttttctcgaacgggctaagcattcatttctttgttagttaacatgccagtatatttttaatgattgcattaatcgtttttatgattgagaaaacgaaaaagtgaaagaagaagaaaaatctgatcgaatggtacatattaacataacatgtcgtcattccaaggaatcaattcacatgtcattttcaagattacgtgtagtcgtgtaatattctctgatttgagtaataccattacccaactctttctttctagatgaagcccatttttgtatacaaatctttcttgaaatcgtaaaagttcacgagacttgaaattcgagcatatcatataaaaggagcgtaaaagtctagtggtggtggaattattgaagttagtttattagtcaaaattaatgtgttttgactagattagtaaacaaaacacaaatctctactacgtgagaaaataacaagaatataaaatagcaaagtgtgaatataataaaaatatctaaaggtaggagagatgacgagaggaagaaggagagccacagaaaaagagtgggacccgcaagaccttgctgtaagaagcagagtgtttccttttgatacgcagaataatgaaaacaaagcaacaagcaagattcatcaaatccttatcttctctctttcactcacaaccaattgctcatcccacctacttgttccccacaaaacactctctccctctttgttctttcatcttctctaagctctttctctgaacctacgcttctgctaagctattctaagagaagccagactagcaataaacccttcattttaagcattctgtttccttcttgagaaacctagatattttggtttcttgtatccggtg

SEQ ID NO: 3605 - DNA, 785 bp, Arabidopsis thaliana
aaattggtgaatgtacactcacacaaccttatctttagatgaaaagacgaaacgaaaagactttgcttgttttgatcacttacctattttggtcatttatcatttcttatgttttaagttctatagacaacagatttggtactactcatacgagtttgatctttttgtgacgcactttacttcgcaatcatctttctgattctgtaccagaccggtttattgtctgggttgaagtgtaacgaattggtttgatactccacattgttaggttggtggagtttatcataactactaaaagggtagataatccaaaagtccatataaaatcaaagagtattacaaatgttaaggaaaaaatatttacttatgttctaaataaaattaatccgcaactttttactgaagtttcaatgtgttgaaaaacttgaaaccaaaaccaaaaccaatttcataaataaagttattcgaaaactaatttttattttattgaaagcgatgacaaaaaaagaaattaaggcccatttaaaactcaatacgccccatttgaaacccaatacggcccattaaagaggaccctaatataaacgactgtaaatttccgaaaccctagtaagcaagcaagctatcgagcatcgtcgtctccaacagccaagagaagcagaagcttgaagaatctctgtaatctaaaaaatgggtaattctcctatactttttttgtctccttatgcttctacctattgctgattcttcttcaacaatgttgttcatgttttgtttctctttga

SEQ ID NO: 3606 - DNA, 2000 bp, Arabidopsis thaliana
tacatattgtttcatttagaaaaggagttggttgaattgtggtttatcacttaatttttattatttatatgtaatttatttttaatataaggttttattaattaatttgcctgtagtattgttttaatgtatgtttatagttattcatcaaacaattgtgatcaatataaagattatccgaccgttagactcgtcacaggaaatttttctgaagttgaatttcaaaagctcaaacaattaaaacgcgtaatgataagtgttgtaaaatgttatagaattaaatttaaaattgtaaacaaaaagatatacaaataaagaaatgatgttgatgatgatagtgctttattttcttatattttttgtgtgtctttaccaataagaaaagaataatccatttttatagatatgaaaatttagtaaatcaattgaaattattacaaatgatgtagtgtagttattttgaaaatggagtaaacattatctgtagaatatgaattaatgatacgtgttacatgtattagacattcattggatttgtaacaatttataaataattagaaacatacttcagatttatctcttataactatattataactttttctaacaatttgtgacagttttcgtttcattttagttcttaccttcagtaagatcagcttttattttgtgttaaacaaattcaacaactcgtacaaacactttatgagacttttcaataattaagacgaacaacaatgatctagtacacacaaattagatactaacatttttagttcgaaatcatttactaaattcaaaattttgatatcaatcacatggctcgaaattactgtattagattgaaatatcagagcacatatcaatcccacaaatcctcatgaatttacttaatccacatactttaaattttatttttaaatattctatattttcttaaaatgttggctgaaataatgttttacaaaattttatttcgttggaaaattattaaatttatcaccttcctatttgatatcacttttaattcaccaattgtatgtatcaaaatattcaaagccattgactgaattaatggcaacaaaaattatcaaagattttctgtaattcctacattgactacatgcaattttcaagacattgactattttcaatagttttcactctttttaatcttgatatctggtcaacttttaccacctacctatttgtctatcctactacatatcattaatcacaccattaaaccacacaaatctatacttaccattaatatttttcttttgaataccaaaaaaacaatcaaaaagtaaagtgtcattaccaaaaaaataaaaaagcaacatccacctactgacctacatattttttttaataaaattataatgaatcattttgttagtaaaaaataaaaatgataaaacaatgggcgcgtaaacgattccagctttccccaccatccattatttcccaaaaaatcaaaataaattaaaaagacacaagtggatgcttgagatttggtttctatataatccataacacacccttcatcaaaaacctctttcccattcactcatcttctcttccttatctccttaaaaatcttctgctgttttcttttttatatttagagctcctctgtttcttctccaataaccaaaaaaaaaaaaaaactcttcctctgtttgttttcaagttctgacatcataaattcagaccgagaaaacataaaaatttgagtcttttgatgatcggaaactgatgactcccgttctctgcgaaatcctgctctctgggctcacggtcaaatctgctctctgccgtagaacccatctcgttcaatctttctccgtcgtcttcctctactggttttacaacgtttcatgaattgctacaaactctaattaattttttcagacagatcataaaaaaaaaccaaacataaaacataaaactctgtcctttttttgtcttcttgtaacttttcttgttaaaaatca

SEQ ID NO: 3607 - DNA, 2000 bp, Arabidopsis thaliana
caacaatattgatcatagtcgaaactcaaaatttcaagccaaattagaatcttaaaacctaacaatgaaaatatatgatccctcgtttacaaaaaaataaaaaataaaaataaaatatatagatatgatccctagtccttatttccgtaccaattatgatattgagagatagttttgggataaccattttcgtttactcgagataaattcactcatcagtttaaaataaaccaaaaccattaccacataagattcttatcccaatttaactattatatttctgctaattaattgattacatgttgtgaagtataaattgggccaactatagaggaatggtgtttgtttatgttttattttggctgctagtgtggttttcttaacttgttagcaatcattttactttttgaaaaaattgttagaaaactattaatgtgaatagttatttactcaataaatcttattgttaaccactgagaatttaaagcatttaaacatctgattattttaattctatgttaattccaggcattaaattttaagcgtaatttatagaagaagaaaaaaaatctagttacattccatctaagataggggtacaaatccatacaagagtctatcttctgtaattcttagcaagttgaacatttcttaatttttattttattttatttttggtcaaacgttttctttaatacaagtggcaaagatattctataacagttataatcatttatagttagggattttttaatcattttgtagtatttgtttttctcttttttcctaacaaagtttttggaacttttgatcatctctcgattgaaagcgaacatataaataatttttactactgcaaatttttaaaaagttaatattcgactttataaaagagatgagagtcaacaaaacaaaaagcaactaattttggacgtacgaaatgctttgtaaatacattgatatcacttatgtttataatatcactcatcccaagtgttggtcaacatttctttgataaaaattaaactattcaatagaacgaaaaccacaaaaaaattataaagaattattgataacaactcttcatgttaatcttatatatttttttaaaaatatttgtttttaggttttaatacaaacaacatgattctagtttattaaactaattaacgcaacttgatggattataaaaatatagcttaactaatccatcaaattaacaagtgaatcgcactataattctaaaagaatcaggtaggtccaggatttgtcttttctccacttctcaatttcccattaataatcccgaaaaggcattacgtaataattaatattttacgctgtagtattattttatgataaacatttccaaattttccaacacttaatcataatttaaggattaaaggaaatttgattggtgcattcccaccacgagtttgcttaacgtgtcgttaaatgcagccgtcggacttgacaatgcaaaaatgctacataatctaaataattaactctcgcaataagattcactaataataacatttttaacgacgatatataattttacaataagaaaaaaaatatgaatctaatatttatttaatattaatttactccattatctgaataatctagaatatgtcaaatatccttttattattttgtagctgtcgaaactatggtgaataaaatctcgaggaatatattagaaaacaaaaaagatctagaggaataataatattttaaatatttggggcacagttgtattgtgaagcagagaatcggttctcaatatattatccgaaaatgtcttaattttaaattttgttttttgtttgattctgcgatattggaatcacacactctgccaatttgacctttctctctcgcttctctttctctatccaatcggaaagagatcaaccaacgatagaggagaagaagaacttgcatacgcaaaaaaactttcccgggaaaattccagaaactgctttggaaaa

SEQ ID NO: 3608 - DNA, 1412 bp, Arabidopsis thaliana
agattgtgaacggagataatactaatttcctcataaatatatatacattgtctttttgcaatgtatattaattcccttagaagaaaatgtcccagctgttattttataaagctgatgggtacatgcaatggttttagaatacgcatacgaaattatacaatcagtttcgtggaattaaattaaagtttgaaacgacgattataagcatatgtatcgaattagagattaagctttcctagttttgtctaggattgaattcttatgcgagagatgaaaatgtgatctaagcatcgctagaccctaaacattaatggataacaaaaggatgtgtgttatatctacatggaatttttatgtcacatatcaaattttatgtatagtttaaaatgtaattaagtccttatcaaaacatatatgtttggttagtgttatactgtaattgatgttttttttacaaatatgttaaatagcgcattgcatggtttatcacattaaccaatgtttttgtgcttgatggctcgatttatgcgatgtgctaagttgtcttagaagacggatcctcggtatatattcttgtgacctaaagatatcccacgggcgacatcgcaactaattgatatgcagaatagactaatagtacaaaatttgtccgtatcacatattttttatgtcactagttactataaaaaataattaaaatacaagtcaacacataacaaaaagaattataaactaataaaatgattaaagtcgttgattagtttaaaatctgcaactaaaaatgataatatttgcaataatatttttcatttttatattccctttgttctactcgttttatctaattatgtttggttggcacaacatatatattcattttgataattctacctatctttcttttaagaacacttgtcagaattcagaacgtaagataaagctaactcacaatgtcatcgtaaatcatcttcacaccacaatcgctacctactaacttctagctactttgttgtcaacttctcatattaaccttctcttttttcactatagtatttgaatccaaattactaatttatttaaatataaactttagaaatattaaaataataatagtttaaaaataactaatactacaaaacattaaaaaaaaagaattacgtttttcaatcaattatttattattctgtttttttttccaccggtcaatggattaaccaacaacacaaagccatatagtaaaacaagaagatgagtaggttgggagcgtgcaacaatgaaatagttcacccacctttctcctatttattactacttccttctcctcacgtctctcctctacatagtaagacccaactaaatatcttcttttctctccatacactttttccagatatttctaatcaacaaaactg

SEQ ID NO: 3609 - DNA, 405 bp, Arabidopsis thaliana
tgttttctgcaatcggtgaatcaaaaaactcaaacttctttctgctttttaaacccaagtaatctggattcccaatttttaataaccggatcaaaccagtccatctcaactaaaccggtattaatagcactagctcaagtctagttctttcgatctgcaaaattgactctgcgggaagaacaagtctacttgaagcgaaaccaaacggtggtgatccgtgagatttcgtcatcatcggcttaaaatgcatcactgggttcaagcttcttcttccgatttcagtggaactcctccgcaagctcggaggtataattctattgtccttagctctcgatttttgaattcagctgatttttttggtgtttgtgtatcagtggacatacagctgtcaatgtcggaaaatcc

SEQ ID NO: 3610 - DNA, 2000 bp, Arabidopsis thaliana
tacataaactgttaaacatatatctatcattgtacttctctctttggtaatacgtatttctctctttggtaaaaatgaatgtacttctcgatttttagttttgaagaaattaaatgcattattaattggtaagtgtttttttcccaaccgttttgtcaatatattattttcctaatatttgtgatgatagagtgattattttttacatatatagagattatattgagatttgttttttttttaaacacatctctagatttgttttaggtccataatagacttcgataaaaaaaaatcacaatttaattttatgaaaatacaaaattctgcacgagttgtaatactagtatgatataaatcacataccaataaaacctcaacattgttttgttttgtaactgatcactttgacaaaatgcaaatccgttaatgaaaaatttatgtgacttttgacttaaactatttttcaattaaatttatcggataataaatgtgagaatgtcagaaatagttagaataagtaaatgtgatgaattttatttattcagtttacatgttaaaaagtcattcagaaaacagcaaaagtatttaaaataaagtaacaactccaagttttacatttctgatttgcatcataagtgtatttgtgactttttaagtccgtcctagaatttgttcttacaagttgatcataataatgcgagagatgaatctatgagaaataaagttgagtatcagactaaattttctcatcgaatgttcaatgttgcatccttgttgaccttgtccccaactatcatatactactactatatttcaaaataagttccgacatattaagaccaaaataatagtggtttttctaacatgtaattaaagcccatattttaaatgttgattagggcccataatgttatagtatatactaataattaattatttgattatttaaattattataaattttttgatatacattacatatgaccataggacatatagataaattcctgtaaatattaacatattagatgtcaaaatatttttccttgtagagtttaaaacaaattatcagtgtccatcaaaagctggtttaggttcgtgtcaacggttgggccgaaaaaataaacgaatttcaaaaattatagactctaattaagtaggattacttattttgattgtaatcactacataaataaaataattaaatatccattttttctctctctctttctcagtttttttttttttgggtaagcgtttgctcgttgtgtaatttcccggcaacggaagagaggaggaggaagagtgtaagcaataaattcctcttcttctacgaaacatttgctcttctcctctttctcttctcttctcttctcctttgcttctccgattctcttccttttttttagtttgatccgactactcaagctttttttctgttcatggtttcctccatcatcgcaggtactacttcacttcttcttcgatgaaatttctgctaatcggtttgatttttggttattattcatatgaaattttgtattccttatttgtttgactgctctatgattatcatgtagtttgattgtgactgttctggtttttttttactcaaaactgatcatggtttttaacgagaaaacaagttgatactctctttggttccgtggaattcactgatcatcgaatcggtttttgacctgtttcaaaggtttaagctttgatttgagtttattgctctgtctctgatgatgttttgtcgccacaagcagcaaaattttctattcatcgagttgaccaactcatggtcttgcttcgattttcttcttctcagttatgtttgttgatgtatggactactaggaaacacatgagtagcttgtgatcgagaactaatgatcttagcaagttactgttctgctttatgatgcaaaatcagaaatcaactagcaggtctttgatatttgattcatatctgcagttgcagaaggcaaaaag

SEQ ID NO: 3611 - DNA, 596 bp, Arabidopsis thaliana
taaacctatagtaaataatgttatatgcttcaataataactttggcctttgtttgtaatgttatatgctactataatgactcttcatcttcctaataaaactcctctttcaatttcaatttgcaaagagggttcaaatttggatgcgaatataacagtttattactttgcggcaaaatgtttataatttttaaactttgagggttaattgataaattaaagataaacatcgacatttctaaatcagaaatctcgattttattttgaatgttcaaaagctgccagattgagaatatttcgtccgtcgttgaaacttgagaatagaggcgaatctggttcgagttagggttccaattgaaaagtttgaagctccttttgactctctctctcttctagatctcgacaactctaacctcttcgatttggtaaattttcgctctttctactgaaatcggatgaatttgtgattttccggggatgggttcgtgtctctatgcattttccgatgatgggttatgagaaaaagtttttttttttttttaatctttgctttgtgtaggtggatcttgagaaattgattttagttcaaagcttctg

SEQ ID NO: 3612 - DNA, 2000 bp, Arabidopsis thaliana
gaaaagtttattgttttagggtttatctttgtgagtttcgaaacgtcttagcgcaatggaaggtttaggtttgacacgtctaccaattggtttaaccaaaaatccaatttgcgagtgtttaaccgaattatttaggctttaaccggcatgtgttcttcaaaatctttattcatctatgtcatcaaaccccaaagtatcttatgcatgacatttcccaatcccttgtatatttcaagtttttttttgtttagttattttcattttaccacattttttatttacttaaaagatatcaaatattcattatttataaattaaagtatttttgaaaataacacatatattatcgaacaattcttgagttcatctttacgatgaattctttttttcacttccattctaaatactaaaagcatctacattgcataatcttttattaatgtctccaagaccaaccatggtaaaaatagactaaccatgattaaaattaaaaacattttattttttagatgtctaaaatatcttaaggaagatatttttgacatccaaaaggaaatgtctttaattttaactatggttagtctttaagacatacatgagaggttatgcaatgtgaatggtctaattgtttttcataaatcaaacatgatatatgatctcgtttgattacaaaatctaaactctaattctcttttttaaattcaaaccgatatttaaactcgtttaattataaaatttaaatctaaccgttttttctaaactcaaaccgatatttaatctcgtttaattataaaatctaaattcttttataaatcttaactgacatttaacctcatttacttgtaaaatataaactcgtttataaatccaaacagatagctaattttgtttaatcataaaatataatcattaatcctctctagtaaacccaaacggatatataatttcgttttgtgatagataaattttatagttaaatgaataattttttattaggtagcaacatccgattaggtgattatttacaggaagactgattatggtggtttcgtggttaaaagattcactatggtagttgaatgactaactttgagtcttactactaagatttcaatcatgttagccactgtgaacattttaaatggcaaaataaaaaactcaatgttcgcataatttataatattttagtgaacaaaaaaaaatattgtgttatttttcaaactttttcacataacttatattattttggtcagtaaatgttaacagctatttataaatttgtgtgtatcacgaatttcatatcctttaaattttatcggtcgaaagacaagtttctctagttagcgcttagcagcttccaagttccaacgattcgaaagcaactgatgctttgaccgatttgaaaatgcaaaagattggtctctgtgcatatactatcctttaaatttaaccaaattctttttgtgtaattcagaattttctttttacagttgtagctattcatgaattacaaatattttcaatcatttggttacgtgatggactaatatataaaccaatcaaccatgtgcttgtcgtcatttcttttgtttattaattgtgtttataaacacatatataataagtatgtgtttattctattgttaacacaacgtttatcatgcaatgcaagtcttagtctatgtttagtttattaacggaagataaaatatattattactaatagaaaagaggatacgaccgacgaagtttgaattttccaaaatggcaacctaacttaaataatgcaaaatcattaaacctacaattcttatattatcaataaaaccatataaagactctctatagaaaaaaactatataaagacaatcaaagactctctcgttacaataaccacaaacaacaatacacttctcttgacgcctatctctttctcaccaccaccattaccttcgtcacttctctcttccaagcaatttaaaccttcaactaatccagaa

SEQ ID NO: 3613 - DNA, 2000 bp, Arabidopsis thaliana
aggctatatatgccttattaggtcattgtttttttttgcgctcaaagtttcatatatttgtgttggtgactctagatttagtcttatggattaacatgaaaatataatcatatatacgaagtaacttttgcctgaagtttcacttttgctaaataatatattgtctcacaacgttcttgctatatatatatcttctcaaatacatggcctgaaatggtataattattgtttcatatttagtagtccaagataaaagacagaagaagtgttatgaattatgaatgtttgcttttatcatatatgagattataaccgtcatcattgacaattaggacatggatatattaattttacacataatgattaaaagctttagattatgcagtgtcttaatcatgttgctatataaggttaggccaagattcatgtcaaatcactgcatactctgcacgactttagatcattatgatcccttgtgaatttgaaccctcctaatctctcttatcccttttaaatatcatgttcccttagcccattcctgtttcaacatgcggggagaaaactaatcacgttaactccaaacaatcaattattgttgtagttgtcatttgtcaactctattatccaaaaagtgaaatatttcgtttcattcgctttgttttatcttgtcacaatctttgtaagtaaggctataattcagtatcctcacatatccgtcgttaaaaacatatattttcccataataggactaaaaaaaaacatatattttccataataggatatcttcaatgttgtggacttgtggtccaatactgtgatatggaacattatcttgtgcttcttttgggttttgttaaatgttaacgtatacgataactagctatatatagaaaatgagattcctacgtcgaaaataaaatacgtacgttactttatgttcttatagttaatgatggttagtgcgtggttaaaatgttcaccttatcaattgagtgctcgaagtttaaatctttctactctgatttaaattatggttggcaattttagatgagatgacaaaaatacttgactcttctacaaaatacgatgaacacaaaaaagaaaaaatttatgatgaaaaataaaagataaaattaaaatattgaattatcttcacctattctttttaaaagaaagttttttaacacttctgtaagattatcaacatgcatgtctttgcgcttcaacgagaagaaaggagaacaaaaaaaatcacgagtattagtctgaatttggttctgaatcttttggtcatatatttgattaaattatgtaatatgtaaaaacacaaataattagtgtaaaaaggttttgtgcttacctaatcatcacgtctacaaacacaaatattgggcccaacactccaacgcatgcctatttcattacaccatctacaagttcttctccacaaatgtactttcattttttttcttggcaacaacattctcttttttttttctttttttcaaaatatacgttttactacaaaattaaaatttcgtaaagtacaattttgcatacatttatgccggcaatgcttcactgtcttctgactcaacgcatgtggtggtcacccaccgattttctcctaccttttcctttttctggttcacttaaaccgatacaaatttcggtttaccacaacttttctaaaaatacgcgttctccgctcacgttagcaacaaccaatcgggagtttggtgctattgctgccgtcataaaagtacgcaggcacacaaggcgcactctagatggctgtcataatcgcgccatagttacagacgccattacacgtgtcattcttctgactaatccacgtcatcctcctcctcttatactattgccatttttaggttttcctgcaaaacaaacaaatcagtccttcttcttcacttttgttaccttcttctctgcaaaatcgactaaagttttgagtttcttcaccgtacgattaaccggag

SEQ ID NO: 3614 - DNA, 473 bp, Arabidopsis thaliana
agattaaggaagttacaaaattcaccaatatatataattttctatgtggttaattgagattgtgtaatgatttggggttgtagtttcaggtgttgatttggggttgtagtttgaacttataattgtgttatgtgtataaatatttgtgtttatatatatcaagttagtataaatactataatttcttatcgtttcttttattggcactggtgtcttgatcatcccgactaattcagacatgagcttatctgaaaacccactttggacacaaacgaattgatacgaacgagtaacgactcttttattgaaaacgaaaaggcctaaatttgctgtgaaaggcccaataaacaattaagtgattatgtaagacgatgtcgtttaactcttaagtttctcaagaaagttatctctctctatctatcttcctcaaccttatccttgaagctttgtttcatctgttgttccctgtgacc

SEQ ID NO: 3615 - DNA, 1458 bp, Arabidopsis thaliana
aatcgacccgagacaattagaaatgagtgattgtgtgattgtttggtgaagcatatgatatgaaccgtataagaagatagtaagagttggtagttggtacaagactcgttgttacatagattgaaaaaaggcgtcggcacatgaaccttgcttaatctatagactatttgtaagagttttgataataggaaggacttataaattattttttgggggaatataatacaagtttgtttttgtaaataagcgatttctttgtaaacgaacatttggattttgggggtttatttgtgtgagcatggattcataaacaaaaatcattaatttcttataagttattcactagtaaatggagattatgactcgaatgtagccaaatttagtttggatgacgtgaacaaccaaatcagaataatcacctatcttaatatagtgatttagtgaccagtagacgatagttgtgacaagaaatcttataaatactttgttgtcacaattcacgaatgttaaaggggttagaagttgaaactatctccaagttaaagtatccattaagctatcgttaaacataaaatacaaatcatgaagcatacgaagaccttaatatcaagtcatatacagaatgaatatacaaaaagaggaataattcctaatgtatacgtacgatactacgttgacgaaaaaaaaaaaaaaaacgtacgatactacgattggagttttctaattacttacagaatatttaaacaacattatgtatctagaaggatctagaataaaattgaatctaaagtacaccaaaaaagtggaatatttcccaatatcctaacaactttgataatatcttaatttcaaactgtttttattatgtaacaataccgtatttcatttcttaacttaaaactcattatttacatgatatttcaaaaattacctatgtacttgtcattatatacatggtatttcaaaaattacctatttacatattacccttttaaatggtatatttactaataaaattaagtattgcatttaggaaaagagagtgcctcttgatacaattttaaaataatacaaataccctatgtcattccaagtaactaataataaattgacaaataatttttttatacaagaaacgtaatccacaaaaataatttgaaaaaatctacacaaaatagttgaaaatagaacactcctatttatttatttttttccttttgttttgagacggataatttcacttgcattactggaatttttcatcaattattatatatttagctcaaaactatcactacccaaaaaccagacgcttcaacttatccccatttctctgaaaaccctaacaaatcctcctcttgttccgccactgccgccgccgctactcaacggtggtgaattttctatacggtcagttcgatcctctttttatcgacaatcctacacaaatccataatc

SEQ ID NO: 3616 - DNA, 1507 bp, Arabidopsis thaliana
tttcgttgtttatctcaaatccataagctcagagataagctagattgtatgaatttcgtaactttcgagaaacaaaagtagatatttttgattttgttgctaaaattagaaactgggttttgggtaaagtttgcgactttcttcagaaaatgttgagttttgagttgagagattgaggcgtggaggagagagaaatgaaattataaggggagagaagagaaggttctagagacaagacaagatcatttcactgtattgaagcttctttgacatttatgtgagcacgtggcgacaagacaagacaatgttccagaaacttcgttactaatctagaatctctttttttatatatatatcatatgggcctttacttaagcccatttctaacgatgccaatttatgttctaggtccttctttttaatgtgggccgccagaaaaagcctactaaaatgaattattgggtatgtccaagggtatttatgtacttaagaggcgacctacatatctcgtgcgtgtctccacctgctgcacaatttttctctcacccgataaccaaacaggtctctcacgtgtaatttagtgtttttaagactttagggaataagattagaacggttcttccccaaacacaacgaagaagtcttttgtttccgatatagatcgaggaacttcgatttatcagacattaacaccaatttttaagatatcgtgaaggagagatttgattgatggcttggaggcgcatcatcaccaaggtttttgtttcatttttctcttttcccctttatccaatttttaatacgaaaaaggtttcgactttggtttgatactgtagtggatttgatctaattagataataatttctgatgggttttatcaagatctttgtgattcataagctaaagatgatatttttcaaaccctagaagctcaaattcttctctgccctcaaaatgttgtcttttaggattctagattgtctctgtgatattgtcatttgatttatttgactacccaagtcacctaattttgaaattggtataaaaagtttcaatttttttgattcaaaatgggtaaaagtattcacttttatcaaaatgttttcatgtgttgtctagtgtcattttgagtttgggattagtaattaacttcatctgtattgattctcttcaccgatgacaggtttcgagtcatgaaagggaattgagcagtttaagaagcttacttgttagagcttactcctcttttcctagagtgggagttactggaggtaaattctgattccgtttatgagttgttcttgttgttttagaagtgtttttgatgtaaattggttttattttatctatagctgtgggtggtggtggagcttctttaccgcgaacgaggtttcaatcgagttatgttggtagctttgctcgcagagtccgtgatagagaagaagttaatgaggttgcacatctgagagaacttattcgaagaaatgatcctgaggctgttatcaga

SEQ ID NO: 3617 - DNA, 2000 bp, Arabidopsis thaliana
gtattgccgaaaaaagtatggttgaccaatcccaatggattcaaccttacaaatcataggtgatccacaaacatctaactaaaaccaaaatatttaagatataacaaaaaaatcttgcaagtgtactattttaacaggacaagtgtatcttgtaatacggaagatttcgaaaatttgaactcccgatttcaacataacaaaataacatctgtcctcgggcctatacaggcccagtaagtctaacgataaatgagccttaatggactagatttaaaactttataaaggggccaaggcgttcacaaacccaacagtaggtacagaaggctcctggtaataactgaaaagcaacgcaaccacatagcaaagacaagttacttgatccaagagagctgtttcctttgtgtgatgttgttcgattttgacctcagtgtttatgaattcctgagtaagatctagtctttaacttccccaccttggatactgtattcacgaatgagcatgtttttgttccttgggagattccataattggtctgatgcatatagacatgtgttttttttttttggtgtcatatgtgcgctgtgaatcttgtgatattttagaatctaaaaaatatacacgcacaagaaaagcttacgaccacatatatcaatgggttccagtttaaaaatttggtgagtattattaagagagtcggagaagaaatatttgagcgtggttaaaatattaagaaaaggaagagacatggagacgatgtctcaattaagggggcaagcctctctggccaattacagagaaaagggcccttttagattctcttcaagatcttctttttttttttcttgttttttttggtataaatcacacatttactacaaaaatgcacttataatatttagtgtcaactcataattgctaaaacatttctctcgtgttttccatagcaaggtgccaaaaacgaattgatcaagaaaagtaaatgttttacattagttactatagaatttagatcatggtttgtttaagatttagaacttggtgtaggaactaataattccctcgtgatatatgacaaattgacaatgacattcaccgttacgaaggatcgaattttgtcaagaaaaaatattttctaaactatggtatgaagacaatatacatatactactcattactcttgaattttatttttgtttttcctttgtagactactcattactctttagattgagatatcaattagaaacatacaaatcacacacaaaatagtgggaaacggcaaaggagagaatttgttggcggaaaattgtccacaacattacaaatgagtaaaggtcacacaaaagagatccttttttctcatatggcagcgccatgaaaatggtcacatggaatgcttttttggtaaattttcttttctcttttgcttatttcactctctgagtgcttttttccctttctctgcttacctttaaaataaaataaaaccacatgaattctaccgcaaccacttgaaacaaaagattcaacatcaccctttatttctcaacttatcaaaaatatatatatcaatcgtctatattctttgacctttggagttacaatgtataaacatagaaaatatatttgcatcgctcagcattttgactattaaagggcataattttggagcttcatgccaaggcaaaaagataaagaacaatcacatgaatgacaaaagattaaaaacaaaagatttttaactaatgaaaaaaaacacaaaaaacaaataccggtaaataagggcaaaagtggaattaagtgttatagctccgctggcgattggcagagatataaaaactgatctctctccattcatcttctcttgtttctaactagtcacattgagagagagagagagagaaagagagactctcagaatctgaagaagaagaagagattgttgtttttgccttttatcatcggtttctttgaatctctggttttaaatcggattta

SEQ ID NO: 3618 - DNA, 493 bp, Arabidopsis thaliana
tgatcgaaaattccgatttctaatacaaattctataatcgaatgacaacgaatcaaaaagaatcgataacccctaaagttcaacagagcagcaggaaatgggtttattccaacgtttctcagaattgtgggtatttcgacatttcgaaaaacattaggggtattttagacttttcacgttcacttacatgagctagggttttatttttttcagaggtcatatataaatagctccattcgtcttctaacaaagctccggcgccaccattaaaatctctcgatctctatctgcgaaatttcacggtgagcttagtattactctcaattgttctcagttcagtatgtcttgattttcgtagcttagatgatctgattttgtgtagatattttgattcagcgagctctatagtagtagcctttaggaatcgatctgttaatgtatgtgttgttgattggtagtatcatttttggtgtggtgaaggtaggtatttgaa

SEQ ID NO: 3619 - DNA, 2000 bp, Arabidopsis thaliana
atacgatattgttacgcaatcgtatctattatcctgaagtcaattatgtagtcaatattcattttatacgtaaaacatctatttaagtggttctttaaacgtgtaaccaaaaatcaatgaatattttaaaaccataatacgacaaaccaccaaacaaaatttccgacaaagatatattttctcttcagtgtcgaatcatattgcggaatcttataatgtgattcgatctatagtacagtgactattgaaacaaaataaattacattacaactggatctagactaataatatggtacgctaattttggtgctatatatgttctctatactttaattcaggagcctcttttacagcacaagttatcaatgcgttacaattaattaatggattagtgaacccatatatcgttgcctagtttcggtgatttaatgttaaaaaatgaggactaatcgattattcattacaaatagatttgcgtcactgtcaaccttccactgcgatggagaacatatcacatttactaagtaatgtcacacatggaacatatcacatatctgcacagatcaaaactagttttataatgaaaataaatcaaagatcaaatctttgtcgcactgttgtcctcgtgtcccactggtgtaatctcgtcctgatccatttaaccaaagccgcaggatcgcagtgatgcatatccacctgtgcaaatctgatctcctatattgtcgtaatatgatcattacacaaatattcacgtgagttacacatgaaaaactgtataaccacacttgtctcctatgacaatggtgacagctagataatagtgtataacaaacaagcaaccggaataccggatcaaaccaaaattaatatggctagtgtatatacggctgaaacgaacaaagcaaacaatagaaaacaaacgaaatgaaaaaaaaattaacgtgggattgtactagtagttgaatccatgtaagctgaaaatataggtattttggaagacacgaatttcgattctcatagaaaatattaaatgttaagtaatgattaaaaatatgaagaaccacagctttcttaaacacttttttttctttttcttaaacacttctgatggtcaaaataaagttttttgaatagaacctttggttggaaaaacaattcgtataaaatatcgacatccggaatacaagctttcttttcaattatgtgctgcatgcggtattaacaaaaaaaattttggatctatatgtttatcatatacttcgtttttatattactaaatagaaaacatacgattacgcgcgatattccgatcgttataaattgtttcataatcacatttcaatctattagggaagggctatattatattattactactataatatgagggatacattaacagtcgctaataaaaacatgttggtatggaatccaaacatgcctagtgattttaaaaaaaaaaagggttttaacatatctatggctagtggaagtgaagagagagatcgtatatgcatcccttttctgttgtgtcggccgtttagatctttttatattatggttcttttttgtatttattttaagaacatttgcttctctatgtacaccatacggtattcaaattcaataaggttatacacatatatttctttcttttgggtgaaattgtctatacacatatctacaatttgtgtatataaagaaacgccccctacgtattattggcccttcgcataaaccaagagccaacgaagcaagcatcttccaaagaaaaaacgttgccaataattgcttccaagtttcaagccacgtagtattttgatcggtccactcaaataaaataataatatggatatttgcatatatataagtctaggtattgcatgtaagacttcacaacgtagagcaagatatctggatacgcggaaaatagagagaagaaatcaaaaagcatatttttattttatctttgaaaagaagattattgtttttagtctaca

SEQ ID NO: 3620 - DNA, 2000 bp, Arabidopsis thaliana
atgaaactccgaaaaaatttcatttcaaatggctcaaaatagatttttaaaaataatttcaaatttcaaatctaaactttacagaattgattttaatttcatgatacacccccaaaaacgcaaacagttggcatgataaatacaaatcggtttaccgaaaaagaaacaaatccaaatgctagtgtgtacattggcatggaattgtctttgtttttggttgttaaagaattgcattgttaaattacagattgtatggaattatagtcttgtggtgacaccaaagatactcggatctttctttcacttgtgtcgctgaaaactgaaaagaacaaataataataaaacgcaaagcaaagggcgtttcttggaagcatgagttcgcaaaatggtgattaggcaaagcaacggcgctcaaagctttttcaacactaatctctttgatttgcgtatcacccttcggcaaatcggacacaccttactttcttccgacaagatcctttgagcacagccgcgacaagtggcagagtgaccacacggtacaaagaaacagtttctacgttcctcgaagcatataacacacagtgtcgagtagtccacatcatccgacgagctaaacgacgccgtttctacatctcccttccccgttacctccaacgactcattgatcaacggcggcgtccaatcggtggtgacttcttcttctgccaccaatggtagcctctgtgtgtcatcctccatgtcacattcgctcaggaatttcaataccaaataagtaatcgtcattattgttcctgagaaacaataacaaaaacaaaaaaacaaacaaattagctctacattgaagataaatagtactccatatgttaattatataaatatgggagaaatatagtacccaaaactgtaatataaatcaccactctagctgagaaggatagccccaagtaccatcgaacgaactcatcctgcaaaatacaagttactcgcatatatatattaatccatggtttcgtcaagtttttttttttatatagaaaattgagtagagctaggagctagaggggtactcgcgttatccgatggtaacttgatggaatttagtttacggaagaacatatatagaagctgcagacattttgagatcgtggcatcgaacattttcgagagaaaagaatgatccagtgaagatagaaatgatttgttctcatctgaagttatattgaatttcttattgtttgttagagagcattaaacaaatgaatttctgattaattccaagcaattgtcatcactctgacagtatatatagattgtgtcaaaagactcgtcgtgcaatccatatttattaatttgatcagaaaaagaggcaaaatacaagttgctgacacaaacttaaaaagaaaggtacagtacaatttcctaactctgatttaataatacctatttgttaaaaaggacaattcaagtgagaaaatgaaaaggcacccaaataattcactctgtttaagtcctaaacgactgattcttttatctgaaaatacgtgatgctaaattagtcaatagttgaaataagatttaaaaaatggattatccgttaattcacaaaaattcctagaggtctctctggtacattcaatgaacactctttttaatagttgaaaataaacatttgggaagaactaagaagaaacaacattataagatgggcttgggctttttgttgtattgttttttatgttttacaattttatttaacaaacaagatgacaaaaaaaaaaaaaaggactccaaaagtccaaaacagctatggagtatatgagggtaaagtcgtcattttacaaaaagcatttttatcttcgttttgtcgtcttcgaaagttctcaaagagaaggcatctgagaaaccccaatctctaatcttcttttcaattcaatacttttttttctcaatctctcctctcaaatcaaacaactttgattgatcttcgcaatcgattccac

SEQ ID NO: 3621 - DNA, 1925 bp, Arabidopsis thaliana
ggcgttaagcaattttagatgacatagataattctaaaaggaaattgatttactgaaggattcatacgcatcaaagtcgtaagagaaggcaaatggattctttttctgttttgaatttccactaggtttatcatcagaggtctctttcgtttttgtggttttcttggctgggcttgagaaatcaaagtctggcatgtccattttaaatgatgatccaaaatctccatccagatcgaaacccatatccctgagaaagagacaaagaaacagaactatatgagacactaggccttgttgccaagcaacagaaacttatagtagtaatcatgataaaggaggaaaaatttcacgattgaactacatttatttaggtgcaaacatggtttaagaaacttatcatattggttacactcacaacttgaaggcattcttcttattttttgctggtgagccaaagccaaaatccattggatcatcatctgtcattgacttgaagttccatgtatccttttccatgtctttatctgcagctaaccatggaaattaaaagacaacgaacctttgaatcacccattttaacaatgggaactacatcttatggtttctatctacgcccaaaaaattaaaagctggccaaaattgagaaatagaacaataaggagataaagaagaataaaagatagtgtgcatgatctttttgcctatagcatcaagttattaaggcagtctacttggggattccttttcttcaatggaattttcgccgcaagcggcttaaagacattccactagcaatgccatgttagttatgaatcatatcacatgaacatttgaaccataccgagcattagatctttgtcctgagtatctgtagaacttcttttagcaggtgcagacatggcaatatctgttcagtatcactcttgaaaaccaactgcaaagaaaaaactaccatcataatcattctagcactcactcacgaaaacacttatctgttatgttatgataatcacaaggcaaccaacaaaaaaatcatcctactacgtcacaaactcaactagcatagacaaatcatcagttccattaacactcttctaaaactatttctaaggcgatatgacgcataacgtacgtaggtatgattatcggagagactgagaaacataacagatcaaacaatgtgattatccgagaaccaatctaaacgaagaagaacagtagcaggaatcaaattatgagattcaacaccaaattataaaaaataaccaggcggttcgtcgattttaagcaaggagacgccactcgagactaaatttcagggacaacgagcagcacgaaactaagtttaggagaaagtgcatcttagcattgatcgaacatttcttactcaaatctacgcataaacgtcacctctaacacagaaatgttcatcgattatgatcaaccgatcgtcaatcgtcgaaccttagcaaaccgaagctaaaacaacgcctgacagtgagattctactcaatcgacgagcaacgagggtaaattcttaccgattgaatcgctttgcagttgtatatgtagtaggcgctaacgataaacgttcaacggcaacaagacgacgacaccggagagaaaatcgccgacggaactcgaaggggggagattttgaaattagctgggctccgaatgatttgacttgggcctttatattcttatgtttggtatatatatatagaagctcgcctttttttttggtacggctattttattttctatatcatttttgatttataaataaaaaaaaggaggagatagaggaggaaatctatctccttatcctgaccacagaaacaaacataagccaatggaaacaaaaaaattctaaggtgaaaaaagccaatcagaagctgagtaaactctaagctcacacaaaa

SEQ ID NO: 3622 - DNA, 2000 bp, Arabidopsis thaliana
gtttattttccactatttttctataatcaatatcctttttgatcttttatatttattttaagtgttcaaattttttatataaaattcatatagtgtatatatgaaatattatgtccaacttacttttgtttttatagagcaaattgacaaaataatatgattgaaagttgataaatgacatgattgaaattttatgtccgactttccaagattttatttaagtaaatagttgttttgatattttaattgatcgctgacttttcaaaaaaaaagttgtgataattaaattagatttaatatgtgatacacaatttgttatatcatctctgaatatagtatacttttacacaatttgttttgggccgtgattaatatagcccatgatcgttacctaatgggctatgtttctctgcctctaattgcttgttatacatgatgatgatatattgataatctataacctatatacctctcctgaaaaacgaatttttaaaaatgtatacacttctcatgtttcttgttatatctttttccttcttgttacaatttatcggtgggaatcaaatctgattgggttcctttttttggtcggtaatggtattcaatagtcaagtatgtaaaagattctagcatatagattacaagtcttaagcccaacaaggaaccaaactaaaactgattagggaaaactaagtaagattctataagctagagtttgtacaaaaacaaattctagcccaggtaatgaaatatccaaatgcaaaagacaacatttattagctcagaatctacttttaaaaaagcccaaataccacatatcataagcttgcacttccaaacgactctaaagtctaaagtctaaaccaaccatcgccgctgatcattgacttattggcatactacaaaatttacttgtttggagcaataatgggttttctcttttagccccacctaaaccctttttaggaggaaacctagattatacgtggccacactaaatattattctctcattaattgctctacttttaagagccaaccaaactttttgaagacacaaatattatgaaatagtaatacatttgacctccgaagtttcaacgaatgatctacacaatccatcgtgtcaaagatacaatttttttatccaccattaaaactgtaacaatacaacattactcataacattgactttcaggataatcaggctcttcatcaccttgacttgcagtttcagtctttttatctacttactgcatatatgatatgagaaatccgatttgtgtgttaatgtgacataaacaaaaaaaaatgttcttcctatatatataacaaatattttttatgaacaaaccaataataatgtgtatcagaagcaaacaaatgattttttggtgcactcatgttcccataacaaaagtgattagtttctcataaagtaaactcaataattattccatgagtatgtttatatccatataaaatttgcaattaaataatcaaacgtcaaggttcaattatagtcaaaacaagaacgaaaaactaaccaatgtgtaatccacagattggttaattgcactgaaccgtaccttatcataccaccccaacggctatcgacatcgatttattaccaaaaaactcctcaaaactatataaaagactctactatcttccactttccataaaagggtaaaatagacatttcgggtaaccttctctcaccgtcaccacacatgcaattacactcagacaggaactcaaaaagacagctcattcaattacatcaacacagatcactccaaagcctttctctttaaattcgttatcgttttttttattttatcaatttaatctttttatttgttttgttcttcctcgattcaacactcgatgctgtgacaaagcccagattttggccggaaagttttgtgtgtttccggcgaagaatgcgaagaaaccggaagaatctgtaacggaatctaagctaaaagttaaagtacg

SEQ ID NO: 3623 - DNA, 893 bp, Arabidopsis thaliana
tttacagaacaaatcaatttcttcttctaaattcatactcgatctcttagtagaaaaagttcttccccagaaacggctaatgaaaggaacaattacaggattacctttctggagaagacacagattgagaaatttatttgcttttgatgcaattgagatcgtggtcgatctccgcatttgaattattaacctcgttttattcgtaatctatgtatctgtaaatgggggctaaaaccctagcataaaccctcttatctcctccatgggagagagacgatgatgagagcgagatatgaagaccggttcaattccggtttactattttctaattaaactgggttaatagtctaatttcaaaattattttagagctctgggttaattaattagtgccgttgtaacggtgaaataatatcggttgtgggtccattaagtgtacacgtgttcggactataatttgcatgttctctgttgtgtcgcgaagcagaccaattcgttgattttatgagatcagcagagtaatattccaaaatattcaatcgtcgacatcacaaccattttaattcgtattttttatatttatttaatgtaatataacttagttttagaggaaacatatcaaaattaaataattaacacgttaaaattacatcggtataatatgtataggagtttataaaattaaatttatcataaaagcatatgctaactttaattaagtgctttctttttaataatcaggtggcattaaatataattagacaattgatttgtttgattatattttggtgacaaataaattattaacaccattgtctaaccatcctttgcttttatagttctctttattctctcaaaaagcctctctttctctctcttttgtttctcgctgcc

SEQ ID NO: 3624 - DNA, 1585 bp, Arabidopsis thaliana
gataaagaaaaggtaggaatgatcatgcgagcatgtataatactttacaatatgatagttgaggatgaacgagatgagtatacttattttgatgcatccgaattcacacaaccggaatcaaccgcttcttcacaagtggatttcaactattttacagatatggcttcaaatctcggtaatattatggcgtctggagcctggttcgtgctcggactatgcatcaacaattgaaaaataatttaattgagcatttatggcacaaatttggcgggaatcaagctaaccactaatcgttattttggttttcaatatttatatcatgtatgtttaatatttaagtatttacattaataattaaattttatgaaataaaatatttgtaatttttaatttaataataatattttattttttaagaaacccgcttaaagacctaccattggacaaacaaaaaattaaagaaccaaaaaaatctcttaaacttttaaatttcaaaattatgattaaaaaaatatgaagagcccctaatggtctcttaccattggtgttgctctgagattgcatgtttatgtatctatgtttaggatatgcaaagttgattatgaacttgcttttgggataattgtcttctttttttatgcattaacaattttaaaatttttaggataacaactctattcaaagtcttttaacaaaaatactccattcaagctcaattgttactaaaatccaaaactttcgccaaaacttattttctcaattggttataattttcattgggtaggtttcaaaacaacatgttttgaaactatatttttttttacttttttttaaaattagatatctatattctaatctttaatctcctttgacaacattctaattataaattcacagaaaaattaactaatgctaaaattttcaataacatattttattattaataattaaattaattgttttgtcacatggaaagaggcaaaaagaaaagtatatatcatcacaataagatcttcatttcgatcctcacatgcattccatgaatgtgtattacatcaatttacaccttttttaaaaaacattatttcagaacagtattaaaacaaatttcgtggataattctaaagtattacatactctagaattaaatatatttccgtatttaaaaaactaagaatatatttttagaacaaaaacttaaaaataacaaagtaaatcgatagattgataaatatatcttctctttgctctttttcaatctgtaaccaaaatattaaaattcctcatgtatttatttctgatatcaactaattgttaaaaaatttttttactggttttaaatttaacccgtgcaacacgtggcttgatagcgttatataaaatattttgtttgacttgaatgggtcatctatagtcttcccagtcacacccaaaccgctcaacaagaaaaaccagatttattttctctggaaaacactcttcaagtcttttaccttccgagaatatatttcaaattctatcatatcatctttgatcattttccttgtccttcgaatttgttctttgttgtggcggagtcttgaag

SEQ ID NO: 3625 - DNA, 2000 bp, Arabidopsis thaliana
ttttgtctccttgttcaaattttgtgtgaatgtgtgtaaagaacgcagaatctaatagaagcttctctttagggtttgggttgttaggacatgcgtttcatcctctcaaattttgattttgtttcttttaatgaactcaagggttagtttgatgcttatcaaattgagggtttttgttttggatgcagagactgatttgacatatgaatgacgtcgaggcacttaggcaagaaggtgctctttttatactctttaccttttttttttagtgaatttcgtcgagtgtttctgaagaatttcagcgaaaagtttgtagctttagcttccatttcgttactattttctggtatttttcccaagatatgcatagctttaatgcaaattcttggtgtatttatgtttgctggtttgattagaagttatggatgatggatgattattaaatgttgtattcttagttctcatgctgtttatttattggggtttaggcctttagcttggatttaaaagtctatctgacattttatagtgaagcaaatttgcatatgtatgaatgtgactagacatacgagtatgcgtttatcattgtctaagctattggtattttaaattcttgatgtgaaatattactatttcggctgtctttcgaattgttgattctaaaaatcgttagacgctactctgccggtgaagtagcgcttagcgcctagacggtcgaaacggggattaatcggggcctaggcgttaaagtaaactataatgaatttatattgttttataagaaattttatgaaatttattatattataagtgaagttgtgatgtgaagttatgttggtcctgtggctttctgctcaaattttattgctacagcccttggttcgatacttttcacgctaaaaaaatcgaatttcccccacttaaatgataggggcaaaattgtaatttaaaaatgttggggtcatcttcttcctcaaaaccctattcgcttgtttgatcgttttttcgcttatactcaatttttttcgtttttatccgcttgtttgatcgttttctcacgtaatcaaaccaaaataacacagatctaccactaaaatacatattcatgatcaaaaagaagataattaagtagattctcatgaacgccgatttgttcaccgattgagccaaaatcgcggcggtccacgcagaaatagcgcttttttcgacgcctagtcgaccgattagtccgatgtttagaagcgtttgttttagagaataattatgccttcatttttgtcaagtttgtttggtttggtgagtagtagttacacaatgttcttattgctttgcatatgtttatggatgtctcaagaaactttatgaaatttgcagggcattcaagcctcttttagaataggtttggttcttcctcgagtagtagcatctacagagagacagatttcctctacggttttaaaaagagcttctgaaagtgtctctttttcattcgctccgtacataaatggtaagtgtcactcacaggcgattacaatttttcttagattgttagaaaatgaattagaataacgagtaatctcacccttttgttcatgtttagggtttggttttagttcgttatcaaattggtctcgtagttatgaatctttccctactgaaacatccataaggtaaaccattcgcctagacttttctgtcatttctctcttaaatttcatcctcagagcactcactatgtgaatgtttgctggcttgggttgtgtttcttcttgaacaggtattttcatgcgagtcgagaaacattggcgaaaagaaaagaggatgctgatcgactgctgagtcatcgtgaacgcaagaaacagactgtgaaaacgaaaggaaagttctcaaaacgggagaaaaaaacagataagccacctgttgaagctccttatgtgcctcctaggctgaaaagattggcaaagggattgcctgggaagactgtcgacatatttgaaggg

SEQ ID NO: 3626 - DNA, 2000 bp, Arabidopsis thaliana
gggtatttagcttacacttatatagacatgataactatacagtacatggcatttcactggatttgggaaatttactgttaaatcatattaatggtttgctctattacgtgagttttaccttctgaatattatagttggagacaaaactttaatgcttttaaaagtataattgggaaaatcttttttcttgcaaaattaaaacattttatttggcaggtggcaacaagtttattgtcaattagcttcaggatgtgtgataacaaaaaaacttcaaatgtagccttgccataagcttcaccgcttatggttttcgttgatgatttaatcctcgaatgtctatgctttcatgttttttacaaaaatttctcggaccaattaaatcctaaactttcattttttgaaatgatatttacagttcttatattcaaaaaaaaaatcaactatgtgaccagtggaagaaacattattcatgtgttatttgaatgtctttcaatataaagttgggtaatttgttttgatgcaagtagtagtaaagtttattttttatttttttattatgtggttaatctggaagtatggaaccaaaaaaaaaaaaaaataaggaggtcatctgaaaccatcggagtttggttgataaaacttttctaaaaaaaactgtattttttatagtttattatgacattacgaacatattttaattttaattttttgctgtttggctccaattgggcttataaaatctggtatttacgaaaaaggaaatctaattatcttatcatcagtaagcttacatattaataaatcttaaacagaaaagaatttggtgtacttgtcaatttacaatgtgtcgtataccttataagtttatagagatagtgaaagtatgttttaaattataattttgcttctttttgggggaaatattaattcaattgttcggtacaaaggcaactttgctttcatttgatgaaatgattgggttttatccatttctttaatttttgttaaaatgattacactgaactcgtaattaacaacgtgagcaaaacaacaatttttaattcgattagtgctacatatatagtcgataaatataataagaaaagttgacgacaaactcagttatggaccggggtgggtagcttattagtgaagctgttgtgttataaacttatagtactgttttaaatttagaagagtatttgtatgagatttagttgtataagaaaagaaaaaactaattttcatattattaatttaattttatgtctttaattaccattatttagtcgtgacttaaataaatctaacatattgagaaattaattataattttttgacaccactaaactttactgagtagtggtgttagttttatatttcctagtatttagttgtatttttttttttgtagtttgacatacccgtatatcatttacctaatagttaatatctttagaaatatatactattagcatgcccccgcatagtttataacaaatatatagttaataacttaatacatatagaaacatcattcatatgtggtatatacatcatcacagttacatataaatatatatatatatatatatattactaatcccttccaccgagaaaaacagtatattctatacctacaatttcaaaaaacaaatgtttcatataactttacttaatagttttttttttttttctgttaaagaactttacttagtagttctataatttgtttcatagttaaaaaagaattcaatacctactcgttctttaaatattttcattgttttttgttgttttagaaagaaatgggctccaactcaacatccatgttatttataaatatatccacctctagtcttaatatttcactactcaaacaagtttctgaagaagagacagagagagaaggatagagtaaaagctaagagagagagcgagactgagagagaaagaaagagatatcattttggttattaagtaattaacttatactaatc

SEQ ID NO: 3627 - DNA, 927 bp, Arabidopsis thaliana
ttacacttagctgcagtcatatcggtttcctctctctgttgatagtaggttttgtcttcattgcataattgatcattgctcttgatgatcatcattacctatagtaagaagcatgcaagttttgtagcagtgctagttcagggttttaggtttacatgggaatctcctagtatcatttaaggggttttcaagtttttactctcttgagtttgtcataataagcgtctttgatttggtcagttgagtcttgtgtatattttctgcatatcttatctggatcagttgcttttttttttttaatataatttgattgcttatccttgctttcatcttattggttattgagttctccaatttatcgtaccgcgattcaaaccgtacttaaatgttaaaccggatattattaaatcgattgaactgaataagattcggttcaagtttggttatatttttcttaaggcctctgatttagttgggcctatttacgatcttacaagcccaaacttattgccgaagatccattattgaaaagtctcgacgcgtgtaagcttactatatccctgttgccaaacaaggcttttgtcccttgtagggccaatcctttatttggctataaataaaggatgtatgtcttctaaacaaacactttttctaatcggagagcttcgaagggttctgagatctcgcggctccttcgatcttctccgctcaactattacctccgatcgttggcttatgtctactgtaacctcttagatttgattttggcgcgttattagaaacccctaacatctttaaactcactcgaggtctctcgtgatcgatctagggtttcgcgagatctgagatttcatattttccgattcaccttcgcaatccaattttttttgttgcttggattttgtttgtgtgtaatcgtgtggtaag

SEQ ID NO: 3628 - DNA, 2000 bp, Arabidopsis thaliana
ttccacaaatccaacatgtttttcacatcttcatgtgtatttagcatttatgtttttattttattttctttaaaggttttcaactccttttttattttatttttattttttaaaggatttataaatactaaattaatatgacgttgtaaaatctaaccggattttggatcctgccatttaaccgtggtcattagcgattccacaaatccaacatgttttcacatcttcatgtgtatttagcatttatgtttttattttttttctttaaaggttttcaactcctcttttatttttttatttttgtaaaggttttataaatattaaattaatatgacgttgtgaaatctaaccggattttggatcccgccatttaaccgtggtcattagcgattgcacaaatccaacatatttttcacatgtatttagcatttgtgtttttttttctttaaaggttttcaactccttatttatttttttaaaggttttataaatactaaattaatatgacgttgtgaaatctaaccggattttggatcccgccatttaactgtggtcattagcaattccacaaatccaacatctttttcacatcttcatgtatatttaacatttatttttttaatttttttttcttaaaagattttcaactcttttttcgttttttaaaagttttataaatattaaattaatatgacgttatgaattctaaccgaattttggatcctgccatttaaccgtggtcattaaggattttataaatccaacatgtttttcacaaatcttcatgtgtatttagtattttttttttaaaaagtttttaactgtttctttttttcttttcttattttgattttttaaaaagtttttctatttcagggtggataaaattagcagaaacaaacaaatggaatagaatcaaatcaaaaatcaaacaaaaaccgaaaaccgaaaaaagaagagtaaattataaacataattaattaccattccccaaaaaccattcccaaaaaaactagctaccatattttcatgaaagttaaatacagaccaatcccaataataaaaaatctctcgaaagtgaagttttgcgcaaagaagtcggctcagatattatttgaagttttgaactatggtagatacttatttataaatcaattacatataaaattaccaaaagctaataaatcgtaagccacataattcacgtaagattcctgtccgtctctgaaagtgtggtcgttactcgttaccgacgaaccgttgattctatggaaacaagaaagtccagaaaaaaacaaaattgcatacacgtgaatcaacaatttatgggtcgacctgaaatatatttagaaaaataatttactaattctttttttgatagagaatttataacaaactttagtgacaagtcataatcaaaatcagatgactcatcattttccaattttcctaggacagtggatttttcatatggaccccttaaaaaataaatatattaataaatatctaaaagcttttgtaaccgttgattaattacttaaaaactcattagaagcttgattattagtggaagacagacaacctttgtacttaaataccttttatgagttttgtctgcctctaatttactctttgctacacgcttctagatccctcttccttcgtcaaaatctcatttttcttttttcttgttgatattgagaaatgacttaatcctatttcgtctccttcctcaattcaacgatgcttagggtttgccccaaaattatataaactcgtcgatacatacaaagcttgtgactagaattcgtttcttcaagagtaaagcttcctcctttcttctcctctgttttcatctctctgaaacaatggaaagaattatgataaatccattgttatcaattcaaaactccccaaccaagttcttgaaaccaccactttcgtccattcacaggcaacaacaacaacaagagaggcagagcaataacaatacccttttc

SEQ ID NO: 3629 - DNA, 2000 bp, Arabidopsis thaliana
atgtttaactaaactaaattggatgacataatttgaaagaattatatatgcaaggtgtaaatttaacgtatagacatgtcttgataattaagaaccacaaatgtcacagctagtggtatatataaaactaaattttaaatacgtatatatgtgtgtgaaatgtcatgataggttaataaccatttaaacgaacttatgaatagtaacaagacgaacttatgaaatgaacttgtgaaatgtcatgagaggttaataaccatttaaacgaacttatgaatagtaacaagacatgaaaagataagaattaatgtacactttatcaccaaaaaaaggaagataagattgtacgaaatcggacgtaataatgtaaggacatggaaatggcatgaccctcgggtgcacgaggcagttccacttcctgacgactctccattttacttggtttacttttatcttatctcttttcctttttaccttgcgaatcaaattgaccttttaacaaattcaattcctaagtgtttttgtacaatatttgtgaattataatgtgtagtgtatgtctatgcttgtttgattttctaacgcttgttggatataagaaacaattatcttgaaatctctacagtacttatcacatccaaacacactatataatatattggacaagcgatacactgtcttatacaaaacaaaccaatcacaaacaaatagaaaacaatacatctgtttcgagtcaagtaacgtcctatatattttatatagaaagtataaatatacacacactagttgaaaaacttgaacaagaacatgttagagggcatacatatatcattcttactaacaagagatgttttgtataattaagccaagactttctaatattatatttgtgtggtatagatatcataccaacaattgaactagaataagcaatatatttaccatactatatcttgtttacctaagatttaaaacggataatagccatcggatgtacatgtacacgtgaagagttgggatatgaaagaaatccaaaggctgagaaaaagaaagagaggtgaaactccaatgaaagaattgggtttgtatacggaaacacgagtcttgtgctctcttttggatccggaccacacgagcggctaaagaagcaatgttgtcaaaaacgttagagccgtatgggttatgggccccaccatctctttacttgacgtggttcccagttccaaacttgtgttgtgtatatatcttgtttggctggcaattaatttttgaaaattttaattcgatttctgaggacaaaagtggttgctgattaatcaactaatccaaatttgcacaatgctaattcaacactcgtgctgcattaggtgaaaacttattcacactgggaaacctgcctttttatatagtatagattgtttctcatgattattgttgattaattaaaacattttttaaaaattagtgttgcaaaagaaaactaatcttatatgttgttttattatatgaatgtagatgcggatatatgattgagtcccacatgctaacacgtattgttccctgctggggaagaaggaaatcaaaatcatgggagaattataagcatattcactcgcctacctaccttgattactcatcattcataatttcatagaatcattttccctaaagaattaaatacacccttgatttataaagtttaaacgcttaaaaagtccaataacgagagggcctttgaatcggattcgcaattatatttgtaacaagtaaataattgggccgactaaaggaatgaatatacttccaaaacaacattctcagtcggtgcatatggtacggacctaacgaatccaaacctaacaataaaaagaaaacgttacaaaaaaatatgtaacagagaaaataacaaaaatataacgaagggaaagactaaagaagagacacattcattaacaattcatacacctttgttcaaatcaacgaataagcttctttatttta

SEQ ID NO: 3630 - DNA, 2000 bp, Arabidopsis thaliana
aaaactcaaaacaacttgaatatcttatagagaaataaacagattgttatccccaatacatacacattaatcacaaggtttcttgatcaactaaagatcatatctaactatatccaaatagtattgcaacataaaaataaaatcgttgaaaatcgcaaataagtataccacttattcaaataatactttgttactcttcttaccaatatttttcctaaatatacggaagaagctatcatatgtattggactacttggtaggaaatctttatcaacgttgaatttttattattttgtttatagaataaagatttataaagaagaaaagaactaaaattgtataaaaagttgataataccaataagaaattttcttcagtcatatccacacacaaaaaaaaatcattgaattttaaaaaaggagaaaaattaatcatcatgatgaatgtctttcggttgatatttgatcgtgtacataattcgtcccaacattaacactatgtcaaacgaaaaaataagttttttattgttttattgttggctacaaataggatgctaaattatcaaaactaattgaatcgaaggtgaaatctatgaaaaccaagttaataaatgacatatagttaactaaacactatgccctcaaactaacacttgaattactataatttataattgatgtgaatgagtatgtttattttctcgagcgtatatgcagttatatttgtgtattaggggtcttccaaaaaaaaatttaccacaaaattatatattaaaatatccatgatgggaaatgattgaattaaaatgatctcctctcttactcaagaaaattatgggccgaaaactcaaaatatcttggtaaaaccgaaagaaaatccacctctggttttattttgtgtagttatatcatgatgattttcaaaatacaagttctaaataagtctttttttttttttttctgaaatacaaatttaaactgaagttgttgatcaatatatgatctcccaggtaaataaaaaactatatacatatatgtctatatgatcggatcatcccaatcttccacaatcgatcttatcatgatgcatatcgaccaaattggtccaaagatcatatcttagaaatgttttgaactatttttaatgcatgtcgaccaaacattttttaatcgaaacacacaaattttatactaaccaaactgaatgaaactaaacatattcgaatatttgaaaaccaagctggataaatctattaaatgtttgatggaaaatgtattaaagtttttttgacataaaaggaaaacaaaagccataatggtaagagaagatggtgtccatcacctaactaaccagcctcacctacctcataaaccacatgatgaaatcgagttaccccacgaacacactcagctccatgtttttttaagaactaaaatgtttgatttgatttgtaatatttagtattactgttgacaatttgtatatgtaataaaaattgaagattgatttactttaacataagagataatgccattttgttaaatcattattaaaattgaagaaaaatttaaacagtgcatctaattctcttctttgactacatccaaacaaagaacaaaattcccaaatcatttttattcttcttttttacaagtgggcatttgtgaggttgtgaggcccaaccaaaagagcctctcactacattccacaagaaccacacaaattcaaaagtctcactcctaacacaaagaagcatccaaacgcaatcctctcacctccacctcacattcccctgtgccaccatcacttaccctttctcgcctctcctgaaatcaaaatcccattatgcaaatccattttcatcatcatcaatatcatcaccaacttcattctcatcatccatggcccatttctcatctatgtagattctcatctctctacctcctcctcattttctcctcttgattcactaattcttcttcttcttcttcttttcagac

SEQ ID NO: 3631 - DNA, 2000 bp, Arabidopsis thaliana
aataagtcgaacactaacaacttctccaacatctttgaagaattctttgctgtaaaagtgaaggataaaatatcagtcatagaaaacttggtccgagaatgaaagtggaaatttgaggtgctacttacacatgcaatattttagtttggggagagagattggcaacatagagtacttcctgaattcaaaaaaatagagattggcaatattttagtgtgtgaataatattcatccctaaaaagaagtcatctttcgactttgtggcaacagttctgttattaaaatgtgtgagcgtgacatattttgaagaggtacctcaacaaaatcggaaggtgtctcattttcttctatcggaaggctttctcgttgaaggtagtcgttgtagctgaaaaattaagaaaacctagtgagctcttcatgtattcaaaaattcaaccagtgtaatcaaactcaagaggtaaatagttaaaatcccataccaaaccgtgtaatctatgcaatacctaattaacaaagttaaaagcgttagtctagcagtaatattgtatcaaaagctctaacagtaattaataaccagtgtcaccagaaacaaatgtcaataacatggaaaattgaatttacttgagtcctggaggtcgtggacgtcgtggaggctgtggacgtcgtgaatacacataaagaaaaatcttataatcgtgcaaatattcaccgttcttcttatacagcacctacggtaataaagagtttattcagcaatcgtacattcaaattgaaacttagatacactatatatttttcatcataactaactataaactagtctaaaccttttttgcttcgttagcagaagcaaagtcaacaaggccatagcacctatggatacgcttggcggttacaaaaagtcgaacacgaacaacttctccagcatctttgaagaaattgatgctgtaacaaacagtgtaaggtaaaaatatcagtcatgctcagagaaggaaagtggagattgaagatggtgctacttacatatctgatattttagtttggggagggatatggccattaaagagcgtcttttttgtcacctggatttaacagccaagtgtgttagcacaagattcttaattgaacagaaatttgtacaaaatatctagcaaatccgttggttgtttcctcctgttacatatgatacaagatcaaagagtagccattagaagaagacagtgtaaagaagattgttttgtcaaagaagaagagtaatacgaggccatcttagggttaccttattctacttatgtctcttgagaatggaattggtcaccaaatcatcttcttcagggttacgcttacctaaaagaagagcaacaaaaaaaaaactcttgagacaagtttaacacattagataaaagagagagagagagaggcaaccaaaaacaaacccaataaattgctactagaagtggccatggagaagatgaaacgaggtttatgtatttttccgttaagagcaagcaataatatagccctaaagaaatatagacctagcctaggaagaagtttctaagaccatccttatcaatgaactcttacataaagttctaaacaattttgatatacaaaataatgtttaaacattagaatggctcttacaaaaaaagagaataaagaaaaaaaaaacttagctaagagccatttttcatttcttaagcacacttttttatttttttattcttattttatttaatataatattttgatagttcttatgatattgttaacaacctattgataaggatgctctaactaatcttataaataaaacaatgaatctggtttggtctgggcgtaacagaaattatactcttttttttttttgtcaagaggaaattatactaagaagcaacagattaaacattaaagcgtatagtaaaattaattgtttgagaatcttaaaccaaaccgaaccggtattaaaccggaaccaaattggcaatgaaatttag

SEQ ID NO: 3632 - DNA, 2000 bp, Arabidopsis thaliana
actcttgtctctctcgaagtcgagaagttggtggcggtgaccactggaccataaaatgtgttcttgttaacaacacgttttaagaaattgcaaaattgagtggacctattgggctttaaatattagtgggtttcctaatttgtacttgttgggccaattttatgacctccacaacttggatataaaatatttggtaaggaattaagtaaataaatactattttattttttgaagcaccaaatgcaatttatggtgttaataaagttttatgataataattaattaatgcaaaataaaaatagttttggggtaaattgattttttttttttgggagaccaacagtcttcaacctcaaaaacgagaagctctagtaaatcatgatcgttttgtaatttattggtttaccaattgattttagtgatatagttttcgaaccgcttaaatgattaataaataaataaattaaattatggattggtgattttgtctctaaataaaaatgttgaatatgaaaggaatagttttgaattgtccttaataatttaacgttgaactattgaatagtcaataattcggtcgctaatagttgactagtacaaacaaaaccgaacagagcatgtattaattggccatttcaaaattcgtgttgcaataattaaggaaagtcagaactttagagaagtaaaccggtggcggttacccataattgccggttcggcgagtggcgtctcggtctccatttgccggttcccattgactaacgcgttagagagtgactgatgggtcgacttttgacttttactatttttcttcttttgtttcttactgccagttatgccccattccctgcctcttaattacgtatgagtgccactcacaaatatttttatttctgaaaatcatttgggggagacaaaaaaaaacaagatataacaaacctgttgttttacttttgttactgacaagtccttcagtcaaaaaataaaaacaagatagataaagaaaatgaaaactgtatttaataatatcctgaatagtcaaaatagaattgtctataaaatctgattttttaaaaaatataaacatatatgatgaagtattcttgtttcatgtatccattcgaaaatataagtaaatcctatgtacaattgaaaaaaaaaaaaaaaaggtaatctagaaacaatgctgatcaagctgtagtattcaacgtaattaacccaagctagggctagtggattctagttttcaacaaaattaacccaagctagggctattctaaagctagtctaaacatgtgggaggtttgataaatcgcctaactttatttgtttaattaggtcagaccatgggtttgatgtttatttgaatttttatactttagagatggtaatatgagatcttacaacaaaaagtcaatgtcctttagtggtgataccaatataagttcgaatttggtttctagcttattggtataaattccattgacagcaaaaaggaatcacgaaaacaatataatctagtactatattcacattttacgcgtaacgcgtttgtaatattcacataattatgtaagtgtgaaattgatcaaatcgcgggagatgctaaataaacaaaatcaaaatcactaataaaatgttcacgataacttagaaagatccaataaaaagatgacggtcggaatttgtatacgatagtaataaaagtattcgtgtttctaaaagttagtaattcattggtctaaatattataatgaggaaaagtcattggtaaggaaaaggtttgaaaaaggagcacataaataaggaccagcgatgcttcctttcacgatgcaaaacacgaaatgaagagacacattctctctactatatataccatttgctcctcttcctctaattccacacattcttcttcaactacaaaacaaaaacactactacacattctttcctcttgttcatttcaaacccaaaaatcaaagttcgaagttgaaagaagac

SEQ ID NO: 3633 - DNA, 827 bp, Arabidopsis thaliana
tgaaaaaaagagggaaaaatctaattaatattattttctcctgatttcaaatgatattggttgattttcgatctctattttttctcttctattgttgtgggcgtgtgtgttatcttttagctgtttgtgtcgttgttaattctaaaacgaaggtgtttttgtttagaaaaatctaaattgagagtttttaggagaaacagaaaacgatattttaccaaattgtaaaacccttttttggtctccacaattattagaaacactaggagataaaaataatcaaaatgttgctcctaacaaaaatgtcatatgtataaattttgtttaatcgatttgccacacacactcactgtatttactaacgtcaaagaggtgtgactttccaatctttcatatactacaaatcacaattatttcgacataatctctaaacaaaaacctaaaaactagttatttatttttacatcactttcctataaattggttatagttatttcacaataattcaaaattttcataatttcgtgctgatatactacattccattgttctttactaatttttatatcattattatgttctgttatttcattgtttttttagtattttagttacacttttttcaattgagaaaacttctaaaaagagaataatactatccaacaacattgaggttggtgccaccaacgcaaaacgtgaacaacgcgacataatagatctgactatataataaaccaaaatcaaataacaaatgtcttcaacactttatcatcttcaattgaaaaaaaaaaaaaaatcaacccaaagctctgcttcgttgagctaaaaca

SEQ ID NO: 3634 - DNA, 2000 bp, Arabidopsis thaliana
atttgtttttgatgttcagaaagaaagaaaattatgtatatttggaaaacatcaacggaaaaaaaagtagtatttgctaaaacaaaatctacaacaattgcaaatcatcaagtccggtaatttttttttatttttgtatttttcttcagtcaaaccgatgatgtgttgtaacgtaaatggcatctttttccaaactcagattctttttttttgtgttgataacattataatttcgaccactttaagcccaaggcctaaggcccaactgtatagcataacgtttaccgtcaatgcttgggccaacataataaaaccaagcgcgcacacacacatcaagccgacacattcggaaagactaaaagagcgacccaaagggaactgtgttttttttttttttttttctttctttcaaagagaagcaacgaacattatcaattcaatatgttgttatctccctgtttaaagtttcaggttgattcaagttcttcgtagcagagaattagatcaaacgtaatctacgtgaaatgcaaatgcatggccacatcgtagcagaatacaacatcactacatgagtcgttccttctccaatgtttaacaaaatattcaacaagtatacaaagctgacactctagtcaaaaatttgtaatggttatagtcgtagttgttacttgtatgtatattacttagtaaatcaaacattcttaagatagttgttttaagtagaatacaaaaacaacctaaaactgtaaattttttgtttaaactttggtagtatgaaggtgtaaaaactttagtaaattttattcaaaagataaaaaaactttggtaaattttctgattagcatttgaatggaaaaaggggatgggaatcacaacgccaattgcgcatttctttcctccttttataatttacattttaaattggttaaaggggtctcgaaaatgtcgggttggtaaaaaataagagtgagattagctacaagaaagctgactttgtttttcaagcaaatcatcaactgtcgcgtcgtaccaatcatggatccaccatgttatttgttatttttttgtcggcacactagtgttaatttgaattatttgatatattaatagcagaaataaaatacttcttacttgaagagcttaaacatattttcattacccgagaatgttggtttatcaaatgtgtatattagtggaaatgacaaatacgagtccaatagttaacgtaataactacccttcttttggggttcaaaagaactaattatgttgtttggagatttcgggaatacgagatcgaaaaatctatcttatttggatttgctttgattcattcttagtgtaaaaaccaaaaggaaagctaacctgttataaattttgatttactcaatatctaaacagaaaagcaatttgcacaagtaactttaactaatcttgtaacaaaaagacacaagttaaagcaatgatatactgtggatacctttttcaaacattgggtaaactttttgggcgtagggttatgttcacccacactatggagtggaaaacagcaatcattcacacaaccaccaccattcctactttttgtgcgtagggttatgttcagaaatatgatttaccattatctccttttttacatctatcaaagtatattattaactgattaatggaaatttcagttgatattactcgataaccttatgtcattactcagttcaatccttatgttatatatgcaattttaacatagaacgtacattattcttcatgagttctgttcctaatcagtgctatgtacgtaacttttgtttttactttgttcagtttttgttttgtctctttttttcttgactatgacactgcattcaaaaacataagaaaacagattaaagaaaagagaaaaaagataaaattgaaagattcgtttttctcaaatttcaataaaaagaaagatacatttctctcttcacacttcactcttctctttcccgcctctccgcc

SEQ ID NO: 3635 - DNA, 2000 bp, Arabidopsis thaliana
aacttgctttcgatattaaaaatctttgaacgagatggtttgataaagctcgatttcataattttcaaacccgtagttcaacacatgggaatttccaaagtccaaaacccatcacttgctactttcaccaactcatgattatgttttacatcattaacagtttcaatatgtttactttgttcattttttacagtttaaccattcattcatttagatatctttcttagcagcataaatcaaaacgccacaatcacttatgaatcaaaacacgttttattaataaaaacatcataactcaaccatgccacatagtcaacaaggaatatgaagaacggtcaacataactctaagaacattcctcacaacaaacacacatcaaaatcaactatgaatttgaaatcaagataaaaaaaaaaaagaaacatcgtaacataatctatgaccacttggaactattagattttggtcccgaatattaatatcaaacataacaaataactatttatttctaattagtcaggtttcactagaacaccggtatcaattaaaaaaaaaacaatatgcacaatatttttcttatacaatatggaaattgaaatgttaatagaaaattaaagtttaattaataatcttgattagtactatataatataaattaatctgcagactgcaccatcattcttgctacatgtcatgttcatatcaaaagcaaagcaaaaaagctgacaaaaaagtcaaatatattttttactaagaaaattcctcatttctttattgttttgttttcttataaaccgaggaatttccgccatctctctttctctctttcatcgtcctcaccggaacgcgcctactctctttccacatcgtacgtttcctctctctaaattcttcaactttaaaggtgataaaaattgaatctttcccacaacccacaagaaaattcgaatcctttctctctttctatctcttagtcacgctttcgatcagcaatctcctcgaattctggttggttccgtctctgttttctgtacacaaagccctgctgctgttgatacacgtgagccgccattaatgcccctttgttttcttcttccaggtacgttttcttcaaaagggcctttttttttttttttttttttttttggcgttttctttcttcttccgtttctgcttcttctgagaattcttcttcacattacctttgtcttctaggattttctatttcctctaaaatcaggatctttcagctgaatttcactttgattttatttaggttagtcttcattttcattttagatatttatgtttctttttctgagttttttgcattgtcatttgtcatgggaccgacattgctccgacaagcgtttcccaatctggggttgatttttatatgtttccaagtgttttaattcaaataaggtttccggcaaattttgaaacttttcatcttcaaattgctgcttttgggaaaaagtttcagcatttggttcttgtcaattcttatcaatgctatcttaactcttctttgtgcatttctgtttgagttctgtggctaaggttgtttttggagataatttaatctcgagaaatttctcagttttgtttttgggattttgtagaatattaagtcaaagtttgctcttttgcagctgatttaggaagttggtgatcaaattacatctagtgtttgtttccgccagctgaagtgaatcaaaatgtttagttttggccgagcaagaagccaagggaggcaaaacagatctatgtctcttggaggttagaaatctctagattcttgtaattgatttcactgaggaaatggtttatctaggatgattgtgttgaaattttcagtttgctctcttaaaacttgaaagttttgagtgttttttgagactttagtttggaatttaagattggttgatgaggtagttgaagtttttgtggtttggagcttcaaagagtgaagcttttgtggttttttttccatttgg

SEQ ID NO: 3636 - DNA, 412 bp, Arabidopsis thaliana
ttcctaattctcttccttcctcaatgatttctggatttcttcttcagtctcgaacacgaagattaccttgaagagcagatttgctctcgtttcgattttttcgggaatctttaatattacagctgctgttgggccgaatgtttgtttggcccaatttaaacccatgaaataagaaagcttaaagtgatggtggtgtactgaaataaacaatacggactcacacagatgataattcatcgtcacacacaggcgggaacaaaaataccctaaaatcgctaaatggcgccacaaaatctcagcttataatatcacttcccgctaacaattgcaatctcctcccagaaatttcaacagctctaaaaaccctaaccgtttcgattcacactctaacctttcgataatttcccagaag

SEQ ID NO: 3637 - DNA, 2000 bp, Arabidopsis thaliana
acgtttaataattttttgtgtgactaaattttttttattaaaaattttgaaagatatgattttatatgtcaactcgcttttaatattataaactctttgaattttaaaattaccgtgacaaatatttacaatttaaatacataattaaaaataacttttatacaactcttagattttacaacatttagcaaaagaagatttttttggttcatgactctctccttagctttagatatttaggataacaacgtcttttttacgtacatatgaaataaattgttgtacgggaaatagattcgatgattctcattttggtacccgcaaatttattattgtttttcgtttatcttcgctgcattagttagtatagctcttctaaaaataagatattatgtagatcgtatattcataagcttatctacattttcttttaacatttcatatttttctcacattcttttcaatatgtatatgaatttctgtcttcataattttttttacagagagctatcactctccctatctttttgcaagaacttattttatttgttttattttttcttacagtgtctctttccatcctcttatgattttgtctaaacaatatgtgccataccttctaaacttttcacatgctccatatttcttcttcgaaaatctctttcttttcttgttagtataaacatttttcaatctcgtcaagatgtactctgttttgttttctgttattctaaaaaaatattttagctactaaattggtacttaactctatcacttctctcttttgatgcagtttagatcttcttcaccttcacgctttcgagactgaaagacctcaatttatatcttcgagaacttgattcaaattgatacgattaaaaataccaccatcaaaccacgtccttgttaagtttctttaagttatattttaaaaaattggatttagttgtataaaatcctataaggtttgggtttaatattacataattataattatataacttctttttataagtttaaatttaatatttgttgctttctttttttgttttaaattttaaaacagaaagtaattactatttttaaaaatattaattaattagatgctaaatatgttaattattgacgtggcagcttccgattggttgtcttaaaaaatgataattaattagatgctaaatatgttaattattgatgttgcagctcccgattggtgttctaaatcctatgtggatggctttaaaaacaaatagtttcaacttttatatagtataaattgagcaaattttaataaaatatttatttttattctaaatatttaacggactcaatatttattttccctataaaaactgtcacatatcatcacttgtacacaaagttgagttgtagctcgatttgtttctccacaaaaacaaaatttcaactctatttaacacgcgaaacttcgaaatatcaaaacacaccgaatcacgaaatcagtatttttattcgttaaccatctaacccggtaacaaacaatctaaaccaacactaaactaaattaaagattgaaaacaaaaaaaaaaacaaattaaagaactcaaaaatttggaggtcggattaaattccatcgcattaaaccgacactactacactcactaaaacgatccatattttgtgtgaatgcaaaattaactctttttgttaatgatgtgttctatctttaatattagtcggccactttgaacaaaaataatatttcgcaattctattggctggaagcgaaaaaagtaaagaagacacgtccgtagcagatccctccactcccatgtgttcccttgatgaacaatgaaacatcgatgcttaccaaaaaaaaaaaaaaaatccccagtttccatcttttttgaaccttctcgatataaagctctctattcaattcccatctctatcttcttcctcttcatcttcctcttctctcagatcactggaagctctagctcgatttctcacaatccgcc

SEQ ID NO: 3638 - DNA, 2000 bp, Arabidopsis thaliana
aagttcatgaaccaaaattagcaaaggctgtccacaacactgactgtcattatgatgtgtgtccacatatccaacgttttatggtagagtttatatagtatagtatgtgaatgtattaaccttgtggatgtaattgtatggttaattttgttcatttaataagattaaccaaattaattggtcatggtttccaaaataatctcgaatcctttgtaaaaaaaaactaatctgcgaaatataagtgaagagaatcagagctagatccacgtttgagaggataacgtcctcttgacggagatatgattgttggagcggcaaaaagatagggtctagaacttcgagagaaagagagaaacgtaacttgcccaagtggttacaattttgatgcggttgttgaaattcgggagaggcttcacgatcatggaatcgaaatcgaaagagagaatgtcgatagcgttgttgtaattttcgaggttacttctgacggaaattctgtgaccggagactttcacatgttttggaatcggatccagcagacaaaggtggatttgagaatatatttgaaaaagatctcgagagagaaagaagaagagaagcaatagattgttgagagataaggaagatgatgataaaccttaagagattcaattttgaatattaagagtgtcctaaaagattggatttttattctggaaagagagatgaagaacaagagaggccaaaattgtttttgtattcctaaaaaaaaagataacgaagagatattactaagcaaaggaagatatagttagagggtagtgatgtcaattcacatcaaaaaagtgtctaatgattgtgaagtgcctaattacggctaaactttcagaaaagtgcctcaacacgtaatattctctttaattgaattgttcaattaatttgaattatacttggttaagcccgtattgttgtgagtgccaatttctgcatcaagagttggcataaaaaaagagaaggagaagatacaaagggcaagggtaagagtgcaaaagaaccttctttcttagtccaaaaatgtctattcttgtaaggcccaaaaatggttcctaaattaaaagattcagcccatttaaaccccaaatcaataataacctcctataatactatttttcctcttaccaaaaaataaaataatacaaattttttgttttattgagaatttctattttgtatttattcattcgatgcattgtttacattattattattattattatcatatatttaaatttgaaatttatgaatattcatttctatagatagtttacagttttatctatcttttactatttacattactttgatttttattagtataaattaaaattttaaaatgaacaatgtaaccattcttttttacacgttctcctttttacttgtcgttttcgacataatatttccgtttcttttgaatactttcctttttgtttgtcttttttaacataatattttcgtttctcttgaatacttctccttttacttgtttttttcgacataatatttccatttcaataccatacttcggtttttttccttcgaaaattccctttttacttgtcattttagacataatttttcagtttctatgtcatatttacgtccttttaattatcaaaatgtaggtaaaaattaagaatacactatattttcattttttaaaaaattcattgaaaatggaaataagtaaaaaagtaaattggggtttgcaacattacagagcaacaacacgtgtcgacctcgggatggacaattcgagagcatttaccgtggtcaaaaactcaacctaaccacggttcaagaaacaatggagatatcgacacgtgtctcaatctaaatacccgatgatattatctcacagatattcgcttcctctataaatatcttctcttcgtcctcaacagcttctccagaaaatctaggtcacacacttttaaaatcctcgttcccaaaatcgaacaacaaca

SEQ ID NO: 3639 - DNA, 456 bp, Arabidopsis thaliana
gctctttgagaagctcttgtccaaaaaaatagaaaaatgtaaagaaagtctcgtctgtgcagactcttcatgcttgtaaaaccggttcaaggttaaaccaactatatatttaccacgaaattgatgagaaattgtttgctcttgcttcgttgttagtgtgatttatgtgagtgaggtttgtaaaaagttgtgtgtatttcctctgtttttgtttctacattttaaatggttggccgacatataaattcagtttattgaaaagaagaagtaaaaaaagattctctagttagtgctacaatgagtcataaccttttattattccggaagaattattcttgaagggaaagaaaaaaacgcgctttaatctctatatataacaataacactttgggttttagactttagatacgaatcaaaaacatttgagataaaaatcagaaaagtaaagagacgaaa

SEQ ID NO: 3640 - DNA, 488 bp, Arabidopsis thaliana
ctataacaacttggccacaaagatcccatgatggaatattggaattttgtttttttggtcaaaagttgacttgacttaattgttgtagaggcatggggattgagaagtttctgaggttgcaaatttccttgaaatgtggatgttgtatttttatatggtaacattcattatccaacatattgcacatctcgaggataatttatttaaacaaatactacaagcttatttgataaatcgtctttctagtctctctattttgactatgggttttgaattttgatatttcagtgaagaatcctaaccatttagtactaatttacacgttatagtttcaaaataattgattaaaaaacaaaataggaaaaaaaaaattgattaatataaagtctacgataaatacagagaacggagcatatctagtcgctctttcaggtctacttgacttataattaatctgtctctctgtctacttttgaaatccttcaaaa

SEQ ID NO: 3641 - DNA, 2000 bp, Arabidopsis thaliana
tatatcatgtacctacttgcatttgttgtacattcaattctagaagatttgttgctgttaaattgaaagatagagttttgttgttttgagagttaattttaaacaaatacaatataaactaattctatttcattatgcaaaacaattcttctttcccttggttcgattatgcaattatatttcatacattctaatttttgggttttcttaagatatgcatgaatattattctacttatatatatatatatatactagataaggcccgcctaagatataaatttattcaaatatgtattgataatatttaaaatttgaatggtaaatagtgatccacacttttctaatgttaaatttagtaatttttgaattaaataaaatttcaatcatatacattcaattttactatacattttaactatttcttttatcataataaactgccttttaactctatacactccaacttattgatgatatttgaattttaaatagtaactcatatttttttcagtatttaatttagtatttctttaaaataaattttaatcttacaacttcgattttacaatacaatttaaatattattttttatcataatagaatacaatttaattcgattgtatacaattcaaatacaatccaaattttcaatacaaatacaatttaattctatacactccatcttattgttagttttcctttttaattaataaaattataagttaaatttttagatatagaaatataaattagtatatgtaaatatgtttatttattttttaaagaattttttttgacatatgtcaacatctcaatgatagacctgacacgtgtcatgatctcgtgagttagtaactttcaaaactgtactttatataataagatatatgcttatatgtttcatatatatatatatatatatttattagatcgacaataacattaaactatcattactagtttacttttttaaatatgattttaataagtatcatataaatgtacaaagtgtatacaatacatgtttttatatatatatatatatatatattttttttatatataagcataaatatatagacgaacaaacaatgtagacagacctaggcacctagctatgatctatgcatacggacgaaccctattatacgtacgcatgattattgaatataccttcaaatataaacttgtgagcgtaaggttattatgttttcaatactgacgaatgacgattgtgattcatgttttgaaaaattaataaagtttaaaccatcgaatgcgtaaaccaattattcatcttttaccttaggaaaaagctggatatcattatcatatatttattaagcatattaaaccagaccaatgatttaagtcgaaaatgacagctttcaagctttgcttattggccaataaataacaaactaaaaaaagaagaaattttttaaaacgaactggtgaagtctcgtgttatcacgtgcatggagccagtcagacagagacatcatcaggtgcatgatggaccacggtagtccatttcttccctacaaccatacacgtggcctttttacatttaacagtcaaacatctggtcaacaacactctcatctgggcttccttacatcaaaccctactttttttttgtttatcaaaggcccaattgtatataagtgaaaagtttccaatgggcctttcaaggattattcccagcccaatatttctggagattaggtttatttatcatcgccaccaaagaaatttgagccgaagcttcataatcgtagtctgaggtatttttctcgatcctcaaacatttccaacacctaaaggcttattcgttacagatttctcaccaatcttcggatttattgtgctcgtacgataagcatatattagtaaatttagtggctatttaggaaatttctcgtttgatttcttgttgttgttgagatttgaatctgttgtttatggtttttgtgattacttggttttgcagagaca

SEQ ID NO: 3642 - DNA, 675 bp, Arabidopsis thaliana
tctctatgttcatctctgtattttagctatgtttcattgtatttatctctgtattttctctaggtttatctcactatctatgttcaacatttgtttcactttccaattcacatcatgaaacgttaggaaagaaaaggaatgatcagagcatatgaaagaaaagcccctattgtttcatcagcttttggctggtttggtctatggagactcactcaaatgctaagtttcaaagatttcgagatgcttttgatattacttttgaaagtttctttgagaaaatcaacaggttggtattataagttttttgtaatgttgattatttcattaacgtcaactttatgatacaattttcaacttaatggtatttagttctctagataaccaaaaaatgatgcatctgtttcaaagaaaaacaaaaaaaattgtgatctcaagtctcaactggttctggttaagggccggttctgccttgtaattgtattgctttgatggtgaagaaggagcaattagcctaaccaaccggtttagagaggtctttggtcacaacagagaaacaaaaacggcacggtgttttactctctactgtagaaacagcaagctactgtagagacacttctcttcttgtccatattatcaccaccgttcagtgatccacaaaatcagacgaaaaagaag

SEQ ID NO: 3643 - DNA, 934 bp, Arabidopsis thaliana
gcttgagccatgtcttgtcttgtcttgtgtgttgtggagtatggtcatatggtcagtatctccataatctaaatccatagatatgtgagttgtggagtagacacaatttttcaataatggaatatctatttaccagttccgtattatgcatgcattctccatgacaacgcttctcataacgaatataattacgtggatcataatactatgaggattgatatcattgagatggagtagacacagttattttcttcttcccttgccattagcaatttcaattgtatctatgcttgaaatacttaaatggcatttacttcttaactaaaaagcgaaaggagggaaagaacaagtcattacaagatactataataattagaaattaaaagagtataattacatcttcccaaatgtgtcaaatattcagcaaaaactctgtcaatagaaatgaacaaacggtattttaaagtaatacaatgggtaaactttagatattttgtaaaaacctaattagaaaaaaaatttggaaatcttagttgaagataactacccaaattatgaaaaaaaaaacatttgccttcttgttacctaactaacacgttgaatgttttacaaaaattttgttcaccagtctaactgacttgtcgtttcagttgtcatcttttgaatgaaattaatggaaaagaaagaaacaaaaatgagtaagtttagatcaagattttgactattaaaagtcatatttgctcttgaccactgacttgtatattttgtcatgttatttattatggctaatatatccaccacacatacaaacatactcattaattgacccttatcttttatttttatggtaagaaaattgacacttatctaatactcactaggtgtgtatatataatgtagcatttctggtcattgaaagtaacttacaagcaaa

SEQ ID NO: 3644 - DNA, 1004 bp, Arabidopsis thaliana
aactccccatcttacaaagttaccgtccttttagcttaagctgcctacttctcatcctttttcagcttaagctactcctaatcatccttttaaacctacggctttaagtttttttttaactcatataatcttctgcagtagacttgacttaatcggattttctgtttcatgaacttgttggtagtgtggaacaaatgggaaaatgaatatttttggaacaaattgattttctgtttcatattaagttaaatcattctgtttccactgaaataaattgttttccaaaaatcactccgtttattatgtctttgtttttaagaaataaaagtgagaaaacagaataacgcgaaaatgtcgacatatttggctaagtatagacaagattgggaagctctgtttagttatgcgtcagtctctcatcagtgttcaactgccacggagcgaaccgattcctaattgcaacgtcccgagtccatagaatgtcgacactctttcactctttctccaagttgcctcctttgagtcctttctcatattttatagactcactttctgtttcttgatcccgaggaagaagaagaataaactcttgttcccatgatcttcgtcgatgttagtaccttgagattcgattcgtctctccgattctttataatcggaatttattggtttgtggaatctgattttgggttctcttctattgctcttataggttctttggaaattgtttcctctatactcgtttggatcaggaagagactctctctcaggtatttcatcgaacacttaccctacaatttagtgaaatttctgtgtgatgtagaattctctagattcttctaatcgagttttagctgagaaaattagtgaaatgaaatgagattttccattgattgctagattccaaaactttagcttgttgttctgaattgcacttatttgttgtgttgtatggaccatggaaacatccaaaagagtccattttgcagatcattcccgagaca

SEQ ID NO: 3645 - DNA, 688 bp, Arabidopsis thaliana
gtggtatttgatgaagaaaaaaggttacctatttgtacctattctccaccttttccctcttctcaattgactctttctctttatcttcagccaactctctttatctttagccaaaccacttgattctttcctttctctacatcttctccaatctcattctcttccaactctttttcttttcctttctatacatcttcttcaatctcatactcttccaactctttttctttctcattctatttttttctctccatcttctttagtatcagactcattttctctctctgcctttccatcttcatcgatatcagactcattctctttctctgcctctccatcttcttcgatcacatcctcctctaatttaggctcattttctttgtttcacctgcatcttcttcgaactcattctcttccaactcagtctcatctccttcctcttcatctccctctccaattcattctcttccaactcattatctttctctttctctctatgtttgttctcaccttctttacttatacattattttaatatcttcactattctctgaaactgcctcgaccacactataactaacattgcattataaagcttttcaaaaaatatttacttgttttcatgaatgataagctttgtccaaccatcaacaatcacagtatttttggttaagtttttttgataaaa

SEQ ID NO: 3646 - DNA, 1224 bp, Arabidopsis thaliana
ctttgacaaattacgtgttcccgctctgcataaatcatcaaattcctgatacagattttgtgttgccaaaatatggggtatgatccaagcacaacggttatctggttttgtacctcgagttttattatattctttagccgtggaatatttcgataagaaaaaaaaacatgttccaaataattcatgttgctacgtttgttggcgccttttgtcatgtcaaagtttcttaaacacttgttcgtggaatatgcaaacttttatggattcgtaatttcaagaatatgaatgaaaaattgatggtatctttgatcacctcgaatggtggtttcttaagagcatccacattggttaatttttgatggatgtttttaaatataaaactttattttaagaggtttttgagtagttaagaaactctaacgtgtcattgtgtgtgtggttgaacattgtgacaacatcatttatttatttttcttttcgcgtttttctctcttttttagtccatatgatttttaatatatatatcatatttgtttaaaattttaatatttgtattatttattaagttttataaaataaaatataaataatttttattttaataataatatatttttttaaaagacccacttaaacattagaccaaaaaaaattaatggtccaacaaaaacactttaattttttataatttaaaattttaaaaaacccttttaagggctcaaccattggggttgctcttactccaagtctttaatttaatttgtgaattaacattgactaattttaaaatcacttgaaattgtttcatcggatttgggatgtcacatttggtacccggcaagttcgaaaatgacttttaaactttgacacctcttgcctcttggtagagttttggatgaggcttgaaacttttgtattgcagcccataactgaaaatagtttattagtataatatatcttctcaacaaacattgcaaatattttgaaaatccagctaaaactatacccgatcagaattagaaaatttgagcccaagcccggcccgtaagtattattatagaaaccgatataaagtttcctttttcttaataatatttattccgtggcagcaaatgcaagccaatccaatgtcaaaacaccagctgacgtggccaaacgcacatcaactgtcgtctctctatctctctctccctcacttgtctctctctcttctcttcgacactg

SEQ ID NO: 3647 - DNA, 2000 bp, Arabidopsis thaliana
gaagttttgatcagttgaattagtaaagtgattaagtgatacttatgttgaataagttcaagtcaatgctaaaaatgagcaagttgaatatttttcaaaacaacaaaatggtccaatcttgttttgtaaagatttcttgtaaatttatttttacaatatatgttttaaatttcaacatatcaaattgtattttaaataggttaattaaaaccttaaagcaaaaaaaaaaaaaaaaattattgacaagaaaagttattcgattaaagttcttcattttgcatatacacttgtctaagcaaaatttgggaaaaagttgaaacctaggtgttgaggttttgcgtatacgacattgcaactggaacttggaagacaagacttggacccaacacagccttcacgtaaagataaaatgggcctttaaaagggaagttatagttaagccccatatgggcttttacaatcttgatgctctagctaagcattaccttttcttttctagtttataaatatcttcttcttcttcttttttggttattaaacatgatatatgtttctaaacacacataaatatttttcgtatgttttatgattttgggagccatttttatatcttccattgagttttacattctttttcttctcaaaaagcccatttttctaattgtcacagttgtcaaacataccccaatataaattataacatataagatcagtttacttacattcattagagcacccccattggtggagtcctaatgtggaatcctttaatttttttaagaataaattttgattattttgaagtttagagattttgttgagtctttactatttttattgtccaatggtggaatccttaagtgggtttctttaaagaaaaaaagttagttttaaaatgaaaaatcataagtatttcgatttgataaagcataataattattaaaaattcttaaatcataaacatatatgacataaaaacatataaaaagacaaataaaaaattggaataacgattaaatttaaatttgactcagataatatttttgctatctattcaattaaaagaaaccaaaagcaattagatttattttcaaatttatcttcagaagatataaaaaaaatgtgaaagattttatgttttgttttgtattcttctccagtcaatgaaaaactgccacatataagtttcttagaaaccaaagaatacctaagctaaggtgcataccttgcttaatttcacatttttgaattatttttaaacttttttcataaggatttgtgcttagaaactcttaaagattaccaatgaagatggtcttagtacttgttactaaacaacattttataaaatattagggaaaagaataagcaaactataatacatttcattttaaatagtaactgtcgtttatgtggaaaatttggtccacgaaactggtcgattatcgcatctttcagactttacgtatacatataagccggcgtgtgactaagatgaagtcatctattctcaatgacgtatgcaattacatgaacagagaagaaatccgctgcggagaagctcacagtaatactctgaccagtccacttacaagtcacaatataaatatcagccagagaacatcgtgcacaagctgctacaccgtgaagtaccagattacaaccacgaaaaggttcgtgcggctgacggaagcaatgacatcatcacatactctgtatgtcgatcatccaattagtccaagccacgtgtaaacctcagctggctgcgcggtcaacgttgaaaaagaaaaaggttggtttttatcacacgtgtccgaaagaaaactacacacgtgtggttcatgaacctccccttcgtttataaaagctccatggactttgctctcttctcctcgatttcaatctttgagataaaccacaaagatcctccgattcgaaggtttataaaaactcaaaatcgaatcttatccacaagaaaacaacaaggtacttttccaaaa

SEQ ID NO: 3648 - DNA, 2000 bp, Arabidopsis thaliana
tccttatataggctcttttgtgtgcgtgactgtgtgctatttcatattactaacttgaaatcatattacaacccaatcagggaggccctgattgaatatggcccggcactgacccattgcagttggtacgatctcagtataacttaaaaagcatcgatggtaatgaagagaggatcaagttgagaagtcacctgttacttaaatatgttgtcgtttgtaaactaaaataaaactaaattgtataagattaaaaagcccaagtgaaaaggagaaaatcaaactttacggtcgaataataatatatcaataatattttctcaaagctcttaaagtgatattggagattttgtgatatatcgttttaaaatctattcagatcggttgagagttggttactcgttcaggattaattaggtttgattcaaaaccaatcggttcgattgttttgcattgaacattctgaaaggttgaagaattgaaccaaagaagaaaagcaatatattaattttcatacaagaatctaacaaattttaaaaaattctctattgattggtgtatcatgtgtattaatatacgatatgttatattataaacgattttattagataaaaacaattaaaaaaaagttagtacaacaaaacctaatcaagttaaatgaagagaaaacgagggttttgtcttaaagctcaccagaaagatacgaatgagaaaaatgtggtacccacaacacacccccgcatgtggacacatttcaccgttttaacagtgacacccaaaccgtaaccatccttcttaattctgtcaaattaaattataagaaagaaaaaaagtagctttattttatattaatcgaaataaaataaaatgatagagacagagaggggaccttagagacatacttttcaagatcatttcatatatggcttatttttaaaagaagaagaacacaaaacagtagagagagaaagagatatagagatagagagagatagggctttgaggtttgtgtttgtattataatacataatatataggaatagtgtcttcttcttcatcatcatcttctatctcatcatcatcatcatgcatcatcttcttcttggttctttctttagctccgatttatagcttttaattttgactattttttttccttcttctacttggtttctttctcttgatctcaggtacaagaaaaatacaacttagaaatctttcctcttaattctttcaaaagtttaggaacaaaaaacaaaagtataaactcttaatttgtttttctttgtttatgtcttctagtgaaatggtttttataaaatttcttcatgtcgtcaatctctatggatttttcctgttcttataattcctcccttcgttttcttcttaacttttttgtcttacgaattatttgtagattattctcttccacgcaaagaagaagatctaaagatgtcgtcatcatcatataacacaagcgttattccttcatcatcatcctctgctcagcctttcttcatcaccagctccggcaccggagataacgactttaaccggaaagatacttttatgtcaatgattcaacaacctaactcctcagctccaccacccaagaaacgaagaaaccaacccggaaacccaagcaagtatctcttacatataaatctctatatatttatcacctttctataagaatcactatatataagctttaagataataccaagaagaaaaagaaccctaatcatttgttctattttgttttgtatatctagctagtatcaagatttcatatatattgacaggccagtatatcttatatgtttatacgtgtatatgtcatttgatttatgtttacatgtgtgtgtatcatttttttcgatatagtctacatagattgacattttgggtctaattggtgacttaatttaaatgattaaattctttaattatatgaaacagatcctgatgcggaagtggtagcattatctccaaagacacta

SEQ ID NO: 3649 - DNA, 1336 bp, Arabidopsis thaliana
gtgccagcgtaagcagaactcatgaggagttaaggttacttcgatgcttttgatctcaaacatatgacgacagtacagctgcagtttggggagaggaaacacaggttataatacatgttgcatattaggaaacttatatattgcattggataactgaaattttaacctccactctcttgttgtaaatggtaaatttgcaggtgcaacaaagagtgttgccatacctcgtcagctacataggttccgtaatgattcatttacaaggagatgtcattttgacaggtatttgtttgttgttgaagattctttccatcgttgagattccgcattgaaccagagttgtagattagattactgaagtcgaacatagtattcttaagaaagctgttgaatgtatagatagaagacctgtaatgattggttaggcggtattgcccttgttcagttcgatctatgtaggcgtctaaagccattgtgcgaaatagtgttgaactatcgttctggactatactgatacaaaagagttatactacaaaacagtgcaactggaacgagatatatgtaacatagaataatcattttataccagttgaggaaacattgtacttaattataactgggaatgtctaaaggtaacttatgaacttctatcgacggcacagtggtcagattaacttccaccgaacaagttttggattcggaaaaaacaatttgaactgtggacgacaagcacgagccaagtgatatttatttatttattttaccgactaaaaaaatctttgtagtaatttaaaattttcaatgcagaaaatattatgctaaattaaagtgaatatttgatactaactagttgacccgcaaatataatcttaactttatcatattgttgtgatactatttacatatcaaagtattaaatcccattttccctgtaatgagtatctatttatccctttatcataaaataataatccaaaatacgtgctctcttaatttatagaaaaataaaagttaataactatttagaaccttatggtaaaaaaaaatacaagtaaaagtatatctctaagcattttccctttgaaattttcaaactaattaaatagttaccaaaacaaaaagaagaagggcagaatagtcaaaagagaaaactcgcgcgtcaacgttggcgtcgtcttgccaaactttgccaataataataattagacttctgcactttctcacgaacctctctgtctcgtccattacttaaaaaccaaatctttcatcatcttccttcaccagttgactctctttcaatctatctctgaatctctcactctcctacccgaaaacc

SEQ ID NO: 3650 - DNA, 2000 bp, Arabidopsis thaliana
ggacaccactaacgtgccacttgtgtagagatattcaattgtatattatatagtatgcaatatgaattttgttttgttttttatataatttatattttttccgccaatattattttatttatatgaagtcttaacttattaaacgtttgcacaaaaaagaaaaaataaacttcttattacgtctcatacacagggttcggaccttattagtggcatttgcgcagagttactattatcgatcacttaaaaacatatataggaaaagtatatcggtaatggagctctagatgtagaaatttcgtaatgaaattatgaaatctcaattaagatgaacatggcatggcatacctagcctagttgtatcgatgttatgtttggatttatatgcttatggcagaaagtaacaaatacagaaatacaataatgctactacatggttataatatatggtctcttttgttaagacaacgaccaacacaactacaccacaagataatcatcgattagtacattattaaatcttaactattattgctaaaatctagggatagttgaaatataaaactatacgatgcactattacatacattctccattaatcatttggtaatgatgaagtgctccaattatatactacctttctttattttgttatgttccttaacatctctattactaaagattttcggagattatgaaatattgtgaggcatatatgatatattcatacaaattactctacacgtttttgaaaattgataggtttaaacatgattgtaccagggaagacatggtcaaacagaaagctattagctttgatgagggacctcttaacaaaaaatttgttggtagagccaaaatgattgaactgacaaattttcatagagtttggtgaattgaataactccatatgaccaattctgttttgtaagacaacgaaaattatgtttttcgaatatctttgtgttatcgtacagaggagcgagtcaccagaaagcacaaacacaacgattttgtatcaattacatcgatacgcaatacaaatatttggaatatgtcatacatatgtattgggcctttatctcatgtctcatcaaacctcgtatctatcataaacttacgattcacagacccacttactacttattctggcccattaaagttcttctttttttgtcggttctagcccattaaagttcagcaacccttattattcattttttagtctttctatttctaattattcaattttatccaaataatgaatgaataaagttaaacaccgacactgttatatatatatatatatataacaatacaccgccacgtgagaactacgaatgggaatttcgcattacatgtttcgttaacaatataaactggaggaaaaaaacacatcgaaaggaaaaaaattcaatgtaagaaaaagtgagggaaaggcaaatcaaagacgtgttctacactaaaaggaaaagtatgaggaaaaactaacaataaattaaacaaaatttggtattttattacgtaatagtagtattaattaattaaaagaattgacattgacctaacaaaaattcttaaaacaaaaagaaagaaaaatttgtttgaacaataatggaatgactttgtttgtttggagaacaagctaagctgacgtgtctaataactcaacacgtcagctaacagacatatataaacaagtgtatatagagttaacgttatccaatcatagacgaaaagaaaaaggttcctttttttgactttgtatccgtagatcatcttcttcttcttcttccagagttttatccttatccgttccatcaaattctctctctgtaagttttctgttgatttctctgttacatactctgttttgatttctctagatttagaattcatttttttcccgaaaagacgcggaatttcgatttgggtgttgaaaacaaaattagggttttgtgtctcaatttctttgattgtgtatattctcagaagcaaag

SEQ ID NO: 3651 - DNA, 2000 bp, Arabidopsis thaliana
gatgcatttggtgaaactagtgtttgtgagtgtttcctttctctactaaatagaaatctcacagtcacagaaaaaggtttagattcatataaatgaagttcatacttatatttataaaacttctcatgccatcgaatacccgataatggaagtatttagtgtacatggttgtccatcttgcagcttcttacggaagccacatgcaaacttgacgtgctaatcttctatcaaatgttgttggaatatacacgtaccaacgtgtagtggtataatttatgcaatgcttaattgatggatgtatcaattcttgtagtcgcttatcgttcactatctcttaaacccaccgtcctaattagttagttccaactgcaagtcacgtttgctatatccctagtaccttgacaaatctaacgaatgtagataatcaacctttgcttgtattgtttgtgggtctattcataaccaaatcaaaagtttttaattaataatcttactttatattctacctaaaagatttgtggagccgtttattcgttttatttttcggcagttgagatctatcttaatattgtctgaaaagaagaagtaccaactctagctcccatactcacacaagtcaatgttgcttgaattttttgtaaagcattaatttgtattaggtaaaaatatttaagatttacgaacgagttatgttcgcttatttatggatcattatcactcgatgttagtgagaaccagaccaatagttttctaaatccggtatattaaaagaacaaaaaaaattgatacacaaatatttccctttggccaaatatagggtagataatattttctagtttaagttagcgattgtttaatagtaaatcatgacttgtagtgttatatgatttggtagtggatatgcaactgctagtagttttagtgaaatgttatgtgttcgtaaaattcatgtagtttaacgaagccattgttaaaaaacactactagtagacgctattttaagcctgacactttggaattagaaatcaaacgtagaggcatgcatacttaggctcggaaagcatatatatggtatcgaacctatcggtgtgacggtgtccctatagtggctacccccaaagtctgtcgtctcccattattactctgtcgtctcccattattactctgccattgcaaattttggagtttgcaactccattttctcccgccttttattttgtcaactaattttctttctattgcttgacaaaaaaaaaaaaaaacgaattgcctttatcattaagtcaactaattttcttcttcccttagaaactgtatttagttactacaattgcaaaaaagggtatgattattaaacttttgaatgcatggaaataaacactataaacttagtttaactgagaaaacgcatatatacgttgggtcaaaccataatactattatctttggattagagcactacgcatactcagactccagatggtatgcagaatatttgcttatgtctactaattcaggcaaacattgtttttaatatgttttgtcggtattataacttgtgttattagagataaaccctttttggatgtgaaaatctcattaagccattgatatttttagtgaaaatctcgtaatgcataaacactaatatatactacaaccccatccttacggggcatggtgctcatgttcattgtcaataagtgttttaaactcgcaagattaggtattaatatttcatctaatcataggtttgcttaaaattagttacccattttctgataagttaattacgtaggcccaaaaagtcgagctaccctttgaaaaaatcatctcatctcaatggacacgccatcaaccattatcaccaattcagtccttatttccacctaaccatttacactctatatagtaagcaaaaggaaaaaaaaaaaactttcctatatataaacactcccactttctctcacaaacccacaacactgactcacatcatcacc

SEQ ID NO: 3652 - DNA, 2000 bp, Arabidopsis thaliana
ctttgcacttgtgtgttgcttcacttctttctccaaaggatattgcaccaaaatcaatcaccaaccaaaagtcccaaatgttagaccaattaatacaacatagatttgtgataatcgatcttatttgttatcaacagatgcaattaatggtaacataatctttctataagctatcaacgttactaacaatgaaaaacaaagtctggatttttcaacgcaaaatatcagcaaaaactgggaatatgcaatctttgctgacttattcatatcaatcgatctagaaattgaaaaccttaatatgaattgaagagatgaaggaatctaatttagctcgttctcaaaatcgaattgaagcagatctaacaaacgtggtgctaaacaaaagaaagtctcagaatcaaattcaaaatcgtaactcggattactgagattttgccttttgttaaaaaaaaaaatcaaaaaatttgttggagatgagaatcgatctcgaactgatgaggatgataatctctctcaaaaccactgggactaagataatatgatcataactattagaaaacaaattgtatataaatagtaaacattatatggttaagttttaactgcggttagcgattccgttaccattgttaacgcccgttaactcgcatgtctgattttgccaaaatttaaaaaaatgaaggtttttaatgaacataaaaattaacttaggtattaaacggccaaattaaataacgcaggtatgaacaaattaaaaataaatggagttttttttggtttttttcctctgttaatagtataatctccctcgacctaatccatctcccgtcagaaagttgttccaaactcttcagtgttatcatcttttccttttaagattatttttgtcaagtctacttcttataacaagagtaagtgctttccctcctgttttaggtttttgtaatttggttcgctaatttatttgatttctcatttgtgtttgtttcgtttccctgaatttttcttcctttgatttttcagattacagactttgagactcttagtttttactaagacacagtgtgatcaaagaaataggcccatctttgttttatagaattctttgtaatcaggttgtgttgaaccttgttatgtaggctatagtttttgctttgaaagccatgtatgactctgaactattactcaattttttaaagtaatgtgggattttttctacttattttttttcttcatcgattgagtagtatatgtgtgtttttaaaattttgaattacctcatatgcagaaaaaactaatatatttttaactatatgtattatatatatcaaataaaaataaattagatataagaacaaataaaaatgaaagaaaaatcatatatttattattaatgtagatatatagattttaggaaattagcaattaattgaatgtaatttaataaatataaaaattaattaaagatttaaatttaaaataaaatatttttagataaattttgtagggactaaaaaagaaataaagaaaatagttaattcaagtatttaatgcaaattaacgatttgtaaatttttaagaatataacattttggttgagatagaatttataaaaactcatatgttattagtaaatattagagagatttttgatcaaaaagtgcatcaaaaatatatatataaatacttttattttaatttcaaaagaaaaacattacctaatacgtatcttattcctaggacatttatgattgatctatctttacgtattttttacgaaaagaatggtttaagattgaagaagagttaaatatttttatttattctttcaaaaatattaaataatcaataaaaatcatatttagaagatattttatggacatgtgattttggcaatttccccataggaaaaagcgaaactctctataattgattgttactggctttgatactttgaagactgaacacaaacaaaaaaatctcttatcacaccacctcca

SEQ ID NO: 3653 - DNA, 2000 bp, Arabidopsis thaliana
gatgggaagtatatacatttgttggtgaaaaaagtatgaaaaagttcgcatatacatcaatttggtcccgcaaaattagattatctagaacttagtgataattatcgtggacgtattcatgttttagaagcaggcttttgagtttctcacttaattcatagttctgtttttctttattgagctgaaatttttatagttgattcttctattattggtactacaaaagtataaataactacaaagagtcgatggggagaaaagggccaaatttagtggtacatacattaatataaaattaaataatgttaggtaaagtgacatatctcactttatcccaatcactttcgggtcccaaatttttttaaatatttgttattcaatttttcattcttcaagcccaagcctcttctctatatatttttttaaaattttaatctcagggtcctggaccaccacttttatgggcattaaacgtttgatacaaattgtgtggggaaattaaaaatgaaagattcatgaatccacatatattatttctagactgtacatgtattttattttatatgcacactgcttaaaatcttgattataatttacgaggagtagttttaacgaagaaagaaaaaaacacatggagtaagtaaaagaaataaatcttggtgacagaaaaacaaaagtactcgtgtagttttatcagtcgtagtcatgtaacaccgccacataaccaaattttatcgaaaccgtatatttttactcttctttgatttgtgttaagagattttattaaacgttgaagaaaaatcttccgtttgaccccagtttatgataatgtctaaagtaaaagagttgaatatttttaaaataaagaggagacttgaatgaattattatatcaataatatcaactattttattttcttccctaaaaaaactgtaatattattctttgccactgtttggtgttgtccatctaatgaggcaaaaaaggacgagagggaagtggagcccgaaagctgggacctttgatgtgctggctccgacctcgccatcgttggtcttttatgggtcttgtctggtaagaatcactcttagtcttaagactatagagagagataaagagagaagataaaaaaaacaactccaactttctttcttttttttacataaaaacgtcgaaggaggatgtctcgttcggcgacttgacctctctctctctctctcttttaccttcattgttcactgtttccagacattgaaagaaagatcattagtttctgaggggataaccatttttttttcttcttaaaaagtttttttttttgtcaattggtcttcttcttcctcatccgctcgcttatatttaatttaataataataaaaatcggtgttcatttttatataaaagtataaattttgtgtttggttgatccatccgtagtcgtagtagatctacaagctctgaaattccacgcccacatctcctccgtcctcttgagatccttctcttcattcattttcttgctcaacttgagttgcttccaacatcttgcaaggtaaagtttccttttttttggtagcgaatacgaaccagttggaatctgccgcataaatccttttgtttttttttcttgcttgccgcatcactaattttgctttcttccgatggtttccttacttaaagatgttaacttttcaatgttgcatcaagtttcttagattgttcaatcactagactaatcagtctcactataatctcctacagattcatttctattgccactcataacaattgagttttctcacttttttgctctttagattgtctttgagttcattcaggtcttgaagaagagcactcttttaagctgtgtgaaacttgcgccgttcctgtgaagaactacttttggcattgcagatttcagagagctgtgatttgtgctatcttaaaaacggacaagttctatgttgtggcggatgagatgagggatgctatctgggttg

SEQ ID NO: 3654 - DNA, 2000 bp, Arabidopsis thaliana
taacgctttggttgtgtatagtgtgcacacctgttacgtatatctgtcatgttgaaatggtaaaccacccaaagtttagataactaaaagagtgattttctaattggaatccgaaacaaatattatttaatcaaaacattacgagacggcaaaaaatacaaaaaaaataacatagtggttttggagttccggacacgtgggaggaactaagataccggtgacacgtgtatgtgtaacgtttcggccatacaaaacgttcattagattctttaaacatcatctttcatatacacttggtcatataaatcgctttcatcggagagtcaaccaatataagttgatgatacatctttagccgatttttttttttctttttttaatgttaaaacatgatcacaattaggtttggataggataataacaacagcaactgaatttggtaatgataccgatgttaatatttatgtacgttaaacgataaatttgaataagaaaaaaaaaaagcacaaaaatcatacaatttgattaaacagacagtttatataatgtgtactgttggtaatcctaccgctagacaatgtacttttaatgtgattactaattacaaaagtggtaagaattagtattgcgctacttctatgtcaaactaatcataccaaatagatcttatcgataaaacatagatatattatatatatatgtggattgtggtgatcatagatgcatagacttttgccccaatcatatgttagttaatcatgcctgacgtagttttatacaataattcttttgtatatcagctggggccacgtaagaaccccattcttacctcaccttgatgctatgcttttactatactatcagataatcacataaattagattagaggtgtgattggtgtttattactagagcaatcagtactattcagtagaaattaagaaaagaaaaaagtttttttttttaaagatagagaggaggagaaaagaaaaggtaaatttagagaaattttgtttcttcgtgtaatggcaaaaactacagtgaacgcaacaaaatttgcaaagaaagatgaggctatgaggctatgactatccccattgaaacagagcaaaaccccaagaacatcactgagtattttcaatgactatcgataaagtttcacattgttgttttcatacattattatatgcaacagaaacagttttcagtttgatttttcacttttgtccttttgtctgcctctctgagagataagtagacagagaaagatgtttagttttttggattatttactttgcaaggattattacggagaaggaaacacgtaacgaaatgaaaatgcatagacatgcaaattgcttagtgcttactccaccgttcattgctttattttttgttgttggaaatttggaatggaccattcctatattaatgggcctgatctgtttagagaataatgggtttcattaggcccataattttattcgaattcatcaatcttcttgatctctctattcattcttctgtattcaataatttttaagtttttctccggtcttctctgtctctctgtccattttcgtggcgaagaaggtgaatttcttctctttgtttctcctagatttctcaaaaagattgtaccttttggattctagatcttatttgatccaatgttggatcgaaattatccttctttgttctagaatttggttactgggctgaacagatcttgtttgactcatggaacaaattgtggatttttgatttgatctgattgaaatttactgactttactatgaaacaaaggggatcgtatcttatgcctgacccgatcaccgttttagattcatgtgtttgtttaaacaatgttgttgaagttgtcattttttggattctgtggtttggtttctcacgttgtttatgcaaattcatagataaaaattatatgaagatttgtgttgtttttgacaaacagattttttaaggtcttttcaagaaatt

SEQ ID NO: 3655 - DNA, 2000 bp, Arabidopsis thaliana
acccaattatacagatcaaatcgtgcctttccatcattgagaattttcagcagctccatgttatctccttcgaagcagactcttgtatatccatgactccagcagttctgcattgcaaatataagggcttgaaattcgttctcgattgcactgttgttggttcgtcctctagcttgtcctgcactaacaaaaaggcctgcttcatctcttgttacccaacccgctttacctgtctttcttttcttatataataataccggccttattttgttgttttgaataagaaaatgtatatgttttaaagaaaaaatcaaattacgaacacttcaaaacataatctagatcattaatttattacacgtgaaaagaaaacaaaaataataatttcatttaaatatttatcaaattaaaatatatttattatataataaaaatataaaaatatttattatataaatatatatttaatataaattatattattatataaaatatacttattatacaattaaaacataaacaaatttattatatatttctgatgaattcttctacactcatgatatatactctctccaccttttcttttgcagtgaaagctcacaaaaatatacaaaactacattctcatcaaaaaatcaccaacttaaaaaataccaaaaattgtatttaattctatagttaaaatcaatttgagttttattgagtttttatataattttagtcttttaggtgaatttggggaattgttatttgttgttaaatcctacttcaaatcatgaaatttgaatctttgtattttgaagtatgtaaattatctaaatccaagtcttctttagtccaatcccaagcattctgcatcatcagctgtcttttctcctagggtgcgtgtgaagtcattcctgagattgaaggtctcctggatctgcctctcatcatagccgcaagagttcgacaagtacgtttctgcccctagattgtcaaacataaccaattagataacactagatagagatgaaacagaaggcaatgccaatgctctgtgtcgtatggcttctgcaacaaggtatatagagtagctggacagtggacgtagaaatactatgggccagaattattatgggctcaaattagaagtatttctattgggccagcattatttattctctaccctaaaccctactatttcaacacttgaccaaaatggcctttaagacacgctgggcctacgccaataattatccacgtcggtctaaaactcaatgacttgacgaaaatgcctttgaggattctatgaaattaccgaaattacccttttgtttcttagccgcgtaagtttcgtctgatattatttttcttcttctccgagaaacaaaccctttaatttactgttgtttctcacaattctcaaaaatctctcatccgaattgcgccttttccgcttccttttgctctgtcaaatctctcaaccggaaaaatctcgggaaggttcgtctgatccaattctgaagattttgaaaaacccaccgagaacttcgaggtgaatttgatcatcttcttcaaaaacctgtttttttgtttgtttgttcttgtgtgtctctattgttaattttgacgaggagatttatatatcctatgatcaggtcgtgtttcacttctctaattaagttgctttcttttgattccaccgtattgtatctctggatcgaaattagggttttagtgtgtgttgtgaactttaaacgcataaagtttctgcctttcgcgtatttgaaagtttgatgcagccatattctgtagtgtctccaagcaattttctagggttttacataaatatgatgtaacttcttatttgttgattttactaattagatgatacttttcagtgaagttattgtcttttgggattacttgaatcaacccaatagctcttgcaccattttaacccagtaataatcgtttgtttttgctttcttgcagatttaattgaatttttcactg

SEQ ID NO: 3656 - DNA, 1141 bp, Arabidopsis thaliana
aaaatattgaaccgaattttttatcctaccatgtcagccactggaaacgtcgtcgtttccgtagattcgtcttcggacagaaaaacaaatcattcagccgtcaaaaaagaaaataaaataagaaaatatatatacatttgatgtatgaatacaaatgaaacaatgtatttaggtttggaagattattccaactacaagaaaattttgtcactttacttttatcttcaatgttcgtctcctttgtttcttcttcatcttcatgtgcatataaaacgacagaagcttgatttgcacgtaaattaaaatactagtatcaaaactttttttttcattttattatcaaaattatctcttaagctattgagcactaatttattttttattattgagttctcgagatttgcctagaaatagtcgatgagtctggctcacgtcagtaatattcggatgagtccttatctataaagtttggctgccatttgatggtattgggatgattaatttaattaggcaaataaaatatagatggtgaaaactaaataaaaactattcacttgctgtataataatgttaatactcatatcatgtaaatcactgaagtgcaaattcaaaaaaaaaaaaaaaaaaaaatggtctgcttgccatttaaagatgtttaaagatggagtaagtatatatacacaagtcgtaaaatcaaacacaaataatatattgacaaactcatatatcataatgtatacataccaatttaaatccacaagaaaatatcatatgaatgagaaaaccaaccacatttacaattttactcatatttattttattgttttatatttttcttttctttttgatgagaatgtcttaacacaattatctagtatataaagattttttccaaaaaatagaagaacctgttgattttctaaaagtagaagaaaataagtgcagtccataaaataaaatcctataaaaatgttaaaactagattcttttttaaaaaactaaaatttgctgcagacatctaaaattttcgaaaatgattgggtggctaagatttcttatccactagaaaatccagtgagtcccgttaactctcttctcttctctagtcttgtcttctattatgcaaaaggtcttcttggcc

SEQ ID NO: 3657 - DNA, 2000 bp, Arabidopsis thaliana
gactgtgtccttccacgttaaggaggcaaatccgtgctaccattcgcaatttttttgagtagcatgtgagaaaataatttagaaacaagcagtaaatctgaaaatatgatattactcttgatataacaaaatatgatattaattactcttgggtaaaggaaaacaaatatgatagttagtactctctgtgtttggacaaaaatatttttgcctgcttgcatcggattaccgtaatacgactgtttgtcttcactccgaacaaccggagatgagtacaatacgactacattaaatataagattgtaatatgaattgagagtcaaattaacaagggggaattcagttatttctttgtatgtttaaggaataggtgatgggttagcctggtgtaagactatatatgtttgaatataggaattatttggacttttcttaacagtaatgcattgtgtgggggtaaataatgattgggtaatacaagggtattgctacttattacagtacaagagttctgaatatcaatagtttggactttacaacgttcaatttctggaatggatcaatgagattcgatgatacatatttctatcatgctcataatttaaaatgttgttgaaaaggtatgcagatcgtgttgtgtggattaaaatagcgttggatatcgtttaaaacaagtgctgccgcgatataactatcttgtccaaaaaacgataatagctaggtgtccaaaaaaacgtttcatactttcatctcttttcttttcttgcaagagtgccataaaatgaaagtatgaaacaaattaccacctttgcttgtatacgttgttgttatcagttacaattaaattcaatttttaagtttagtcaatttcacggacgcggttaagatgttaggcggtagccgaccatcaaaatagagttaaacattggattattctctatatatagctacataacaaattcattatccgaaaattttcaggcaataaagaacatattggagcaaacaataatttatcgtaagagtttttttaaaattcgttggaacttggaagggattttaaatattattttgttttccttcatttttataggttaataattgtcaaagatacaactcgatggaccaaaataaaataataaaattcgtcgaatttggtaaagcaaaacggtcgaggatagctaatatttatgcgaaacccgttgtcaaagcagatgttcagcgtcacgcacatgccgcaaaaagaatatacatcaacctcttttgaacttcacgccgttttttaggcccacaataatgctacgtcgtcttctgggttcaccctcgttttttttttaaacttctaaccgataaaataaatggtccactatttcttttcttctctgtgtattgtcgtcagagatggtttaaaagttgaaccgaactataacgattctcttaaaatctgaaaaccaaactgaccgattttcttaactgaaaaaaaaaaaaaaaaaaactgaatttaggccaacttgttgtaatatcacaaagaaaattctacaatttaattcatttaaaaataaagaaaaatttaggtaacaatttaactaagtggtctatctaaatcttgcaaattctttgactttgaccaaacacaacttaagttgacagccgtctcctctctgttgtttccgtgttattaccgaaatatcagaggaaagtccactaaaccccaaatattaaaaatagaaacattactttctttacaaaaggaatctaaattgatccctttcattcgtttcactcgtttcatatagttgtatgtatatatgcgtatgcatcaaaaagtctctttatatcctcagagtcacccaatcttatctctctctccttcgtcctcaagaaaagtaattctctgtttgtgtagttttctttaccggtgaattttctcttcgttttgtgcttcaaacgtcacccaaatcaccaagatcgatcaaaatcgaaacttaacgtttcagaag

SEQ ID NO: 3658 - DNA, 1939 bp, Arabidopsis thaliana
gagctccgacgacggcgaacctcactgagtttgtgtgtgattcgaaaacgtaacgtttcatgtttagcatagtttaattagatatagtgcccatttaatcaggcccattaatattattcggcccattggtttccttttacataacatatgggcaaaccgtatgcaagagcttttataacattaatgtttcctgtaagaagcatctctctcattacaacacatatatcgtgattctgaaatgtttctttattgattatgttatgcagttagctgatcgcgttggtgggtctccttaccaagaatcagtctcagcgtttaaattttcatcttctccttggaccctaacctttttcataactctaacaactctcttaattaatatctcactttggttaaaatgttttgtagctatgaagagcttttgattcccttgggatttgaggtaatctctattgtggataacgaacttgctcctgatacacgcaaagtaaacaagaaacagtctctagtttctttgtgaacaagaaagattttaaaagaaaaagtttaatatttgaaatcaatatttagggaatggaaaaagttggcagatggaagaagaagaattcattgtaatgatcctcaataccatcacaatcacactataccatggctctctatatacatcaataaagattacagttttggatctcctatagtaagaaccgagtgtactatttacacgtctagatgaataaatgggtccaatgtttcagttttttaataattatatgtgtagttgcatataccttataaacaaacatttatgggtgactttgttgtgaaattacaagtccctttctctttatggtatatgccaaattttcatccataatataccttactgaatttggcatataccttaaggagaaagaggtgtgtaagacaacgcagtcacacttcaaatatatttttgtcgttatccgttttataaaccaatgtcggcagtttcacttttaattttaaatcgagagagattggaagttatgccatactctgttttggagataagaatgttcaccactagcaaatggaaatagtgttgtaattgaccgctaaatgctcactttggtatcaaacttagtgatgttttagccaaaaacatcttgtgaacattttagcaaatcaaattagtgtgtaaaaatcgtggatagatattgtgacagaaaaatatagatattggatatattccttacaccattccccaatatattttcatactaaaaatggagttctctaatgataagagcaggtggaggttttcaccaaccctttactttatttcggaagatcatcttttccataaacttccgattccgacaaactcatacactgatcggtgttaagaaaccgttaatttttgctgacatggatgcgaagtagataaaaagaaaaaaaaacgatgtttctttgttcaaatcacagaattagaaacaaaatcaaaagtctaaatagtcgtcgttaacgttagtataaatggcatagacagaaattccttcagaattcaaaggctgctatcagtaggtgaacagttgacaaaaagttgaaagaaaatataataggcccaagaaagcccactggtcatatttctttgaatttgtttagcttaccctaatgcgttgtccaacttatcctgtcgttaaatttgtgatagacgttgccgttttatattaaagaatgactttcttttttggtgcaaaatattaaagaatatgactatgcaaatatctctctatacaaaagtatgtatatagttgggtgaaagagcacaataataatcaatacaaaattaattttattcagtcattgtttaatatgtttttgttaaattcattaattaatctgttaatctctctataaatagatatcttgtgcttgaagcttcccacaactactcaaa

SEQ ID NO: 3659 - DNA, 2000 bp, Arabidopsis thaliana
aaaaaattaaaaatatggccacatagcgacaatttcgtgataaaacaaatatattaatataatatacatatatatatatatattaaactagtataaaagtaaattttatagtacctatcacataaattgtcaaagataaaattagttattgataatacaatgactatgttatctttatttaaaaaattaaattaatttaaatatttctaaacaattctaaatcaacatcatagtatgataagtttacatttttctgagcgtaatattgaattatttttcaacatttttgtgatttgagttggaacaatatctactccatttgttccaccaaatttgatattgtgagattttcacacaaattaagaaaaacaacttttatattttaaaattattgttttgttagtttaataatattaactatatatctctcttctttttattggtcagcaataaaaaaattaatgatgtgatatagaacatcaatctttgtgaaacaagaaaaaaaataatttttaacactaaatttatgcactagtggaacatttgaaaatgtgtgttatttttagaaacaaaacttatttttgtattatttgtgagaatttttcaaatataaattacttctatataactttttgaaaataatttaatctttaaaagaaaaatattaatctcttaacactaaatttatgctattagtagaacatttgcaaatgtgtgttatttttagaaacaaaacttatttttgttgtgagaaactaagaattcctcaaatataaattactcatatatataagttttgaaatttataagctaatattttttgtaataattggtttattttgattccaaattcagttttcaaattcaagttcaaaattgtttgtaatctttgaaaataaacatgagaaaaatactataaaacttttctaaataaaataataattttatcatttgttcacatggaagtggatgtaaaatgaagttatactagattttaacccgcggtataccgcggtgacaatttatctttttaaagttagtataacttttttttgcaaattatatctgtctataatatatttttattttatactttacaattattattaagaacgtcttgccaaacccgtcccgccaaacccgtcccgtaaaaaaaacatttatttatattaatgttgatcttatttctgatatgtttataaattattgtctaaatatttttgtcgatgcgggacgttgaacccacacattttttgccagttggttaatatatgtttattttaaaaaatttgaatcataaaatatgacagaaaaaattaagatttttttaaactctatatattatataatgatgttaaacaattgtgatatatcaaactttttataagtttaaatattaataatgttttataaattttatatatataaataataatattttaaaaataatatttttgcttataaggtaatgacataataactctaaaagcaaggatttagaagatttaaatctttaattaaatattttcattgataaataattaatgtcagtaacatgacattgtaaataagttcaaatacaaaatttatttatttaaacaaaaaacgtttagtaagaataatatttatttaacaaaaaactttgttttaaaatattgttagcaaatatatttatgctaattttaagggattaatttgaagtttgttgggattaaatttgattgataatgtgattgacaatttaaatcaaaaatttaaagtaaaattaattattttggaaaaaagatttaatgctaatggcattagattgtaaataagtgtcaagtagaggatttatttgctaaaatggctgcaaaaatgtatatataaattaaaaatatgaaataatttaatatgactaaaataaaataatgccacttctaaaggactaacgaaagaatagtcttcttgtaataatattcttttaaaaaaatagaaacgttggtcacgaggcctcatca

SEQ ID NO: 3660 - DNA, 343 bp, Arabidopsis thaliana
gttccatacattgcatcatgttatgttttcttaatgttatacttgatcctctttgttcacttaaatcaaatgctgaggaaccttttgtatctagtctagtctctgttctttgtgttctagataaaggacattttggtaaatatgcagaggcttctcttgaagcatcttcaatattctctggccacacatttgacatgcaatttcggactaagtaagtcactatgctttagtcctctacaccaaaacatgatcaagaggtatctcatccgaatattccacgtgtcaagcaagcggtggctaggattgattacacagtccacgtcagctctctagaaacggctca

SEQ ID NO: 3661 - DNA, 2000 bp, Arabidopsis thaliana
tgatagtttgagcttctgaagggcctcagaaggaacttgggcaacttggtgtttttgctgagctgcaagcgctcttccctggtctgcgcatttatgtagatttgattggacctgacgttccacaacatatgtgagtcctgcattccacaatctatttgattactttgtataacactagttctattttagttaggaagagtaaagatatgtttttccttttaatcactcttctttagagttctttaagctattcagtgacaacattatagctggattttctttgtatgtgttgaactattgacataatttgatggatcgttctctatttgctttctcgatgaacagggatggagaaatgatctccctttgcagatattccccttgcatgggaaaagaatgtgaatgtaaaaattcaagcaaaattctcaattccgggagcaaacctgctttggtttcggctgtgtcattacagctccgtagagggttttaccatgatcgttacaatgacataacaaaggtacccctttctactagtctaggggcaaaacaatgatttactatactgttcttatatgtaatgtccattttcgtggaccttgaattgtttgtttcctaaaagatgtaataatttctgattgaccatctcggcaggattcatttcctccacacatagtgattgctccaaacgcaggcatcgctgcatatccaagctggttgccaactattgtacgtttttccagtagctaatgtcacatccaatagttcccaggatacacagagagagcatatgtttgttattcattcatgtgttggtgtgaataatttcaggaactgataaaggagatacaagtcccagcagtattctctgattactgtgaagaagcttgtcatctggctgcttgttgcattaaaaccatcacaggacaacctctatcatcacctgtaagtctaaattataggttcattgtcctatttaactatttcaagtctatgtttattgatatgtgggttcctcctgcatatagtcaggcttatgtctcatcaaaactgtatacgtagaatagagagtcgacacatatactatataatgaagttgaaggagacaaaaacatctcttttttcttcatctttggggccacacaaaacagacacactattgtccacttctccaatcaacctttgttggaaaatgatgttttgcagataaattcttatatatttcttcagaatcatattgatatgaatgtaacgatgtatctttgaaatgcagattgagttgaatccatttagacagccaatggcagtagaggagagtactctgtttatcccttgctactcaaactgtttcatcttcgcaatgtaaaaattctccaacattattgatcaactcaatggttcactgttatggtctggatcgacgatagagatactgttccggtgtatggaccaacattatctatacaatgaatgtagaaaatgtcacatcattttgttattggttgttgtagttatttatgtggataggaccatcaagtgcatacatacaatcattgtagtcttaggtgaatattatgctatatatcatatagcattagtcatttcaagtgaaactttgcaattatctttgtcagatgtcatgagcaattgaacaatgaaccaaactgaaccagatggtaaaatccggttcttggagatattcattcacaaaccaagtttgtgtctacgtggaagatgaaaccaaagcaaagaatcttcaaacttcttgtttctaagaaaagtctaaaaccagtttggtcgatttcttccacatccaaaactaactcaatattttatctcccccaaagtccaattttccaaaaaatccaaaacacacagagagaaaaaaaactgaaacatcccaaatggatcatcatcttcaaccataacaacacgaaacccttcttctccaaaatccccaaaaccttgaaacaaagtctcaaaatttcacttcgtggatccga

SEQ ID NO: 3662 - DNA, 872 bp, Arabidopsis thaliana
taagagacaaaatcagtactagatactgtgccaactattgtcaaacccaaaagtgtttggacggtttcctattatatctctatgcttttactaagacaacctagcaaatattctgaaagtgtaactgcacgactgatagttgcatcaatagtgtgacaagaagccataaatgtttgatcagaggtgtaccatacgggtacctgcatagttggagtaaacaattgaaagatgaatttagccaagcaggaataacaaacagtttaaaattttgtaatcgatccagggagtgtatttactcaaagaacagatcaaggactcttctaatagctcctgagctagctagttcttttcctattgcttcacttcgagttttcagtaagacatgaatgaactccacaatctaagacaagccatcagcaacacaaacgaaatcagaaatatattacacaacagaaaacacacacaagacacaagagtatatgttttgagttagaactccgtacttgttacatgtttgagtgttatgttttatgttgaatttaactaaaatgcagacgttagtatggaatgggcttcacaaataaaagcccaatagtatgtttttttggtagggagcccaatagtatgttggttcacccaaatatcatttctttctctgagagctgtttattatattcacacaaagaagaccaacaagaaacagagttgaatcagttctacaatgatctctgtctctcgattcttgtcgcctcaattctacgcaattccaaggttttatccgacaaaacccaatcttttaagtctctcctttgttcatttctgtaatcgtggcgaccaaactcaatctcaattgtttcaggagcttcgtaaaa

SEQ ID NO: 3663 - DNA, 1928 bp, Arabidopsis thaliana
gcaaaagtctcgaccttttgtccaatttcataaggcctactttctgtaaggtcttctctctctctctctctctgacctgattctgcctgggttctgtggagttgaaatgaatcaaatgtagctcttgttttaatcagtcagctttgtaacgtatacatatatatcattgtatgtgattaacattgtccttaaaaagtgttacacctagtaattacgttccaactttatcagtaaacctattggtaactagtaatttgctcccgatattggttttctcattaatttttatagccattctttgttcatttaaaccatattacaaatttgtcctggttagaactgattatgatgacaaatcgatgattagttcaaaatgaagtttatagcaatatattctaataactatacatcaattatcaccactgatgtgtttgaatgaaaaatgaattgataatcttaataaatgtttgattttatagataagtataaagtatgaatggatttagaaaattttagtatttagtgagataagcataagcaaaactagaaaaatgaaattattattaaataaattcattaatacacattggcaatgtgacattgcctaaaatcaaatatgtactaattcaattaatgttaataagaattttttggattcgattctcttgcgaaagtgcaaattaaaagacattcttatctcctacgtaaacagaatcacgcgtccattgcgcgttctcgcaacgctaaaatatttacgttggaaaatattctcataattctctcctttgcccccacagtttaatatatttcataaacacccccacgagaaattaaaaaccgttccaaatttgaaaaaatacaacaaacaattcatgaaaatattcaatctataagcaaaacattggtagtgttacatgtgtcgtccttcgtgctgaaaatttggatagcattgttaattatgacaacgtaagtgtagcctgtgattcatagtaaaatataaggactaaaaataaaaatatatcttttttggaaatcgtaccgcgtaagaaacatgtataaatacctataaggtcttatttttttctcttccaatttcgtttcgacatatttcgcgattcgtctaaggtaaaaaaaaactcatctttttttcttttagatcgttaatttttgatcagcgattcgctcttctgatctgtgttctttaagcttgtcttctctcttgattcgatctgctgaaaacctagaaatttttgatttttttgtttgttttgctccatgtgtatgggtatatttacgattttaacaaaacaaaaatatgaattgaggttttttatttagcgaattgggttttaattgttcacattcgtttggctctctcgaggtgagtgataaagtatagaactttcttatgcttaggatcttaaattcgagttctttgatttacctgtcatgtgttattgattgatctcatttatattgtgtctgcttgatgtttaaagcttggtgtatgcaatttgattgggtttactggagattgatctgtgacctaatcaatgagtgataacattgctggttcatctgatttctcatctggtgtgtctgctcgattccctgaagaaagtttgaaactcaggcttggtttgtgcagtttgattgatttatctcattacttgactctggtgtacttgattctttgatgaaagcttgaagttaatgtttggtttgtgcaatatgattgggattaactgcatttgatctctgaccaaaatcagtgattaattacattgcttggttatctcattacttgagtttggtgttcctgcatgatcccctgagcttgaagttcatgcttggtttgtccaattgtgacctaaattgatgttttcttgtggtatcttttcgtaggttttgttactgattgagaaaac

SEQ ID NO: 3664 - DNA, 2000 bp, Arabidopsis thaliana
acaggagagaaagagagcgacgaagcagaatctggaaatgactcaattgagggaaaataaaatatttataacaatttaaaatggctgagagtgacgtggttccatagatatttagacatattattgaaaatgaaaaacgtcgtgaccagaaaaaataataagcagcatcagaattgtataataataattcactggagacattacacacaactaatataattgttgaaggcgcttcatattatgtatcattgaaggctaatttatcaaataccgaactataaaactttgaaattcttcatattaaagtatggagtgaaatttattcgaaactcatattaaaaaaaaaaaatacaagaagaagactttaaagggacaggtggggtaagactttgggaacttccgagccttgcgcaagtgtacgacgtttactagttttaataatcgcttacacgcatcctttaggcgcgtgtttcacacttcaaggaggctcctttgttattattgtttccaaggaagtccaacaacaattaatgtatgtttagttgttgttactggtattgtttaaccatggagtattatcaaaaccaaaccctgttctcacataacataaaatcactccatcaatttccatgatgtcagatgttttacatttcttacacatataaaatttttttgatgacatagttgtatacttgtatcttttcgttttttccatttgaaatagcactcactaatagaagtaaataacgaaatgtcatgagacttttggcatggaaattgcaaaacattgttttttaaacctgatattcttcctatttacaagttaaaagtgtgaggaaaaaatggcgaatttacatgttaaaatcaaattaagcttttgattgacaagctaaaaagcctaaaagtaattttgatttttgaaaatgttgagtgcggagtcgtcacagagcttttttccaaagtctttgcaaaaacgtcattcatcacaagaaataaagaacctaaaaaagggagaaaacgacgtcgtatatgttctattaataatttaaagtgttgtccttgccaataaagaaaagacacaagtggtggtggtctgtgtagatattacgtaacgcgcaatctcacgcgctcgtggaccccacgatccaatgactttctttaacgtccaagtgcggatgggacccatgttttatggaaccgtttcgaagattttctttgcagtggtttttgctattacgtttatgccctttgttcttagcttcaacaacaatattgccattttccaaagaattttattccagttttatactaattgatagttataataataccgtctaggttaatgatgttattaattctagtagtattgattagacaacaaatcttagtgttatttattttagtgttttttaagatcataaaaaaaggtgtagcttataatagcatatattatacatagttgatgtgggtcaatgacaatgtaatttaactgaaactttcttatgaaaatcaagtttgtttctagtcattgtctttttttttggccggttttaaattttaggtatttttcgtatatctatttttcttagattaaaatttgattcaatcgttttggttcagttttgcattgctgtttaagtcactagatattttttttctacatagtgtttctatagaaaagagccttacactattatacacaagtgaaataagtaatttgattcataagaaaatgcttaattatatactagtggctcaattattcctcttcataatgtaatggttaggtagttaaaattattaaagaaattcgattaaggaaaaaagcggtattgcaaaaacaagaagccaatagattctctctcttaaccagaatcaaacctgtccttctctattcctataaaaaccaaactccatcttctcacaaatctcctccacaccaaacctctctctctatctctgtccaaataagaacaaaaaaagacaagattcagaaaaaa

SEQ ID NO: 3665 - DNA, 2000 bp, Arabidopsis thaliana
gaaactgagcatgcataaaatctttgaaagtaataatgaagaaatagattgctttcaatgaattgataaggcaacaatatgaatggtcggtcgatctaatgtaatggtctcacttcacagttcacacaactatctgtatatcccttagacgtttgtcttgtctcccacccacttttttttttttttttttaaatcataatcttcttctcaagatttccctactcatggatctcttgttttgttttcatcccttaaataatttccaaaaatggtgaccactatcaatgtgtaatttccccactaatgtactgaataattgatagagaaaaaatcgctaaactatagtacaagtatgaaaagcaaaacatttttaatacgatcaaactgttataatttgtactatatctcaatagtaaatattaaattctaatagaaatgagtgagtttaaaatattcatatcatatgctactcccgataataaagtagtaaattccaagtgaaacataaaaaataaaatctagttgaatcgaagaatcaaattcagagggatcagaactggaaagctgctgattcaacaagtctcggtccatttgaaaagacccaaaggcatcaaagtccattacttattctgtgtttgttaaaacgcactaaaagcccattaataaagtatgttctttttcctaatgtaattatgcaaaaaaatggttcatacataatacattcgtaaccatgacgacactgaataaaaatgttctttttgtatccaattcagtttttgacactaaaaagaactacaatagtattctctttgacgaatcaaagactgcaaaagtcgtgaacaaatatttaacaaaaattttattataaattagaccaagtgatgatgataggaaagatgattgtggattgtaggacaatccgacggtgcagagatggcgagtgcacggagaatcaatggatgcacgcgtagaagaacattggcgcgtagggtcaagggcttgatgacgcgcgtggggggtttgctttaaacgcgtgaagaaggtttaattcccacaaaatggctcggctcaaggctcaagccgacggtatattacactgtcactctcactcccatctcttccgtttaactgttctttcttttcttttagggaataagaaaatctttataaatgataaaatatgttatcgaaagaaagaacaatgtgcactgagatatttaccaacaaaacaaaacaatataaatacactaaaaactctaagaaaagttacttattattagctatgtgttttgtgtattaatgtataatcaaaatattataatgctagaaagtttggtatagtgaccactgtgaaggtaacaaatagtaatataatttgtgttcaaaatcaaaactggatacccaaaatttatgtgtgtcatcataagttacaaatcaaaatggtaaacccacaaaagaaaacacactaagtttaattagagaggtctaaatgatgtgggaatcatagagaaggcaggtaaaaagaaatgaagaaaaagcttcctgcttttatgctctctctctctctctttcattgaacatgtataattataacaaaggcggccgcattaaaagtaaaaaacagaacatttttttaagtagacttcgttattacagtactctcctactcacttgccattgttattacataaccagagagctcttcttcactcttttcctctctctccctccctccctcttccattaaatctttgtggttctcttttattgttttgatactgtgctctgcttcggagagtgtagaaagagacagagctaaagtctctgtgtttcttctcagcaggactaaaaggaaaaaagggtaagagcttggagacaatttttcttccttcataagattctctctttttaaaccataaaaaatcaaaagattgtaacttttcaattatttgtttgctttatataattatctttgtgtaccgtacagaaatcgattgcta

SEQ ID NO: 3666 - DNA, 2000 bp, Arabidopsis thaliana
tgataatgatttcatgtcaaaataatatatatatataagatcaaatctatatcttagttaatattaaaaattattaacaattaacaaaacataattcataataataaaacatttgttaataccatatatattaaaaatttgaccaataacatatatatatattttttttgttaattttccttttggttaagaaaaataaaatgtaatattttttagatatagaaatatgaattagtatatgttaataatgatttctttttttagttttctatttctttaagaaaaaaaaagttaattattttcttacacatggcaacatctgatcgatagacttgacacgtggcataatcttatgagttagtaactttgaaaaccatactttatataataagatttttttttgttaatttttcttttggttaagaaaaataaaatgtaatattttttagatatagaaatatgaattagtatatgttaataatgatttattttttagttttctatttctttaagaagaaaaaagttaattaatttattttttagtatttctatttctttaagaagaaaatggttaattattttcttacacatggcaacatctgatcgatagacttgacacgtggcataatcttatgagttaataactttgaaaaccatattttatataataagatgttgatttattcttactttttttgctatatctttccttatatttcatacttaatattttttttttgtttctaagatacatacattaactctcatatttattgtcttaactaaattttacttttatttgtacacgtggcttccccccacaatatttttgacccaaatccaaaaaaaaaaaaacactatcaataatatttcctcttaccatttatgtcttacacacaagtgtcaaaatatagtagaagacatagaaaatgtttagattatgattaaatatcacaaaacttttgtgacataaatcatgatccatatgcatccaagttctaataataggtcgattcgatcttgtaaaaaaaaaaagtaattaatagtaaaagattttgtattgaattttgagatatttttctctcactataaaaagatgaattgtgtagctagagatcataacaaactctgaggagattcaagctaaggtacatttacaaaaacttattttaaattacaatgggttgttgcattttcgaaactgatcctacagaccaataagtactattcagttaatttgaaaacacttacaaaaaaaactaagatataatttagcaactttaacattttttattatgtttgtagggacattaatgggaaactggtgtagttgtgtaacaaaagatgaaaatagtgataattctagtagctctcaaacttctacggataaagaaagtagtgtgcaagtttcttctgtgagcactacgtcttcttcagagatttcatctgaatgttcttcttcaaaatgatcatctcaaagctcccaatgatggaagcgtaactagtgagcaaatgtcgcatggatcatcttcttcatcttatcaataaaaaaatcttcaaaataaataattttctatgtcaatttttatattaaaagaaactttgttaaaaattatgactattaattaataactatattattacataatcttttaaatataagttttagttttaatttttaatagttgctttatgtcatgctgatgtgttgctacaacaaaattcttagcaaaatttatgcatttttttcttaaaaaaagagagttctataagtataatccaagatatattcttgtacttaatacgaataattaaagttatgattaatccataaagttctatttcgatgacacggtgtcgtatttgaagcgacgtggcaaatccttattggtctatatgacgcagaacgggaattgctctgaagaatcctttctcaggcgaacggagtttggagtcaaaatccagagcgcggggaaacgaaacgagccaacaaatccgcc

SEQ ID NO: 3667 - DNA, 420 bp, Arabidopsis thaliana
ctctttcactttcctagaggcttctcgaggaattgcttgacttgtcacacaaccttagagcgtaagccagaaaaataattcagaacaatacaaataaaccccagctattgtgagaagatataataattctttatgggccagtcggtgaatatagttgggcccaaatcatcggatgtggatcttgttttgatttcaacgctttcgtttttttttgtttctgttttccttgattgaggaagcaatctatgcaaaaaggtccaaaacactttagcattgaggaagaagaagaagaaagcttcatatttccaggtaataagtcctttgactttcgtcattcacaattgctcatctctatagtttctatgaatgaattgtttgcttacttatacaccatcaagcaggggatacagttgaagcggc

SEQ ID NO: 3668 - DNA, 889 bp, Arabidopsis thaliana
ctaacccttgcgtgatttacctcgtgctctctctctctctccaagacaatcggcgtgtaaacggagttagacgcagtctcttcgccgtagctttcgccggaggtttcgtttatttttggctctgcgcagttgtgtgactgcgggaggaggtttccagtttgcaaaactttttcgattatttacttccgaatttatgctttttattttgtcttctatttacgctctcgaaattaaatcgaatttttttttttggccttttgacttaaattaaaaacaaataagctttgtatttgaatccttaattattttatttgaagtttagttctctaaataaaaactgatgacaaaaaaaattcataaaattaggttcgttcgtcgtaaaaatatttctgacattataagagaaacacctgaaaattcgaggatgtttggttgtcacgatggattgcaattttgcaaagtaattaagtatgactttgaaaagtccaatgttgaagaggttaattttgtaaaaattaaacttatggggtcacattcgaaatatcagcaaatacagtgtgtggtggtaagagaaaaccaacttgggtttaaatagagaaaataaaataaatggggttaagttcgaaataaacgtaaacgcgagtattaagcgaatctggtactgcgcgtatctggaaacaactggactgagtctttccctaaaaaccctaaacatagatttttagtttagtttggtttcatttctcatttcggcaaccaaaccaaacattcagagagacacaacacaaccacatcatcacacgtttctctctctctctttcctctccgtcgtctctctctctctagccaccaccaaaatccttaaaacctagacttttctcttccatcg

SEQ ID NO: 3669 - DNA, 2000 bp, Arabidopsis thaliana
tgattgtatgttgttagaatggtttatcagagtgcattcgcacaactatccaatctctcgagatcttctctattcgttttgatattttgaactttttgaaaacctctcaatctattgataagacaacttttttatgaaaaaatcaagtttgagaactaggttttgtgtttattgatctagtttacttagtcatattcactaagtcgtcaatatggtatgctttcaacaataacatagtaatttgaatgcctcgtacattttaggcgattttctattacaatgttttggtagagaatacgtatttgtatatttatgatgtatacgtgcatatacattaattgttttgtcggtttattatgatcaaacaatagtttgtctgtcagaagattcaagaaatatctttgaatctgagagtttccaaaaaacgttatgatgaaaatttggcatatacgtatttctgacaagctgataatattgtcatcttgcatttcaagcagtttcgacaaaattttatccaactgttatattcaaactaattgaaaatcgaaaaaccaccattaaaaattagttaaaaataacatatcattttgaaaatgcaatatttaaaaatttaacatatcaatttaacatgcttgttttcttaataagttttgatatattataaaatgaaccgcgtgattacaatttttctttttgtgatggaactgtcgttagttaaacacttaaacttaaactttcatgtaagttttgtttattcatatttgactcaattgaaacccaataatcaagaatgtcaaatattatatgttttgtcggatttgtaacgtgattctcgctcatttaataatgtgataatatcataaaatttaatctatgtagttgtttaatatgatattaaactttattaatgtaataagatcgataatactaagttactaacccaaatcatacacttacgagttacgacactaccgcactatcttggttatattaaatactccttttgtttctaatagtttgatgtttatatcaacattattatttactttcatttgttaccgatagaaagaggagaaaattgttgacaaaaacaaagaaaaaagtaaaattaatattattaaattaataaaaataacaaactgtaaaagctatttttaaaaatttttcttgtaaaacatctaaaaattattcttgtagaaacagaggaatatcattgaagataatagtgtgaaattatatatatatatagaaatatataaagtaggatttttttctgtatacaaatatacgtttccaattttatcaaaaactgtaaagatttttttctttgtcagtacctgctaaacttgttaatttttttattaaaaaaaaatcaaattacaattcttctataatcattttaaattccatttctttataccacaaaagattatattgcctttatcgtctttggtatgtatgcgtgaatatatttatttattttcttttctttcattttctttttaaagaactttataaatgaaataaggaacaaacaatatacacatgtactaacgtatataaataatatcatcaatatctatccaaaacttggatttcatggttgacgtggcccaaccaaaatctcaagttctctgcggatgacgaaccatctcaccatctctttttttctctctcttttttttttttaatatcatcagcacggttacataaaattcgtgatccatgaagttggctttcttgtcgttttacttcatcaccccatttttttaaagtctccatctttatacttcttcaactctccaccaccaccattgtcaccaccacatttaaacacacactttcacttgtagtgggattcgaaagtgcgttttattcatttgttttactgtttttgataacctcaaaatttgcctaaattttattctctataaatccttatatgttttacttacattcctaaagttttcaactttcttgagcttcaaaaagtacctcca

SEQ ID NO: 3670 - DNA, 2000 bp, Arabidopsis thaliana
taccttttatttcaatttttgttatttctaaggacgagataatatagcacaacgcaagcataattactaaacacgacttaaaacttgataagaaatttagagattatcattacttacctaagattcttgaagttaattggatcgaacaagtacacagtatgacttacttagcatttgttgacaacaaaaagagaaaataactttgcgtttgtattaatgggacaaaaaaatagattacttgtcaccgagtaagaatgctttttctcgattgtaatgcatatagccggcatacggattttcagtggggtcgagtgtaggcatgccggagggacccatttggaaatttagaaagattgcaaccgtatcatctgtgggtctcttctttaaattcgagtttgaatggtcccaaatatatatattggtcaaattttatgattgcaaatttgcatttacttggttttcttgacggttgtccctagaattgagaaataatgagttgatatttaatattttggaaaataattacacacgtatcggagttgtgatttagatataatatccaaaagtttcgcaagttttatggatcaaataacaacttttgtattcgatcatgtagtaagtttttttttgtttgttaatagtttccaactatatgtttattcaacaagactaccaattgtaagctaaccacattggtcatcatcgaactacttgtctcaaatttttaatgaaacgttatagatgttagttggtatttagaaatagttgattttgtaaaaccataaattatttattttcatacgtagcattgaaaacgttaccaatacgatatccaatatttagtatgtataattttcaaaatttcaaaccatatgactgatccatgatcgaatcctctttatatttttttcatgggtccgagtagatttttaatatctcatgttggagaatcctgagattattttaaacaagaaccatttacgacaaaaaacagaaccatttagtgggggtagattttaggtaagattttataataccatcaaccaaaagaattatgacggataaacaaactgctatcacttaattgaatcctcttgttaattatatatatagacagattaggagaattatgttattaccaaagctgtgctatatttgtctttgcatgtgttgttcattggacggttcacgatcgccgatcggtaatcatggtgaatcaaacggtgatgattgaagcacaggtttggcctcggtcggagattttgtctcttgctattatttggacccattgcttcttctttgtttttgctttattaataatctattcggaccacacacacaaaaaaaaagtcaagtccacacaacatactttaaccaaaaacacagatgcttcgatttaaaaagaatcgataagagagtgttgtcacggaccattcttctgcatagtccgagacatgtcgcgttgttttcccaagactttacgtagattgataagtttatggttcagtaaagtgtatgtattaagtgataaactaaagttttatgttttgatgtatgagtcgaaataatgttacaatttcttcatcagattcagctatgtaactttgcccaaaaataaaataaaaaaattcagctatgtataacacagattttataccagtatcttaaatatttattttccgatgaaatatatgtgtagttaattttcttaaaggtaatctaaatatctattactttttttgtcaacaccgtaattacatgaacgaaccaaattttcatctatccgaatgcatagcaaaccggattctggtttggttatgtaatccaattttaattagatcaaaccggattctggttatgtaaaccaataatttttcgattccgtcgaaattgttttacctgaaaggggatttggaaaaaccctctcactctcaggctcaagcgccggcgttcactctctaaccaaactcgatttcgtttctgggttgtgagattgagaa

SEQ ID NO: 3671 - DNA, 1827 bp, Arabidopsis thaliana
ttaataacagattaatttctagggttttcaatcttattgattctgcaaatcgcatttggtgagatgagatctaatcgcaacgataaggtcatattttgtgggagaaaaaaggcatagaagttgtatatagatataacaaatgggtatgatgagagacataaacttttggcgggactgactttgccaaggttgagagttgtgatgaagagagtttaatctacgtgcagcccttctaggagaagtggctgtatctaattaagatgtggtcggtcaaaaaagccctagttttattatgtaacttcattgatgtgctattattggatgtgtattaattctttggtgtgcagataaatgtgatgattgctgtactttaattttggggaaaaagtttgtatggaattagaacaaggatcgacttgttttcgatatagatactctgattgattgtgtatattgaatatcgatacttacataacggttattcggttaaagtacagttacactaattaaattaaactgtaagttaacaagaatattctggctcaagctaaattattttttttattattattgtttactaatcttttgttacaaatgttgaaaatgatatttattatacatgtagtacttcaactaaaataaataacgtgttttcatatttgatgtacgtgtataatatatcattttcaacagtgagtaatattaacccttttatcaaaataaagtaaaacaaaatgatataacctatcaacaaaatgcaaagaaaattgatccgaaccgaatatagccgtaacggtacaccaaaattgttttgagattttagtgtccgttgaccttttcatataaagccaaattattcggtctggtttccaaaagaacgaaaaggtatatgattacggtttactcccttgcttctgtgttttggtttagtttggtttaccttctcaaagttctcgaacgtcaacatttattttatcttattttgtaaggttctgcacatgttatacttattaattagtctactttttcaggcattgggattatttgttttagtctaaatcggttttggttgcataatattggatgaaaacattgtaaaggacaatttcaaacctgacttttctagatttggaaacgttccggctgcttgaaaagctcacataaatattagtatgatttcttaaaccaaaaataaatgatgattatcaacaataccgtaaataaggcaaaggaaataaatgatgattatcaacaattgccgaaaataaccacaccggtacaccgaaattgtttttgagattcataaaaccggaataatacgcctaaaggttattttctccaataccggtttagtttggtttgccttctcaaagtactcgaaggtcaaaattggaatttagtaataaacctgctccagctatatacaaatgtcatttgctcacctttcgccgattgattttgtacatcacacgcagacgcagcttttagtatttttttcaacaatcgcttttttttttctcgatctccgtgaagctctcgaatctctggtatgtttcttcgcttcttcatagtgtttctcatttccttttggtcttccataattttcggagaatctagtcctgtttttctcttcttctggaatctgaattcgccggtgaattccgctgatcgaatctctgagttttgttgaattatttgattcggcgataaaactttttttgtttgtttctgattttggtgagtgttgattgcttgagttttttcacggatcgatttgttttgagaattgggtggatactgtctgtcacaggttttgagttttggaga

SEQ ID NO: 3672 - DNA, 2000 bp, Arabidopsis thaliana
tctctataataatgtgtgtgactttttgaaaggatgttttgtaccattttattaacgaatctaaaattaaaatattcacattttgttaattaatatgtggttgacttaattctagaaaaaatgaaatttagtactatactctatttcgcagaccgatttttattatttttcaaagcgctgacgaaaacatacggaccgattctaatctcttatttatgtactcgcacattaattagcttcttgatatttcgatggcggaagatagcaaattgttaatgatacagttggatttatttttatttaaattttctcaacgagagaatcattaaatatacaatcaattctatgtgttatgaaaaactgatattcattgatatatcatcagctaaaaaaacaatgctatatatcaaaaactaacaaaatttgaagttaactaattcatgttaaaaattacataaataagatgaaaagatctattcacataaatttcatgaactagtttactcaaaagttttgagtcaaaacacaagatctattattaatttctattttcacattcgtttagcaactacaaaaaagtttgaaagaaaccaaaaaagtgtgagggaatattccaaatatgatatgtatgtgtactaattcgaattaagaacattaaaagaggaaaatatcagcattaaaaatctgtgatcatataatttgaaactcaaaaaataaaataaaacatcagttaaaaaaatactgtaataaacaagggtattatcgtcatttcgcaaacacgtaaggtgctgaaaattgatcttttcaaaaattgaaagttcagttggtggcaaaaacccaaagacattcaaaattgtcggataattttaaatttacaaaaaaaaaaaaaaaaactgttaattcctctcagacagagaaaaaaaaaagaaattaaaaatctgttttctctctttttcttttcttttcttcctttgttttttttttcttgtgaagcagagaaaaagttgtatcttcttcattctgtacttttttgcgattttttctccacaatcttctcagtaaaattgaaatcgctcaagcagtctcagttgctacttgagagatttatactcttttctttttgtattttcacttccaccgcattttcttaccccttttttctctcatttccggagtttatagaatcagaagtttcttctgtgggggtggatttggtgtgtctgagatctatctccagaaaaagttgaatcctttctgagaatctgaagtttttctactgaaggtgctgctgattggctttgctctaattttggaaggtatttaaagccagggtcttgaagtttataatgggtttaagttttaactcttaaatcgaacaaatttcaaatatttctgcttttgttttgtttctcttttaatgaattctgatcaaattgagaaatttcgtaccgtcttctgtttggtttgtgtgtagtgtgacataggaattagtctttgtatctctcaagatttgagctaaatttgtttgctttttgtgaatctctgattaatttttgattgttgaaactttcagcaagaaagctcttaaatgtcaaccaggcaagcaagccttagatattttggtttcttctttgtttactttcatgtgactctctttacttatctcaatctctagatatttgtattgtttactccaccaagttaaacgtttcatctgcaaagtctctagcttggtctaacattgcttatttccttgtccaattttgattggggaacttcaaaacagtgactgaagattcagaaaaagtatttcagtctatgtcctaaagtattggtccccgccattatgttcatgaaattagatagggcttttgagtggggttcttcttcaaaagcttgatggaaaccaactatagattgtcatgtatgactagattgttttattttttcttcaacatttcccatttgagcttataagtttcgttctttcttgcagcaaa

SEQ ID NO: 3673 - DNA, 1030 bp, Arabidopsis thaliana
tcatcacaagcatcaacaacttgtgttgtctgtaaacagtgaggcaatgggtccatatattgagtattctttggatctataagtgtaaaaaaagatttaagatttaaatcagaacccatctgagatgttggattgtagtgtaagatttagagacaaatggtgtgacaaaaattgtgccttcttcttctcccaatgtgagttcacatttcagtgtcataattcgtaagatttgcgagactaataattagttttgatttttctattcaatttacagacagttaatggttatggattttcagacattctttgttcttcggttcactcttcgcagctatattttattggaggcggtaacataacttattgggctagcctgggaaaataattatacattgggcccattattttaaataaccttcatcggcccagtttgtgtgtaaacagttatgatcagatccagaccgtccaaaaatagggaggggtgactctcgaacacgatgctctgaagactgaaaaaggcgtaaacttttttcacctggctagggttcttggtcgtcgttaactggtacgtttcaatggtctctctgtactatcatttctgcgaaatgggtcttctctttggaggctaatcgacgttgtgcttaatctaattgctcttttaggttgtttagaggaatatatcacaggttttcaattagattgatctgcttagttttgtaatcagtgtaggttaccagtgaatcatgaacttccgttagggttataagctctctgtttcttttcctgacttatcaatgtcactaatttagatttgatgcgtagtttagcttttgaagatcagggaactgaatatatctggtttaaggaagctttgaattttctgcttgccatggacattcgacttatcagtatttttgtacattttggttaatgtttatcgaattggtttgatcagtctgtggattttaactttacaagttaagatgctattcttttaggtctagttgataggtcatggatttgttgttat

SEQ ID NO: 3674 - DNA, 2000 bp, Arabidopsis thaliana
aattaaatggaaactcttttggtttgacaaaaaaaaaaaaaaaaatggaaactctttttgtatggatttccattgaaatgttttcccactcctttttccaacaagccgatccagtccacacattctaatcatctgaaccatacttttgacaatacaatatatatatacatagataaaggaagatgtggttctttaattccacaattaaatacataaacattaaaaagtgatatatgggccttacgcggagaaggcggtacgacggtgcttttgacccagtaatttctggatcacgttcacatgccgataattattgttaagttgtttgcatattttattatgtgccttgtttgtgggattttcgctaatttcttttctcgttttttcgttctcctcttccctcaattattttctcaacttcctattcgaccaaagcattaattctacacacgacagtaaaggacccactcaaacaataattagttttcaactctttcagaatatattttagtgacactaaaatagcatatcataaacacaacagaggccaacgactctgaatgatccgtaccgcagtggaaataacagtccggttatgtcggtaggctatataagccactactttcatttcaatttctcaactttgttgtacttagttcgtatcctatcagtttatcatcactttaatttgttaccatatagtatctgtaaaaactaattaatatttatgaatcatgctcatattttcaaatcttagagctactcaacagaacacacacacatacagtcaaaattttatactacataatttttgttttaagtttacagttataaaccaaacaaatcacctcacaaaagtatatagttataccaaaccaagcacctcataaatgaaaacaaaattaaaaataataatatatataataagaaatattcatcaatactaacgttcaattttagtaaattggcaaaaataaaatattagtatcacttccagagattacattattatttggtgaatttggcaaaaataaaatatttcgttggtggatgctttgctgggacgactttgtttattaccgtcatattgtagtaacctaattttattacctaacattcatttgaacattaaaaacattaatgtcatttgattggaagagtttattaatgaccattatttccttatttccaaacctaataaacccattatttccttatattaaattatggcttgattggtgcaatttctttctagctctttctgtttccgtcttgattcgaataaaaacgacaaatgttatctctacccgtatccgattatgtttaatatattatgcattgatatttcacgctacgatctggaccgacgtttagtgtggaccctgtcacgagttttatctatgacggaccaaaagaaaaactaattaaagcagaatatcaaagttagtcgggtaagttccaactaataaccgagccctgtttggctttgagcattagtagtaatcaaagtaaacatatgatagaaaagttattataatctattatatacagattaatatgtacgattccagattctatttatgtttctcgtatgtaaaacatataatgtgaacctacttaaactatactaagactattagtttggtttcaaattagattaattagtttaaccaaactgaacatatccctagattgtaaaagtctaatatatccactaattatttttgcttgccgacctctaatccacaactttttgtttttccatttccactgattttcaacattccaccgggtgttaccaacagtaacatacatacagtgaattttttcaacactccaccgcatgttaccaatagtagcaaaaccctcgacaaaaatttgtaccgactataaatattcaactccaactctttcctctccacacactcaaatatctctccaacactaaaataattgtaccgactctctctctctctctctccgtaacaaaaaaatcacca

SEQ ID NO: 3675 - DNA, 2000 bp, Arabidopsis thaliana
agttgaaaccaagatttgtcgacaattatttaatgtggtacgatgattataaatgtcatgtacgaacgacttgactaggtattaaaccacacccaatgaacggtacatgattcatgtgttaacctcccccactggcaaacttacatatgattcatgttaacatcccccactgacaaacttacatatgattcatgttactttttttttacgccctcgatttgatttctcaaacctaacaataagaaccatttgtatccacacatatgacctaatttgtatttattacctacctataaaaaagtacttatcaaaagttaaaattaacattaatgtatcaagcatactatatttgaatttacatatgtatataatataactttgcactgtggttctacttttaagttttaactatatttgacattagataaggatctatgatacatattaaattataatattagaaatacaggaatcttttttatcaaattcattatttatctatatatatatagaagtattgtaaaattatttgaagttatacagtactgattctgcttagtctgtcagagttacaataaatcccatagttaaccatgtagacccacttcataagggaagtaaatagtaaaggcatgcatatgttaaaattcaaataaaatatcttctttttttgtcaaagaaagttcaaataaaatttcttctagaacaattctcaggaatctgatctgtattcttaaactattctaatagaatataccgtcgcatctgattttttatagaatgtgccgagtcatttttattttattttttaacacaaatgagcagagtctcatgtgtgactcttctcttcatatttactctttttaacaattgttcagtcaatttcttattgttctacactaaaaactatcattaacatgacaaaccaaaaagaatccatcattatcaagatatataggttttgatatcttcttttgttaagtaccttagttggtcttcttccccaatctagtttctggttattgtttgtttttttttgtatactttttatgttcaagttatataagaaaaccctttcacaaaaaaaaaaagtatattcagggaaccagaaatgtttatcagttaatttttttgtaaaacaatgacatgttttatccttacttaaaagaaagtaatattaaacaaaatatagtggtttcgttcgtcaagcataacaaatgaaacgacatgatcgtgtgacccaataagcccagcagccggatttgacttatctccttcttcttccttttcggtcaaatgtttgactttctgctaaaaataacaaaaatgaattttaaaattgagaaaaaagagtttcaccttcaccaatcaccatttctctctactcgccaagaagtttcctttcctttgattgcacaactaatctcaaactaaaagatcttctctttaggcatacccagatctttctctctctaaagtctccacctttcacggttttttgcttctcacctgaatccaatcaatctcgccggagtgaattcaccttcctccggttgactcgtcggacttagtccgacctttcaattcgtagattctgtttacaattcactgatcgtttgattagaaatgggttacttgttcttctaagtctctctttagctgaaagtttgttgctttacgactcttcgatttacccttacttgttcaagttcttcatcaaattcgtagttatggcgataagaatcactttcacttactccacccatgttgctcggaatctcgtcgggacccgtgttggtcccggtggttactgctttgaatccttggttcgtcctagattcttctcccacaagcgtgatttcgatagatctcctcggaatcgacctgcatcgatgtatggtagcatcgcgagggagctcatcggagaaggaagtcaaagcccgcttgtgatgggtttgatctcgatattgaagtcaacgacgggtcatgagtcgtcaacg

SEQ ID NO: 3676 - DNA, 2000 bp, Arabidopsis thaliana
gtctttttgtccaagtccagttttctcggtggtcaaagtggcgtttttcgtaagcagattgaaataaatatctacacgtgttataatttcattggatgattttttgtctcgtttttcatatgtaacaaaattatatacgtgaaagaggggtctaaactaaatcacaagacaaattaataaaaggtccaacaagttagtaacagaagtgagcttttttttatacaaacaaaaattaatctttgacaactttaagacgagaaatagaatgttttagtgattttctgaatatttttcaatggacttattggatttgctgtaaatgttatcaaaaaaatacagtaaaatctttataaattaatatataaatatgaaatttgaaatatttagtgaaatataattctactattttttttcaatttgtattaattctttataaagttcaattctaatacttttactatgtcgattttctttttttttttaaaacaaaatatttgtttctacgtataattggtttcataaacattattgattataaagaaaaaactactttttagatcaaatttttgtaagaaattacataatttgtaaaatttctctataaaatttatcgataatttgtacgaagaacgccactttgaccaccgagaaaattggacttggatacatgttaaaatggatgagtttaatctatgtatgttatatacgtgaaagagagggctagagcagaagacaaattaataaaatttcacacaaattaataaaagaaatgaaacaatggcttggaagcaaaataaatttaatgattcaacaaaattttcttgattccgtaagacttaatcagcggtgaaatcaattttcttgaccaagtactcgttttgacaaaacaagccaaaaatccaattacttgtataaggcaagtcgggtcacaaatatcttcaattttgcaagtacttgtcttgtgtccagccctactcatagttatgcagactttgtgaaagagatgaaacagatggctttagcaagaccaaaagtaggagcagaagagattttgtgtgatcaaatagatctagagttactccctaggacaatgaagaagatattaacgtctgaggcggattctgctaaggtggagctactgcaatttatacaccggatggcaatgtggtgtattatgtctataagagttgtaaatccgagtctgaggcgagacaagaattttatctaatctcagtgttccaaggttcaactgtaattgttcaatgcacgggaaagtgcatacataagcttactccgacaacctatggtttccttatggagtatgctactgcaggaacccttttccatgagataaaaaagcatttccatacactttatggagtatgctactgcaggaactcttcccatacactttattcgccgtttcacactgatgatccttcaagggcttcaatatgtacatcgaggtaactttgttcagtggaccttcacagcggtaatattttactctttcatagctatgaaggattagaggcaaaactcagcgactttagaaaatccaaacggattaataaaactagctggtggagccctgtaaatcgccacttatgataaaacttgatcatgtcactagagtccatttctcatggtatcacgaacgaagcacttgacgtatgggctgttggtacttagttgataggtgatcttagatgaccaacatgtaattattttgcaatgttggagagtaaaaatcaaccacggctctcttaaccggaagagtgggcgtcaattggattaacatattctcaatgctctgcaagaaatagataaaaaaatttaaaaatttgactttattagttatattttccttggtataccggataactcgcttcgctgaccgataaaaccgaaccatgacctaaattgcgctccaaattttagcagtccctttcttcatttccttcctctgcttcttctccggtggatgtcctctttcatca

SEQ ID NO: 3677 - DNA, 1174 bp, Arabidopsis thaliana
tgagatgtgttgccattcatcttcagaatatgttttactctctatgagattttattttaattttcacatgtattccttctttttttgttaattcttcaaagattgtgatgttgtgttcctatcataataaaacatttatctcttgatgttttttttattatcttaatcatattttcctctttttcgaaccaaatcttctaatcaaggcattataatggcccgtttgagaaaaggtggactttctttttaaaatcaactaattcatcttaaggttatagaatagataaatatccgaagtaaatatataaaataaattgggtcagcctaaacaaaataatgaaatgcaggccttacgtgacagtaatgggtacgcctcaacaaataatggtgtattcactattcagacgttggtgtcaaaatcaatgagtgatatccttattagaagaacgacaagctttaaactagtttcatgtgtaaagtacgaaacaataaacatcatgaaaacactcgaaatattgtagtaaacttgccaacaaaaccatgagtacaagtgtacaactccaatgaatcagatatatatgcaagatggaaaaaatccccaaacaccttaaaatacaacaacatgtgacaataacgaagtgaacgaccatctcgataaatagttaacaagactcattctcatccgttgacttttcatctatacacttaccattttttttatacaatctttttctatcatgactctatcctcaatagctacgtgcccacatggagccaaggctcatgcctttcgtcttctgatcaaatgtgtgtcattgatcacaccattcatcttagttgttaagaaaatatctgtaaatcattttttttttcattttatagttgtatcactttattatagtccactcggtttttgcatttttgttatagtccactagttgggccgtgttatacaatagcgagcctatctcaacaaaaaacaaagcccaacaagtatttattttgccagttttgtaagcaattaattgaatagagtaagtagagacggagcaaaaacaagagaagcgtttggattcgacgtttgccttatccgttcagctcatcttcttcttcttcttcgtcacctctgaattagtttcccagaatccgaaattcctaggaagagaacataaca

SEQ ID NO: 3678 - DNA, 718 bp, Arabidopsis thaliana
ctcatcattcttccacaatttctgttttttttctctttaatttcgtttatattttgaattctaatttctaaggatacaaaaatatattctggcttgttttttgctttcctttttatttttgtacatgagcaactttctaaatttttatcctcatatggataatttttgcttcatataaaagtttttgaattccaaagaaatgtgatttagggatggcgaaaagaaaccgaaccgaaccaaaatcggatttcataagtaattttcttataatacaaactgtgaaactgtagaaaattcttataacaacccaaaccaaatctaaattcttataacaacccagaccaaatctcaaattgaaaccaaatttggtgaatttgtaattaaccaatattcagaattaatataactaattaaatataaagtacatttaaatacactaaacactataaagagattaagagtagttagaattataatttttgtcaaaaatcgaacaaaaccaaaattgatgtgtatataatatattacttaattggaaaacccaaaatctgaaccgaaataaaccggtaaaccgaaattgcaagcttagaaattaaaccaatttgaagacaggggtacaatggtaattttcaaaggaagtggataggataacactgcggatttattctccgtcgagctccaaagtctcgagcttagagctctctctcagtcgaaaaca

SEQ ID NO: 3679 - DNA, 2000 bp, Arabidopsis thaliana
cgctccgattcccacgtgactctcacgtgagccttaaaatatgaaactctctaattcctttagaggctttcaacagttagtataccaatcggatacgaggtaagccaacagcccaacacggcaacacgtacccttattactttggcttagccactgtataatgtatagttgctgtaacaatcaactgttagtactaaacaataattaagtattgtcttttaaaatattgttcattcttcttcatatatagtatacatggattactagtattatattgaatagttacatgtcaattattcataatcgtaaatgttaacatcgcaaggcgattttccattatacacgtctactacattcatatgataggggaggcacctatttgagtggaatattacgacagatgcatattattgtatgtttatgttactaaaagagcacctttatcaattattagattaagtatgtaataaaatattggtagatagatttcgacctctaggtattaccatgtagtcactgagaaatcttttggggtagggactccatctcaataatcatgtagactaattattggcaatataaaactaattaaaatgtaacaacaaacatacaatccacaagttgacagtttaacacttcaaatggatataacagaagcaaagactcatcatacatccattttgtgactgtttaattagtaatggtgttttggtatatgaagcgagctacgataaagataatggggggtgatagtgtgttctagagcttactgatttgaaaagtgttaagaaattagtgtaacaaagttatctttttcaatttttggaaaccctcataaatattgttttgaaaagtgccacaccaacttaccaacttaaaccgctgcgccataaacattcaaatttattttgccattgtatacataaatgacatatgttattatatcttattatatatacacacaaattcttcccataagaatatatgtatgtgtggtggcctcgggatcaatcacttttgacaatgtcttgtgggaaatgacttagtcaaacctttcacttggttttttggaaaataaattacacatcactttcaccttttctctgatttttggttttaatgtcaacttttcgttttattttattttcttatcactgaccttcgggctgtccatgaactatttcctttttttttattggtagtgtactaagacaaaataaacaccataaatgtttgactctgcatgcaccatttttacgtttatatatatatatatatatatatatatatatatatatataatttatgtttgtcatagtatagtttcgtataccatgtaactaaacatattatgttggttctgacttttggttggttcgatttggtttaatcgaatacagaccaaaaaccggttatatcgatcgactaacgattgtttagtctcttcaagagacaaccatgcatgtgttcaatcgtaatgtggacattaaagaaaactttaaaccatttgtccaatttgttttcttctcacaaaccatttgtccaatttcttaaaataaaagagcattaaagaacttaattaattagtacttattgaattcttcttcacaaatttggtttgttccttttgatttctttctccactattcacaacttagaccagctgttcttgttttgcattggtgaccaaaaacacaactaaaatttatatgcactgtttctctctctccctctctacatatagatatatatatatatatataatataataatgaaggtaatccacatggggagaggagaaaaagcataatggaaggaaaatagaaaataggtttctcattgacttgagcgtttccaatacatagagcaataaatagatgtctttatctttgataattacagaaccagagaactctttttcttttcccttcttctctttcaaaaaacaaaacaaagatatctcaaccaaaacacttagaccaagagagacagatagagag

SEQ ID NO: 3680 - DNA, 2000 bp, Arabidopsis thaliana
aacgcctgacggctttgctggatgaaaatatagctggataacatttatttttaagaagaacaaaaagtgtaataattatgtgttgtatagcgattgtaattcatgttatccttagccgcctccttattattatgtaagcaatattttctttggcaaaatgaagttctaataatctaatccaagaaaattcgtaagttactctatcctgtgatacaaattcagacacgcatgaataaaggagattaaaggttgcatgtatctttaaaaaaccatcatttctttcaacgggttaaaaatgagttattcacaaataattgttttgcattgcataattagattgagttatatatgttattcgattccgtcaggtttacatgatcagatcagcagacaaaagattaaccaaaaaatgaacgtcggtggattacagattgagaaacaaaaatatgttcaacaaagtcgtgttgtatttgacagcttaaaccacttgccagatgtggttaatgataagagcgatgtatatttgatggggccaatccgggattttatacagtaagtgagtgataaggatatgtttctttctatcagctagtgcataaatattgtgggctaaattatcacaaattgtcgaataagtgatatgatttgtgggcgaggttatcacagattcacaatttgcttatcacaaaagatatttttttgtttgttttagaaaaacaaattatttgtatggtatcacaaaaagacatttgtgtatgttaatgttgtaggattccaaaaacgacttcataataataatataatgatcattaacaaagaaaatgtggcaacggttgagaatgaaggacaaaaatatttaataaaataaaaaagataatagcatgtactagtagcaaacaacataaaagaaatgagtaactatcgctttaattaaaagtgggactaaacatgtctctagactattgaaatattcttattgatttgaattttcttattgtaaagataactttgaaattcactctttaattattttcttaacgagtttttggaatggatccgaatgtatatatatatattgatttgtgtttctatttatctaagcttgtggtaactttattggcgatggttaataaaaaacacgttgggtgcgtatatgcaatattcttgatactcgaattcattcctgaacatgagatattaagataaacgacctactacttcgtgattaaaaaacataagttaaaatttaaatgtccgaaggaatcatagttaagtgacagcatttaagttgtctaaaaattgccatttgccactcgcatcaatttgtaattttgcaaagtgcaattttatgtctcaagatttgtttcgcagtaagtaatgaaataacataatcaatgttctaacaaaatatctcacctaccagccacacgagtgtcaatttagtttacatttgaaccagagacctaaaagtttgaactaccaaaataatgattttgccgacaaaataggaaaactaagaaagtagtaatgaatatcagatatctgtttcttcagatcaaagcctactaaggaacgcaaaaatatataactaaacaaaattgcgtaaatttagaaacagtgattaaaagcccatatttgattcaatagtaattgaaaacagcataagataatggcccattagccgttatttaggcccgttatcatatcacaaaacaaaacacgaatcatctacgacgaagacctgaaaaaacacactgcaattgagatcgatttcgactgtaagtgaactttgattgccgcgaagattactcaaatcgccggacacaagtttttcagtgaattccattggcatagaactcgagagaaagagacacagagagagagagagatctaacaagagtcaaagtttctgactttttcgcattctttttgagatcgagttctgtttttgttggcgtgtgagatgaattcttaagaaggaagaagaagaagaaggaaag

SEQ ID NO: 3681 - DNA, 2000 bp, Arabidopsis thaliana
attactgtgggtcagaagtagtcacgacaatgattgagagtgattgtttaatagaaaggttttaggaaaatagagaccaagttgcttggtgagagtttctttatgtatgatttctattttctctctaagtcaacttctgtggctgaaaatagagtaaggaggaagagctttcgtactttgcaagttaccaaaacaagttttgaaacaaaaaaaaattaaaattgaaataaatccttatatcaccaacaaatgtcccttcaagtattagattaacttctgaccacgcattatttagtactagctataaccattataatgctaattaatttcttgattaattcaagtggatccagatctttcttcttaaaagcagtaaaacgaatatctaattaataattatttatattcccctaaccttttattatggctggaaacatgtattcaaagagctagtgatagctgaaaagatattccaccgttaactttattaccatcactattcactagttcactacaaaacattagtagtggtagaaacataattaatgacatagatgacattagtttgaagtttattctttgttatgcaacttagaaaacacaaacgatgcaaatattggtttgacaaatatcaactctataataatgagtatagtacctatcattttagcttatgtttatttgtggtacaaatatttatgacgagggagcaataaaaaagttacaagaaacaattttatttgtatcattagtattcacgaaaaacgaatctacgtaatgtacaccatattcataatgaacatattcacccataaggccgtaacacacaagattacgatagatagatttacttattgatcacgatgacgatcacaatgcaatgaacatatccgacaagcttgtttctattttataaaatacaaaaaaaaaaactttgataagttttggcaataaccacgatattaaaatacggataatgaagattggatctaaatttatatttttggcaagagagtagattcggacccactttcttacaaacaaaaaaacttcgtcacctttacaattttcaattatccacccaaaaacaaataattaaaaatgccttaaaaattcaaaaatagtggttgtgatatttttcaaacatgttcacacttgctaaaagaactaataaaggttttttttttttgaagtgtccatcaactttatattatccacgtattttaaacacattagattaggaatcaaaaacaccaaaataaccatagccactagttgtttacccactgaacaaatcaaaaatttccaatatttttctctagaagggaaataaacgttaccagacaaaatccaaaaagctcactaccatctactattgagttttcttgtcatcttctttttggtcacggttttagtttactcttgagtctctttcatagtttcatagcaagagcatcttattatttctttctttctttctttcatagttcactgtaataaacttagaaggctcacattttgccaactcctcaacactttatttttctcttttttcttcacggatttataaaccaataaatttgcagtaatctttttagtcgaatgatctttgaacatatttcctaaatacccggcaagaaaaaattctgaatttttctcattaatttctccaaaaatacaaacttttcttcttcctctgtttcttcttcctcctctgtttcttcttcttcttctgttacttacaagagcaataaagctttgtcttttagcttttctagaaggtatttgaattgaatctgatcttttttctttcttcagtgttgtttgtgactgtgacatatagttcatgtttctttttggatgctctctgtgtcaaacaaaaaaacagagcaagttgagattttttggaaatttcctacatcaacttgcaaagtctgaatctgtgtctgttgaatctttttttacaggaagagtagtagtatcttctttttcacagtctc

SEQ ID NO: 3682 - DNA, 1576 bp, Arabidopsis thaliana
tgtatctttgtcagtttttgttacgagttttgtgcttttttcttccaccatttggcttggctatatgtttatcatttctgtaattcttagtttaatgacaacaagtgagaaaaaaattataaatgacaattggttgacttctaattcagaagcttatgttatattcgatcgaggacatgagctctctcagcttcaaacacaagccgctcaactatttaggatgcctgcgacatctcagaaggcaatcaagtaatcaacagtcacagtagaagcacaagctgaagaagatgaagaggaggttggtgagaccggtgctgatgctcgtgacattgaattggtcatgactcacgctgtagtttcgggtagcagatcggttaagtcactcatgggtcacgtcttcagacattgtaagtgcaataatatggttctcactccttgaagagaaaatgaacctctctctgctttgttcattggcaaattgtttttatataactttgaagtttcataaaatcggattattgccctttctgttatctaatctcattgtatgtacttagttatgatgcatctgcattatctgacttctaatcttttttgccaacacatgtgaaattacacgaacataagtttgataaacgtaaagaagttaggatttagaaacatcatcttgtgaaaaataggcaaagttaattatacgaaagtctcaataggaacgtttaagcaaagaagtgacacataagagacgttgaaacactatgcatagattctaactcgtcaatcatcctctgtttcttttcaagactgcaggttgaattcatcgaaatttccgccctttttaaacacttaaagttctccagaatgtatcttatgagttctttttcatcttctcttcctccatatcctttccattcaaagatcgtgggatgagacgacaagcattcgggaacagaactcggttggttccataaaactggagcatgattctctgaccgttcaatcagaaatgtggagtcgaccattaaaacctctagtttaggagaattagagaggaaaaccacaagtgattcacacaagtccgggtaaaatcgatgtatgctacactctttaagtagagagtaaacggcgttacaccatgcaaccattgtatcaccacgtatagatagctcaagatactcgattgaagaaagagatctcagaagtaaacggagcatatattaattagagtgccacgtcagcggggtttttttataatgataagtctcctccgctcaatttcagatcagaatcagttcatccatggaaacagcgtcgagagtggaactgattgttaaaggcaacttaccggagttccttctcagtacaatccagccaaccggaagctcgacctaatctcccattaccacggcgatgaagcttcgatcccaaccgtcgatctctcgagctccgattccgcgagagaagccatcggtgaccttgtcgcgactggggagccttccacgtaatcaaccatggtgttccaatccatctccttgatcggatgaggtctttaggtctctctttcttccaagactctccc

SEQ ID NO: 3683 - DNA, 1364 bp, Arabidopsis thaliana
agctgtgaagactgacggacaaggaaacccatgatacagatgcaaaatattcattttttttgcatctgattcattcttcatgaattgtagtgacaagaaaagtgcatattgtacaattatatatatgtaaatgatatatattgttgagtcaaacttatttgcttgcatttgaatagaaagaaagatcttgattatatatgtcagatgatacaagaagcaggagcattaagtactgtaaactgtaagatgataattgtaactacatcaaaatagacattgaaaccacactaacctaatcacattagtgtgtagaaacatgtgttcgattagggattttggaagattttattttttccgctagcttatgtaatttcagggattttagaagattttggttttatgtttttaaaccacttgttatgttttcaggttaatgaattgattaacaaatgctttttttggatataaattttttatatgattaaaataatactaaaacaatattataggtgaaaaataccgatcacacaataaccattatttaaccataaagcaaatattcaatcacacaataacctaaccaaatattatcgaggttaatacaaaaattattatttacaaggaccatacatcgaaatacgttggatggttctcgtatacaatttgaaactaattttggatggtattaggtagatgataaattgttattatggtctatttaccgtatgaaactttttcactattgtatttgttttttttcagtaataattctagattaaaggtaattgtggtatttatgtgagtgttaacctcttttttgtaccaatagttatttcagtatcttttttgagtgagtggtaagcagtgttttatttgttttgtataatatctataagtattttaatgtttttttatttttgttacatgtctctgtttttgtctaatagacaaatgttaaaatgagacataaaaaagctaattgtttcagggaaagagggcattttccgtaattgatcaacggctctctcagaaatatagccgttaccgactttccgattatagaaattagagtcctccaaaaccctaaattggctctacccctttataagcaacccaaaatttcgtaccttttcactcacttcatcaatctgctctctcatctctcatcaatcatcagccaccaacaattcttcgctctctctgctctgatctctctgctcgaatttactaacgatcccttctctgcaggctcatctttatctaatttcgtttactcattatatcttctaatccgtttcgtatactatcgctattcttgttttctgtttgtttgtattttgggattttctttgtgtttagtgata

SEQ ID NO: 3684 - DNA, 2000 bp, Arabidopsis thaliana
ctcaatattaatcacatgttcatagaaaactataattcttttcccctgtctaaagtttacagatttagctgtttcaaaatgtacattattcaataatactatgtacatcattcttaaaacaaagagcaggtccatgataactcaaatttgaatccaataaagttaagatattgaaaagcaccacttggcttaagtaattaaacaaatgcaaagccaagagaccttaaaacctcaaggcagataaagcaacagagagatctgtcgagatgagttagtctgttttacagagaagattaatctttatttatcactcaatggttttaaactgtagtgattcagatagacaaaataaatataaaaaaattgtaacaaatagattttatggaaatagtttggtttacattggattgttctttttcgtttttcggttaccatttgaaccgaatatatttttaacacataagaaccgaaagtgtgaatgtgtgtgcgcatttctccttgtaattcgtgtattaaagaacacaatgtaataattattttgttgctaaaaaaagtgatagtacttaaaacttagttagtaaaggtgtttgccaaaaaaaaaaaagttagttaaggtaaaagggaattgagtatggaaaatggaagatcagagacgagaggtgagaaggtggggatgggccagtaacactcttttagccaacctatggctataaaggcaaaagttgttttcagtttcagaccaaattgaatttgtcttttacccatttctacctctctatttcatttccctaacaacttaaattgttataattcatttttctatggtcaagaaagataatgcatttaggctgtgaatggagcatgcggagcaggaggatccagttgcaagatggggtggattattgattatttgttgccatttacataagttatgttctctagagtgtgtttaggaaaataaactgacttgtcaaacatgtcattctttcttaaaccttgttcgcatccgcggtccatcaataaatgatccaaatagtattggatcaagttagcagagaataaaacgcaaaatcttacgttaactctattttgtacggtgtaactttcaaaatttggtgtagtatttctttgaagcttaacttctagtattagaaggaccttagctttatttgagatactaagcataagtttcaaaatgtatttatctgaaattcaaagaaactcttataggtaattgaactaatgtacacactattcagccttcggagacatacttgtgtcacacaaattgtgtgcattggtcttgcatatgcaattgggagaagctacgtgctcttataacacccacatattttctctattatttgtcctcaaatttcttgagcgttttttttctcttccacgcctaaaattttatagaaagaggaccacattcaagtccctttccaactttttattattatttagaaatggtaaatatgagtgagtcttttgggggtttgagtgaaagtccagccacgccaagctccatttgctgattactgcttaaaaacatcaccaaccgtttcttaattaccttcattgtttactcatgtttattgtgaatggttcattataaaatttctatgacataataacttgaatagctagcatcatctcttgaccaaaaaagaagaagaagctagcatcacccaaattagtcaatgattcaaaacgaaagttttagtacatataagaagaaaaccaaacctaaaactatgagtagtggtagtaaaaccatttcaatatgtttacttgttggaatgccatcataataacaataaaataagaaatgttttaagaaacttttacctgtgaatcacgcggcttacggcttttgcagagaagaaagatatttacaaatactcgattttcacaaaaataaaatacaaaaggtgatttcttgatataaaacccaaaagtcatctttcttctctattgacttgagaagaaccacaaca

SEQ ID NO: 3685 - DNA, 1007 bp, Arabidopsis thaliana
ttatgctatcgaaaaacacttctctatctatatatagagagaagtggttttaaaggtaatttcatttttacctttaagtatctggttaattatattaaaggtaatttcattttttctatatgtgtaggctatggaaactgctactatgaataaacatgagcaagaaaggaaaaaaaaaaaccatatttcttacaagcaaacagaagaggaatgtgttttcttgttgttgcaatgtttatgagttataatttaaatttccaaagttcgcagattttgattaatcaaatttgataacataaaagcaaaaaagaaagtatccaacacttatcaaaatttgatcacaattattccatctcattttcagtaatgacccttattacgtactgaccgtaaacatagaacttaccgtaattaagcttttaaaattgaattcttcaccacatgaacatttggaaatatgtagaacaacgtaacgttttcttttcttttttctttggtgtcagaaactaacgcatttctaaagattttttttttttataaaggtaacgtatttcgatatactcgaatgttagtatgttaaaccattggataaatgacacgtggtgaaatcttagcctcaagattagataagcgtagactaatcaatcgtttccctcttctccttggtattgaacaaaaacacagtcgtcactttcgtgcctcccgaatgatctcatgtgggcttgtctcgtccacccaacaaactatagaaaaaaaactcgatcggctgatacttaatcacccacttgattttgtatttttgtacctttttttgttgtaatttttccatacacccaatttcccgtggaagaaaaggagtcagctttttcgtttgctttaaagcttgaatctttacatagttccagttactttctatagagcttcataatccctagttgcccaaaaggattctgggttttgtgagaatgatgacgtcatgtcggaatatagatttaggtacgatgatg

SEQ ID NO: 3686 - DNA, 2000 bp, Arabidopsis thaliana
acatacacaaatgtgattgtaaaagtcacatcttactcaaaaagtaataaaaaataaaataaaataaaaatatatggagaaaaaggacacgaatctatataaatagatgcaacttttttaaagggggattgacaaaaaggcactaaaaaaactctccttttgacgggcgatgtctcaagggaaatcttgaatgtgactcaaagcgaagagatgaaacagctcgaaaagatttggtttgagaatcaaaattgtcctcatacagacaacattgtcgtcccaccgtctcaaccttaatagcttctggggtctgtttttaatagcaggccttgcttcagtcatggcacatctcgtcttcatagccaacttcttgtacgaacataggcacacgctaaatgaggaatcgaaaatttccttttccagaaagctaacatttttgcttagaaactttgatgaaaacgacagaaaatcgcacatgttcaaggagagtgcaattcataatgtgagttcaccttttagtcaaaccactccaagaccttcaacagtgcagatcacaccatgaccacgaagtccgtcgcaaaatatgcagtttgagccaagatgtgtatcttttgaaagcaaagaatttttcactccccaattagaatgtatagctaaatgataaatagaatttcaaaagttgttgaagcattttgattacttagctaattttactgacttattttcatatttttgtgtgttagtctcttctcaaatctatatataacccatgatatactctatatttagcactttatcatggttattaagatccattttatggtgtttcattagtattttcattgtggtttgttgcatttagtgtccaagtgagtcttcttgcattttagaagtcctatagttactgtgtgtattttgtgtctcttttgagatatttcatgttaaaataatggaggacacacatttaaatgcaaagaagagaattgatgattcataacctatctgaagtctctcaaagatcgactcggatgaagttctttcattgagatttagctttggacctctttataatggttataggaaattgaaatagatttccaatggaggtgatgtttcatgggtatgtgagctattggtagagatttatggctgattttcgtatacatatgtcaatctatcgcagaaaagaaactcatctagaaacctctcttaaaaacggacagaagcttcttcgacctccaccttcggccccaacaccaccaaagcccctctccgatcaccatcgtcgtccatgacacaaccgaagccatctctttttagctttgatccaaattgcaaccgggttgtaacccggtttatctcgtcgatccggtcagaacctattaagcaaattttagacatttgttaataataaaattttcactacaaaaaaaataatatagtaattttccaaaaaggtttttggttcgtgttacattttctgagatgatccatcaacttacaattggcattttctttctctctctctcttagtaggatattcactagcgtaaaatcactcgattatgaccttttatgtgtatgaaacggtcttgctagctggaagaaaaatattaatcttccgtcaaacaagtaagaagactgaagttggagatttttcaaagtaaacgtatgtagcctaaaaaaaaggagtgacaatggtagagaataatgacaaaaagcgagctcatattatcgtccatacaatttttttctgtcactttcaaaccttaacttcgtttgttttcttttacattcttgttttcatattttattttatctctatatatgtatatatatatatgtatgtgtgtgtgtgtatatatgcaatagaacaataaaaaagaagaggaagttaaagaatgacataaagttcctcaatctggatgaaagtgatgaaccctagaaaaactaataatacctttatgtattactttgtcctgttcgtttgtggttttgtgttg

SEQ ID NO: 3687 - DNA, 2000 bp, Arabidopsis thaliana
tgcttcaatggttgacgaattcttaccgtagaagttgcatctaaatataccaaagattaatactgcgaaaatatgataaagaagattttttttttttgtactctctagaaatttgtaaacgatattattagtgtttgattaaagactccaatttttaacataatgtctatatccacataatgaatttgtgtctctactatatgtagtgttcccgtcatatatgcatttttgcgatagtcaatcggatctttgtattgcggttaattgatctggtctttcttgagcgtacaaaataaatagaattgtacgtattattagagatggttacatttggtttacattattagttaaagttaaccaataatgtaaaccaataaagttaaccaataatgtaaaccaaatgtaactatctctaatacgtatgttgactatgatgtacttcaagacaagttcatcatcacttaacgtaactaacactatattagttaagttcaagacttattgcccatgattcatttgtaaactatgaagtaacatatctctgattttttcctcttatgtttgataaattagtcattataattagtgtcttgccaaaaagtacacttctatcttattagcattctacattacaaactattaatttcactacgtatagcggtatagggagaagatcaataaggcgatcacaatattagttaagttccgagtcttgcattaccattgtcctatgaatcacagaacaagaggacgcatatatatatagtatttataaaagactaagatagtcacagaacaagaggacgcatatataattgacaaatactcaaaacatgtgaaaagataagggctattacgtcttcattaagatcccataatctttatgatgagaacttaagagccaaactagctatgtaacaaaatatcaagtttgaaagtaataaactgcttgaataagcttcaagttcactacatggtttagaaaggtttaaaatctattactttcaaacgcttttattgtgtaccaatcaatccaacaaagtatgcaatcgtactaatcaatccaacaaagtatacactcacaccggtaacatcaaaaattcaaaaattcaaaatttcatgttaccaatcaatccaacaaaatatacaatccctgagaccgagttataatttgttggaatgattggtaccagtgaaattgtgttgtcgtgtgaacatcaacacataggaggtaatatacgtaaatatgctagcaatcaagctaagtatacaaaacacttcatgttgcagtgttctattgaaattttatatatcgaactagaatactatcatggagaatgatcaaatgttgcatatcttcatatccacgaaaaatgagtacacaaacattcgatcataccccatgacagttttctagtttatacttgatagtcctcacgatttcatggtggtgacactacacaaaccctagattcccctaaagtttttgtgaaaaacgcatatgttcgattttaggttttacttctatccttgattcattacaaacctatttttatactaattcgtcgttaacctaataattttaacctacgaaacccaacctatatgggcctgactttatgtaatgatccaatgggcctttcttcttcaatgatgactttcttcattgactctccttctactttcgatggtattaaatttgacggaaaaagtaaaacgataccgtctgggtgaaaggcagagctctttgcttctgaatattattattttcttaaattcttccgtttttttttttaatccaaccacaaggatcgataacgaaatcatcagatcgccagaaaaaaaaaaaaaattgcgaaatggagaatctgagctgcagatctgcgtcaatctccatctagatgttgttgctacttcttcctctatagaaccataatttcatcagatctcgctgattaatcatccccatttggatctgatcgaaactcttagggaagaac

SEQ ID NO: 3688 - DNA, 1604 bp, Arabidopsis thaliana
gttggtttagatattcgaatttataaaacgtgaagcattgtaactcaacaactggggatgtagctcaaatggtagagcgctcgctttgcatgcgagaggcacggggttcgatcccccgcatctccaagtttttggacaaattttgtattttatatttcgttctaattagtaatcatcttctggaaattgtgtagaagaaaaagattaaaaaagcattgggattatgaattcgaaggcttttattagtgatttttaattcggtttttttattatatttttattgacattctagattttaacccactacaaaattataatcaatttaaaagcttttttcaaatagttatttaatttttatagatttcacatattatataaaaaaaagaacagcctattaaatagaatttacatttttaaaatctacatcaaatgttgaactgtttaaaaaacgaaggagtttcaaatatgaatttctttccactttatttgaaacaaattttgttcctcgactcttgattattatttgccttcagcaatcacagcagaaaacccttctcctagacattcctcgggggcagatcacaccaccttggaaacaaacaaatagcacatgcaggcatgcagcaacacagacaggcgttcatccctcacttacctgcatacatcatggcaacttgttcccatctcaccagtcacctcactgtagcgagtaacaattcggtccatgtgctggcttggcatggaaggcaaccctttctttttaattgttatgttaatatatgtaagaaactataatgacacttacaatgattgatatgaggtaggggatatcatattagtggcgcatatcatattagtggcgcaattaaagaagctttaatgtgtcgccgccatttaagcctaattcaacgggctgatggacataaaatattaaaatgatttttttttttgttttgttttcgtcaaaatattaaaatgaattgattttgctcttttagtaaccgaagaaaatctgtcacttgtctattattccctcaattttatttgatttatagtttaaagatttttcatacaaattaaaagaaaaaacataaaaaccttctttaatatatctattttttataaaatattatcaaataaaattaattcgaaaatatactattaaatataattagttaaaactattaaatatatttaatttttgcataaaaaaatataaaagcaacatttattttgtaacaaaaaaaaacacctttaaactagaaatatattaaaacagagggagtactagaaaagtaaaatggccaatgtgttcatatctatcgtgtcggctaagagtcccaatcaatgactcatttttacacgcctaaaagaaaataccatagaaataaacaaaattaagataaaggttactaaaaaaagaaacaccaaaagaagagagggaggctcatctccctatatatggcctctatatgtatcaagtgcagccacagttttaccaaagctttagaaaaccttgaagtgtgattatagatacacttttattcagaaaaagaacttaagcatgcaggagctgataaatactttgtcagcgcttacgactg

SEQ ID NO: 3689 - DNA, 1016 bp, Arabidopsis thaliana
ggcatgttttaatgaagaaaaactttgtaccatttaattccaaaagtatgttttacaatagtttttttttaacctcaagcttatgcgctttttccacaattatcaatcttttgaatccagtcagcagcagtctcaatgatcttagaaacagaatttcttaacaggatatttaaaagaacaagtttcttgacattagagctggaactggaatctggtctctgttttgtgctaaagcaagagcagctcatgtatacgcagtatgtctttttaacttctttattaatcaaaatttgctctgagtgatttgaatacatgtgatttgacaaatgattcttcgaatgtttcagatggtatatatatgttaactttatagtgttattcaaatgggttatacaatctgatggtggaaatagaacttacttttggctgtataaaaattaaaaaacaaagattggcccaatcctggtcttaaagacaaaaatacaaatcttttggtctgaaattacataaaagttagtggatgcaatacaataataaaactttggtttcagagacttgaatgcagcaaagtctacctccaaagctacttggccaaggagttgtgtggttcagacttcaaactgttttttccacaaaatgtacagttccatccatttaaattctaaactattctatccataaacttctattccatttaatgcaagaaaaaaccttttttgtattcattcaattatttatgttttggccggacacaatagttgcagagtcaacatatgtggtctgagttaattaaataatgcaaggatgaagccaacacatgtggtctcaatctcagtaatgaaaagaatcatttctgtggtgcgaattcatattaactatttgcaaagtctgaaaatgataaaccacttgaaaaaaaatcctgaaagaaaagaaagagagaaaaacaagaaaccaagtctgaaactagtgcagaagagaagagctttgtgttttggtggaagtaagaaaacatcacc

SEQ ID NO: 3690 - DNA, 1128 bp, Arabidopsis thaliana
tctcttgtttcccctctccgctccctgtacacacgaaattagggttcatcatctaacgggcgaattttgacccgaatacccattttaaaatctgacccgaataccatttatgggcccaaagcccgctggacttgtgttaatatttggaacatttgggccgatctatcttctacgaatctttcttaggcccatcataattgagccatccagaggtgaaaataaataatcgaacggttaatattggtttgattataaacacaaaagttctttccaggtctccttgtagtctttgttgtagtaaatggcgggagtcatccacgtcagcagtacccagattccggttgcgtttatgtccgcaaccaaacagagctttaggagagcttctgtgatcagatgtgccgccaacactccaaagaaacggtacaccatcgcggttcttcccggcgatggcgtcggtaacgaagtgatcccagtcgctgttgacgttctttgtttagctgggtctcttgaaggttccttctttctcatcctgttgcctaatttaatttgattttcccaactgaaatcgtgtttttggatatcagggatagattttagcttcgaggagttgcctataggaggtgttgctttagatcttgtcggagttccactgcctaaggaaacattgatcagggcaaagcaatcagacgctcttcttctcggagctgttggatggtatggtattattaccataactttcgttcatctcaagtttggattcatctaaagtttggatttttgaattgaaggccgaaatgggataacaatcccaagcatttgaagccgataacggccttgttgcagcttcgtgcggctcttcaagtatttgatgagccctccttcttctgtgaggtgctgctaataaatggatatatatatatatatatatatatatatatatatgttgtatgtggtaatgtaaggtgtccatttacaaaattaaaaactttggggtcaattctgaaaataaaacaatgtgcaaaaaaggacccataaatgcaaagaagtaaagtctgagtgtactagtagtatccatttgacttgcggtttcaaaatccgaaaaagaccaatcaatcctttctccctgaa

SEQ ID NO: 3691 - DNA, 357 bp, Arabidopsis thaliana
agaactacttaaaactttttaaaacaaaaagaaaccacagggacttatattgaaaaatgtcatagtatctcagagttttgatttactctctttttgacccttcaattttagaatttatcatttacatacgtaaatcaatatgaatgtgttttacattttaacctctccaacaaattctaaattactgttagcatataactgacacagaaaacaattactgttacaaaagaattaactatcatttcaccgaaataacgaaggagagtggcattttggtaaataagaacaaagtctctatttataatcgcattttggttgacttgcttcaatcttgaccacagcaaagagaaacaaaca

SEQ ID NO: 3692 - DNA, 2000 bp, Arabidopsis thaliana
ccgcatcgtaacagtgctgtaatagtatcaaaatctctatatatacatatatatatttatatattttcagtactatttgaaccgcatcacacttctcccgcaccgcaaaacgcaatcaccattcgaagctttagattacgaaagaaaaacacgaatcctcaaagtttgaccaatacttcggtaaatatggaagaaaaaactaatagacagataccacgaggatggaaatgctacttaaacaatattgcaatctatgctttggacaacttttataaagcatattaaattagtctgcgtttttggcttttttacttgatttttatattcgatcaaatgatgctatataaaagattgcaagtaataacacgttactaaagatacatatatcaactttaaaatgatagcagtacaaaactaacagtaattttcttaccaccttatttataccgcttcattttatcgcaacaatcatttgcgttatagctagcgatacaacgtcaccactcaccaatcgagactaatatttcaacgtcaaattgttatatcttcataggctaatatattaatagaggagaggaaatgtcatagtaagtcgaagtgtataggaccccacgaaatgtgatttgtcggactgcacaggacaggccaaatgttctagtcggttgcatcaatcagttttgggtaagtaatagtattatttgattttcggttccctgaattttttggaaaacgataatacacaattctactagagacacatatgggtatgtggtctactcgttttgcatcttattattccgatccaaatggctcaaaattatgcgttaaaaatatgtttgtggtaaaaattttggaagaaagcagaggacattaaacagaaactcatactagtcttttgatttttttttataaaatataatcttgttatttaagttattcctggttgttaaacacgcttaaattcacaatggtccaaagttattttttaatctaagatgaatcattcaactaataaaacaagatgaattgatttgcataatataatgtttgagccggaaaatgtaatttagcatgggtctaccttatgtctttcttggttttctattgtaaaatcgttgtctaaccatcttataatatcttaaaaactgttgttttacaaattacaacaaatctttttttccgtattatcaatctctagacaatgcgggtcaattatcttactatttatgcgtttatattacaaaaattgcacctgaaaataaggaattgatttagaagcctccaaatgatttggtgccattccaaattaattaagaaggcatcataccatgagtcagttaactggatccaaccccttgaaaaggaagaatcggccgccaaaaaaatgagaccgaatcttttatcatgctggattatgaatgtatacacacgtaattgagccaaaactaatcataaatagttctatacttcagaaaataaaaatcaaaatacaaacagttagttagcatcgtttagctgggttttttttttttcaattccaacttgaatcaattaaactgatagctttggataatactgaataaaaaaaccttgtcactaatttgacgaaacatgaagaaagattataaaaaaatattaaaatctatcgaaaataattatatttatctacaaaacaatttttcccgatttagtcatttcttaacagttacaaatatccaaatcatattttataatattaaaaaaatcatattatataattcctgattttcaattttgcatattacgtcgacacttcgtcctccgggttttccgagcacaagtcctaatcaaacaataagaagacaaaaagaaaaataaaatctgaaaaagaacctttgctctttgttaatataaaaagccctactctcgcatccaacgtttcttcacctctaattcttctcactaaaaatatcaaaagctttcacattacaatatctccctctctctacacaaagctctct

SEQ ID NO: 3693 - DNA, 290 bp, Arabidopsis thaliana
cctgaattttgatcccaaattatttttcttttgcttcatttgtggattttttttcttttgaatttttttcaaccatagaaaaaagggcagatcatatagattcaaaaattgtagtgtttatgtgtggatcgtatagtaaacaatttatacgataattatttattgcataatctcgataatttcaatgacatcactaggtaaccactatcgatgaaacttaaggagaaaaacgtttattaagtggctccaatggtcacttcactctcaaccaccactcacaatcttaaaag

SEQ ID NO: 3694 - DNA, 1006 bp, Arabidopsis thaliana
acaagacttggaagacacacacacatactggttcgggcatttctgatttattttttcttttcggttttcttttcttttctcaaagcccttgttgttaccacttatcatcttccatttggagttgatcgagaatactgggaaatgtggcttatacgttttcaccgtaaatgagaaatatcctttgtttaccatctttcagtccaaaagaattaagagcaatatctcggtttgactaatcagtatcttaatatgggacatgttcttgtgtatttttgttttgttttgttaaggacatgttcttgtgtctcatgtcccacttgcacattgatcctaccttccaggtgatctgtccagtgtttgatttccacatatatgtacattttattttaataaaatgattagaggacattccttaaattagtgctcttcactaattattagggattagacttgtgccaacaagagaatctgaacctaaaagtatcaaagcaaaaaaaatgttccgaatagtaattgggctgttgatttgggcttttagcatggagagtagtagtaggagagtgggaataaaacagaaaaagaatattcggcgtgaaaacagcagcggtcacgtaccggacctcaacaccactctccattctactttattaagcgggaaacagatacttccttatccatcgatgaaacgtcgaccacactggatacgtgtcgttctcaaagaggtctgtcactaaactatcacgtcgacccagtgtaaatttatcatccacgctctcgtggattacgtggaggaagaaatatcatttcttgtttgaaataaaaaaagaataaaaaaaattaggacagaacagaagagacacgcaaacatatccattagggtcacaacggttcttacagcttctattaccagaaaggaaagaaagccgaaatttgtttcaagataaagtaatttaagttggagcttgtttcttggtcgtacagtgtcaggtgaatagagaagaagaag

SEQ ID NO: 3695 - DNA, 2000 bp, Arabidopsis thaliana
caaatgagggaaagaaggttaaaaagctttatcaaatcttgagtttgatcatcggcccttcgacaggagaaaaggctagctatagatacaaaagtaatactaagcataaactaaagagtaaatttaaaacgtgctggtgggtgtatagtcgaagtaagtgaccaatctacactcactgaaaattttaatatcaaaatttaaagctaattcagcatattataaaattatggagtgcgaaactataaaatgaaatcataaaagatcatgcgagattaggtggaacttagcaatcatcctaaattacaaaaactcgatcaatgtgagttgatgtatactgtcatacgactaatagattataaaaagaaaaaagacctaaagcatttttattggaagtctcgtaacaatgtaaaaaaataatcatacaactaatttattagaattccataaaagagtttttagtttgagatatccataaaaaaaattatcttcttaattaaaacactgatatatatatgtactctttttaagtgttttctatttattatttttacaaattataaagtaaaatgatatgaatatcagttaaagagtttatatgtttttttttttggtttcattttaaatcataatataaattatctatttattaacctccattatgcataactctaaagatatattagaattattttaattagtattaattaaggtaactacaaaatatttgatatgtttagaacaaattaatacaatgaatatttttaagatgtaatttgatgaaaattaataaaatattaatataatattaatgaaaattttaagattaaataatattaaaatagtagtatcttaattaaggagatactatggatatcacaccaataggcatgctctaacatatttttttccttttcggaggattctttttatatatatatataaacaaataattaaatagcatcccaatatatacataaacaaagtttaaatcgttttagctatgcctgatttttttataactttttaagaattagataaataataaagcaacatgtctaaatactattctaaaaatatatcaattgttaattgggacagcccaatttgcactggacacggcaacaaatgaccaaattctatacacaaaaacaacaaacgagtaacgtttaaaaatgctgacgtgtcccaatatgatcttacctttgatatcgtttttaaggaaaagttgtgattgtctgagtcagcttgtatgagttcctacgtgttgaactaatcctgacactacctgagggaggtaatcacaacatttttcatatataaccgccccaatttcactgatttcaccttttccttttaccaatcacatcatcccaattatttacgtacttagcttgactagttgtcgttcattacaaccatcttaggtttcttataatcattcctgttacgtagtaaagaactattttacgtaatagataagattagatatcagttgaaattattgactatatagacatcctaattttatttccattgttaaatttgttaatatatctaactatcaaaacctaaatcgacgtgtcacactcaaacttataaagactaaacctattacaagaaataagatcttataggccgaatttgtttggtacgttgatgatccaaatataaataatagtttttctttttctttttaattatgaaaggttaaaaattcataaaaaaaattacccatatttgcttaagacgctagcttttctataaatacagcatagccatgtgtaattgatcatcagataagttccgtggttatcccattaaccttctttctacacaacacaaaactatatataaagatcatacatgtaataacgtcctgcaactattacaatcattctcgcttgaattaacgtggacgtcattgtttttggattgttaatcaaaggcggcgttacttttttttaatataattgtttctttaggatctttgtctctggaaa

SEQ ID NO: 3696 - DNA, 1431 bp, Arabidopsis thaliana
actgctttcccttctaacatcctttttaaaaaaattgaatatgattatttaactctaaagaaatatctaagagaaccaagttagtttatgcaagtatatattgtatgttaatatttctatatatactgaaaaatgatgggatgatgtgtgtgtgagagtgaagctccaagatagtggtggagattatgttggaacttacatgaagcgtctttttttttacttgtcgtagttttatcagccacatggatttgcatggaccgttccatatgtggtcaaaaccaaatcattcaatcgatttcaaatatgaagtacatatacacatctatattcatttatatgatcataaagtggttgtttgccatcattttaagaaaattaccgtaagcttgggctgttgtgcggcatgttgtaaaaggaaaacacaatgtgagtggatacgattgaacaagccatagaaaaagtgcaagcaagattacaagagcaaaaacgagtgaagggaagaagaagggacaaaaacatatgtggttctcctttatttcaaaatgaatttcagcaatgaaaagaaaatggacgtcaaattttatttaaccttcagaaactatacttagaaagttagattattgttttatttttgaagttaaaagttttttttagaactatagaactttgtgggtatattttgttttatttacaatgtcatgtatgactagttgaagctcttaacatgtatttttttttacatctttactaaatgtctcttaagctaatcttttctttccatattaattcccactagcaaagttgttttttctttttaatctcaaatttgttaaactaacaaatgtatatatatattccttttttaattgttttctttttgtcaaagtgttttctcaattaaaaaatatacaaagaagcaatataacatttttttttaattgttgaggttggcaagtaaatctttctttcttttttgccaggacgagaaagatttgtttttttaattctctctttaaacgaaaacaaaaataaactcgttggccagctcaaacaaaactattcgcctgtctttcccgacgtgtcaccgacccgtataacaaggataataaaagctccaatttaattttttatttctacagctttttccaccaatacgataattttccatttttataaaaaaaaactttatttgagaattttccttattaaaaaaagaagtacagtataaaggtaaagacactttgccgcgtttctctcggtgccgctcgacgtgttaatcttcttcctcctgaagatctctctctgaaagacattctcaaattttctcgggaaaacacctttttctgattcgtttttctccagatcattccttctttcttatatccgatttcttcgggaggaggcgaagagacggtcaacaattttatccaa

SEQ ID NO: 3697 - DNA, 532 bp, Arabidopsis thaliana
aattgtgggatacgtgaacgaaagcttcgtacgtacgttttcgcttcctctcgatctctaataataatcctaaatccactgccacaaatacagtatatatgcacaaaaattaaaactcgtatcccttggaaagtggaaaaaactaatttgtattaaaaagatttaatttacaaacgatatatgacgaaaaaaaaaagatttagttaacaaattgtactgttacgaatatatagattttatctaaaactgatttacagggatggtaatattttatagttgacaaaaataaaaaaaggatgacatgataatattttcttatgtttatttttaacgcacaaaaataaaaactagggagggtgtataatgcataaattaaaagttagagggcaaatttgtgctacttctgcaaaacttaaacgatgccgtttgggttgtagggtttagtgcatccgtgctctgttcacttgttccatttcgctgtgtaagaaaagaaaaacgaaactttcggttgtgcgaaatcttaagatcaaag

SEQ ID NO: 3698 - DNA, 2000 bp, Arabidopsis thaliana
aagagacgaatctcgaagatgaaaattggagaagctagacgaagaatcaagcacaatttgccaaggttgatttcaatttgacttagaagaggactcgatttttggttttgagctcaattttgtactttgtcgagctgctataagaaagaagcgacggatcaatttcttgctccggtaacaaatctgagcttcactataagtgattcagcttaaaagattacagattttgcctaaagctcattatttgccaaaattagaagaactcagacgaaatttaattttataagaacaaaagtaaacaaatttgttgagaaaataaattttcgtagattcattctcattaaaattatcaaaatagttacgagggaaataaaacaccgtcgtttcgtccccagccacgtgttcacgtagagatttaaaaataaaaaataaactgaaaattagatatatcacaaaaccccgaagctgtgtaaagccttacccaagcccattagttttataagtaggcccaactatttgtatgttaaattgataaacaaacgtatgttattgcttcgatgtgttcaagtaagtaaaatacaacaacgtacgttagtacggtaaagaaagagttcaattttgatggatcctctaattctttttttatattatttgttattcttcaaatttgttgaagtgcaatagctcaccaaagatactacgagtctacgataaagaaagagttcaattttgatggatcctctatttttttttttttcttccaatgattctatgtcacattgtaattctacctaagcctgcatgcttatgtaaattgtaatcacgaggaaaatcagttttagaaacgagcaaaacctcactcgtatacttttagtttacgcggtgtctccgaagacgatcgattctaattataatcggcattacattgttgatatatggaaggttcttcaatgaacagtgtgagtttcctaagaaacagctaaacagttatcggtgatcgctaaaacctttcacagtttgataaagttttctcctgctctagtttaatttcatcaattttggaataaattttatttaaattatttttggcttacaaataaatttgtattggactgttcttgtaaaaattaaaacttttgtaatgaatagttgttaaatataaatattttgatagttaaattattactaactattaagaatttagtccatatttaatttaatatgaactaaattctttgtttttgatcaaaaaacttataaaattaaacgtggaaaaagatccgatcctctcaaaccaaaacaatgacttggttcgtcacattgaaaatcaaagagagtgttaattaatttattaaatatatcatgttaggtttgataaataaaattgttattctgaccgacagtccaaatcccaaacgcgttccagactacaccaacctgtgaaaataaacgtttaaaaaagaaagaaagactcaaagaagtaaaacaaaagtaattaattaaaatttgaaatagtagccgttacaagaaacttgtcgatatttgtatcaaaagacgtttttacacaaaatgacgaaaactggacttatcaataaaactaacacgtcttcacgtttccttgagaaattagcacatctaagtaaatgtctacacgacgtgcaatgatgcttttctttctctaattttttctttttaataatgactcagctactttagatttatttttgaaaaaattcactcacgttttatcattcttttcctattttgatataacttgataaggtcatttttgaattttccgtttactaattaagaaaattagaatattttatcatactctctttctctttccctctatcagatcatctttctcaaatagctctatttagatattcacatacatatccagttgtgattctcttccttatataaacctccacttaactcatcttcttaaaaacaaaactaagattgaataatcataaagaagaaaactaaga

SEQ ID NO: 3699 - DNA, 2000 bp, Arabidopsis thaliana
tacaattgcaatacccgctaattcagcaggaaactatgacaactggtttccgtgtacggaatgactctcttgcccgcatcattcttgatgatgtgtcatacactacaaggcaagaaaaaatcaataaataaatcaaagttaatagtagtatagtatatagtataatctgttttgctcagtcatattcactcaccgtaaatgccaaagtgaaagcatcagtttgaagccagttagcttctgtttttttattatgtcatattcaaaatcattcaattattcatatgtcaataattactcggttacagggtgaaattttataatctgattcgtatgaaccaacgactcaaaagtttagctagctagtagctactcaaaaaaaaaaaaaaactacttgttaaaactacaagtttagatttagacatatgttcactagattttgacagctacgcattccttaaaatgtctgatgtttaattagcatgatttactaaaatagacttgtatttattatgttaaaacaaaatacgcagtttttgttcgctgaaaatgttccaaaacaataatattctttaagcgaaaaatagaaattcatataattatattacagttaagggaaacaaaaagaggaagaattcgttggcaacaattgacaaatacctaaagcgtgcgaggtcagtaaatcacacgcttgagcagttagtggcggttagaacggtaaataaaggagacggaattaacaagtaatcacgttaaaaaaagctaaacgaagaatcaaattgtgtaggagacgacgtcgtatagatacataacggccgtctgtcttaacggctctttttggtgtcgtcttcttttatttttattttggtctcccaccagattctataagaggaccaatatatctccaaactcgtacattcactgtctttaactctcactactctctctctctctctcctctgttctaattctctaggaacagagtaaaagactttggctcagcttctgcctctccaatggcggttcttccgacatggcttttagcaatgatgtgtttactcttcttcgtcggagctatggagaacactacacacgacaacatctcttctctccctaggtttttatctctactacaatctctctcttatttttttatgaaatgttaagatccatgtttctttcaatacagagaatcagatttttattattatctgcattagtaatttgatatatttttcattctcgagctacattttgctcagattccacaataaatcttccgaaaataaattcttcgttttcacattagttatttgttatagttttcattcgttctagctacattttccatcggattccaaaaataatttccaaaagtataaaaatattaaatttactgttttagttctattcaaccgacaaaattatcaacgagagaaaatagtttttgtttttttcaccttttcgatatctactacaatattccctcccttcttcaaagtaaatgatctgagccgttaaattgtgttatgatctagatccaacgatctaaaccgtacattccgctttctttctttttgctgcattcagtcaactttattacgtagctacacttgactctgtttcgtctattttacccattttgacctccgacaatgcgatacgttaaaattgttccatagggttgttttcgtcatttaataaacctgtcgacgacacttccttctctaacggtttctccggttagcgaattttatggagcagtgtagtactagtgcagtgtggtgcattccccaataattatattaaaaacattacttattatatactatagtttctcacttgtttagtagcatgtgtcaatcattaatttcctctagattctcaatttttggatttctaatgatttcctaacaaatattagatccgacgaaaccgaatggaaccaacacgcagtgacgaatccagatgaagtagcggacgaagttctcgccttgacagaa

SEQ ID NO: 3700 - DNA, 1222 bp, Arabidopsis thaliana
tatatttaaccaaaggatccttatttggtttatttcatctatacaaagaaaaatctcagtgacttggcaaaatgaatttataagaattgcatagaaaaaaagatgtaacttttgagaccaataaatgttgcatagattcttgaagataaaaactagataacggcattcgaacacaaccacaaaagtcacaaagacattaacaacttaaatttccagtacatagagatagagttgcattggaaatttatgtcagtcacatcacaaagattacacttacaccgaaaaataaaagaagatacatttctattgccttcttcacatgtatatttgtcgcgttttgtgagtggaagaagaatgaatagaaaagatcggtcacttgatatgtacttttctttttaatggtccaagaaaaccactaaaaccctttaattatattctcttgaactcagactaaaggaggaaaaatggaaatgaatcttatgtctcttttttccatttttctggtcatagttttgacaacaagctataagtgataaatagaagatcttttatcagaaaagaaaatacaagctatagtgatagaccgctcagaatcagcttataataaacgtaactttgatgtatatccgtcatactaatgttagaaaagattagagatgaattttataatatgattttgaattcacaacgcaagatatccaagcgacttacccttcattaggaaaaaaaaagatatccaagctaccaaaggagcttcccaactttagaataaagaataaaacgccgtatgaatccgaaacctataataatcataatttgccgagaattttgtaaattttgtcgttgttgggtcaaacgtataggccttacgttatgaaatgtttgggcctatttgggccaataattaacatcatcagttatagtgattggtcgctcccctcgcatggaaccacatccacatgtgagaacaaatttatgattgtagtgtacataatataagtggaaatatatgtcggtcacatcacaaggaaaccgaaaagagatatttcttgaatctttcttcttcacatatatatatttgtcacatagagaaaaagatcgatcacttgcgcagttttgctacggtcaagagaactccaaacaccttcattttttattattattttttcttgaaaaccaaatcttcaaaactctacactaaaacgaaaggcgcaaaataaaa

SEQ ID NO: 3701 - DNA, 2000 bp, Arabidopsis thaliana
tatgactctttggattattttaagttgttgtgtctttctttcagcttctaaaatccaaactaattaagcaattcaaaatcatttagaacgtttttttgtaataaattcaaaatagttttaaagaacatcatgtggtttttgcgctaaatacaaatgtctcgttgtttttttttttagaaattaatatcccattaataattaattactgtggagttaagtttattaacaggttttagttcagggtttgttttactaaaaacatagtttagggtttaaaatggatctggccaaagttaagggtttttttcattaaattccctaatttatattcaaaactttcaaaacaagttaaaggaaataaaaccaattaaggttaaccaaaaaaaacaacagatttcacgcatctcacgcgcatagtgacattgtacatacttgtcatgcatcgtctcttccacatggatacaaaagataggcatacaacaacaccatcatcatgaaaatatgtacatgcacatacatacatacatacaacgtcttaggactagagagcaaagagggtagggaaaatttgatgctatgtttgggtaggccactgtcacagagcttaaagagaagtgctttctttccctaagttagcaaattaccccattttgtcaaaattccgtttcttctgacaacaacacttacgttttacgaatataaatagttgtagcatgatttatttttgttaccaatagataaacatatttattcttatcgattgccattaggactagggattctgataataattgatatgtcttaaaatttgcagagacaacaactttgcgtgttggttttctcatctgtttgtgtttagccttagtctgaaatctgaatgcatttaagtttttcaaaactaatcactttcaatcctttttaattgtcaacatctacttgtccttttaatctaatccaagaatattgaatacagaaacatgtttacacaaagaaaattaggtggtaatgatatgaattagagaagtgtaatcaagattccatctcatattaaacctatttaaaagagttgtaagaaaaaataataaaacaagtaattatttacttataactatgcatcaaatattacgaaacttttaaaatgaattgttaatctaattcaatcaatattataattatctatttaactaataatatttatatggtggcaaccaaagaatatatatgggtccaactggtaatttagatgaattgtaaaatttttcggaatagttgcaaactataaaaaagagttgtacgagaaagttgtataataaaattgagaataaaactttttataacgtttttgataaagattttataaatgataactgtcaaagttgtacaaactctaccgctttgataatgagttatcaaagacataaacttttatcctagttaatcattttaacttttagaatttaagctttgaattaaaattcaagcttagctttgtataagaaaaagtttaaatatttttactttgccttaacagtaaaaagcttttaaccaaaaacattgaattcaacctactctcccaaaaatttcacctttaattttttttgaaaacaatatttaccagtttagtgcatcttgttgggttgttccttgtcctttctctctcagaaagatctttacttttactttttcagtattttcctctctcttctctctcttctctctcttctctctacttagctgcctcgcttttgctccttttacctctttccatctttcaatctcctttgagagagagagcaaatgaaaaaaacccaaaaaactcttttctccaaccattaccatctcatgaacactctcacaggaggctctctcttctcagagagcctacccatctaatatttcttcatctgagtctcttttacttctctcaaagtatcgatctttattcttctttttgtaaaccctctctctctctctgatttctactgacctgtttggaagat

SEQ ID NO: 3702 - DNA, 896 bp, Arabidopsis thaliana
attggttttaaattctctttctctcattctcaaatcattatttatttttgcttttccttcttcttcttcttcataaaccgtttattttagttctctatgtctgactgcataatttattccaatcaatatctggaattgtagtgtaattgaaaccctcaccatgaatggttgtagttcttagattggttataagtgtgcgactagttttgaattttcatttgttgttgtatgattcgtttaaattaaatcacaagagtctttgggtgtttgaaaatctaactgaaatagtgatacaattatatgtgaaatttatcgtctcaaaaagataaactacatgagtaaataaataaaaataaaatcattgctctgtattttttgactgcatgagtcctaattggtgaaataaaaaaacttttggcacgagaattaataaatatatagaaaaggtgaaataggtgaggcggtacttgctgatagaatcagaagcttcgagactgacttgttttagattctctgactataaagaaaggcaaagtaacaagtttcgttttctcctttgcactccatttttattctcgattctcttctctcccgataaagaagctctcgctttgtgttgtccgtccttcttccaggtctaattccaccatttctctttggttaaaccctaatttctttctctcccgaatcgtcctctgtttttgttttgcgcgattagtttccaccgcttaataatagggtttccgatcacttacgttttgtgttgttttgttcggtctctggttcttccactgtgatctgttttgttcttaagttgattgtcttaagttatatcctctgttcaataatattctggtcttgttgggggtttccacaggttttctcgtctctgacgc

SEQ ID NO: 3703 - DNA, 2000 bp, Arabidopsis thaliana
cactcgatgtttttgccaatacttacataaaagctattggaggatcactaataaatgattgatcatcaatcatcatgctttgcggactctctttttcgttgaggggtaaatgattacaaataaacatgcgcgcgtggatataacgcacttggtcagtgcgtgtggcacaagtcagagtgaacacgtgggacagccagatcacactgaaacacaactccgacatcttgtcggatcttatgtaaagcgttgggtcccacttttcataatatctctcaccacgaaacccatctttttgctctcaattattgtcgctcattgccgtatctcttcataatttcactatatacatgtctacgttaggcggaaattattaaattgtttttggaattttagtttacatgttatttttttctaaataaacatgaaatatatttacaaaagtatatccaaaccatcatttttttattgtttacatatacactaatgacacttttatttggattgtgaattatgattatgcaacgatcactagtagtttactagaacaattaagtttacatgcttcaggcattgtaaaacaactatttacaaaaactgaagttagtctacaactagtttttgtgaaaagaaaggaatattagacgataaaaaagtaggcagcagttaaaggaatcaaataattaacaagttagcattgattgaggcggatggttacacatgataaggagcaggcgagtgaggaaacaacacaacacgcacgatcacgctgttatgacccacatgctcctatctccatgttactgtacgcaaagtggttatacatttacacacacttgaccaatattgctcacatttaaatttttatttctaaaggaaaaagcacaaacatttaaaggttttactgacggaagaaacgaaaaaaagtagtagctttaaaatgtcattgttgatgaaagtagaaaccatgatgatgatatttatgtgcaaatattcatctcacacgtatatcattggttcataaccgttggttggtccacaactttgaacaagttcagattctttttgattgtgttttgtaccaaccactccaattagtcaatattccattatatccaacctcaaatactattttcccttttctctttaaaaaatatttggacaaataattggctacactattggagatttgactcagctcggtatgccgtaactaatcaagatactattttctatactttcttttattgatatccacataatacatgtactttgagtataatgacgtgtacttgattaagacaaaacgaagtacgagaattattgtatttatcaactttgagacatactacatgatatggatcatgaaaattaacacaagtagtgcaaattgcgttatccatatacaaaaaacatcgcaccttgatgattcacttaattgtagattactttctcagagtggtccggacatttctattggttttaaagacattggctttaaatcttcagacacaaaacacatatacatgtgtacacttgaaaacatattggccatcttatttgttttggacaaactgccatcttattatgcatgggttcttgtaaggaataaactaaaaatgtttgtgaaagaaaaagaaaaacacaaatattgagaaagtacaaaaagaaagacatggcaaaggccaaaggggggacacaagttggagataaagtaatacaagtccaaaaacaaagaaacaataatgatggattgtaattagccacctgacaaaatctctcatcattcaaagtactatattaatcccctctcttcttcattaccatctcacatctctctctatttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaac

SEQ ID NO: 3704 - DNA, 1809 bp, Arabidopsis thaliana
tttgcatgaaactataaactaatattatgtaatttaggggtatgtgttagtgttcctgttatgtaatcatctacattcaaagttcatgtcaacatgttgataccaaaataaaactatcaatcttataatctgaagttttgttcttatacatttgcaggaagtaatgggagtattcaatatgaatgtgctgctccattatccaacatataggaacatttattctctttgggccctcacactatacacgcaagctctacggcggcttcagccttgagaaaaatgcacggtcaattctaccttcaactctttatatatccataataaaataaaagagagatgttccatttctctgcgcaagcaaactatggtcattgaacaattacatattgtgtcaaataaattatgtaactgaatattgtatcaaagcgtttattaaactgtgcgggggattttatctcattttctttatttttttgaaataattttatctcattttatcccgagtaacatatgtttagttccagcagtcgtcgcttgctatatatctctctttcatacatagagaacaaatctcactattttgatttattattatgactatagagtatcttcatcagtgaacaaccactcttttgaatatctcaaaaccaaaataattaatattttaatatcaaaaacaaattgactatttaaaaggaaacacatggtaaataaatgttaaaaggcctttagtgtccatagaaatacacatatttctcattgattcttttaattttttgtattcattttatattttaaaacctcccatttttatgatcaatgggatggtctaaaagactaaaatacccgcatatttatatcttttttaaagttaaaattgacttgttattttgtaattttttgttcatgtagagatcattgaattattttttatgtgtcgaatgttgtaaataaagattaacattatctacctttggtgatgggacgtacgaaaaaaagtattaacccataataaaaaaattgctctccaccaaacatttaaattatggggttggtgcatcacataaccacacatctaaactaaactaacgtatgaacatacacaaataattgaatttgcatggaatatgaacaaaacaacgtaaactctgttttattatatttgtagtttcagaaaaaaaaaatttacaaaataattgttgtttttcatttatttatttaaaaattaaatgtattaaataaattttttattaattatattttacaaaataattgttgttttcaaatttttattagttgaattaggtgtagttaatgatgtttttataaaaaaataaacattaaataaatttttttttttttttaatttatgtaaacaaaccttaaattataaatataatgaaacaaatagagtatgtgacgacgaacataataaccattattaattctctataccactattagatgtgtgggaatatgttggtctctacttcatgtaattgataagattgtcacactatatataacaattttttatatatatatttatctttatatatttaataaacctataataatgtattgttcacctactcctcgtataagttcatgcgtatacagttcggcactaaacgtattaacaatgtcttgatcacctactccacacacgttttaaaaacactcaaatatataatttagtaaacaaaataaactccagaactccactatcttacttacgttattattattatatcagtggtttcaaggactcttctttctcatctgcctcttctttgcttttcagcaaca

SEQ ID NO: 3705 - DNA, 248 bp, Arabidopsis thaliana
accgttttcatgtgtttggaacgctctcaaattaatataaaccacacacagcgtgccgctttttgtttttcttatctctttgacctttcagagagaacgaaacgcacagcctctcaggtgaagacacgtgtcatttgttccttgacttgtcactttcataccttaatcgccaagtaacgtaaaagataccgacatggccaaaacctacgaatctgaaatttgaagaagcataagtttgtctattaaag

SEQ ID NO: 3706 - DNA, 1704 bp, Arabidopsis thaliana
gtatactagtccttatcatatcttgatattagacacaagaacattttaatgaggcttaacttaccttcagcaaatctctggtcatgagtagatgtattgtataatctggattagatactaaacactaataaggaacatgtgaaattgttactcatattgtatatttttcttcatctttctcggcagaagctgtaagcgcagtagtagcgtttatatctttcttgttcactaaataataacaccttttttgtttgttaaatgactatattgtaggtcccatgtttagttcagggatgtgcactgaagtgtttcagtttgatgtatcctcaacctctggagccatcattcctgcagctaccaacgtctctgctgaacacggtaagaacaccacagacacacacaagcaacagaacagaagaatccttcgtggtcttcccattccactcccaggatcagattttaacctcacgaaagagcaccaaagaaacagcagtagcaaagaaatcaagcctgcttcatcaatggttgtatctgtgcttgttgatcccagagaaggaggtgatggagatatagatgggatgattgggggaccaaaatcactgtctcgagtttttgtagtcgtgcttctggacagtgcaaagtatgtaacatactcctgtgtcctacctcgatcaggagctcctcatcttgtgaccacttgaagacatatgaggattgaaacatatatcagcaggtcttctctcatataggctttgtatgtaaaagaataaatacctgctctctggtatcacgtaatatccttagctaataccgttgtccggtttttgtttccagatgtagaatccgaatgctgtaactttttttttttaccttttataaactcatagccttagaaagttttatcaaacctctcatatacattgcaaaagtcgatgaccaaaaaatgtcattctacaatagaagctgaaatccaagtagacaaaagtgatcagttagttgattccatggtttgagccaagggggcatcggtgatagcaggagaatatgagcacacaagtgacagaagaagaagtctttacctgaaggtcgacggagagagaattggattagcatgaaccctcagattcatgaacctgagctcacttttaaaatttctttatttcattgtcagaaaaagagagctaataatattattatttaaatgtaacaagtaggcctataacacgtgaacttccctctttgcaaaaaaaaaatcatcaaaaacttttacctctcattggtttcttctttatcacactgttacgcttggattctcatttcttcaagttcataacgctcggatcaatcaggaagacgaacttgaactttctttttttcatcattacccaaagctatgaggctcacaccaccaatagctccgccgtcatgaatccttctcttccaggtactgtgccgtctcgggataacaaactttctatttattctcttctgatcggatctatctatcgatgaagattgatttcactactttagtaacatttcatctgatcgatctgtgttgtgttatcgaggaatcaatctcattttgtagattcaattttctggatagattttgtatctcttttccatagctctagtccaaatctagtctccactgatatctgagttttgttgaccaggtcaacacaagtcagagctccaaaa

SEQ ID NO: 3707 - DNA, 2000 bp, Arabidopsis thaliana
aattaaaatacgtgacctatagaccatagaaacaaattatttagtaatttttttatggtatatagcaaatggaaattgtttttatggttttcaaaatttttttttctggtcaattttttttttatggttttcaaaaaatggaaattatttagtaatttttttatggttttcaaaaaatgaaaattatttagtaatcaaaatggaaattatttagtaattttttatggttttcaaatttttttttttctttcttcccgacctctctcccctctccttgttcgccctagccgtcaaggccatcttcctcctcgttttggccggtgattggtggcttccatagcaccgtcgccggtcctgttcttagtagtttcagtttgttgtctcttagttattctttgttctgattttagtttctcaaaccctagtttcgtcgtctcctcttcaaatctctcttttttgtggtggttccgatgtgatgactatcatggaggatgggtggcggatcggtgctctttgtagtcggatctattccccggtggagccgtctcgtttcttcgatctagttatggaggtttgtgtttccgatctggttctaatgtctcaactatcggtcttgttcttgttagtttgagaattggacttgatttgttgtatgttccggctggttctgatgtggatctattgagttctgttcttggattttgttggctttgcggtggtgctgtctcgtttggggcgtgtatttagtcggcttttcgtttccatgagttagttctgtttatccctttagtattgcagcaacggcctctttgtatgcggattcttcttccgtttttgagttcgagtgacttctagggtttgtgttttgctgtgtttttcgactggttatggtttgaagcctcaggttcagcttttgggtaggcttgtttgactcctagctctgcctatctctctgtcctcctcttggttttcggtgtcgtggcttggtggaaggttctgttttgtgggttcttcaatcggatgctagcctcctataatggcatctactagctctctgttggaacctcttttggtttcccggctgagttctggacgttgtggtgggtcgatctcttgtccttctctttgcgtggcgtaaccaatctttagtctgtaggtggctttggctgggtctacgaaggtccgtgtgtaaggatgagtggtcctttttagcgtttcccctctcggatctcaaggtcttccttgatccttcgccttctcatgttcattggcgctaaagcggttctgatggttaggttctgtgttctgatcttcttgtttcgtcgtcttcgtttttgttgtggagatggttgtgtgagctcgtattaaatctcttttcaagactcctgtcagttgcctctcctcagcgccaaactgttctatggaagtgttagtcggcggcttgttgggaagagttttcagtgttgtagctttggaggctttagctattaattctgtagctgttatctttgtatcttttcttctaaggcttgttttgtttgttcaccttttttggcctcatgtctctgggggtttctatgtacccgccgactttgtctccgaaaggattttttccttttcggctatatataactcaaacgcatccaatcaatgaaatccgtctaaaaaaaatagcaaatggaaattgttcctaaatctttcacaattttccaagtattttttcttttgaataattttagttattatcctgataatattttttatgtaataattattcgaaacgtgtcacatatatatacaccaagcacaccatttttgattatcatccatcatctcactcactgatatttatacattcaaatatttatttattttcaagttttacgcaaatctctttcactcttaaacctcataaccttagagatcatcagtcatcaatcatcttcttcgttgttatcacttctttagtagctctcaacgagatttctccaaaatcagcg

SEQ ID NO: 3708 - DNA, 828 bp, Arabidopsis thaliana
agcttcagaacacaagaacacgcgagaaaaaagatatttgatctgtctttccctaagacctatatttataagaaacaatctcttcgtgatttcctttttttttggtccaataaattagggttttttctttttatattagttttgcatttataatttttatgaaaaaataagggaaaggtggaagaaaatattaaaactaatataaaagaaaaggaaaaagtctaatttgactacattcacgcttttggatataatttgactacacaaatcctaaacttaaaatatatatttatcagaatgattataaaatatcaatatttgttgatgtaaaaaccatcattacttaaaataaaaaatagaaaacaaaatatttgggggtgggagggtaaggcgaggaaacggttaaccgcagacactaatctagtttcaacagaaccacctacgaaccaaacccaacctcctggtctactttttggagacgagcctcttatgtagccatcgacgttttttcattatttttcgggggaaacgccggcctaagacccccagtaattaattcccatagttaacatgagagggttcagggtttagcaatcaataagcagactcatctcctaggttcccacaccccttaacttatttgaccaaacctttcttcatttaaacaactcaacttcaatctctatcttccgatgtgggacaaagtgctttcttactgaagcatttattgtaacttgttcgtcactggtgacgtcaccattctttcttataaataaatcataacctattaaccttagtccataaagaagaagaagctaacgaaaaata

SEQ ID NO: 3709 - DNA, 2000 bp, Arabidopsis thaliana
gatgatgcgatgacgttcaacatcattaagttctttcatttatttacgtattcgtaaagaaaatatattatttcattttgcatatgtacttacgcgattaaacaattccacattactacgctttatcattgttacttaaatcgtttattagtggaataattgtctttgtgtctaataccataaaagatagtactaaagtcttcatatgactagatcatcccttccgttttttaacgttaattcgtatgttacatttcaaatcatttattgtggcttattaaagatatactataatgtaaggatcggagaactaatggtgatcatgtaatgaaagacaaaacattgtcacatatattgtaattatttttggttttcgttattaattaattgttagtatcttccggattttgattcataaaccaaccaaaaacgcgtctcaggtggttttagcgtacccgacgttgcaactggcttatctttttcctacacgtgtcttcctctggttggtattatatcatacgtgtaaaatggacttttaccttaattaaccgcatcttatggtcatcaattcatttcttaagctacttttttaatttatttgtatgacttttcttatcgttacttatttgattaaacctttcttacgccatttttttttctcgacaagtatgttgcatgaattcatattggagaaaaattaaagatcaaataggattgaaattgtttggtaaaccgcatccaaaaccgcaccgcaacagtgctgtaacagtatcaaaatctctacatatacatatgtatctatgtattttcgttactatttgaaccgcactgcactttttccgcaccgcaaaatgcagtcaccattcggaccctaagtttagttataagaagggcttcttcgtaaacgcaaaagcaacgtacgtcagcatgaactggtggaagagaataaagtatctggaagaagagaaggcagtagtgaccaatcattggtacttgattggtttacgccacgtcatcacactttcctttcacagctgtataatattcccctcttcttgttttttcttgacaaaaagaataaaaatcatttttttcattttcttatttttatttcggctgatcatttttccagtttctggatacattttatgattttaattaccgaaccagatatgggatatggttataagcgtcgtcatatggatattgttgtcgccattttcattttgtctttaactttgcgaacgttgcccacttgccactttatttacttgtgttaaagtgtgtaaaataccaacaccaagcaaatatgggccacaaggcccgacaaaaatgatctgttgcgttaggattgaaatttgaaaggcctattatcatttaggctcactcgtacctcgtacgtattgctattgcctattggttgtaacaagatcaacttttatgtaattaccaatattaaacttatagtgttatacaacaaatagtgaaataaaaacaaacatgtccattaatatgtcatcatatttgtatcataagtagcaaaacataaaaaaaaatatatataaaaaagtcatcaccatccaccatcatctccttttctttttgcttcataaacatgaaaaccaccatacatttatctcgaagccaaaaaagcaaaactgtccattatccatttaaagcattacaataactaaaaaaataagagtattctcgtgacccacactcatatggaccctacataatgacgtggatgagtcctacgtgttacacaacgaaacgttcatgtcctccctggctttcaacccaaactcatacattacaccctctctctctcttctcttcaatttccgtcttctcactctctaatcttttcgcctttagttgaatctctgggatcattctacctttttgtggatttaggatcgaagaagagatcactcctactgttgaattctggttttacttgagagagtttttcaattctgatctgctgttttgcg

SEQ ID NO: 3710 - DNA, 615 bp, Arabidopsis thaliana
caagaaactgtgagtcttccagcttcttttaggcctaccttgtagtcttggggttttgtttctgttttcgaataatggtaacctttgtataacttatttcagtatcgtctcagtttggtactatgtcagttttggtattcttatcttattgaagtaaaaatgtgatagtgtattcgcttttctccctgcagcgttctagtctcgtccaggtgaaaggagggagaccttagacaagaaaatgaaaagaacatatcagaattgtcaaattgggtgttgtagaagaatctaaagtgtttatgtctatcgatccttttctaaacgagaaatttagggatgaaccagaaagaagaatgtataaactgtaagaaacaagtgtgcttttgacaaaagtttttttatttgaatgttaatttctgtgtctttatcacacatattaagttattatccacaaaatgtatctcattggatatttaaaacaaaaggacaataatattaaggaaaagacaaaatagaaaatgacttggccactgtagccgcgttaataatgtgatagcttttatctacaagaagcgttacttggtcgtcatctaccttctcagaaagggagctgcatca

SEQ ID NO: 3711 - DNA, 1785 bp, Arabidopsis thaliana
accactcacaaaatgtttctcttgattctgttttagttactctccaatgtgattcatttgacgcattgtgataattgacatgtttttgttttttctccttttctccattgatatgatccaatctaagatcaataaatagatgtcaagtcgaagggattttggccatcttgcaacattaacaacccacgttatgtatattctcaccttgaaaaacagaattttgcgaagaattatacgccaaatttgtaaaaatatttggtcaagaaaactctcgtacgtgtcatttcatgacatatattgtagcacaagttgtggtgacctactgattgtctgatcgatagcatattagaaaagaaataaaatgaaccttaaaagtcaaatccttaacaactactagcaattaacaaacatgtttgaatagaagtttcaagaattcacattgaaaactttactctctcttttcaaacatgtttcatcaaacggaaatgtaatatttagtccactaaatctctaattaaagtcagtaattgatagttacaaaattaatatgcttcttccatcggtatgaattaattatgatgcccaacaggcaacaactagctaccaatttgatttctaccggctttgatcaacctaaaccggaaataaatttctcggtaatgtgaacacagccgcaacattagctgaaaccaatataattacgacacgtgtatggcgggaatcagacgccgcaactttaattttttaatcggaggtaacccctcgccattgggaaagacaaaaggagatttgcatggtagcgatcttgaccgtcgatgttctatcttagagatctaatggttaggaatttatggcggtaccacccggtcaaagtaatgcgtaccgtcgatatttgacacgtgtcggtaatttagctccggtttgacagatagacgatacgagagattacctggaaacgccggtggccaaccaaataccgaacgagacaagcttctctctctctttctctatctatctttctctctcaaagaaagcttttggaaattgtctttcgtcaaattctgttcttcttcttcattaaactcataactttttctgggtttttcgagaatttcttcgaaaggatcttacggtaagagaaaaggaaaattaagagggaataagaagattcatcatcattgtcatctgtggggaatctcagagcttttttttctgtagttttgttatctttctgaattctctacctgcttcaagatttcatttttattcatcgatctttggggtttagtttcaaagctgaattctttgaggtttctgaaatttgcgagctgggtttttgttgaaataggcttctgagttttggttatatttgtggataatcgattacttgatctgacctgagaaaaagtagaaacctttgagtagagctggttctattacaaagttgtgtttgggagcttgctacaagaccattggatttcttcactttcttcatttgttgagtctgctacaagatcaaggatctgttgattttgggtatttgatcaaaatctgaaattgatcttgtggaagtaaggttgctgtagttgtcaaggtctttggtgaagtttgtttctcacaaagtttgatccttgaagttggtctctattgatcttagatctagtgtgaataaaggaagtccttggaaagcagcagacttgaaaacgctatcacaagaggaattgcttcctgaagagactgtctggattgctgatagatttatatgattcagagaagaactcaccg

SEQ ID NO: 3712 - DNA, 2000 bp, Arabidopsis thaliana
aagtcattgtacaaaacatcgaacgaaaattataacgtaagcaccataaaatgagaaaaatacacaaactatagtgattgacgatgcttttgacatataagtcttactcgttaacagattattaaatctatttttttcgtatttgatcttacgcttatgcaaattatgtttctggatagcatttcttgcttaaacttccatatcgcataccgtatttaaaaccatatgcttctgataacagttatgaaatatcaacattatgataccaaaacttccgtatcataatcactttaactatctttgactttgttttctctcaccattatatcccgagaataaattatgacgtctcagtatagtatgagccatcttctgattgcaattatatatatatcacattgttctccacatcatccaatgatagcatgtatccccaacatccatgtgtatctcttccaacaaatctatctggatcatataactcctacttttatgtgtcttggtttttagagccacacaatcctcaactagagagtttcccaaatcttcaaaaaatccgaaataagtatcaaacaatatctcaatttgattttcttctataagtaaaagaaagatgaaatgtcagtagtgatgacaccaaacaattttgggttgaggaacttcaaaatgttttcaagataacaccaatcaattgaagggatggtgaagaaaacattcggacctgagtaatccttattataaatcccagagaagatggtaaaatcagtgatgatcaaattacttaccaatatgacgctctctaaagatgaagagaaagaaaccgtcatcgttttcaaccaacaaattgctataaccacgaatgtgttctttagagacaaaaccaattgatggagatagagtttgtgagaacgataaagaagatcggcgaccaagggacacacgatggagagcactttgatcgatcgcgttagtagtgaagatagaatcgatagaaaatcgtaacaaaacttgggaatccagaacctcatcttgatagttagagagaagtgtgatggtgagcgatcgagtaagcggataataaaatctataaaaatcaaagttcaatcgctagtgtcaccttttacagttgtaactccgacaatacaaattatttactttagaagagaattaagaaaaaaaagaaaaaaagagtcgccgacgaaccgacaattgtcagtgactctaaaaacaaatatacaaagataaaaaaccaaacaaaaaaataacaaaattaaatttctttcacgaaatatatttttctaaattatcaaatgaaaaaatatttttttacgctctttaacaaaactctaataattagtttttttttgtgaatcgattgtaaaattttttagttatgttgagaagaataacacaatttttttttcttttacataaaaaacttatgtgagttttataaaaagtaacgtgagttacataaaactcatgtagttttataatttgttattatgttgctcgtataaaaatttatttacttaatattgtaacaaaacaaaacaaatttttttgaaaaaaatcgtcataaaaaaaaagtcaatataatcttttttttgtcaaacaagtcaatataatcttagtagtcgttgttgtacaacaaacatctacaatatacttttctgtctacccaaataatataattttcctcttttgtattcaaaaaaataataatttatctctacatgttggaaatatcaaatatagtaataatgtttttaagagaaaaaaaggaaaaaagaaagtaataaaacattctagagagttccaaactccacaaaacctcaaacaaaagcaaacgcaatttagcctcttcataagagagaagtcctctcagagaaacggcagccacatcaaccaacccaaacatcgaaagagagacacttttctctctctctttctctatctccttccaatctctctagggttttcgttacaacggcgaaaag

SEQ ID NO: 3713 - DNA, 836 bp, Arabidopsis thaliana
gattcaagcttcactgcttaaattcacaaaaagagaaaagtaagaccaaaggaataaatcatcctcaaaccaaaaacacatcatacaaaatcatcaaacataaatctccagatgtatgagcaccaatccagttatacaacactcttaacaccaaatcaacagatttaacagcgaaataagcttaagcccatacaattatccgatccaaacaaatataatcgaaaccggcagaggaataagcaagtgaatcaaaaagtatgggacgaggaagaagatgatacctgaatgagaaagtcaataaccttgacccgaatcgttttgaagaaaatggagaaaatcggttgtatggaataaaatcttcgaatgatgagatatatgatctctttggtgtcagtcacatggcacacgctatcaatttagaaaaacgcggtggttggtcaccagaattactacttctcggtctgatttggtcatatccgtattaagtccggttaatattttccataactggggtttgaacattcggtttctttttttcagttagtccgatttggagttttgagtatggaaaaataatactgaatttatttgttcaaactgttttggaaaaaatatttcccttaattacgaatataattaaaattttaaaattcattttattagatcttggttaattcggtttaatgcattaatgaatttcggtttaagtcggttttcggtttttatgtcccaccactatctacaaccgatgatcaaccttatctccgtattcaccacaaacagtcatcactctcacttgacacaaaaactcttttgtctccgtctctctgtctctc

SEQ ID NO: 3714 - DNA, 2000 bp, Arabidopsis thaliana
tacactaaacatttagttatgtccctatttaaaccgatcaaaccgagaactgacatctagtattatcaaaataaaacatttccaagaatttagtaagatatttgacttttttggtttgtttaatttagtggtgagaattagaagttaattattttattttgaacttattggtccaccttgtttttcgatgataaatgtttctctagccaaaggtttattggttcatgtttgtgtttaaatttagctaatgccttcataatgtctccatatactacactttgatgtcttagattcatattactacaaaagaacttatgaatccgagaaatgaaccatctcattgtttttctaatagtcatttccatatattttggtttaaatgaaagttggacagtagtaccatggggttgcaaggataacacattagaatttcgaaatgaacttgctcccaatagtattctcaaagttaattgcacatctaaagacaacactatatccgtccacgatgtcttattcaatggtaagtatgaatttagtttcggcgagcatgtaagcaaaagaacaatatggaagtgtcttttaagacaaggtcaatatcatcatatcttatggaaagcatatagaggagcttctaagcggcgatgtcgtcaaaaacgaacatggattgcaaaaattgatgggatttacttagaaaaaaatagtggaccgcaaacacgtatgcatgattggtttaaaaattattttgtgttttttttttgtaaaaaattaatatgcatgtgttattaaatggatttaagccgttttaagtgatcttaagaaagtgtatttttagtgtattttctaatatctaactatacagacataaatctataacttttaactcaataatatacatatttataaccgtttatatgttgtttgatgtgatttaagtgagtgttgttgtctaatttttgtttagaatttatcatttttaacacacaattttttatttattttttgtcggccattttgattgataaagcccaaattgggcagattacagaaggtccaaagaggattacatatggaaattaataggccaggcccaaaactaaatcaaacagagaaataaaatacaattaaagtatagttgatttagggttggacacgtatatgatacgtggtcttcacattgccacgcgtcagatgcaagctccgccgttagttcgccggaaaccgctaaaaactccgatgagccaccaccgatcagctctgaagcggtgaacgtcctctttccttctgtggatcccaattccaaactgtttcgaaattcgctgaacatcaccatctccagggaggctccaccactgactacatcgagaattgatgtaatctgttctttgctcctatgacatgagcaaaaataagtgacgaagatataattccacaaaagattagagagatcagacgagatttggaagtaaaacagagggcttcgacatcgcagttgtaaaagagatctaaaccagactttgccggtaaggaaatccgatctaaagtcggaactttatttatctcgcacagagacgagaatatgtacaaatccggacaaaccggaatcaaaaaggatgaacgatggtgtctcctctctgaaaggtttggggagagagaagacaggagaaaacccctaattatattttgtcttagatctagtttttttaacacacaaattcttcccaccaaaaaacacacacaaattccaacattaaaagtgaatccattatccatggactttaaaagcccgaatgaacaaaccaaacttaaatcgaagcccaaaaacaaactttcagattcattttcagtttctttcactcttcatcttctgcaaactaacccactggcttagcctaaaccctagtagccacagagacgaagaagaagaagaagcttcaccgttttacccttttacgattgttctgacctaccaacctggccccggtcaatctccgtggaaagaa

SEQ ID NO: 3715 - DNA, 461 bp, Arabidopsis thaliana
atccaaagttgattctttactccacaatgccagacattgttcttttatgttacatttataagtcatgtattatccgatttggaggggggggatatggatttccgaatttttttactttgataaattttgtcaatatattttgttgacagaaaaaagaataatcaatatactgtatgtggtattattctaacaatattttttaaacgtataatatgattatgtaccaatatttataaccatatcatatgattatgtacttttgtaaaaaaaattcacaccccacttaaaacttggttactactaattggatcttgcaactcaattttctaaatcgcattacaaaatactgaatgagcaaattaataaaagattagtcaaatgtgacaacgaccaatgaggcatggccaaataaaagcttgaagagactattcaaagttaaggataagaatcaaagaaagaag

SEQ ID NO: 3716 - DNA, 1461 bp, Arabidopsis thaliana
tttttttattttcttttaataaaacgggagacgcagtctccctcattctaccaaaaaaaaaacaatgcagatatttgcaaatttttcttctttttagatacagagtatatgtaggcatgtagctaaagatacttgatttggtgtgattttgatcatctggatgtaaaaggtatggtgatgcgtctagtgttggagcacttgaggctttggttattggtgttgtggtcattgttaattagtaccaatgtgaagcacctttatcgatttcacagggactggaccatagtgatgcttgagtgacgactcttattcgtcgtggtctaagccgcctctttatcatttttagggctctttggtcgactaattttattttatttttccctttcactagggtttcctgacttgttaaacaagctttagctctccgattaacagctaacagctcttttaccactcagaccctttatttttttatcccggccacctattatttattttgcttgattttatttcattaataaaatttataggaaaaaagaaaaaatttaaaaataagaaacaagaggtaggctcttctagcgaactcctttcatacgttttctctctactctcatcgcttttcttatctctctcggagctcttccgtcgtccaccattgattacggtaagattcaccttctcctactcaatttcataactatagataaataaatctctgtcttctctgcctctgttagtttttttctacgattgaaaccatcaaatcaattcaaggttttacacagtttcttatgcttgtcctgattgtttcgttcccggagagggagaaattacggcttttggaatccgcccagaaaatttcccgcccagctcggattttgatagaaatgttttgcctttttggtttctgtaaaattgatattcttattgtactttgattgaagtatgtgtgttcaattgaaattgatgttgtgtatttcttaagtttgaatctttgtgtaaggattgggggtttagggttttgactcatgattgctttctgcatttttaaagttaaaaagccagactttgaggcttagagctacttatattgtgttgcagggagtgtattgagctaaatatggctataatacaacttggaagtacatgtgttgctcaatggagtattcgtcctcaatttgcagtcagagcttattatcccagcagaatcgaatcaactcgccatcaaaagtatgatttttaagtctctggattgcattcagttctgtggctttaagcctttcaagtattttgatttgttcacattgcacatcttaagattagtcttcgtagaatgaagtttgtattatgtgatttctacactgagagttttatatatgaaatagcattaaaggttttccttttcacaacttttacagttccagtagccaagtaaattgtttgggagcttcaaagtcgagt

SEQ ID NO: 3717 - DNA, 2000 bp, Arabidopsis thaliana
attaattgagcaattaataaccgaattagttagttgaatatgtatttatcatacaatttgtggttgtactattgctattagccaactgttgtcgtctatctaaatcctccaacattgaaaaaaacaaactaaaacaaataatacattcgtattaaaaaagaaaacttgttagttggttagtagtgaaggtagttacgacaccatccttaaattaattttgacagcttatgtctttaatcttgtttaacccaagagtctaaattaaagacgaaaaccaagtttgactgactcttccgatatatgcatgtacactatatcacatatctatatgtgcatgtatatatgagtatgatctatatgactatagatgtatgtatatgtgtgtacgaagcctatgagatcatataattggcttatgtaacatctcatgtaggttgtcctttcctttgtagtgtcgtgtcttatcgtcaactgtctttgattgttaatttgtatagtacattttaagtaccttgtactaacgtgtgctaatgcggtttcttacatgtgcgtctctatgatcaatggtgtattcaaattgttcacttaaacacacctttcttcaaattcttaatgggattgcacatttgcaaacctaactcactaaacttcgatcatttctttatatgctagttctttatatgctagatacgtataacggctttcagaagatttatccaaatggaaaacttttatcatttgcgaatcaacaccaacattttttttggcttttttgttttctatgcttcccaacaattatgtgataggtaaatcaagtagatgaatatttaccgtttaaagtatagttttatatgctctatttttttgtttctcggtgtggatcaatggaaaattggaaatcttctactattttttcaaaccctactttttttactaaagtagctatagctaaaagaaacaccttagtaattcactaattcttaagctatgtattcactattatattcaccatcgatgtatactacaaaagagtggctcgactgtagaaactcgagaaagtccgataaagtaatataccccaaacacgaatgctttatacttaatatttagtgaaccaattaggtactcactcataaaacgaggctaaatgcattatttttttaaaatccatatatttggtgcccaataaatgtaaacgccgagttgtgaggaggttaatcatttcttgaatggagttaccagaaacgatggcttgaattcatccttttctcatactaggatttatcttattttgtatcaatatgctattcatttttttaatgaagatattatacacatactgatttctccacatttacagaaagaagtgtgtagatatatatacatgtagccagtgcacgaatctaatctacaaatactttagttttatctaaatactctcacctttcacgagtcatgatgtaatctaaccgctatattttaccgtactaacatcttttaccatttctaattgtattcatatttcatcactgttttttaccttgttatgcgtaatcaattgaacccatttcttaaattaattcaaaattatcaatttgccacgtaattgttatttacataaaatattaaatatcttcttcttttttgtaaaccaaaatattagaatatcttcaaacatatgaattcataaaagtcccgagtagtttttgtatttttcacaacgagagagagagagatcgagtataatacattcaaaagtcatctggctatatatggtatagtaggtagttaatacttatacatatattttaggtatagcctacaaaagaaaaaatctgctttctaatttttggatgtatataataacaagacaccgacctcttcttcttctcaacccaaaagaacaaaaaccaattttatttccttctctcaaatcttcccaccaaaaattaactctttcgttcacactaagtcccttttaaaagaaaatatcccaatta

SEQ ID NO: 3718 - DNA, 608 bp, Arabidopsis thaliana
tgattaccgttgcagtagatagttgttcagggaacctttactttcgatgtctctattgtgacaatacttatttcagtctttattgatacaaaataaaatgtaaaaaacaaatctgaaatcatttccatttcaattctgcaaaaagatggtttatccaatttcagcctaaacaaaagtgttacttatctgttttctcattgactcaaaacagttgtctagtgaactaactcgtagacataagtaagtaagaaaccaaacagaaagagcttaaaacatcttctgattttggagttaactcatgttattggtgggagctattttaaggacatttgttaaatcctttaaaaagaaagttgttaataaatccccatcatttgactttggagatgcactattctacacttcaacctcaacctcgtgagacatgaggattaaagtaaagtaatcacatttctgtcacatatgaacaaataaagttatttaaatcagaataaaagcgaaatcgcttgaccactcaagaagagaaaaacgctaacaagtcccatagtttgtgtttattggacttctttcctctcatcttctccagcagaaacaaaaaaagctgaaag

SEQ ID NO: 3719 - DNA, 916 bp, Arabidopsis thaliana
aagaattatgcaaaattctccctaatctctgtttatgtctctcgtaaacgaggttttaaaatactactctgatgttttgttcctgtagttttttttattgtgttcatgaattctcttcagtggagaatcatgtgagtttggtagaacaacttttaatgttatgttaagtctggtcctttgctagactttggttggatccacgtttgaacttcttcatggttaagaatgaagacgttatttctcatgcttatgtgcttgtttcatcatttcaacctctttttattgctcctcttagagtcttaagtccataactatgaacaacaaacaaggtatcattacaatgccaatctgaaggtctaatcacgattctcatggcgatactgattcaaagaaactcatattgtgtctcaatcaccacattcaccaaacaccatatattccttactgtactactattagtgtattgaaaccaggagattcagagccatttttataaattaactagatatgtatcttatacctagtgtgaagcactgattgttggaattaaatgaaatttcgagaaaatgaacgagttcgtagtttgatggtaaataacaaggtctttggtcaaagcaaccaaacaagttgttgaatttaattagaaccaaaccaatccacccaatttcaattcattttggtaactaaccggtttataatcattcatacccaatcggcgtcttctaaagaatttcaaaactctaaaaagttaatcaaacacccctctatttcctcataattacatatctaccccaaaccactttattctcctttcactatcttccccaaatttcaaacgatcagattacagattcttcaattcctctttcccttctcctccatttcctgattaaggcttcacatctctgagagagaa

SEQ ID NO: 3720 - DNA, 1226 bp, Arabidopsis thaliana
gaaatagtcttgtcgctctcaaagttctatatctaataaaagttctcattctatgagtttataaacgtaaacatcaatgagtttgcaattccatattggagatactaatctcgcacatatacaagattcggttacacccgctacgccaacaactcacaccaatgtgatctctcattctctctcataaatgaaatgttatactattttttgagaattgtagcattgataggatagattacagtctatatgtctctgattttaaatgttaattgtaacacaagatgattatattgtacatatttttgttgttgttgttccgtctattttgctgattatacttgtttattgttgttcttccgtgtctgtcgtgttttatctgtttgtcttaaactttgtattttatatcttgtgatttttgatactacacgacaaaaatgaccttgtcgtgttttatcttgtgaattattttattctttcgctattagattaatccattttgtgaataatttgcgagcaaggccctcacacacataattataccttttgagtcttgaatcaaaaggctgtcaaaaaaaaaaaaaaaaaaaaaaaatcttgaatcaagttgatagatacatatgggcttgcgtgatcttgagtcttgaattcataataggcgaatttgaatcttgaacgactaatcgataacaaacaaacaaaaaaatattatataattggttagagtagttaactctatcacgcttaatgagcattttatatttgtctttgaatgacaattcaagtaaatactttaatttcaaaattgatggatcgttttttcattgtacttttcttcgaataatattagagataatcttccacacttaaaatagattaatctcattgtctctcatcctacataagcttcttactttaatttgtctacatccctcttgtctcaattaagtattattattaacgcttcaaattcttactacctaaacacgtgaacagtagtctttcagtagtcttttaatttgcgagtgaagttaatgaaaaaaatacaaaatggtaagttttggtcaagattttgactattaaaattaatatttgctcttgaccactaagtatatttttgtcatctctttattatggctaaaaattgacacttatctaatactcattcattggatatatatatataatgtgtagcatttctggtcagtgaaaattgacatacaaggact

SEQ ID NO: 3721 - DNA, 2000 bp, Arabidopsis thaliana
tgtattacttctttagaaaaaataatgtttggactaaaaagcagactaaatattcattacgaatgatgtgacaccattttcatttgttagcttctactactataaaaaataaataaaggaatcaatgagtgcacctttaatttttttggttaatcaacgagagcacttgatatcaagtatgacgataaccaatcaaagtaaaaaactttggatgtctttttctctttgctagtaaattaataattatacctaccgaatttgtaacacattacacattgacatggtgcatgtttaatccaatactatcgacgtcactctatactccgtaagtaatagtatatatacattgaaatgatccattataccatctgataaatttttgtgaagtggctaaaaatataaacagtttttttttttttgtgagaaaatgatgtaacggagcataattattcgtggaacacaagaacatgtaaccaaccatgtagcacagcgttaattgagatggtccatacgaagagccgtcaacggtgggaatggtcatctcaattctcatcagggcctagcgtataaaaatactttagagacgtgtaataatcacatgggatctttgggaccacagtctaaatggcgtacggtaagttcaagggacccgttttacacgtggacccaatcacatgttgtcagttctgattttcacgaaaataatttcgaatatttttgtaagacattaattagtgggactaattgttattttctgatctgtgtaatcttattatgatttaagaatagttgccgtaagcgacggcgttaagtacatactacaattgtattaaccaattttatctacaaatagcaaaaaaaatcgagactatactttaaaaagaaacgattacaacttaactctatcgtaacatgtaattgacaaaatagtgaatgctatttaagtgtaaagactgaatgctactatttgataattactgttattttgaaatgggtttatatatactgcagtttacttttctacccccttgctcgaaacatgcctacattattacaaaggggaaggctagggcactcaaacagtatgatgaaagcttttagttccccatccaaagaacaaatataaaagtcttttgtaattaatgaaaatgttactagttcttatccactcttacagataaatactaataaggtttaattttttttttaaagatcttataaaaaatgttagaaaaggagctttttcttatattcaatttaaattttttaacaatttaaaactaaaacgggaaaacgtcatagtccctcaatctctttttaataaaatggaatattaatttccataatgggtttaatgatggtttacttttcccaatacaaaagttccattttatttaataagactatactaaatacttaaactttttaataaaaaatatctgtattttagatcaaaagttacaatcacacaaaaccaacacaacaaactccttaaaaaagcgacaaaaagtaaattgtaccactagttgcatgacaatctttttagttgttcaaaattgtatgaccatctaaactctaaagtaatactaactttagaaaatattaatctgtaaaaagctatatattccctaatatattagtttattaatttcaatatattccctaattacaaattttggtgtgtgtgtgattttcagccttatctctttgagctgtagatgttgctgttagccctctgatccatgattcatcggacatcgagccccatcacgagcctttttattctcaacaataataatcattttttttcttataaccttcctctctatttttacaatttattttgttattagaagtggtagtggagtgaaaaaacaaatcctaagcagtcctaaccgatccccgaagctaaagattcttcaccttcccaaataaagcaaaacctagatccgacattgaaggaaaaaccttttagatccatctctgaaaaaaaaccaacc

SEQ ID NO: 3722 - DNA, 511 bp, Arabidopsis thaliana
atcaatctttgaaacttgttctcatgttcttgttttgcttcaattatgttatttcttgttttatatatttttctgctgttatgtttgtgtttgtgtttatgaataaaatgaaataaattatgtttgtgttttcttgaatcatactattatcttttagaaagaaacaaaattttgtcgctcactatcacatttagatttaaatttatgacaccgcacatgcactagccactagacactagtacacgactaaactacaattccaaagagtcaaaatctatcaagtattttttttttttcaagataagatttcttatcgtaatataggaaatgtgtggcttaagatccacgcatgattaaaacaaatccctaaacactttgtctatgaaatataaccatctgcttgtaaggtcaaattgttcaaagcatcaaataagtaaataaaaactcttttatgttcacctttttcactatcctctctttgtgtttcaaatcgtgggaacaaattatcaca

SEQ ID NO: 3723 - DNA, 2000 bp, Arabidopsis thaliana
tttaaaaccttttttttattcatttttaatctttgtaaaacgaacttatattatgtttgaacaaatattttttcatacgcaatccttagatggggaaattaatacctttgtaacaaaaaaaaaaaaaaaatgttaaatcaactaagtattgggtgagtcttctcaacgaaaacatcaatcaacaccggcctcataagttgattaaattaacacatttattataatcatcgtacattgatttgaatcaaaattaattgttacgttaattagtaatgcatctaactatcccgtaggaaaaggccattatattgggatccgcggtcaacggaggttccacccacgagcacggtctttatttgttttttcctttctcaaatatatatacggatgtatgattttttgcttttggggttaaacaaatatgaattactgtgcttagatcagaaatagacacttttatacaaatgattatatgattactgttcatagcataagctcctatgaaaacaaataataatcgcaacagccgtttaacctaatcgaatgctgaaaagccctcaaaatagttcatctaatccatgaatcgatttaacagaaaaagttgaaaattgtatgcatatgatatactcaagtatattccgagttttgagttgtgtaatgcaaggagtcaaggaccatagtttgtcgttgaacacaaccacgccaagttgtccaccaaaactggaaactaactaccatgccgttgtttccatagaagcaaaaccattaaccttcccattatcccgcatggccacatatatgtttaataatatttctcaccatacatttaagtctctctcgtagtcgttatttacatagcctacgtagttcattcatatcatttttgtttctttaccttatatcaaacaaattggttgttgattagaaaaacataaattggttcattaaatatcaaactaacgccatcaatctattgtttttttataaaaaaatgaaagagaagaaagtttgttgatatgaaacttacacttgctttgagttttgatagacaaaccaaagcctaactagtatttcctctattggtacttgaattctgaactttttcaccttccctttcgaggtggtttaacagtataccagttgagatgtaccaacaccaaattcttatacttttttttcttttaaccttgaattcagtattttaaacgaaactatgggaatgtgtttgagacggattttcattaaggacaatgcaaataattatgagatgctcagaattgttgtatatatcaaaaagccaacacctatagttatatatataactttcttcgatttaaaaacaataagtcgctttggccgagtggttaaggcgtgtgcctgctaagtacatgggctctgcccgcgagagttcgaatctctcaggcgacgttatccttttcgttttttcgtctatttttaaaccgacttacatagacactgcgtataagacaattgattccttttttttgttgttaatcctatcaaccctagaaaaggcttcacgcccgatttcttttttccccagaaaaaggcttcacttccgttcgttgttcttcatcggtctgcgccgcctcgcacatcgtttcacctttctcagaatctctcttcccgtcgattagtttcctcagaggttagcttcttcgatttctcagattcaattctgctttttgctttcctcctgttgtttttaggtttttgtcgatctctatgttcagcgattcctaaaccctacttgttttccgctctattgtagtgaatccaacccagatttttcagattttaatcggaattattcgggatctaatgctcgcgtcgagtttatcgctagaaaaccctaatttcggaggatctgtcacttttattatcagaagcttgttgttgtaattacggattaggtatgtcctgatcgttattgttctttgtttgcaggttgcgatttgttgaaaaccttgatttagact

SEQ ID NO: 3724 - DNA, 2000 bp, Arabidopsis thaliana
atcccaaattttaatgttttttctttaagattagtgaaagtttcacatatgtatctttctcgtccaattgaatatgttattttccaaatataaagtttgataagcgagaattatatcaagacgataatagaagttaccttaattcaaattgtggaaaaatcatatacatatgagtaattggaaaagtggaagatgagccgatttatataaattttgaattttgttaattgtgaatgtaataataactagcgaaaacattaagaatttttatgcaaccgtcaatgatttcatgggatctttatcaaaagatcaaattgagaaatattcaatgacatctgatgcatatcacaatctttgaatgcaatatagttcaatgcgcttatcgtcttgcttgcattattacagaacttattgatggtattgggattttgtatccagtttgggcaaataaagccatcagatcactatcttgcgtgtctgtgtgacatgtaatgagtttagcttggagacttcaagcccattttctagagtcaaatttaacgttgcatttgatttagaaaaaaaatcaaaagaattcttgaagatcttgaagtgtacctcatacaaagattaaggattctagaggaggtgtttgacatttgaatctatcaacattactactctctccgtgtctcttcaattcaatttagaaaacaaaaatatattcattgctttaagtactttgttcagtaaaacatagttcttattctcttttatcagtctcactctcaccaaattacctacaagttaagattttctatccacataaaatatcaaaattgaggactgaatcatgattttatagataacactacttcaaaatcttactatattggaattagatatgattcataaattcatgaaatccatgaaactacaattttattcctagtgtatagttcgatctatcaaattgtatatgggttatcgatatatttggatgattgacacgaaagaaccaagtattttgaataaacttttttccaaaatattaataatgcatagtacttattaaaaaatcaaaaagaccttgaaaaagagaagagattgaacttatttatcaaacaccagatcaccaaaaatttggtgcgaaaaaggtatctagtaactagtaagactatttaaaagctctcattaatcaaaaccagactattattactcttttaaaaaaaagactagacctcgagtgaagaaataaaattaacagtcaaacttatttctcagataccagaataccaaaaattggcgcgaaagacaaaacgaaaccaaaaaatgtagaacaaagtcaaacttatttcttaaatatcagattaccgaaatttaaagcgaaaaactgaatatttgataaacacttaccgaaacctctcactaatctaaaataaagtatgtatcccttaccatgttcaaaaagagcgcgaatgaaaatatagaaaacggtcaaatttatttctgagttaccagattaccgaacatttaccgcgaaaaacagaaaaacggtcaaatttatttcgcagataccagattaccgaacatttgtttcgaaaaaacagagtatctaataaaactttctgcaatcttacaaccattacaatttaatgtatcattaacacaaaactcttaatttcaagcttgataaacatctattacccgaaaaataagccaatccaattaaaaacatatccatagatacaacaacagaaatcaggagatacgcgtcaagatctaagaggatgaaagataaaacttatcgtgctctcctcctcatcagattcattttgcggactcctcctcatcttattaaatccgcttaattgtttttgggtccgccctttttctctttcacatctttctttctctcgcaaacccaaattctctcagcgccggtcaaatacttgtctctctctctctctctctttcactcttgtcttgtctccttcgaagctgtttgttctgtaagaaag

SEQ ID NO: 3725 - DNA, 1295 bp, Arabidopsis thaliana
acttctaacgcaatatctatgtatttactatttactctctgatataaggaagctattcaagattactatataaagttattttattgttctagaaactgttaagagttgtcacttgtgtgagtgtaaacctatggcagttaataaagattaaaaagagattttaatacatatttttatcatcttagagtttcacgattttcttgagattgatcctcgtagcttgttgatgatgatttgtggattaaaaaccacgacatagcgtattgcggaagtgctgcttgaactaccgatttgacagaggacctcttggataattttcatttctaagcttttagacactttacttatacatatctaaaactactagttattttggaaatttggaaaaatgataatggtatttttttactatcacgtgtgaaaattcctcttaaagaatactgatctttcaaagtacttcaattttgaaagaagtaatgaaacagtattagaatattaatttcctttcagcttaagagaagtggcagattctccctagaaatatgttaagttaaacatctgtaccctcacttttgtaaaacctgtatcacatatcaccaaacataagtagaacaaaggatcatcaaaagacaaaaaaactagagcaatacatgtgattagcatgtaactttttcctttgtatgtaataaggaaagaaaagtttttgcttgtgtagtaaacaattccaaaagtcatatattcgaaaaatataggggcataattgttactctgaattctgaaataataagggtgaataattattggaagaatctaatatttatacttggcgtttttgtttcgacagagtgtaatctaaaacttgaattttgttattgttgttttacaaaatcaggataggcttgacatggaagttatcggagctggacttgtataaataagtgaatcaatcaacgaaggataacaaaacaaaacataaacaaaaactagaaagaaaaaactatcagtggagaaaactaatctgattaagtcactctaaacaattaaggttcttctcatacctctctctttgtttcgaattttaaattttagttttgtattgttagttgatatttgtcatatattgcatggatatataggggtagtgtggtatactctctgaatacatctcttaagttcataaaaataaagttactatcctagtagcaatctcaataattttgtttaacaatgatctcttcaagaaaactcaaatcaaaggtttaaatatttcctctctcattttttattttcctaga

SEQ ID NO: 3726 - DNA, 854 bp, Arabidopsis thaliana
acctgtttatttggttaggcttggttttgctattgaagctgaaataaccaatcactgacaagtcctttttagcggatggatatttcgggtttataatcggaccaatcacttgagtcccgattggtcttttttgaactatctaaactcaaacaaaaactgaagtgagtttgaccgcttttggtttcgggttatgaccgcattcgtttacgtgcaagtatatatacttgttgggttgatttttcttgaatacgacctgaattggtacaacggacccatgcaaagaaagacaatcgagcctagaaatttctgaacaattatcgacttatccatataaatgctataaacacctaatatctcatccatatccacatttaacactttgttttttctaacattagtatgctactattcttcgatgccttaatatcggatggttattattaggtagttatatttagtctgaacactaaattttataatcattacccaaaaagtaattagtcacgttttttacttgatctaaatttacaaatgtacaatgtctttacgcgctaaaaataacaattgtggacaaaaaaaacttagcagacaaaattgaccacaagtgataatatctaaatttggatttgttcaacgacacaacacgtaacgcgtcttcccgtatcttgcgtatgactccttgagagcctctctttaattgtcctataaatataagtctctcttgcaagacttttgaaaccacaacaaacacaaaaatcaaaaggggtcatttactatcttttaagagacgacatatatagttctcgaccaagaaaagaaaagggggtgacctgagttcttcaacacataacata

SEQ ID NO: 3727 - DNA, 1504 bp, Arabidopsis thaliana
aacagagagagagagacttcagtttgggcaatctgttccccaacgaagaaaacaaggatctcgccaatgaagggatacctacacgagattagaaagaaaaaaggaacaaactttgtgggaaaatgcgtacggacagaggaaccccaaatccggtaaatacgtgaacacacacacacaaacaaagtaggtcaatcgattttcagacgcaactggaaatatcaaatctcaaagtaagtatggggaaattaaatatttctcacctgcctaagagaaattgggaacgaagggatccgcaggatgagcctgcagactttgttggaagctctcacaagaatcagattcgcctctctctcaagcaaaaacgttttttcgtttaatattctcaaattcaatttgtgaaatacagtactaacatttgttaaattatttgtaaaacttttctcggtttcgccgcttcaacactgaaaatttgcatattttatttgcaaacaatacatacacgcatatatcgttaattttcttcttcttccacgcacactttatttactgctgaattcggattgtgtcattagtcattactcactcattactaatttccacaaacctttgtatcttcatcgcttaagactataattgatgatgggattttcggatatatgaacttgaatcccatgggggtccagatatccagatggttctacttgcaagtcttgcaaatctaaatggaattaaaactcggttgatttttgtcaaaaaatcgccaaaaatataaaatggtaagtaagtgggcctcagaaaaatccattagaaagcctagaccaaattttggagtgggcttcataaaataaacaaatctggtcatcaaggtcggtacgtcggtgtgactttgcgagtcatcatcgattatccaaaaacaataactcctctctttactttcttcccatgcaccaagaatatattttttttattattatttattaaacaaaaaaaaaagtaaagcagcagaaaatctaacgcacgactcttgtcccaagatcagtctcagtcatcatcaaaacagaaaattttattatccattgtaattttatttttttcttacaaattacaactcttttttttttcattcatggaattggaatgaagaaatgttttaagccaatccaaaaaagaaaccgaaaaaaaaaaactagaaattaggaaaccgttagcaagaagagaagaatcgagacggcgactaggaaactgctgggaccagaaaagaaaggtgacccatccatcattcacttaattagatacatactgtattacttattacaataatgcctatatatattctcccaattcatcatttacttctttacacctccactttcccttttgcccctcttttttacagatttcactctctgctctactactctctcctcctcctcctcctaaagaaagttcttaactctcctgggttcttcaggtttttccttttctggaataaaaagaagaagaa

SEQ ID NO: 3728 - DNA, 2000 bp, Arabidopsis thaliana
aacgtgtaaaagaatgatacaagatttgactgattctatttgttaataatttttaaatttacagtatatgcctaaatttatttggtttaactaactaattttaggataattagtcaaattagatgatcatatatggttaaagctagtctaatttaattagactaagtacgtaataaggttgttcttaaaccgaaaaaaaaaaaaaagtaagaaggttgaacattcacgttggagcagtcaagataaagatgaacaataagaatttctttttaaccttggaaggaatctaatctcaatatatagggacttaagattccactaagtttgaaccacacacatcgaagattgtaagattctgttttgaagaatgagaagttggcattacaagtatagtcggtacaagttttagaaagcttatccaaatgtagtttctttttgaagctgtttgtgcatgtgacaattttttcgctgtacattcctaatctcataaaatgagaaaataatcaaagaaataatatattatgaaaataaaaatttgttttaacatgtttgaaaaatataacaaaactattttaaatcatactttagttgaaaataattgattgttaaattacgaaaaattttataaacatgattgaaaaactcataaaatgatagtttttatcaacaaactggtgggatatggtgtgaatcagaaagtgtcactcgcttgtcaaaaatgtgtatcatgaatgtatacgaagcacatatatatgtaaggcaacacttcatcatgtgaaataaaagctctcaaaataccaccattcggaaattaatcatgtagacacacttacaaatgtattttgaataagctcactgcaacatattaagcttacttttttttttttcgcccaacatattaagcttactaaaagttactgaatgttgaagaactgtcactgccagaagaaagcatactaaagtttgcaatgctcgataggtgattgagaaatatagtctgatatgaagatgtaatttaacttttgcttcttattattattttttcatttcatttttgttgtttattctttctttttcatctcactgaccttaatatctagacttgcctacacttgcttaggtcgctggattagtatctacacttgtctaggtcgttggattagttaagtccctatgaataatctacaatatataattcgtaaatgcctggaaactgatttaccttcgagattttgttgcaaagtgaagtaaaatttattatataaaatttcatttgtcagatcctatgaaataaactcgccgaaatagctaattttaatattcacattacatcttttcaacatgcctttgtaagagtacctttgtttattttattaatctgaccttgagtggacccttcttcactgcgtccaatcttcaagggtgtctttgcttaccataaatttactgatttacaaaattaggtattgaatataaacataaagaaaagatttacctaaaggtaaaaggaaaaacgaatactttgaaaataatttacagatttcagttttaaaatctgtaaattcacatcacagtcattgtcttacgtcattttttgtagtatgaaaataattcataattattaatatgtaaaataactaataatgaaattataaccaaccaaaaagcaaatgaattgcttatgtatgaaagaagatagttgaaaaaatgaccaaccaaaaaattgcttctttatgaaacaagacattgttgaaaaaaaagttttgaacaaaaaaattcttaagaaaatttagacaaacaaatccatctttgtaggcccaaatacaaaattaatgggccttagatttgggattatttatgtgagcccattattaaacttcgtctcttactttttttttttctttttttcttactttgcttgtcccgaaagtcgcagagcgagctacaagaagaagcgaaacacacccagaagaagaagaagaacaacaacgaagtaaaca

SEQ ID NO: 3729 - DNA, 1677 bp, Arabidopsis thaliana
ggttaagcgttttacttatggtttatatgcaacggaagaatattgccattgttggaatgctttttcagatcatcaaaggctcctacagatttcttagggaatggtttcaggcttttgttagaaattgtgtttattgcaacaggtagagaacataaccatagacagatgtatctgaagagataagcttctctatgtctaaagaaatggaccgatacgaataaaacaagcatcattaaagattaaatggtttgtaagaaatactacacttatttatgtgaaattgtgtggttagtgaaaagtaaaaacatcggaatccaaaacctcaaatttaccaatcagcccaaattattgatgctggcgtaatgaatggtatgctgatggtaggcaaaagttggtggctgcgaaaattacaacattatccctctgtggtggacccgaatctgtaatcggaaaaggtggaacccacttggtttaacttttaagcctaaaaggttactaccggtttgaccggtttataatttggtgtttaattctaatcccggatccgtttgtttgttaatctcaaggccacgttatcgccaatattttgatttttgagtgggtagggaatggtggggtcgaatagttgggcctagccctcaacaatgtgtggaactgaagagagtagggtccagctcaggcccacattcacattttcgttttgtagcctttcttttctggtgcttacggtccctctttctggtcggtcgtatgtacaagtagcatagctagtggttcaaacccgaaacaagtaccaacgaatcaaaataagtttgaatcggttacatctagttaccgtcgaacttacaatcatttcgattactttgatctgatttctagttcggtttgtatgtttaatatccggattgtacaagtacacaagtacataagtatgcgtatatgtatgtgaccggtttaatcaaaggacggacgataggaggattttggaatcctggaaagaggattattccatagacactaattagctttttggtggcgcagccttgtgacctacattaatggggtccaaccccaagtatgggcttacagctttttccataaaattaaagtaaatctttttttgcctaaccaataaaaattattgaaaatctttccaaccatagaaaagttaaatttgatcagcgatggaaatttttgtacaaagctaggtatttcatttgggagtgtactagtaactagtaagtactaaccagaatgagtttctgattttggattttgaagcttttcttaggttaaaaaacaagtatattactaaacaataaaagaaaaacattttgtgaaaagagaaataaagtttactggaccccattgtacagatggtcccataataatactgatagaagatagagcaatggaaagtgatttgttcacgtggtacaatcggaatggttctttaaagctcatcgaacacatcaggaccgttgatttttcccgcatcaaaaagcgttgaatactattctcacttgttttcctgctcctatatatatatcctgacgagtcacatttagtaatctccttggacgtgtaacgccgttaaaacgattctttcccattgtatccgcttttaacaactctcgtcgtcatctccaccgtccgttttctctcagctatatttta

SEQ ID NO: 3730 - DNA, 2000 bp, Arabidopsis thaliana
tatacaatattaatcatgtcggagaacaaaaagactaagagtgtaggcgagaccgcgagagttccttttttaaagcaagtagataaaaacttggaaaactagcttgagaatgagagatatgtttatattgcggtatgaatcttttatctatctaaatctatgttccgaaggaattggtggaaaaccatgagctttacatgtaaagaatgatagaccaaacctattttgaaaacataaaacatgtagcattttttatgatcgaaacatatcatagagtagattattgagtattaatcgaattctatttctatgaacaaactaaaatcctaaggacacttggacaaagtgaattgtttttttgtttgttctcctctcctacataaatatacatgtgacatgagataatatgatttctcatattcacgcattgatttgtttctaacatttctatagcatttatgttcacaacttcttgatataatagctgccaaaaaaaacttctttaaatattttcttgtgtttttattgccaaaaacaaacgaaaatatcaaataatttttctcacctgaaatcaaattactgaggatgataatttaatacagatattttgtagaggaccgtggcaattccgtgaataagtaatgtaatgaagggcaaaaatggaaataaaatcaaagtttatgcccaatatctctctccccatctgatgatcactcctttaaaatcaccatcaaagaaattccaattttctcggatttttatttcttatatacaaatccctaaaaccctatagccctctttcttcgtcacctactactactaactccaagctcaagctcctctgtttcttctgtaagtctcaatttatctcatcgaattttccgagaaacaaacaaaaaccaatctttttcatagaaagaatctgaatttcgtgtttatacttaattctgattccaaaaaaacaattctagatctaagatttttatttcttgatgagaatttcactgtagaaagaagtgtatttgttcctttaatttgctttaaaattttggtttcatataatctcaaagccaagagcttgacacctgtgatctgcatagaatccagaacacatcaataatgattcctttttaagaatttttaaattgatttaatcttcttgttggttactatgaaacaactctttttctttcataattagaaacaccaaaatctttatatagagaagaaaagcttaaaactcgatttctgcattttttgtcttcttactctttaaagccctccattgataatcgcttcagccgaaagcagttgattcagcttaattatttatcatagcttctgattcttcttctagctccttcttctttaatcacgatcattaactttaaacccgttttatcaattgttgtgatatgtcagatctacaatgagtagagcataaattcgaatcagaataactgatatcttaattatgtgtatatatgaatgaaagtcatctgtagaaaaagtcgataaggatgtaacatatatatatatatatataagcatttatgtatatatatatgtgtaaagatttgttcttatgagattgtttctttgtttttgttattgcaggcttgtggttaaaaatcatttcagacacagtgcttttgatgactctctgcaacaaacaacagcagctgcagacaaagcttatacgaagctgtatctactgactttgatggtgaaatatcaaaaaccctaaattaattttaaaaaaaaacacattttttttcttcttttggtttttcctctgagggtattcatcatcaatgcttacaaagtacagtgggtaaacaaaacaaaaacaaaaacccatttttttctccttctttaaatcccaaaccaaccctaaagttttgatttttaattttgggggtaaccaaaaaaaaacaaaaccctaattttttttctttagtgatgagattattggtgatgatgaaatgattggagatcta

SEQ ID NO: 3731 - DNA, 785 bp, Arabidopsis thaliana
tagttctgaatggtgaggaagagaaaaccaagaatctcaacggatatttggtcacgttatgttctatatttggccttggtcacaaataaagttcagatgatataattcaatagtggataagtcaaattcaaagtgaagtaaggaataaaaatctgaacatgtggtggttgttttagtttcttgattttcatagtcgattctatctaaatttgattatgcttttgaacaaagtatttctccctaatttaatagtgggaggtcgaccatattccgaagtatacaacagaacctagtggattaaaaaccaaatcactcgttgaaaatttcgactctttgggttgttcccacttccactacaattaaatcaaatactaggcgtacaactaaatcaacggcatcagccccattccttcaacgtatggggtcctctgtgtgtctgtctctccaccgacactctctttatcgttgatcactccaacggaccgtcaggataatgccacgtatatttcttctattatcctctgcacttaacacacggtggactacgtactctcacgctgcttcagattcgtacattgcgatttggaatgtttattatatacccaaagagcaaaactttaggtgggccttaaactaattaatggcatttacgcgtcagtgagagtggagtatataacaatctgaagctgaagaagaagaattgagagataacagagagatagtttcttcttcatccaaaagaatccaatcttttcctcaaaagatagtttctggatcgaacgaca

SEQ ID NO: 3732 - DNA, 1558 bp, Arabidopsis thaliana
ttctagctagctttgttattttctcacctggaaaatacaaataacagtgtgatacatcatgataacattagaaagacgcaagaatgtaaaccccaagtcaagtttctatttttgattaagcaaatgaaaataacaagatatgactttaagttacattagaaaagagattaactttaaggccaaagaatcaaatacttattccacaaaaccatttgttcaactaaacaagctgttactccgaagaaatcattacattctatgaaaataataatctaattgcatccacttagaagcaaaaataatgtaattagcatcaaattaaaaagaccctagagagcaaaacagagaaattacagaggtagacagaacaaacaaaacctagaacgcaacaagacagagcaaacaatgaaacaatctatgaagaagaatactgacccaagaaatcagagaaaaagatctgatggcgagagtttaagagtttaaggaaagaagaaagatacttgcgagagtgattagtggggacgaagatgacaaatttggtagagagatagtggacaagtgaaagaaatttagatccattaatggtggctttgtgatgtcacaaaactcttatatattccatcactttaataatatctataaattctatattgtttatatatatttatatagattttaatcattagaatatgtaatatgttataagcttttgagacagtttacatcggattttaagcaaccaattacaaataaacatcttattaattaacatttttttttatcacataaattaacatttttagattttaatatgttctgtattaagatatttatgaaaataaacatatatatatatatatatatatcttttttaactaagtttattacaaaaaaagaagtctaagttcttgaagttggtatctttggaattggatatctaatacattttaagagcatctccatcagtagtctcttacatagtttctcattaactaaaaagtataaaataataataaaaatagaagagagatatgagagagattgagaatagtttctctgcaaagaaagtaataatcgagaaactatctgtatatgtgtgtgtttataattgaacagaaactacattaacttttaaagtatcttaccaatgaagatggcctaaagcagtatctaatggtttgtaattaattactagccttggagtgcctctttcaatttcagagtttttatttacataaaaagcagcataagaccatggtgatattcatttgtattggacttagtattgctcattgagcttggtaatggactttgaccgacaaaaagaaaaagaatttctgactcatttcaaatggaggtcggtacttataataaaccggtttgaggcataaaccgattgcaaaaccatactttatcctaaaatccaccggaaaaaaaatctccctccaaatatattttctccacactatctttgtcgtcttcttccccaaatgttcttcatcgctcaccacataaaccctagcgatcgatttctccagaaatcaaccaacaatcgttc

SEQ ID NO: 3733 - DNA, 1554 bp, Arabidopsis thaliana
ttcctgcacattaacacagactccataattgatcactttatctctaactacttaggttatataggaagattccaaacacgacctttttttccacacaaacttaatactactgatgggggtctaaaagcatgactaacacaacaaaaaatttccaaaggcagcaaacctaaaattaggaataaaaatctgaggagctaggatacaaaccctatgaatagtttttggtaccaggtctttgaggtattttatcgaacacttaacatgcatacacaaagaaaaagacacggaggattaccgtaaccgataaaaacccatataaatgatcgtatacatggtacaagagcaagtaatcggtaaagtaagaggctttgaagagctagattaccgtttcagttcttctcctccaccgaagagtttggacctcagagataggttctctccagattagaaattttggatttattaaaagcttcaaaattcaacgactttgcacttgtacccttaagttttcaattttcacagaattacgccttatctagaacatatctcaacaattcacaccctcttattttaattccaacatataaaaacccagtgattcaaatcgcaaacaatcttttcagggaatgatgctgtttcttatccctttgtatttcagaattaagaaaaatacaaagattgtacaatttcaaaacttaggggtcaaattcgaaggaaaaaaggtctagaaaagtttcagttttccaatagtttgatcttctcaagagaagtattcatctgcctaatctcctcttcagacaagcttttgctacactgctcaaacttctccttgtcgcacttcaaggctgtgtctctacacgctctgatgcaaccgctaatatcgagcaagtttaagatcaccggacagtttccgatgcttttgaccaatgtgattgctaaccaaacttgtctgtgttcttctcttgatgatcttacaatgcatagcttcgtgattggattcacatatttcacttggaaggaaccgagagacgaacctagaccacactcgccgaaattgacgaggatactgtctttgattgctttcgagagattgaattgtgtaagaatgatcggtgttccttctccgagaagatccttgtccggatccagaaaaacttccattaacatgtatctgttcttaaatcccaccatgcttcttcgaatctcctcgatttgatgataccaagtcggcggctaaagatattctgaacatgtagttagggcattttatatgtaagaagaagaagaagataatcacgtgactccacgtgacttgcttacttatggacttgggtctttgaacatatctgaaatgggcttagttatagcccatttcatctcatacgactccgtgatttgctaactaatgggcttagttatatggtcctagcctagttaatctccaacgttcccttcgttgttcatcggaatccctagaacactcgatttcagcaaaatcaaatcggattcagtgatcaaaagtcaatttggtcgagaagaaattgagcgttgaag

SEQ ID NO: 3734 - DNA, 789 bp, Arabidopsis thaliana
ctacgcagatcatcttcaacctctgaaactttctgcatctcgagtaatccgagtgctatgttttgggccgataagcccaatatttgatgaatcttattatggcgcagttaataattaggaacaagtatttgagtgaggacttcgagtgttacgttgggcctaaaagcccaatatttaatgaatcttattgaggcccagtttatataagtattaaaataacaggtatatagttatccttgtagccaaacatggatttttcaaggcggtgcactttcttacttttctttccttctttctctgtctcctagaagccacttcactgggatcgtctccatctttgatccaggttcgtcttcttcgtgaatcttcctgcttaattttttttttcagttactacttttttttggttattgttaattttctctgatggaaattctccgaaattgaaagttgttaaagccaaaatatttgggaattcaaaaacatttcgatgatctgaatgaggtcagatcgctgagaaaatatgggattataggttattttcgttttaaattttctatgttttgtatgtttgcatgatatatatatatatatatatatatatatatatatatataactaagtcgttacttgattagccatttttgacttatctactttctttttatgttgttgagtattttattgtgttgtttaatggatcattttcaggttcagagattaaacaatttgaaaaatcggagactctgggattgtatggttcgttgttactgatagattacttaagct

SEQ ID NO: 3735 - DNA, 343 bp, Arabidopsis thaliana
gctctttaattgcttcctttaatgtttttttagattttccagtcactgaaataaataaagatgagactaataaccaacttttcacaaagcttcaataacaaaatttcagattaaaaattcctactaacatacacatcttagcttttatgattacgttgattttattttgttaaatttgattacgttgattagtgtatatattaaattaaaatcattgaaaggataatgataacactaataaaaaaaagaagaagaaggttacggtctcgtaaagctttcaaaagtccgcaacgatcacacacgtctttctccgaaactcgtctgagagaggctctgagattcg

SEQ ID NO: 3736 - DNA, 1669 bp, Arabidopsis thaliana
gctccattgccaaaagtttcttttattcagattctgattctccaagaacaggttcctctggaatatccttttatctttgtccttactagagacaataaatttaaaattggattaagatttgttgtttcctgccattgtaaatcctctcgaaatttgtcgaaaaaaatagaagtttttttttttaagtcttctcattggatacaaaaggtttgaaggaagttgtatctactactatctacttatttagtagctttggtggtttttagctgtattttgtatattggttaaaatgaaacaacatttggtttgtttgtctcatgattcgatttgttctatgttttcttttttaactggagaaattgaatgcataacgatgacatagtaggcccatattctttttgactcttctgggctttgaagataggcccacatgttttgttggaaataggctgagaatacgtatctagttttccaatgtttgtgaacatccttcggcctttttactaacagtgttttgcatgaactaatcatagattatatttcatatcgcagcagaattacagaaattgaaacagaattacagaattatcgcaccaaagaccagtctgcggccttgtattcacgggtttagtcctaccatgtcttatgaccggcgagtttatctctagctgacggacttaaaacccaaattttgacacctcaaaatgaaacaatgatcaactaaactatgacaaaaatgattagccaaaacataactaaactaaggtgatactacgatactagtatgaaaaagatgattttatcacgtctttcacgtttgtaccaaaaaggtgatgcgattaattttttcaacaacttcaaagtgataaatagagaggcattgaacaaacgaaaacgctattcattaaatacattgaagctagacgttcttaggttataagcctgcttcttatttccgcgtctgaagataataccaaaaatctggaaaaaaaaccaagataaccacatattatcacgtgacaatcacatgttaaccttgagtcacttgttatctggcacgtgttctcacgcgccggcacattagactaaacacgcaaggtctttagtacacgtcagcaactgataaccgataattactatgacgtggacgttggttaaagaaaataagaacaacaaacacaacacacaaatcaaagtaaacttttttttgtcgtttctttttttctttggtcaattttttttttacatgttttgtcgtatatcaataaactcttaagtgataaaatacatagaaataaatctgaataatttaattcagcactaattatttttaagcatgaaattataataaagagtataaccattgaagattttattttgatacaaagtgaatctagacgctatatgtgcgataaaactgagaatttaaccatcaacatttcacaattatattcagtaagttataaaaaacattacatcaacgacgttcaatctttttaattattgtcacataatttcaccactctgtcgtcatcttttaacattttgtcgtttactccgtttagtctctctctattaaatcgtataggtattataaatatacgttataaattcttcgaatcatttgtgtatcgtcaaaaagattttatcaaaaggacaaaagaaagag

SEQ ID NO: 3737 - DNA, 779 bp, Arabidopsis thaliana
aactctaaccctagattctctttacgaacaagaccctgatccttgaggaaagcggaaacaacagaatcaacagaggaatggccgaaggagtagaaggagacgtgagagttggaagaacaaggagtcgtcaagatcgcaacctgtgaatcggaggagagaagacataatagctccgcggctttactgtaaagaccggtacgacgtttggagaaacaaacggctcgtgactctttcttctgaatcttctcaatcgaaattcttctctttagtcctcccattctgctttctttgatttcacagagattttgagggacactacctctctctctttatagatagtgtatgtaacaagaaacctagaaacaattgtatatataaaaatgtcggtggttttataggagggatctaggcccgtatcaggcccattgcaagaggaaattcaaaattttgtcttcttttggcccaaatcaatttaataaaatctgaattaggggttttgttttttgatttcatgatataaacgacaaaaaccaaaagtacatatataaccagaactcaagagtcttttataataaaggcaaaccgaaaaaacagaaccggttatcaagtctctctcttccttttctatccaaataacatccacttgtaataatcttatcgacaaacaatcgacctataactacccacgtgtcatcacgatacgattattatcctctctgatccaacggacccaaaacatctatctctctttctcgaccttttgtctcctcgatctaaag

SEQ ID NO: 3738 - DNA, 2000 bp, Arabidopsis thaliana
aataaacaatattatttaaacaaatataaaattaaaatttcaaatttttagtttaaaaaatatagttttgtgatgtaccatacatttaaattaaacaaaataaaaacatatatttattgatcaacttaaaaataaatatttaattttttaataaaattataggcatgcagtataccgcggattaatatctagtttaaaaacttaaaaatattataaattaaaatttaataatcatattgaaacgaatgacgacgttttgtaactcccataagattatcgagttaccaaaactcaggcgagagagagagatcagaaacggaagagaagaataattcagtgaagaatgagactactctctcctctgatcatcactcattgatcagatttgcatttttgagtctccatttctgaatcatccaatccgatcgacgttctccggtattgatttcgttgatcgggtttttgttaagtttttaatatcgatagctccgattccttaaccaaaccagtacgtaccatacacgagagagactagcacatcactagctcagctcacattacaccatacgagagagactagcacatcactagctcagctctcaagtctctcatgcgagactcgcacaattcaacaacaacaacataaagcataatccctctaaattgatctctttccttatttatactagaacggagtttgttagagatatttttatatcttcttcaagcaagcttccttctcacgtgcctcttcacttgcacatgtcttcttttgctttgtctcccattcacatgatacaccaatcgtatcagttttcagtcatacaatcctttgtcagcaaacacactttgttagccgatccaaaataaccaattcggtttgaagttcaccgattttcgttccacctctacacggttttttgtagtgaaaaatcgtcgagaaaattatgaaaattgagagcatcgtctcgtgggagagttcaactagatctttatatttacttatgctctttttattgtaaaaaataattgattatatacttcttcattatatacatattttgatttacactgtttcactaattgtagtttccatggtatgaaatcacttttagaaatttgaattatttctatgttttttttttttggggtaggagatgggatcgaacccccacttttattaataactaaaaaaacaatcacacccgaacattcagagagcccgcatacccatttacatactcaagaacaatcgacataacactatccaaagtagaattaaacaaatgaaaatctaagggtaaagtgtaaatatatagctaactcattcgcaagacgattagcctttctatacgcatatgaaatccgtactacccattcctttgaaaaaaagttatttatctatgtccaaagaaaaccaaccaccatctctaagccaatctccagctcgaagtgtatgataccgcgatccagctatatgtgagccataatatgctccccatagttccatggtatcacttttagaaatttcatttatttctgtcatacatattttcccagatgtaatgcatatttttttttttctttttggatattcgaattattcacctttcaagcgaacgacgacgtttggtagcgtcacattgattattatcaagtattcaagttactccaaaacttccaggcgagagagatcagaaaacggaagaaaaggtgatgagagagttagtctcttctgatcatcacttcttcatcttcaaccattgatcggatcacattttgtttatcgaattcaatcgaagattaccgattttgattcgaaattctcctgttttgatttcaccctccagcggtgatcggagaatttcgccatgtcgtggggattaggatggaagagatcatcggagagtttccgtttaagtctcagctacggcgccgatgatctgaacgacgatccgattcaatcaccgtcggcgtctccattcggatctccaacgtcg

SEQ ID NO: 3739 - DNA, 1569 bp, Arabidopsis thaliana
ggccaaagagtaacaaagggataacgcaacacctcaatagccttacgggagtttgtccagtgaagagcaagagtcatcttcttcccccaacttgacgacaccgcaatcagggttagtctggctcttgcggcgagtaacaaaagggaacatggggtttggattggtgtgaagggagcatttttggggggcagagacattattgatccgagatagaggtagaaaagtcccttgttggattttgggtttggcaaagctagagttcctcctattcgccaagggcagcccaccacccactactactctactggactccatcacacacagacactgcaaaaacgaaactttactagttcgtctatatataattagaaccaaaagaaagaaagaaagcttcgaggatgataactgacctaaattccggttctttaggggaagaaaattggatgagcgtgggagagaaaagaaacgacggtgaaagaaactaaaacgatatagaaaaccgagaagaagacgatagtggcagaggagaagaaacgattcaaaaccgaaacttacggaatcgggaggatgattgagcggtgcgaaagagatcgtcgaagaaacagacagagagagagagggttcaatcaggggttaaccgttgcagggaggcggtttttgtttggggaagacgatggtaaatgggccttttgcttctctttagttaagcccattaaagcccactgacatcggcaccttattagaaacaagaaaaatatcttcttttctttttgtttctgcgtcccgttcggtcgtgtccaaaccgctctaagcatatctttttatttttgctgcgaaagtgcgagtgagtccctctcatgattataacaaacgatttttaataataaaagatttaatattgtaatgcatcatttttattcaaaaccaaattaaaaaaaaaaaaaaatgacttgttcttctctacgcttttatccttcttacatgtcatcacgtatgagatatgttctgctattgactcgaaacacatctttctaatattagctttttttgtttgacttcatttttttcaaaaagaaaaacctttttaaaactcattcaatgcttgacgttttaaatcccaatctttaataggataagtttgttttcagaattcaaaaaaacaaaattaagtcgatttcaattcatgataataatctaaacagctaattaacatttggcaaagtaacaataatataactacatttgaaagagagagcaagagattcgctgtggtttgcttatgcataagaataaagggaattaaaaaaaaccaaactcagtttttttcttcttttttaaaaaatttgtgtgtgtgtttgtttgtttgagattagtttggactttggagttttgttcatagtttctcggcaaccaacttctcctctgccttaacgtcatcgagaaatggcgtcttcttcctcttcctcctcctccttttgcactctctccttcccatttctcttgttttcttcctattctttgtagcctatcctccttgctttttttgtgtctgcgttatacaactcatta

SEQ ID NO: 3740 - DNA, 371 bp, Arabidopsis thaliana
tcctcttcgaaaggttacgccaaaggcaaaatcctggttttaaatccagtttaatccactccggtccgacctgaaaatcgaaacatttgatcccgaaaccgaattttatttttaatatattaaatagatatacttttaaaaaagtagctttgtttgtagttattgggcctaatgggctgttattgttgtaccgttatttgcccttttgggctttaaatgatatatcgtaggtcgacacaaacaaaataaaatattggcatagacgagctgctggtcagaagaagactcagaagtacctctctcctctcgtcttcttcctctagaactcccaaaaatggcgtaagccaaaaaatccaccgaaatcgataacg

SEQ ID NO: 3741 - DNA, 2000 bp, Arabidopsis thaliana
ttatcggttaactggtcggtttaattggaggcgtagttttaagaacaaatccgaaagtatgtgtagttttatcgagattaaagttttttatgatggttttttaagtggctaaaagtttagggtgaaaagttgagattccaactagtatagggctgaaaattcagtcaacccgttaattttatacgtactttgtttcttatacataatatatctgtaagcttatacgtactgtaccatggtactttaatttttctctttttggtaaagcacttatatttttctatttccctatagtgtagttaaaacagtataattcgattgtcaatcattttatttatttgaaaatacggaatttatcattgaaaaatagagagtggttggtccatgtgtgagtttatcaaatggaatcagcgcatcatccatgtgataagtacgtggacttaccattagatatgccatgatattagggtatctataatttatattacatgactgctaaattgataatgttacgtaaacgtacttatgtattataacgtttgacttcgaccatctttgaaatttcaaggttatatagtaggttgaagagccaaatagttatgtttataatattgattatcagtctgtgtctggaatatggatatcaagcaatctaaataaacttaaagaagttcattaaccttcatggaggaactacaaagagattttgatattttgttcggttgaagtagaatttagaagtcagtcctatacttagtcaactataaactgtaaaacagttaacttcaaataccaaatactcatagataatctagttatcatcagcgtaagttggcaacttgcaacgtaccacggaatttacgtaaatggaggagcacttatcagttgatttcgtacgttgtttttttaagataaatcgtacgttgaattttcaacaaaagctcattgataatatgatattcgaattctacattcattgccaattattaagacaacttgccatttggttatacatctatgtaataactcgtataccaaagaactattttatgtaatgataatactagctattctcacgagacgcgttataagttgtacttaaaaacaattgcatgtaatatatcacacaattacatgtaatatatcacacaattacatgttgagttttattaaaaatgttttatttaacatgatgcaaaacttaggtttatgtactgcgggacgactgtttctacacttgatatttatccaagttttctatttttaaccgatagttttatcgaagacaagaaaactatttgggttggttaaagtggttggaaatagtttttctttattcaaaaaaaaaaatggtttttaatgttgctacactagtcttagggtctgaatgatgattgtcgttttgcggtgcgggagaagtgcagtgcagttcaaatagtaacgaaaatacatagatacatatgtatatgtagagatcttgatactgttacagcactgttgcggtgcggttttgggtgcggtctatgtcaccattcatagccttcttcattttgttatgtacaattaacgccaatttacctgtaattaaaccactcattggctaaaaaactatatatatatataacttggttgacaagagaaataatataaaacttgggatagtgagaaaaagttataatatttgaaagaaactaaacacaactacctataagtcacatgcacttataggattaacttaattatcatatgcctgaaaactccgtatttttcgcacttcttacaatcattgaatcaatcatcaccaaatcatattattattttcaacgttttccgctaattccaagtcatatctaactaatttatgcatatatcttaatccaaacaagctctttgagttctactataaatagctgctaaagcctaagtcttatgcatccaacaatcttcaacttcttctctaatcaaaagttaaaacacctaagaaattgaaagaaaacaaa

SEQ ID NO: 3742 - DNA, 2000 bp, Arabidopsis thaliana
gttgatgatgggctttgagattgagagagttacgattatgatgataatgcagttcataatatgaatttggattttggaataggactaattaagtaattctgatcattgaggtgggtatcaaggttcatacaattcgtgattttttgttttgtctttggtatttattaattttaaaaatccattttggaatgaaatttgtgattacttttgtttatccgaaataatagggtttattttcctctataatgaatgtatggttctatgttacacgaaaagctcaaaactagtaagtgagtttctttctagatacgtgagctttatatgtaaattagttactgttacattggaggatcattgaactactggaattataatggtggaaaaatatagtataaatgaataagactagcaataaatatcaaattcaacaacaactaatactgattaagttctataattattccatgttttttttgttagatataatattccatgtttctaataaaagcatgttcactacttcacttcttctcggttcgtgaatatatataaatagaatcttaagacagctactttggttagggaatctcttagttggaatctcgtgaatgcacctctagtggcttgcacgcttctgaaatgtatattgtcatgcttttgatcattcataatcgatcttattaaggtatgtttacatatatatgatcctagtgagcgattaatattagaggtgaacagactctcacacaagaaaggcttattttacatttatacattatcaaactcaaaacactggaatatacgattagacctcaaaaatactttctcaactgcatgcatcatctgtgttttagtacaatattattaggctaaacatggatcactaatatgagccaactaaccgattgaatttggcgatgctatctaattgcaatattcacttattggtaacggcctttgttacaagaaacaaagacaaaaaaacaatgttttatacaagaagattaatttcacaacattatacttattcatttgtcgttcttgagaagtataaaccattaatatatattgcctttttaataatggctctttcaccttttgctttataaaagagataaagggaccagtcttttatttgattcatacatatataatgttattatgtcttcaatggattacacatgcatatacctacgaatgttcatggccccgcttacccatcatgtttttatttagaaaacagcccataaaaagtaaataattgaaataaatagttaaatccattgatactaacgtttatatagtattgtttttttgaattataaatatgaaaaaagtagtgggaactgcttttgagatatgtggctggtttcactacaactcctctctccctgcatcttttgatgaaggcttttgcctcccccatgttaatatcggtacgatctttttagcttcgctttttaagctaatctttttataacaatttatcttcttttggtctgttttcttgtttataaagtcatgcaaaaagcaaattagcgaaataaaagtctattgcttggcccaattttgctttaactagaatcaaaaccttgttgggtccccttgtaccacgacttgaccattacactcatctaactataaaatgcctatattcataatcatagggaatgtctatattaatcctatgaagtttaggttaatttatttaattatgagttcaaacagaaaaacttgatttcattagcttaagtagtctttatgttcccaaagaaaaaacaaatattcaattttttttaacatatatatatatttacttttttcatccttttagtttggttgggtttgatttgggtgcatactagttgttttcgttatgggccttattatgtgggccttagacagcccattttatttgacgagcaaaaagtaccggcaaaatgaaatgaaattgaacggacggcgaaaaccctaacaaaaacctccattcaccggcgaaa

SEQ ID NO: 3743 - DNA, 2000 bp, Arabidopsis thaliana
ttatttttttctgtaaataaaatgaaaatgaattgcttcatgaattatattactcatttttcctagagatgggaccgttcataaaaagtattacggatatactgatagcaaaacattttttttttttctacgcaattttgtaatttacaacttatctaaacacattcggattcattgtaatattaattctatgtatacaattcatcttcatccatatttttataacatcttcttgttttgaatttttattttttacatgagtcacatgactataagtcaataatatcattttgctgctaatacgtgctgtaattaaaaaagaagaagcaaaaagactcaaattgttactataaacaagaatgtttaaaacacgtgaaaaaattggtatagggctgcttaaaagtaaaaaacaattgcgtgaaatacaaaggcttcatttaaggttctccattctttgttccgacaactttattgttcataacaaatagcttacccaaaacggcttaaacaaacattcgataaagtattaattaatgtaaggaaaaaaaaagtaacagaacaataactattaaaaagtgacccatgtaagatatcgaaaatgattctgcatttttttttaaaaagatgaagaagtgaatcttctgtcgcggaaacttctaagcaggagacatggcatctggacaccacacggttagtacacttctatgatgtcggcgagagacgtggcgacatttgtggatcgtgatgagcttgtggttgggtcggaatgtacattgtctttttggataatggttttgtggctcaccaaatatcattggattagatcagaacttcgaaatctaacttgtccacgtcaacttttcactgaaatttctttcctgtagtttgtttctttctcattatttagatggaagttttgacaattcaagcgacatcaatataaagtatttttgtttgggatttaaggatggtctcctactatttcaaatttgtgatgagtttagtgtcgactaaagggaaaaagttatattcgtttttgaatttggatgttttgaattcgtaaaaaaaatataaacgcgcttagcttatttgttttattttctacatgtaaatttaaatttataagaaaattgcataatatggtggaataagtactgattttaaggaaatttataagaaaataaattgtaatttatgatgaaaatagttaaatagctaaaaaaattagcggattaaatccaaatacaaatcatgcaaatcagatttctacgtcacattggtgtgtttatgaaaatccaaatacaaaacatagataagtaaacttacaataaactgataacagtagtcttcgtaaagttcaaatacgaagcattttttttttgtggaatgatgaatggtaatggtataatatgatgaagatgatgatgatgaatgcggtgggtgaagatgatgatggatgatgttgatgatggtggtggtcatatggtgatgatggtgacatatgctgatgttatataatgttgataatgatgatgatgcttgtatgaagatggggattggggatgatgtttatggtatgataatgatgttgtttatgaagacggatgatgcggtgtggatagtgttcatctcttttcttgttttggttgccaaaccatttcactacagattttttttttggcataacagtagctacaaacttttgaaaaaagaaagagcaaatttgattctagacgttttggcaatgtggattggtggggtaaaaaaaacgtgtgaattggtgggaaaaaaaaagagtttatttccctaacgcgaattattaaataaaaagattactattagtgaatagtgacttaggataatcctgctggttctttattaaaatcgtgattggtgcgatttgaccggtcgaaccggccggtttgttgttaaaatcgtttgtgttgggtaagaaataaagatagctagagaagcagaaaaggcacggcgaacggagaaag

SEQ ID NO: 3744 - DNA, 2000 bp, Arabidopsis thaliana
aaaaccatctttcccatcaaaaagaaattacaaaaaagacaaattttcaagatgcaagttactccgaattggaatgggttcaaccatattaaaccaaatcaaaatatggtatgatttattctagttcaattatactatattattaaattctgaatgttgatatgtatagcgacatatatgtaagtatcctattaaagataagcgattaattctgatggaacatgataaaagaaaccatatgtaacataggtagaatatatagtggttagtgagtcataacctattacctagttttcatgaaccaatcagggacatagatgctcactctactttgcatctcgctcaattattattttcattataatattattatattgcatttcattgaaaaaaggaaaaaaagaaaggactaaatctatcgttaaattaggctttaattagattttataaaaacatcatgtgcaatgtatttcggagaaaaaaacaagatccctaattagaatttgttgaagcatttaatgaaaaattgacaatgattttgactggtacttaacgccttcctttttagtgtcgctgaactccttccatttgataaaatgaaatgtttcgtaagaaatttcactcgtacaagtagtaataaactatttgaattaccaaatatatatttggagatttttttatcttaacttgcaattcatttattgtttcaaataaataaattttatcattagtcaattataacggatggaaacatgtaatatactggtttgcattgtatcataattgatatgaatttcgaaaatgtatgcgtatataaattatagatgacacaaaacaaccaacaaaatctataatgtatttgaagttatcaagtacatgaaaaatgcaaagcatccatatttacgaaacaaaaatctagagttaaaaaacaattgaaatctgatggggacaagaagtgaaccctacaacgaattttagataaacagcatcactctatatcaacaaaaattgattgaaattaaagttgcaaatctgtttatagaaagaaaaaaacaaattgatatatcaatgatatgaacaactcatctatactgaaaagaactatcatttttccttttcgttgatatcgtaaaatacgagaaatgaaaacgatcatatatcaaactgttataattggtacgccgaatatattccgcctgtccggaaaattggatggactataagtagctaggcgtgtcaacatagaaattggtatcaacgattctagtattatttgtatatcattaatatttattaaaatatagtctaaaagtgatccactctaatctgattcgctgacaaaccaatctgtattttcaacctggccgtttttcatcctacggcgtgttaaaccctcgtagacaaatccacaacgttttttcacatccttatatatatgtgtgtgtgtaaatattgcttcgtccaacaagaagagtattgtttgtagttttttaatcaatagaaaatgttatcatacaacccacaatgagctaactaacacatttcccaagtataaaatccctttagaaaactatatatgatcttgagctgaagtccaaatagtctctgactctctgaaatcgatgtaagcattgaatcttctaaccattataaagacatatacagtatccaattttgaaatcgtggtggagaactcaaacttggtgatctttcaacaaaaactatgtaaatctttttagccaatgaatttgattaataaatactgatacgtaattagttaagagagagagaggaagaaagaaaacaaaattttgaaagggcccataacatgtcctctctaacgtcaacatcatctgctactattactttcaccctctcatcaaactcactcaacctttcatctttctttcttattacataattcttcagatccataaaacaaattgatcccttaaccttcttcaccaacatctctcttacactcaacaagagatcatatc

SEQ ID NO: 3745 - DNA, 2000 bp, Arabidopsis thaliana
ttattggatttttaatcacaagatgtcaatatcaaaattcaataccatgtctcgattagggatatcaatatcatgatattttaacaactttaactatgtaatttaattcgattatcgtttttgttttaaccttcgtttgatttgtagatggtagaggtatttagttgttgaactcttctttatacacatgttgtttgttttgcttcttaaaaggataataatttttaaacttattacatgtgcaccactggtcgcattcgtagttttccatattttatgcgaaagaaatgaggatatcttgggaagatacaaattattgggattgttttgcaataactccaaaatgttatgtttaagagttttttgcttacgtatttcatatcaagccacgtagatgcatttgtaatctcataaaacatttcgattattattaacttactgcaccatattaaaaaacaaatttcgatatcgagattgtaaattgggcaattaggaattaggaattgaggtaggtaaagtttataagcagatgaggaaataatagcaaggaagagaaagaaagtggatgcgtcgtggattccatatttatgtgctttacttttccttttggtaggcgaaaattttgacattttccaacaaacatcctcatgtatttcacatattggcctgaccaactattatgcatattttatacatttgatggattaggctataacatggtttttggagtttacttttatacgttcgatcataggataaacatacgtcttttattaaaagctcgatctaactatggcatgttttaaaagttcacatcttttgtctcattgctaattaacgtaagaatattaggcaagtcggctttttatacgcagttgtcgaatccaacttttacctaaacccttgaaaaatcgaaattaagcatttttatttaatagtaaaactcaacaatttttaaggtggtatagtgcaataatttaaagatttatcttaattttttcactgtgatttcaattttgaaatatagtagataaaaaaaaaaaacagaaatattaattcgttaacagtattattattattcttatttatataaaaattcctttttttcaaaaatcgtatatcctttaaacagagcatcgcacgtactctcttctatctcagtttcgagactcattgcctcgccgagagagaaggagacgccatggaaaggcttcttcaaccatcttcttcttcttcctcaatttctccttccaaattcccttcacggacttctcctttccttccccgtctccgctcatcgggtctgagctttgtctcgactcaccggcccgagtcacgccgagtcagctcaatttcctgcaacagttcccagattccgtcactgtatacgcctataggatctaacacaactaacaattccttcaatgggtctcccaaatcggatgaatcgaaacctaatcccggatttctcacacggatcgcgacgtcggcttctgagcagcgaaaggtattcaatttcacgttttgttcagtggtaattagaaatctctggatgcttacgtcgatgcttactaaatgtttcaatttccacattttcgtatagttttggggacgagcttggcttacattagatttggggtttatgggttttaatggggtttgattttattcaggaaacatatgaaaagtttgtatatagtttgctcgagaagaagattccaagaattacaaaaagttccaattttgtagggttacatatgttactatccatcagtctctagaatcatggaatcatgttctctctgttttaggattcgggagctaattcgatattgttgacattgaacttgctttttcatgttagatattgatagtccctaatttcaagctccacacttgttggaacaatagaactcaaatcaatctagtttcttttttgtttgattagtctgtgtgttggaattgtgcttgttcgctgtcctcttatgtagtctcatgga

SEQ ID NO: 3746 - DNA, 1586 bp, Arabidopsis thaliana
atgtgaatatatgttttgttgtctgatatggttactaagtaacttttcttagatatgcaaattttggataaaataagagccttggctgtttaaatcttaagggttttgttactattgtgcagaagccggaatcttggagactcgcatgtcaaacaatagtagggaacaaagaaaactcaggaaaggtacctactttcatacaccaatttatgcatatgcaaattgcaaacgctaatgtgcccattatttgggatcataagagtttatttttcctttttatgatctttctcattgagaaaagtcggctttggatataggttgtcgtgcagcggattccacagtggaagaagtgaattaatgtaaaggttatttgtctcagatttatgtgtatataacacatctctgtatgaatgttgtctcgtattaatggaagattcgtttgtctagacgtatttttctttagttcttggatatgtggtgccatgatagtgaaatttaagagagaaactatcaactagctcgcatgattgaaatgtttaaaatttgcttaaagatacggtaggagtgaagctggtcagaagattcggtaggaagtgtttttatgatgatctgaaaatcagtagcatgttttacctttttgagctgaaaatggcatttgtttcttaagctttgaaaacgtgtttctaaaaaataagaacttggtttagtattcgaaccgtttctttgacaactttcagatcactttatttatcgaatgtcaccgaagagacaactttcagaacatctaattagattacgcgccgccccgtaaaacaggggtaaagtcaaaaagcaatatcttctcatttttactttttacttttttcttgttgagggaaaatataaagaggaaggagccaaagaaagcatcactatctgaatttttctttgtacatttatttatatataatactagtttttgtgtgattgctgtttggctccgaattttatatccataattttttttttttaatctccccttggttgatcggtgaacacaaaaaaaaaaatctaaaataatcgcaaaatacatttgaagaagctacacgatcaacaacagcaaaggatttcgattgttgaaaaagttgactcttcttaatttgattcgttgtcttggtttctgggttttcttcttcttcttctgcggcgctctccaattttacaccttgcgaccagcgagaaaagaaacaaatttcacccccattgaagaaggtttgtttcccctaattgcttgattttattctgagattaatcccaggcgccaattatatgcttctgttcttctgataaatctttgcccttttacgatttttctttgattttaccctagttttatggtataatctgggtgagtttctttcctttaattcatgtatgattaagcttggattggtcgattctgatgagtcaaaatcttgaaacagacataaattgatgatttttcgtggttgttttaggtcatttgagggtttaagctttctttgtggatttgcaggacctttggttaagctccatggtgtggtatgcgcaaagtggacaatacctag

SEQ ID NO: 3747 - DNA, 2000 bp, Arabidopsis thaliana
ataataaaaaggaaaaaaaaaactgaaattaggacaaggtcagattccaccgtacgttttgtaaaatggaattgaataaactaagggaataaataaatatcaatgaaaggtgagaagagtccaatattgttgaaagaacaataaatatcaaccgttaagaaggacataagccgaataccaacgagagccgtcaattcttcaccttcttctaacgtcaatgtctcaacgacgtcaaattacggcaagttggtgcatacctttctctccttctccaccgtcggtttttttaccccctccatttggcacgtttcaacaagatataaccaccctataaacaaaacaagatataaaccacttgtgttattcttcttaactttcgatttttcggttaggtttggttacagttttttcggctgatttttcccgaactagaacttataagctcgtccattatggtctacattgtttaactcacgtttatacatatttatcaaattgagaccgaaattgtaaattggttcattttttgttgttgtaaatttcaattgcagttaatttggttttctttgttttgtttcagtttagttcggttttggtgttttgaattgtgtgttggttatgaaattattaaatacgttttgatatttgttcaatttaaaatataagttgttaaatggggcagctccaaatcttacgaaactagatatatatctcaaaaatacatgcatgcgataatttacgaagtcgtagttatttgttacaatcatcattgcacatgcacagaaaaaggtatcttataaattactcaaatcaagtaaaaaatagtaggatccactatatagtcaccccaactatataaccatatagagaaacagtgtaatcaaaatctccctagaacggagattattttctatcactactttggtaaaactaaaacataattttctataagcaattatttccttcattgcatcattacaaaacttgatctcacatttcatgaacgatttacgatttttcgaatccgtcgattttggatcagacgtatttacgttttctatacaaacaaaatttaaaagaaaaagatgtaaaaattttgataccaaagagggcaaaatgaacatagacgcaaatcgcaacacttaccacacatcaaagttaacgccagattacatggacactacgggacccactcttttagcataccttcttgcaaaactgttactattttcacactcctaattaaaccattttaaaataaattattatcttacagcaagtaaaatatctacatggcttttccaagaccgttgattggtttaaattttaaattggcaaaatacagtacgcaatacactagtactagttgtcagaaaatgacaaaagaaaacccaatagtctgggagacacttggtctatcttaaaccgtcagatgtaaaaataataaatcctaatgacatctccggttaatcatgtgagtcggttcttgtcaccggcttacttgtttgtcagattctttacgtcgctgtataaccggctttaacccggtcatatatttaatttaattaatttcgatattttcgatcataaactcgtgcgcaacaaacccttccttgacatctgtatataaaagctcatctcctcactctctctctctccgcgttctactaaaataaaagtgaagcgccttcctcaggattttcccgagtgagtttcgctttcctccgagaaaatttcagacttaaattttccggtgagtttttcttcctctctttacctattttttttcttactaattcgttgaacccatcgattctcgtgacattacctttccactatccgatttgccatcttcaatgattcaatctcaagataattagtggattcaatttctcttatgatttacaggaatctaataaggagaagccattgttgaagaaactagtctctctgtttcgaatcttcaaattcagattcaatatctatcaggaaaatttcgc

SEQ ID NO: 3748 - DNA, 1346 bp, Arabidopsis thaliana
catagcttcgtgtcactctactcttgaatctcacatcgaatggttcaagagcaatgtatagaattacgaaatcacataagtaagttcaacgaatcaaaaccgtggaaataggactagcctacctcttgattttacttaaatccaaccacttgcattgcattgcattgcttaaatcacatttttatagcgatacgggagtcagaacaaaactaactggacagtagaaaatcgaaatcaacctaaacacaataaacaatcagaacgatacatcaataacaaagcagtttcatcaattgaagaggccaattcatatacaaagaaacgtatttccagtcaaacctaaatcagaaacaaccaaatcgcaaaatccacaaaaagaaaagcgtaaagatgaaagaaacttcaccgatgcataaaatctcgaatccttggatgcttagggctaacaagccgacgctgggtcttcaatgcgagccggtaagtccgcctaatccccaagaagtaagctgttcctagagctaactcccacaacaccattactttctacaactttcttcttcgtcttcctctttgtcaccttctttcttcctcaacgtatttgaatacaatctacaattttcctttgaaagagccgccagaaatttcaatctcactcccatcggaatcacagatcctccgtttctagtttaaagcaccaggttgcttgatctgcgatacaatcttgaccgtccattttacttgttcgtcaagattttattttaaatgttttaatgggctgggcttttgtagccttgaaatatgcccatatagacgagacggacaaactttttatggataatttaggtttttgttcaccaatcataatttttggtatgcaatgtttttttttctttttttttagcaataattattatttttgtgtgaagcaataataatttgtttgcttgaaacgataagatttatatatatattcgctctaaaaatagaataaacttcagcaatcagattaatccgaatcaattccgttggtgttacagttattctacactctctatagatcccaacctctttcttttaaatatttatatacatctctctttttttgtgaatttttttactagattccaaagtaaatgagtagcgaatacgacaactctcgttattagacagagatatataataatcgcgtaataattatttcctatttaaatatgataaactcatgtgtgtgcatatttactttttatttacttatgggatactcaccaatatttatttgatacgaaccataaccttcactaagttttctttctctagcctccctcatctttctctctctgtcggcg

SEQ ID NO: 3749 - DNA, 763 bp, Arabidopsis thaliana
aaaggtgtttcgtttgtcgagtactttttaattagattgaactgttttaggtgtaactctaccgtgataaaaaactacatatttattttgattttctgctgagtttataattttctaatcgctaagcctaagaatctatttttgataaacaaatttgtcagacatgcgtgcttgttctacgtttaagacggatcgtgcgggtctaatatacatgacaaagtactccaccgaaaaacccgagcttttgaaccaaattgtttgagttcacgtcaatgtaaagttttatctggaagggttcatgcttattatacaacaaatgaaagaacattttgccaaatgaatttggagtttaggaagaaaacaaaaaactagttgggcctctttgaaaccgtttcatacacacagatataagtgaggcttcctataattatttttgtaatcaaattataataatgaatgggctttacttaaaggtacgtgaagccctaaccataaatggaccgtcatataatttcaattttgggataatcatcagaaccttcaacgagtcattgtcgttgaagaattgaagatgacaagtccgagaatcgttatccatgcggacttgaaaaattatccttaggagatttttcctgacctatcctcgcgtcgcgccttcttgtcttctctctcaatccagcatattcctacgcaaatcccttatcgttttcatgtttgtcctggtttaaatcttcaatctcctacccggtcttttcatcctccg

SEQ ID NO: 3750 - DNA, 2000 bp, Arabidopsis thaliana
acgtctgcacgttcacatacattatattttaaaaactctaaaggtggagttgaactcttcgtcgcgagggcttcgtttgacatattatttttcaaacaattacaaacttaacggtagcggaaaaatgttacattgcgtattattattaacttcatattattagtttgcatttttttaatgtagatgattaaattgcaaaaattgataagttgaaagctttttttgcacaaacccctactttaagattataagatatgaatattattatcaaggtgatgaactttgatagcttactttagttattgtcacaatcttatattagtaataagctagcttccaaaatatcttacaagttgcttgttcctctaacttaaatctcacaaaacttaagatatggtaaattgtctagttcttatcatcttttcctagtcaccaatcaagttcataactagtcaccatagtggtcaatattttccttctattgaacagagcaccataatgattattattttggtatcatacttatttttgttgaattatacatatgaaagttagttaattctttctgtatgaaaacacgaacgtgttaataaaaaacagttagctaaaagaatctttcaatgtctgtttccactctttttcccattaatgaatcctgttgaagttcaccctaagtctcccatagaagcacatttctggagatgtagcgattccacaaaggtagattagtccaaagaaagaatgagtccttaacaacatcgactcatacttatgtgtgttgtatacattttcgtgggcaggtttagtacgaatggctgtgtctttgcctacactctcaccaattcacaacactaacggaagttcatgctggatgggcctttaggattcttatagaacacagagaagagaagaagattaggagagtagatagagaagtacttcttgttcatataacataagtgtacagagaaaaatggtgataagccaaaaagaagacaaagatttgtaagtagaagcaaatcaaagcgtgtagagaactttttttgttgatacgatgtatagctttcatgggtacataatacaaaatcttgactgatgaaaacgtgttgttgtgtgaggtttattggaaaagaatatgatttttttcgtccggaattgtggcaagagaatgcgcgtgaaataatgaatgaaacataaaaccatttattagttatggaaggaagttgttggatacaactaaacacgtattgaacataaacatagtaccatcatttcgatttagaatggaagtggatggatacacctaaacacgtattgattgatagttggaaattaaaataaccttttgatttttcacattttttaacctttttgtgttttcaccttgttatgggtaaattaaaggacagaaaaaatatgatgaattcagtagaaagtaaattacgtactctcaaatccgaccaaaaaagaaaaattattgtcttaaagtataagcaactctcaagattttgttcctaagttatagatttttactaaaaattattttgaaaattcattcaaatttcaaacttgtatctcttaaatcgttaattaaataacactaaattttaagttaatattctttctatatttttcaattttcacactcaatttaaatttaatattacataatttattcactaaaccttcaaattattctaaaaaatcaaacatatatacagtctccaataaacccctaatcaaataatcccaaaaagttttgagtaaattctgcgtttcctctttggcttctcgaagaggaagaaaactttggcagagagcgaagcatcacacatattttggcctctccttcacgatattcgaagaagtctcctcctccttctccaacgaatcccagatcaggcggcaagtaggcgaatccttacgaagaattctaacttcatcatcaacgatagatactctagtttgattttcaaagtagtagtgtaaaggaatcagaa

SEQ ID NO: 3751 - DNA, 316 bp, Arabidopsis thaliana
taatgctgttatctatctactttcattacatacaaaagtttgtttctttcaactgtaactgtctctgtatcaataacaacattgctgtgtacttttcctttcaatttcaaaagtttaagtcgcatttgcaatattataaacaattcagggttcgaatactaaattgagagaaattgtccataggcttagtaaatcaaatgggcttttggcccatatcaaacgggcacaaatatgacccggagaagaagaatgttccgggtcaataaaatcgaagaagaagaagagagtatcgttgtgaggtttggggatcgcgaaa

SEQ ID NO: 3752 - DNA, 725 bp, Arabidopsis thaliana
gagaagatgaatagaataattgaagaaagttttttgttttgggaatcaaaagtgagcaggaaaatatcagaatcttgatagcttaacgacaaaaatgatttgaaaaatgggtggatagatctcatctaacacacacacatgtagtcacaaggtacacgccaatgcaaaaccaaattggccgaatttctattcggttcgtttcaactaattcggtttgtttcgatttctaaaccgaaaacccaaattttttgatccaaaccgattctgaatggccaggtaatcaggtatagtcggaagcatctacaaattcacaacaacaacacattatgtctgactggtgagataaatgatgactgagtggataagcaaagaataaaataatgtcataaagtcaacaacatgtctctgtgactctatctctatcctattattagatttaatcagataactttaaaatctggttgctgaaaaaaccgtatctcattattatataaatagagagagaacagccccacgtaaacaaatagcgatagagcaactgtgtcgattgtcccaaataattttaaaaataatttcacgtgtccccattttgctgacgtcattattcccctttttcctttttattgtcacatcagaattttttctaactcattcatttcaatcaatcttcttcttcttcttcttcttcttcctcagagaaattctgtgttgttgtatacagagag

SEQ ID NO: 3753 - DNA, 1995 bp, Arabidopsis thaliana
gaaaaacaacaaaaacctaaaaactaaccaaaaaaatcgattgatacaagaacacaccgattgatcaaaccaaggaatcagttcgttgtaaactacgcccaggaaattgaaaatccgattgagttcgaacaaaacaagcgagtacaaagaatcgagagatgtctcaggggaagaagaagaagaaagatgagttttttcttctaggttttgaaagatcccaagtgattactgttgaggaccgattttgtgttatttgattgttctttcttctctctcttttttgttttcactgcatcggaaaaaaaaaaaaaacaaatttgtcttaactttgtgtatgcaacttgaaacccttttagatgtcgctctttttgtgtacctttttatttaccttaacgatgcagtatttagaaacaacgaccagcattaaattcttaagacatcatttgaagtttgattagagtgacttgggaagttatttgttcagaattttgatttcactatagttggttaaattgtaaagttcagatattcttccattaagtttttatagagttgtgattcttatgaatgttttaagagaaatgtcaaagattttaatacatgttttcatggtttagctttatcttttttatcattcaaaaagttagaaacttttaactttttttttctatgacatactaaattctcatgtaccttaacaaatataaatttttttttatgatttaactaacgcagtcgcgcttttttctattgaataagctcgattatcataactgattatgcttttaaaaacgaaaaaggtaacatttgagaatcattgtcttcaaaatcctttattcgagttaagttataaggggatccaactgtgtttcacgtgttccagaaatttgatcacctgttattctcgaatatgattttgttttgacgtggtatccacatataatgatatggttagtaaaacaaaataaataactccaataattagataaattaataattaattttgttctataaaagaattttaaattgaaaactccaattacaaaaatctagtaaacgttttgttttggaaaaaaaaatatataaaaatctctaattttagtcccgttttgaaaacaaaaatcaaaatcttgttatacacagaacaaaacaatatagaaaatctgcaaaacaaaatcaaaatttaagaattttacatggaatattaaaaacttatgtataatatttaaagcaacagattttactgatgtgaatataacagtccaaaaatgaacatcgttatatcttaaatatatataacaaaacatatttgttttaacatttagtcgttataacaacgacatttcaccccgaaactatattttcataattttttgtgaatacttttctatttcgaaatatataacacggtcttttaaatcaaaattaggaagcaatgtactaatgtattctaatactttgtgtaaaattttcttatctaaaatctcataacacaatccgtttagctacagatcagatggtcgtgttttttttttttttttttggtaatgatttaaaacgaaattatatacatcactaaaatatgttaaaccatgtctctttttttttgttctgatataagttgattttttggtttcgtcaataatcagttaccaggccctccgaccaaaacaaatatcagttactaggccctatacctggtcaaaactgagttggaaacaataaagttgggcctgatattttggcccaataataacacggatgagagttctcagttctcacatttgacatcctccgcttcaattctaaatctcccggcgaagaaaattaccggcaaatttcacggagaaacctcgccaacgaagcggagttatggcgggcatggctgcggtggcaggattacgaccgtggaacgcttttattcaagctctagttctgatatctctatcatttccctttctctccagcgcttaccgacctggagatatcgtccgg

SEQ ID NO: 3754 - DNA, 287 bp, Arabidopsis thaliana
ttactttatgaaatgtttttttagttgacaatcaaaatttcaaagctctaactaagctttcattcaaaatagtcgaggtttttagaaaagaaagttaggaacagggaaacagaagaggattgatccaataatagttgaaccaaaaccaattaaaccaaacggaatagtgttcaattttcgaaccagaccggttaaaatgcataagtaagtgtgtgtcgtcgtcgccgcaaaaacccagttggagctcgaaacccttcttcatcttcttcttctcctccacctaacca

SEQ ID NO: 3755 - DNA, 869 bp, Arabidopsis thaliana
tgatactacaagtacaaagtcccaatcctagaacctttgttgtttttgcacatagaactgaaaagttctcttattatatttaagtgtcatcagtgatgacaatagagtgagaactgatgtgaagcttggatcttgatcttgttggtgttttccttgaaaaaccctttgttaaatgatctactgatggatcattattattgagattgatagcttcagtgatgtcaatagtttgtgaggaatgatcttcctgattcttaagaatcatagagagtggcactctttacacgcttgaataatacgaattcttttgttcgatcattattattaggaaagaaatagatttaaaaaaaaaagaatgtgtggacgtgaagtgttgttgtttgagatgataacagaatattttctcttatcattatgtggcttccgagaaattaagtgaatggtggtggagcatatggacaatgattttgtcgtttgcaatattttccacgaaatctcactatattttccatgaaacatcaatggagtttttctgtgccaatagactcgtcaacggtctatatcctcattcacacaaattgtttgaactaccaaaattccattaaacccgtgtgattcttcaactctctggagatttctcatcgttttatgcatcggtgagattttcatttttttactcctcactgtctgaactaagttccaactatttttaagttttgcttaaggttttatcactgtggatttgaattgatttgatgataatgctttatttgttttcgattagtgttttgagcccatttcttgattatgtgttcttgatggtgggaattaatggttgcagcagtgaatcatcaataatctaagttctc

SEQ ID NO: 3756 - DNA, 2000 bp, Arabidopsis thaliana
atttcgaaggttttacagaaaagaagaaaaaaattaacaataattcatacgtcgagagtaatgattggactatcaggcttctcgggcccactcgaccgtcggtggaaggcccaattttaccaaaacaaacaaaaacgttattagtaagggcctattatttatttcttctttaatttcaaggaaagagtgaccatcatatgttgagcgcgtgaaaatatcgctcatggttatatatttgttttttctttgagataataatttccattagaaaaagtcggtttcaaagttagaaaaaaaacatctaaacattcacgtaaagtttaccaggagcaatggagcataaacatattcaaattacacacatacctaaatagtaaataataataaaatacatagacttgtatttttattataaatataatgaactacattccaaacaattgggtgtttggtctagtggtatgattctcgcttcgggtgcgagaggtcccgagttcgattctcggaacacccctctttaaattctctactgctacatcaatttttttcccctcggattaaattaacgcaagaaagtcgtagactgatgacatacaatatggtggtggctcactaaactgactatatgcctaattagcccgatgggccacatgggctcaatgcaagtcggtaaaaggtggaatgttattgaatgcgatgtatgttggcagaggagtaaccgtacaaattagactattttatacccatgaaatcattatcgttcgataacataagatagtaaactttcatgatctcgttctctatgcatccatctctcatctgtgtagtgtagctttttttttcttttttccccacagtatttatctcgtaaactatactttcatatagtcatatatgtgatatgaacattgacactgtacgtaacttatatgatgattaagtttacatgaaaaccattcaagtttttttaaaagcgtaaatacaaaattacttcatgaaatttacgtttataatttaaaatgaacttcgatttaagttatttgcattcagagaaaatagaaattaattaaatgtagcaacgatgtaagtgatagccataaaaatatcacattctttgtatatcggaaatttggttgagcttttaagtcttgaaccctcggataaaaaaaaatgtacacttgaaaccaatatagcattgctccataaatatcaatatcttagacccaaaaaacgatattgttattccatatcggattttagtcatttcgactattttcccaactatttttcctactgaaagattaattacagatctactattggccccaacatttggttcactagacaacctgtaataatatagttcaagtagtactattcacgtttcaacacactaacttttattgagcttcccaactacatttacaatattaatcgtatcactccacataatatcatctatactctagtttattcgacataaaagcatatttaaaaattgtagatgtgaatttgatagttgacaaaccaaatattttactgtacatatgaatttgatattagttgcccggaagcatttaatgaccggtgccagtaaccagacgtttcggactatgttaggtgagacaatgaatagagacacatcaataaatgtcaccgatacatatacttcatataatctaaagtatttcttgaaaaaatctaacatgtgaactaatgaaaatctatcaattacaacattaaattcaacgatatggacttccatcttcttgataacgatcttcaaaagtaagtaagacagcaaacctatttaatatttttaccttattattccccaactagttccttttccacttttaaccatcaccctataagtggttataactagtaacttgaaatagaaacactctatctctaaaagaggcaaccaaacaaacaaggtctagctttttataaccaaactctgcttctgaacagagttagtcaaagagagagaagcc

SEQ ID NO: 3757 - DNA, 1897 bp, Arabidopsis thaliana
gtctatctctgtgtgaacaaaatgtgtgtttgtatgtgagagtgaggatgagatatttggtgctatatgattcttgtaatcatcccgtccgtgactctcactctcattgtacgtgtaattagtgtgttatagccttaatggtttttttagtccaacaattccctttaagcccaataaaagataaataaagcccaatctattatattgattccaagggttcaatatatatgagatatgtctaacaatacatcaaaagaccagtttgaataacaacacatcaatttatggattggatatgaataagatgtcatgtatgcaacaaccaaatttgacatttctcttgtaatgccttgcaataaaagttattttgttaactttttgcaaagtatgtgccaatcaagaacaggataaaaaggttgggtctaataattcaactacggcccaataataacccaataaaggagggtattaacgtaaatttatgtcttggaccgggagtctaactgcacgcgtcaagtggctcccactagaattggcatcaagaacacgtcaccttgaccttgtcggatttgtctgaaattgaattcattctttttttagtgactctcttaaattggaattagatcttcagtctaaatcttaatgattataagaaacaagattatatgcatcatttcggatttaaacaacatggattaatctcaactaatttagcattaaagataagattttgttaacccttttttattgggtggatcctacgtggcgaagattgagtcatcgtctaaaattttaaaaaagatttcaagaaaaaattaaaaaatgagctggcgtcgaatcccacgttgtccgtagggaccacaacggtattccttattcagtgggacacgtcagctttataaaaccactaacggccgacacaagtcagtagatcctacagtggggaccactctaacctttttctggttaaaaaaagatatattttaccgtagatgaaatcaatattagccgtcgattaaatggtaaaaacaaatatgcttgatttggtagtccacgtttcgtcatctgtggatctcaaatgaattatacattatagtttaattctgtattttcattatttaaaaggaataaaatcagcagcacgtcaagtctacgtagagatctcaagatgaacggtggcgattatgactacgtgtaccaatcattatttaagtcagatatttaaaatgtccagcgcagatctagggttgccagctcagcatatgcgttccctttgcaaacccttcaagatcatgacacgtgtacggtgacgtgttcatcagcctcttggcgctccgttgtgtctctcttctttttcttctcttctccttcctctctcttcttttaccgaactctggttctagagagagaaaccattctctccgactaagagagagaagcgaatttgtttttttttcttttgtgggttcaattcgaattgttttccctgagactcaaggtacgtttttggattttggttttcgttattttcttcaatgaatatctgagtgattatatatgaacgctctgttttctcgagaaagtgtgtattgagtgaagaaaattactaggaaagttaaaggtagattgaattgtgtaactctactagttggtgatagttttgaacttttgacagaggaaaaaactcgactttgaatcttttactggtagattcagtggtgctatactttatagttactcggatctctgttatatttatagtttgatgtccacaattgcgagatctaggtgtaattgaatactgttcttttagatttatgctttacagaggaactgctaaaagatctgatcatttttttgtttataaagttactgtgtcattactctgcattgagca

SEQ ID NO: 3758 - DNA, 1971 bp, Arabidopsis thaliana
atagttacccaccacaaggactgctatttataattgatttattataatagaggtaaaagattttagagttaattaaccaaataatacatatggattggttttcctaagatgcattcaaaagaagcaaggcacatgacttgggagaagatagtgaaggcacggtgacgttttttgagggttcgttttatataacttttttcattttttgaggcaatttcttttctgtatgtttaatatgttttatttttgtgagattattatttgaataataaaggggtaatttatatagcacaagaattgcaaccctctcaactctttgttttgatttagatgagtaatggatttgaataagtgactgaaagattgggtgaaacttgaaaactaatcaattttctttctaaagaaaaactaaaaaaacatgatgaatagtttataaaaagcacaagcacaagaaaggaaataatcaggtaaaatgttactatcttcttgcatcctaactaattccagtaacttgtatctattgacattcccaaatggttttttaaccggtttgatatatattaatttttaagacatattcgacaattctttaacaaccttgaagaaggcggagtcacttattgaatccattattcatctcaatcaatataaggaagtgggttttgtttacaataattgccatttttcgattggattttgtttacaaaacccaatacttgaaaagacatttttcaatgaccttagattggattcaatgttgtgaaaaaaaaaaaaaaatggattcaatgtacaatttttttctaaaaataagtgaaaagacaaatgagtattgagataacaaaagttcttgccaaggttgtctagtaatttcataacctatggtagttgtcaaacaaactaatttatagtatcatattaattataataaatgtataatctttaattgaaacaaaacctaattttactcccaaattaatagaaaaccttcaaaggatggaaattgttggacatgtatttacatgaaaccaaacatgcaatatcagtaaaccaacttcatagtctatactaaattacgtaccgattggtagatagaaataatgataactaaactgatcttaacgattggtattggagagagattttcaaatcaagagttagtaagaaaaagaaaaaaagaacttagagatgtggatcaaatattttgaaaatgatgaaatcttattaaaaattgaaattgatatacgacctgtccagatacaatgaagttgttaggttacaacatcagcatgtttcaaaaagggtcaagcaggtacatccaatcaatttatataacgtaaatcctgattttcagagcaatattatttgtatcttttataacctccctagttaattagtaataaaatatttaatttagtagtatcacaagatggagctttaaaagttatctttaattcccacttttgaaaatgataacgtccataaatacatttcaaaacgtttttattctcccaataagatatcaaaaagacaatatcaacaacaaaaaagacaagaaaaaaagacaaaaaataatgatagataaaatacaaaagcaaaagaaaacgtatagtattgcttagagaaagaacaaacatattgtgaattaaaaagaaaaaaaaagagggacaaaagtagaaagacgtggcaaaaagcaaactaaatttcgaccaatccacatctaaaatctaaccttcttcatcagatggaaggaagctacttcaccacccgcagattctgccatgtggcttctctctcttctacagctcacttcttctctctctgtctctctctaactacattgaaaccaaaccagagtgcttcaatgtcattgctgtgattctctttaagtccagacataactcccatatcttcttcttctgtctttttttatttctttgaaccggagaagaagaagaagaaggagaaggatat

SEQ ID NO: 3759 - DNA, 2000 bp, Arabidopsis thaliana
tcgttttgatctcttaggtttctttttagctattagaaacaaattcatagagactatagacattagacaatgataatgtagaacaacaattaatgttcctcaaatatcccataaaacctattgaatcaactggtccaaaaccaatacaacgagaacttattgtctacgtttatatgacccaaagacactaatcaatcggcctcaattagaggcggatttaaagacatcacggtatcatcatatccatgttactttttctgttctcttttttacttacccgtccatttctttcttttggcaaaataattttgctaaattacgtggcaaaataattttgctaaattacagcgaagaggatcacatgcatcagcactatttacaacaatcctttagggtatatgttagtcaaccccgtaacaccattcgtacccattaatcatgaacatttcgcaaagttttcccaccaaaaacggcgtcggataaggtttttggcattttgtgtttctttttttgtgtgcatagcataatttcattttaaccgtactattcgaagatttttaaattggataaagatgattcattcattacatagtcgctttgttgttactagtgataaattcatgttaatgattctatgattttcggccagctatctcattaattattaagacgtttaagtggagctattagcaatcgtgtatgacataatgattagcattttcatgtgccatgcccatgcatgaggcttttttttgtttaaaattttattctattatatccgaattttgttatatactaaatgaacatttgtctctgatttggtctactagttaattaacctttagcttcactaataaaaaatctcatgattttgatacttaaacccaaaacatattaaaaacaattagcagtcttttaaatcgataatgtgcttagatgattatacgttcgtaggaaactcttttgtttccaatgcatgttaagaactaagaactcgtatccttaagcaccaatgctttatgcttaatgcctcattagagatataaactgagattgactgtgttctgaatcatcataatataaggcacacaaagaacagaacaggaaatacttagcaatataataggtttccaataaaagtgaagaagaatacaataaacttttataaaaaaaaaagtatataataatttcacactcgaatcaaccaaatgtaagatgtcttgtccatttacacatcacatgagtaagtggattacagattgcaattgatgaaatctggatcttagctaaaaatttattacgttactatatacatcgagttttaagatgttcataatcacaaccacaaccacaagtttgaagaaataagaaacagagtaataatatatcaaataaaatttcatggctgatggaatcttttttctaattgtaggtccaaaaaagcctaaattaatggggaaacaaaaaccaaaattcaatagtaattttactaattatgtcttggttaaatagagtaaaaagaaaattaatcacaaacctccaaaaatcaactaattgagatcaaaacacgtgtcgcatgccaatagggcggtggatcacatggtaaaaaaattcactttaatttttgtctttcttcataattcatctcacagatttcaacttctcttttggattctctcaccgtacaccgtcggcgtaccactccccttccacaccgtcggcattaaaaatctcaaaccctaaaacccgtatccaataacccacccggtccaaccggttattcaaacccggtcaatccaaaattcgcctcggaatccaaacctccatacccaatctaacatggaaaaacctccaatcacaaacctccacgtggtgatcactcattggctcttattctggaatccaagaggacctttttagtataaagagccccttcgttggtcctatcaccttctctctctcacacactaacagaaagcacaaaaaacagagacaaaaga

SEQ ID NO: 3760 - DNA, 2000 bp, Arabidopsis thaliana
ctaacatttttatctcccaaaattgtctacttctttgtaggctattattgatggtagaaatcagattttggtcagcgtctgggcttgccattgcctcctctagcttttgcctattctcttcagtggctttttgactattttgatgcttagtcctagttcaggtaatgatttcttgtataaatctactgacattttcctcaacatcctccatggcgtcaaagttccaagctgcttaaattaaaatagagacttcctcattgtctttcaatcttttatcgtacttaaaaactccttttttcttttcctcgaatacattaaagtgagtaagaagtggttgacggtctgagctttcaaaccttaaatactcccaacgactggatgggtaagccttagcccttgttccatttgacatagccctatatagtgtgcaatgaacaatgagctcatgtctctttcctctccaagagaagaagttgctcaagtgtctgagatcgtataagtcacattctgacatgaatgacctaatgttcacaaaagtaccttcatgtatgatttgtcctccttgtttttctgatgcatcaatgatgtcattaaaatctcttgttaagtgccaaggttcttctctattcccatgaataattaagatctcatgttttcaacaagtattactaaaactattatttttattcttcaaactcaaaaagtagagctatatagtgacaaaaaaactgttgcacgtaaatttatcgtcataaaaatgacttttaacataacacgtgaattacacattgtttaatgatacgttactaaaaaagataacgttattttttgaccaccgatttttaagtaataaatacatgaattgttacaagcaaaaaaatgttgagagcttattcaatttcatcatactagtgtgacatcattgctacatatattgaatatattgcacgtttttagttacacatataaacactcgtatgcataactacgtcaggtatcccgacaacaaaattcacctaatttgttttagttagcaaacctgatctaaaaactcaacattatgggtctttcaacttgagttaagtacacaaactctcccataccaagctgtgaagagatccaaaaaacaatatccaatgtctacatttatttttatttctattttaaagaaaatataatcgatttagcttcaataactctaaaatagaaaaaaaaagaaattactatatatagattactcttaaattttcaatcaaaatccaaaaaaaatatttctcaacataacacatcttactactttaaaaacctcacaaaatagttattatattattcttagtcaaattcataacctatattccctattttccggtcagtcatatgcttttgctaataaacttaaatatagatagatctgataaattcttttcggaaccaattattttcttcccttaatttattagttgttaccctttaaatgatcttaattctaaaaaacagaccaacaactttattagctacccttaaatgatctttagttttcaacaaactcatcaacaattttataaattcttaaacccaacatcatccacccaaacacaattattaaaaaaacaatctatatgtttataaacatataataaaataaaataaaaagacacaaaaagaacgttgaaaaaagaaagaaaaagacacaaaagaacgtttgaggaaaccaataaaaagaaaaatgggcctgagagactgaagaacaacccttttatcacgtatcgtgtctccagctgtatatatatttcccacacacactctttttcaaaaccccaccgacgatggcatttccgttattattctaacggtcacacgtcccttacgtgtccaccacttttttttattattattttaatcccatcactctttctctctctctccctatcttcttcttcttcttcttcttattccccacactctcttcttctctacttcaccatcattcacacacactc

SEQ ID NO: 3761 - DNA, 666 bp, Arabidopsis thaliana
tttgtttttcttctttttttctgtgaaaaaatctgacctttttttcccagttgattcttcattgatttgtttatcttacatcaattttatgagtgctgatgattttgagtgttgtttgtgttcttgattacgaattttacagatgtaacataataagaaaaagtaaacaacaaaaacagaggatttggattgtacagtatgatgttctgtttttctgcttgtaaatcccttatctgtcttttggcccaagtaacaaactttaaccttttcttttgggccagacttcaactataatacgttttgtaggctatattttttcttttaactagattcgaattggatggcttgggtatgcggtatcagtgattacttagctaaattcaaatcatcaagaaatgttcacatgatttcctgcaacatgtcaaaagtcagatcaacttagtttgataagttatgttccacgaaattatgtgaaaattgatttgttttcttctttagtttggtgctttcacactgttaatccacaaagccttgttgtaaatcttgaccaatggcctaaaagtcaaacctttgacttttcagtgtttcttctcaacactcaagagatggatgataatattcacagatgatcaaaatctttcacacaaacctaaaaaacacccacca

SEQ ID NO: 3762 - DNA, 2000 bp, Arabidopsis thaliana
aagctttttcatttgatacattatcactttcaagtgaggtcaactctttaatcaatgtaagttgattttgcaattagaatttgtggcgtagcaaagcgcaattagtttattcatttatttcaattgaatgatgaaagttataagtattgaagatatttgacctttggtatagaagaaatactcaaaataaaacgttgactttagtgttgaatcatacttcctttgtttcttaatatttgtaatttaaggtttttacaagtaaattaagaaaatatataaattttatttaatttatctatttcctataaaaacatcattagttataactaatctaaccaataagaaagtaaaatataattagctaaaaactattaaatatatttttgtttgcatagaaaagtgagaacaacacttataatagaaaaaaagaaatatttaaattacacttagttagaaatcgagaaaatataaaacaatgcgtttcagatataatggctcttcagttcgtgatcggcgaccgaggaaaccaatctatatagaacttagatataggtttaagtatacttttcatccattttttgagcttcttaactcgtagaagaatgtttgttataccttactataaacatggatttatatgcactccttcttgggttgttttctcttcatttactaaaatcagttgaccaataataagatataaaaaaagtacccaagtctacgcagttgttacggcccattagagtaatgaagagacaaaaagcaagcaacacaaaaagcgacccaacttgagcaccgtcacaaaaacggcgtcgttccaaaggatggtcaacaatggtgggaacctctgcacaacaaagagactttcctcgagatttcttatattcgcctgctaaacgctgtcgtattagtgggtagatgaaaaagacagaagggcaaatgagccgtgtcttccataattctcaacaagataagataaggtatggctcgcatttttaggtattgtttaatcttcggttgcgtttcttatctttttttttctcctaattttcatttacagtgatttgatttcagctcattcctgattttcaattttctgatttcagcaaaaagtccttatctatttttttcatttatttaaggcaacttgttttctaaaaataggaatggaaaaataaaccgaaccgatatatttaaccgaaacataaaactaaactaaatcaaattaaaaattagaaaataattgaatagatactaaattctttaaccaaaagaatcgaagctgaatcggtgccgaaccaaagtattttggtaaccaaaaatatccaaaatataattatattttcaaactaaataattaaaaattcttgaaaaattatataaaatagtaaatttattagaaattaaccaaaaatattcacaaatattcaaaacaaattaaccgaatgaatactaaatttaaaaaaaaaaaaacagaatcgaattaaaatcaaaccgaaatactaaattttaaaatcgaaaaaattaataaccgaatggatacgaacggaaaccgaataaataaccgaaaacacatgactaaaaagaggtattttcctccataattaaaaggtgtttaataatagagtgatcggcgaaaggtgtgaaattagctgttttgtcttgaagcggattcatatataaaagagcgtgtgccctctttgcttttaatttcagacaatcttcttcttcgttgcagcttcgtggaaattattttctctttctcttccattattatcttaaaggtccgtcttttatccttcttctttttttgttgttgtcctaaaattagggttcttccttgtgaatattgcttgatctaggaaactaatcaggatctgggtttgtcttttggatctagggttttattatagcatttctgggttctttgttgaccaagaagaagatttgtattgatggaatgttgttgatgttgttgtgaacagtgagaaatcaataag

SEQ ID NO: 3763 - DNA, 1515 bp, Arabidopsis thaliana
tctcaaaaaccccacctttgatcctctcctccagtatagtctcattacctgaccgatgtttctaataatcccccttcaaacatatttcattttaactatgtcggtttagagattactggttgaggaaataattggagagtgctagtataaaccttatggtatctgcagcagaggtttctttaatctctcaatagtagatgctttgaaacttatctataatttggtattgtaatgacagtttgtgtttggttttttcttcagtatcttctttgtttgatcatttgatgttggtggagttctccaaaatatttatgctattgtagatcctaacctttctatcttgttattcttcgttttttggccattattttcgtttcgctcccgatccaaattccaaagtacttcaacaatatcttatgcaataacgagacaaacacttaaggtcgtgcaagaatagtgtctgtttttcactgattcacttttacagagaacaaactgaattaattttgattattgaatagttgacatgcaataatatttgttaatccaaatgaatagataaaaaaaaaaattccttgagagtaaagaaactaaattttggaagacaatttttaactagttttctctaaaactaggaaagtcagaaaatgagaaaacaaatttgattttattacggaagtgaagggctttccgacaaattgctttgctcagaccaaactgtaaccgacccaagcccaataaaaaagcgaatcgggtcaaacgaaaacagataattcagaaaaccctaaattcgtttctctttttttttcttcattctgagcaaagcagtaactctcaggtgcgtgtgctctccgctggttccttagaacaatcggcacacgctttttcatttcaatcttcttcttctactcttaagtatctcaggtactaatctcgatttctctatttctcgtccatggagatttagatttcaagtcagatgcttttcgatttgttacagatgtataatttttgtaatcgattgattcgcagcttggattgtattgagccatcgacataccttcaaaattcttataattgtattgaaagtgtttgaatttaatgtttttttttttctttctctcgattgttttgatttctgggcaagtgtcaacttttgtaacagattagtgacctttctctttatagatatgtggaagaatttggaatttacaaattcggttcaccatttttatctgaagcactgaatttgcgtttttcaagcttgagtgaatattatttcttggctcttaagattttgcatgtcaactattatttcatcattgttagcatcttgtggtgttcaagttattattttaaatattgtttgtgctactctatagttattccctatgttgttatttcgttcctttgccttagcgtgacatctttatttggtatatttgtatctgtgtgatttagtttcttcaggctgttaaactatagatttcatgtattttgtaggtctgttgagag

SEQ ID NO: 3764 - DNA, 2000 bp, Arabidopsis thaliana
aattgttttgaccgcattggagctagtgaatctgattctgattagggtttagaaaaagtaaaaatataaacatgattttctccaaaaatcacggtgttaatgactaggctccagacaacaaatcatactagtagatactcgttaaccgtgacgcagcgttggaaaagatatgtttagtattattttaaaatacatttgcatgctttatgcaatgtggtgcaattattctataattcaaagtcccaaacttgccggttagaattaaagactgatttttcgaatcttcatttattttgataatatgctgctgaattaatactactaaatagtaagaagcaaaattctttattcatgattatatatatgttttctataccacattatcaaagcatgcatggtaatgtgattggctcaatgattatctcaaagatagaagttttatattttcaatgcaaattttaaaactgttttcctgttttacccttactaaataattagataaatatttattattatttttaaagtatattagaggataaaattgtctttatacaatatttcttaaagaatgtgaaatttctaaaaaattcatcttactgagggaatggagggaatatactacaccgagatatgcacataataatacacgaatgtattttatagatacacttattagctatagagataatatttaggttaacataaataatcttaggttttgaatagatgttgtggttaatacgaactaatctttcatcggtttagtacatactattttcataagcggacaataaactgctgtggacttagtttaaagacgatttgtccgcaaaagttttattttatttttttggatccacaccattacggattataatttgtgaatgataaatgaaaaacgatccggtctataaaaagttttgcccaactgaaacgcggtaaccatttaaaactttaataatgacctccgataaattactaaaattatttagaataagtgatgttaattaaagactaaaaagtagagatggcccatttggatactaaaggaagaaaaggttgcagaagaaaagtcacacgcttccaaagttcctaaccatcaaaaccgcctgcgaccctcccatgtgctttctctctctccctctagctcactaccaaatttgtttagggatgctcgtgattatttcaaaactttgcagctacattttaaaatctttactttttttcttctaaatacctccaatatagtagtagaaatcatcacaagaaagaaaagaatccgacctttttttcttcttgctttggtgcaggaatccaactttttgtgaaatttaaccattgataaaaacctaaaatttttgaaattttaaaattttgttgaaaaatcaaagtttacctctatatatgtgtaacaataaattatgaaacgaatcataaaaataaatatgaaagttaatgtcaaacgtgtaagaacaggtgaacaagccaacaaatgtaacaaaacattcaatgatgtttgggtttatatactccaataactaccaaaataaccatttcttttttctttttcttaaaaccatgtttcaaagtacatgcgcttgtgcccatatgttttgctgcaaaataataaattcaccattgaaaccctaaatataactttttttttgcagagtttttttttttaaagtaaagaaagatcaaaaagtaaaaaataaataaaaggtagggaaaacagttaaagcagtaaatgaacattctataaattccacttcaaccatcaaccttcttcactcccatcaaagcaaaactatctttctccttctcattcctttttctctcactctcctccattaaagctctgcactttctcaaagagaatgttcatgtaatataacatcttcctttcaaagtctttcttttactgttttttttcttctatctttctaataaccaataaaggtataatttttgtttgaaatttgttctattgcaggggtaag

SEQ ID NO: 3765 - DNA, 1628 bp, Arabidopsis thaliana
tcggcttaaatccaaatatggatttgattccatatgtatgtgacagtttcttaacgttcatattacaatgaatgatggatccttgactagacaaagagaaaatggattgtcacttcgtaggaaaaatagaaattctccacgaaggctggtctcctttatttaacgacaaattcactcatagtctcattcacaatttgaacttgtctaacacaatgtgttatatactcgcgaaaagaagcataataggctcttaagggtaatccacgaaaccaaaacacatataaaacattaatatttttctctaaatttattcatatcaataataaagtttacaaaaaatataaaacaataatccatacttagcccatagcttcgtgtggaagaagacttgatttttgactagtcaacgaaaatgagtaaatgacgtattcagctatagtaaaagggatcataagcggaaattacaaagaagctttgagggtaaaatagtcaaaaagcataatcagaaataacttaggcccaaagcaaaaaggaaaggactctggatccagccgcaaatcagaatctggtaagttcgaacgccacgtcatcacctaaatatctgaaatatctaattaagacttgtctatatataaaggcttctcctttcacaatcccaaacctttctcttctctgctaacgagaaaacaaaagctatcgtctttgctactactactactactattattacattgaatcctttgtgttcttcttcttcagctgctactttgttcgagtgctttcttacatgccgtcggagattgttgacaggtttgtttgttacatttttcgatttttctccgttttttttcctctcttctgtatgtttgctaaatgtgattgttcattgttagggtttaagattttctttttatcgatttttgttgttttgtgtgtatatcctccaagttcctttgtttgtgtaataggtggaagctgaaaggtttttcaattttagggtttttggggttttttgttgactgaaatttgttaatttggggcacaatttgtctcttttggattgagttctgtgcgatttgtggattctagttcgtgtgtggttaagagacttggaaattagaggatttttagctaaaataatcgttaaaggtggtacctttcctgatacagaagttagattatggattctatgttgaatctttaggtgattctctgtttctgagtttgctctgttctagtttcttaatctgttcgtgatggagtttctttcttgctcgctgtgatgctgcagattatgaaaacttcttcttgtagctacttcggtgtaattacgttcaggtggttaaaaattgtttctttgaaaggtgctttgatccgaagtatagttgaacctgttgcttgaaattttgtgaagagagaaaattggagttctcgagcatgttgctaatcttgcttctatcccctttgattctaccaggaaaaggaagtctcgtggaacacgagatgtagctgagattctaaggcaatggagagagtacaatgagcagattgaggcagaatcttgtatcgatggtggtggtccaaaatcaatccgaaagcctcctccaaaaggttcgaggaagggttgt

SEQ ID NO: 3766 - DNA, 2000 bp, Arabidopsis thaliana
taactttactaaatgactgtgataatatactccagatgtaatcaatactactagaaaagaactaagcattctaactagtttacaactaaaatacatatatatacatttgcttacaaatatataagtatgaaaatatgaaagaaacgttttagagactcagagtatgaagtacatgaacaatcatagatatatcttatgaatagttttttttttatcaaccacacattaattaaaaaataattctatgattgattgtccaattagaaggagaagtgtttacaaaagtaatttcaaaaaataaaaatctatcatatgaatggttttaaatattaacgtttttgtttataaagattatatagattacatggtatctggatattttaaagctgttttcccttttaaaactattttcttactaaaatatgtaaatatatgaatattctcgtcggcaaacatcggagagctagcccatcatcatcgcaccaagtgctaaaacgcggtattctatggccattaatggaagcaataaactataaaatgtactaaagttacattggtcgcactttagccaccaccaccacatttcgtcgagtttgatttgatgatccatttcttgcatacatccaatctaaagatcgctaattcttctacttaaaaacgttaataaatttatgagtaatcactttaaaacaaagttgtacaagagatagttacctaatttatttgttttggtaattgacattgtccaagtacagcgctcatgatgtaggattatgtactaatagtactattgaataaattgagaagaagaaaaagtaatataataattttaagaatctttgttttggtgggagacagaattataaaagtcacctattattattagtcactcttaacaaaccatgatatcaatttccaagatttatagtttatactttatacgtagggttcagggatccaagtccatcaataccacttgtttcaaactctcattagtaattaacactaagcgcaaaaactaaaactaatcaaaagctactagttttcataaccttgaactgattttctttcttttttttctatttactttctcgctttcttcaacaacaagcagtctctcagctttttctttttctttatatttctctttcatataattttgatctttttgatactaacaattagggagagattcatctttaatactttatgcagccttatttagttatttcagattctttcttataatattttaactgatatgaaatgatatgttccctcttttttgactttttgtaaggttggttataccagctaaagcttaatcctcttttggactcttttgacctattatcagttgattaaaacagtaaaacctcgattactgttctttcgagatacctaataaagttatagaaaaaaaattgattatcaaatttataacctgaagctgatacggtagtggtttctgagtgagtttttggattttgtctttaagaaacttatttaaattcccaatcaagaatatgaaaattttagtattttcaaactagtttttagtttacgttttctatcttatttgaacacctaaaatctgtttaattggagttttttgtttctcaaaaatatactataaactacgaaacttgtattctatagtgcccctgcttgggttaaaaacctctcgtggagttatacacaattgcaccaaatgttcataaattttgaaatgtttttaattaaattataattataatagatatattcaatcgttaaaataatttagtactaaaatttagtgatacaagttcaaatattgtagtacctaataaagttgataaaaataaaaaataaactgtagttctaaaattttataattatgactcacttcatagtgaagtctcgatagactctctcttcatgaaatcatagtgaaatctcattactctctcttcatcttatttcttcttctcaaccaacaaatctctctcaccaagaag

SEQ ID NO: 3767 - DNA, 2000 bp, Arabidopsis thaliana
gaagccaattaacccagtggataggggtttaaaggatttacaccaaatgtttagaattagattaccaaaaagtgcatcttcttgcagattatcggaggttctagaggaaaatttatcggaggttctagaggaatgcatgtagagccgtatgttgtagtcttgtgtgttgcatgaacattaggtctattgatatgttgttttttttggtattttaggtcctttgtctaacctttgttttgagtcatctatcatgtcgtagtccatgtattacgtctttttttgttgcgtcttgagtctttaacaggtcttaggtactagtgaaaagattggatagttttgacctcgtttggcttgaaaaaggatgagaaaagctgaaccgaggagaaagaaggagtcaaggagacggttagactgatcggtccgtgcattgacgaggtgggcagagacggttagaccgatcggtccaccgccagaccgattggtcagtgcttcattgattcggcagagattgttggaccgatcggtccaccacctgaccgattggtccaccagaagaccgatcggttcggcttcacgatgaacggttccggtattccttaaccggatttatcttctattttctgtaattagttataaaaaccccaaaacctaattttatttttacgcttctttttctgcaacatttggagagtatttttgtaagctactacctttgggattagagattcatccttcttgataatttggagaagatttctaacccttatttcttatttattcaatttgaattatgtttgctttcatatctctttacttcatttctattgctatgtgtgaataattctccaattgaattttagggttctaagtagaaagtcaatgaattagtaactaaattgttatacagagttctcaatctttggggtattcattttctgtgtctttaatgctagaataggattgatcacttctttttagaaattaggtttttgtatgcattaaaagtgttcgacagagacctgaatgaatataaattgatcattgtatttctaaccatcgaaagttgacgttagaacacattgcgaactaaataaaccaattcattaatgcgaatttgattaggaaactgcaaacgaaagtttagtagtcgagtagtcaaatttagtggctagtatctcgggagaaagttagtctagaattatgtttatgtttgagaacggttcttcataattgaatttcctgttttgtttattctgctagtttttgtcttttgaaataccctaacacccaatatctccaatccataagtttaattcttttatttattttcattttcatttataattctgaaaaccaaacaaacaacctctttagttttagctcataacgagtttcagaaatttttagagtatcttttgtccttataaatcgatctcaaatatacagtctagcgattaagtgtattgagttaattattcgagcaatcatctatcacttggatgtcatacatgcatgaccattgtctgttgtccgtagtccgttgtccgttgtagaacctaatgttacataaagagttgaattataaaattattgttcgtggaaactgttacataaaattagagttacataaagagtttcaccgtaatttcatacgcaatagaatgttgaaatataataatataactaaatttatatctctgatcataatacattagatgacaataaaggtaagatacaaaaaaggggaacaaacgttaataaaatttatattgagaaaattatcactttccgaaaatatagaagttaaattgaaatatcaataaataagtgggagtacctcaaattaaatgagagtaacaaccaactactcctttcttctatactctaacgcatacacattttttaaaacaatttccgtctctatataaaacactcactccacaactctcttcatcacccatctccttttggaaaccatttactggaactaaaggatatat

SEQ ID NO: 3768 - DNA, 2000 bp, Arabidopsis thaliana
atgtcaatagtgtttgtttatgaaggaatttatgatgagattattcgagaaggagtcgctttaagtgacccgatcctcgtgacgactcgttgctctttctttctttattatagattatagttgttcaaacaaatgaaaagtatctgagacgaataaattaatgggtggtctgtttctgtactataaagaggtccatgcatgtaccatatcatcttattatgtactattaaacaaatagattaatgattatataatgttttccgatatattgaaattagtttatgagtcacgagttaaatctgaaggcttcaccaaacctaaagttaaaagtctcaaaacagttaaacactcttgtgatatcatccctgtatataatctttaatgaaaacgtagaaaaaaagattatttgcaaccagaaaacatctgaacaaatatccatttctcgtggttttatgttaaaacatttgtcgtgttgggaaataattgaaacttttattttccaacattgaatttttctttatgttaaaagtgatgtgaactttgtataaaatgaaggaaaatttaaaagcactcccctatatgcgatgcgagaaaagggagagaagatatgtatgcacttgtttcttgtcacgttccgtttccacaaaatcagtagatatgccagtaactgtgttatcttcttcttttcgtgcgtctgtatccaggagacatataaatgatgctgaatttcctaactatttttaatttataaacatgagaagcgttaaatgggtagcagcaatcaaacgtttggtgcttaaaagcgcttatttgaagtataaacaatttgatatttataagataaaacagcattacatatgaaatatcatgattcataactatatatgcaaaatttgaaaacttctaaatcccaaaattacacaaagattaactaaactacattataatttataaataaataaaaagattagtatcaaaactaaaacgttaagaaatatcataagtgatgattagacgacagtcaaaatgttaaatttcatgatgaaaaaacaaaaaaaaaagagtaatttgtccaaatacaatcagctgactatatattttgtcaaatcatatatcatatatactaaaactaagaaaaagataaccatcaaaccaattcaatttatatccacctacatatgactttgatacattttttgtgtagtttgatcagtgataagattttcaatcctctatagtaataaaaattgctaatttcgataatttaagagataattacaaaaccaacaagcacctagacacccctaagatctaggagaatgcatcctccttagtcatcacttccttataaagtaaaactataaaaactgagatcacgagagaaaccgagaaagagagccaagaaatgcatgagttaggatgataatccacgtgtcactatcctattgcatgaagagtatacgtgtaagctcgtcacataaagtttccctcttcttcttcctcagagtttttaattggccattttattacttttccataaataataatataaaaattcaaaatatttaattccccatttgctgttgtctttccttttcttcttcttcttcttccttccttttctcgtgcaatctccaacaccttgactacgcttcttcatcccaccaacaaaaaccctttctctatcaaaaccaaaccaccgttagtttttctttcccggtgatacgtttagatagcttctttttttttccggtggttaacgttgacgattgactacttcaattctaaacggataagtattagatagcttcctcttcttcttctccagtatctggcgacgaattcaactagagattattttctctttttcttgtctcctcttgatcgtttgtttttgtttgtatctggattcaatgacgggatttggttaaacgaagaagattcatttctctgttcgttcgatctgtaaatttttgctttcagagtgagattttaacgaa

SEQ ID NO: 3769 - DNA, 1772 bp, Arabidopsis thaliana
tgggatgctaagttagatttgtttctgagcctctagatctagctagtacgatccttaccatatatatatacacacacacacataattgtttatgctttcatatttgtacgtatatatcatctaacgaatctaaacacatgctatgttaataatgcgcaatgacaagtgctaatcatttcggtggaacattgattatttgtagggaatgattttattcaaacaaagcatacattattgagctaattaatagatcattatatatgaaggaagttttaataggatgttttctttttttcttgtaagaagagactttatcatagcaacgagaatatatcccaagcataaaacattatatacaaactcattcaaatgaaaacctaagttagatatttaatttgaccactcttaaaatacttgtttagttataacatgtttactatgcagatttatgaggcgtatcagatggtgtgctagagaacgtgatacaaatttggatgccttgttttcaagaaatcttatacattccttggagatcaatttgtattgtgaggcttatagtcattgagcttaccgttgattaactaaatttatattatatagaacatcaaatagacgaaaaaaatcaatttagttgaccaccgtttgttagctaggttataaactctgacccaaagtgtcctatgctttcagtattcagtttattttataacgtgtggggtcgttttggaaacaattaaaacaataggggctatatttttctcaagttctgttggactgggcttgtcgttaatcaatatttgggcttttgaggttgactcgcttttttccgttcttcgttttccaaaatcaaacccaaaaggatttggaggagttaattcacctgacgaatccaccaccataatattaagcacatttgatctctcacttccttggtgcgagtgttttgttttccgagatccaaaatcttctcttggatccaaagctgtgttactgtggatctcctcctcctctctccctggatctcgtacctttgaggtttgtctctctgtgttaaacttgcgactcagatttcatagagatcgatcccacttttgccttttcctttgtgaaaatctacaatgttcaattattctctggcgctctttgtttgatctcgttgaatattgatctgattccggtaggaaaccgattttcatgtttgtgcagctgagtgagactgcgaattatgtagatttcattgtttgttcatctaatctggggagatagatcgcattttttttttttttgaattttggttgatccgaagctgttttaactgatttttcgtttttatgttattattttggtcgtagttgtagtacagtgatgtgtattgctggatctgaggatttagatttgtcaatgttttgcatctttgggtctctgattggacattaccgaatattcttctgaaattatgatgttttctcataaaccacggattcgagaatagagatcatgtattcaatgtattgaaatccaagcagagaggtatggattatcgccgatgatactgttgaacttcttgtatagaacttactctagcactgatgaggacactagtaaggtgcttatattcagtaattcgaacttgaaatcgccagaaatattaaaagttttgatatcttgtttttacttgtgatctatacttcattatgtctttaatcaattgtaacaattttgctctattcatcttctatttcttatattaacaaaggaacacttgttcgtga

SEQ ID NO: 3770 - DNA, 1157 bp, Arabidopsis thaliana
aggtgtcttaaacccgagagttgtatgtaaaaaaactcaacaaaatccacattttgaagttaaccctcttaataaatagtatatattctacttccttaaactgtggatgtgtttgtataaatgagtcacagaaactatttgagagaaatatcaagttttcagaataagaatgtctttttatataacagtcaactgcatcatccaacaattggagaatccaaggaggagagccaagatcagggtacgacaacatctacaaagtaccaaacataagtaacatacaacacattctaacactaaagaacagcgacaaaatggtaacttggtaatagcaaaaacataacaactctcaataagaccaaacacaaacggcgtagtttaatcaataataatgaaccggaacctaccggttcaagcaatcggttcatggttaacaattaacaagtaaatgtaaaaccctattggtacacccttgccggagagaagcttttgtctcaccactcaccgtcacaacttgtgcttcctctcgtcctcgtcgccgtcgtcagagagaaaacgattaaagctggtggtatggggagagataaagaagattaagacagagatggattcggttgttccatggatgagagctccggttgacgtcagcaatgtcgaaaactgcgctctcgataccctcccttgccttaatcccaagtaaacatcgtttatctgtttaaaagtttttcgttttgattgaattatctttctgtttacgacttttgactgaaacttgggcttcgggaaatctaggcaacacaacagcgttttgaccttactatgtcaaagttgttcgtttctaaaggttaaattttgatttggttgcagttagagatttctcgagttattatttgctctttcgaattggagtattagatactcaaatagtatacacttctgttaatactgaagtaaaacacctccaaatttgcttagtgttaaactgatgttctgtctcttgctcttcttcttcttagatcaatttcttgtttgaaaattttaccatatacttacaatattcatacgagtaagaagaactgttttggatcacttggtgcgtgatgaatgcctcatttttcaagttttgatgtgataggttgaagaaggcattggagaac

SEQ ID NO: 3771 - DNA, 1324 bp, Arabidopsis thaliana
aggtttgcttctcatgctctgaggaatctaagagcaaatgcagcagcccgaaattctagattcccacacatgttaattttgttgcctcagaaaccagccgatccttagtttcctatggatgaaacctagttttgtatagttgttgactctatctctctgtaatgtgatcgctagtgatttcttgcaaataacttttgtgtaaaccagtaaagatatttttatgtgaaataataatcaataggaaaatttcttatagagtttagtaaaaaaacaattttaatggagacgttttagcgaatactcaccacctcaaccactgtaaatgttttgttatccaaaaacttctaattcctaagcttttaacttttaaagcatctctcgttaaacaatttgtatttttttgcaaaacaaaaataaaacgctgtatttttaaattagaatccttaaggttgggtatttttaagtgaatcaaaaattccaaccaaagtaatggaactaaataactgttttttattagaaaactgaatacgtacatataccaaagtacataataaaactagttctattattgatatatataaattaaacacagatttagattatatttaaacacatagctaagattgtttactagagagacttaattaggtctctctattggtggtctagcttggcttcactctcgaattgaagaggaacaacgtgtttgtttagtctttttaggacttacaattacgtctctgttgtttagtaacgatggcaaataaaaataatgatttagtatatttgaacatggtcccaaatgggcaagttgtaaaaagaagacaagtagagaaaattcaaaattggatttcgtggatattattgtaagttgcagggaaaaaagagtgagactgccccaccgtagactaaaatgatttagcttaccactctcactctgcatccacagtttaataattacccctttaatattttaatcattattttagtagaccaaaactgtttagtgttgaaacttgtgcatccacatgagtgttggttaaaggttgagaacatcgatttgccaaccatatctcacagccacagccatttttattctctctcggtctctcttctcagtctctcactaccacagccttaagttcgagaagaccgaagtggacttcattttcttgtacgggaattaaaatattgcagattgacgacatatactaacatgaatcatcggaggagtaaatttgccaggtacttcttcgaagttttgattaactactatttcatatttggttgtgatagtgatcattgttgatacaggatagatagt

SEQ ID NO: 3772 - DNA, 2000 bp, Arabidopsis thaliana
agctgaaactttctgtgttacaacaatttcaccataactaaaattgcatttgcatttgaatactgcaaacgcaaattggctttgtatacgcatcttgtttatatatggattagttttttctacataattaatgaaagcttttgtaaactaactcttgagtactaactaataagaaagttccgtggcaaaataatttccgaatcatcggataatcatccatttacgaggttaagttccgggaactgctggtgttaaggttctggaagatctccggaagattggcattagtgagtttgattctcttgctgatctgttgtttgccatgccatgaatatgtgcaacagctcttctctgtgtagtgttcatcacacatgcttcaaactaagcttatgcagctccttctcgactagcttgtcgcttgagttgtctatgccgcggtatagaggtttaaagtcgtcataaacctgaatctgacccttgaaatcagcattagacagtccttaaacttttagagccagcaaatatgaaagacaatcctgaaaaatggataatcataagaccacaaaagtcttttgaaaccatttaagatcaggagccagtacactatccgtctatcagaatctggcaataaatattatcagaagcttattgattatgaagttaatacatcttaaatagaatcagttaagcgttttttgtaaatctaaatcacatgtgaaatttctttatgtcacgttttcatttgtgtaaaacaatatcttttgatttattaagcaaataatttgcagctaaagctctcaagattcaaataaattgaaatgtaagtagtgtaagtagtgatttcttatagaaatagttgaaatctaaaagtattaggacactgatgtaagtattgttaaactaaagagatctatcaggaaatcaaatcactatagttttttttttttttttaaattccttgagtttatcaaacaaaaaaatgtaaatgtccctagcaagtactgtaggttcattttttttgtttcaaaagagtatgttatttcttaaaaatcgccaaagatagataagattcgaaatttgcataaatgtggcaataaatattatcagaatctttttattgaataatgaagttaatacaccttaaatagagaattaagcgttatttagatctaaaaccacatgtgaaatttctttatgtcacgtttttgtttgtgtaaaacgatctctttgagttaatttgcaactgaaagctctcagcattttacattaattgcaatataaatagtgatttctcatagaattagttcaaatcttaaactattaggacagttacgtaaacattgttaaactaaagggaccaatatggaaacacaaatcactgtagttaatttttattattatcttgagtttatcgtctatcgtgttcgaattctctgtcgcttacttaaacacagtcaaattcattttctgccttagaaaagatttttatcgaaaatcgacgtttttgaaaaaactcaaattatcgtcgttttgttctcagatttcttctgctctcttcttcttctccttcttcttcgttccaccgcctctgttgctttatcttcttcttccttccttcgattgttgattacgtcggtggatctttgttctcctctgtgttgttttcattgctagatttcgtcaatgattggcttctcacgattcgatttttccggctcctgttcttaatttcctctgaggtagattagtaaaactctttgtctcgtaaacattgttcgatgatgaaattagaaagttctcactcttgtttgccaaatttgggatatttctggaattgaaaatgaatcgtcatttttttcaatttctgaggattttgttacaattgttttttatttatgttagaattgagattgtgtgatgaatatcagtaaccctagacaattgtgaaatcaaagctatgaaaatcttttgatgctatgtttcctatgatacagagaatg

SEQ ID NO: 3773 - DNA, 2000 bp, Arabidopsis thaliana
gtaagtggaaaagaatttgttagtgggtttaggtgattatgcgtcggtatctttccttttcattggtcctttttttatcttttattttttttttgtcttttgccaaatctattgttcattaaatcaaagtgaaaaagtgtctttggagattaaactattacacgatgctggaaatgttctgatccgatcgtttttcttcttgacgcgttttcttcttacagctgcctagcagcattgatcttccgagcaagaaaaatagtggttaataccgcattatttaatcaagttactattatccgatttgaaaaatgaaatttcctagttttatattattaactctaaagtcttggaatgaaattactgatcaagtagcgaccataaatattttcacacacatcacatattagagagtgggtgtataagacgacaaaaaaaaattagtctcaaatatatatgtagttttaattttgtgtaatttagggttaattaacagtactaatttagcttatttgcttcagtttgatgattacactggtttacaatttaaattatgctaatgaagttcgttaatgcatggtaattactattaagaaatcgatttaaccggacctttaattttatacagtccgggtcagctaattcgattcaatttttgattgaacattttgccttcaattttgctttctgcaaccctattataagattaaaggtccggttaaatatacaaaagggagactagcaagttgtgggacaattatttagacttcttctcctttcacttccttaagtcacatgccattattggggtctatcatatactattactacttttacatgttgtttaacatttttcttcttgatttgataattgaggcaaaaacatgtggaaaagtaaggtctttttactattcaagtgttcacggcaaataaatttacttgcttttgtctctggcatagtagtggttaattataattgaaattgtaggctgaaatcaccataaattagtttgtttagtttaacatttacgtttgagactagtattagtagatattatacatgtaacattcgcattttatgattaaaactatggatatttttaatttttaatgacatttattttagaagtgtctaattaatttttagtgatttttcatatatatatatatatatatatatatatatattaattttaacttcatttgccatcttatatttctaagtttattccgtatatactatgtatatatcaagtttaataaacatttgtaaaaaaatgatgtgtttactaataagtaataactaccttaccgtttttaacaaaacatatttatatatagtcatatagaccgaagaggagactatgtatatgataccttgatgagtgcatgttaaaagcaaataagtaattaacgtcttttctaaagaaataatttaataagtgtatatatatactgtcatagcccttctttatgatatatattaatgaactgttcacatgtgatattaattatttaagacctgatatttctataaactttatccttttgctttcttatatagaaataaactctacatatatatctttagttctttacttcatttagatgacctcaaattattatttttaataaagataatcatggagctaataaagggagggtataagctataaactataaacaaagctttttttgttcggctgtttttggcttctcattttatgaaataaatctttaccatcaacaaattaactaaaaatcacaaaactgacacacacaaaaaaacacaacattttgttcggctttttttttcacttcctttattgttttattaaaaaaaaatttagtttagtttttacataagttttatatttactttcaccataatgaacaatcctcttataaatagaccccttccattattgctctatatcctgtctctcttcagtgacacaaacccaaagaaaagtagtgagaaacaaaatcgaggtaactactag

SEQ ID NO: 3774 - DNA, 2000 bp, Arabidopsis thaliana
ggacacaaaattatttaccgaaattatttattcttcaaatcctaatcatcaaatagtatattttaatgtttgatgattctgattactaaccatctagaatatttgctaaagtttgtattccctctatttcataaaatttgatgttttacgttttgcacgaaaaagtaaattttttattttttaagtattattttgttagtttaataatattattgttatctcttccttttaatattggccacaaacaaaattaataattatacttttacaaaacattaatcttttgtggaacaagtaaaagaacccaaagcatcaaataatttggaagagagggaaaaattaacaacgtaacaaggtttttataagtcgtccattgttaagaaattgggctatagtctaaatatttttttaacaatgggtcttaaaagttaaaacataaaaaaaaatccaaaaattgtgatgagcttctgcaccgatgcccctttattctacccatttttggtctgggtctggtcttcacgtcggctcttggtacactgccactataaattccgaaagctgctcgtcgaatctctacattactgacatgtttggttagctatctgttcatcgtcttattcaccgggcagaatcattcaagctagctatctattcttgagaaaagctttcgaaaatattgtactgccacttcacctttagaaccttaagtaaattgttcgataccattgccattgtaagaaaggattttttattttttccggtttaacattggttttcattttaacttttaacggatcaaaatattaacagagaagtccgatagtgactgactgactgactgtgacgctttttgtttttagctaccgttaatgtttgttttccgttaacggcgtattttagtgtgcgtggacatatacgctcaagtacgccgcacgcttctcttctttttgtcgcgcattcaaaaaccgaaacgatcagaaaaaaaaaaaaagaatattaaataaacattttggactaaacaattaatttttttttaaaataatttctcgaaagagaaaaaaagagagagagagagagagatggagcttctacagtactaaaagctgagtgaatccgaagaaatctccgccaacggaatattttttttctgggagctgaaaatcgttggtgacgatggcggattctctttctagggtttacggaactctgtttagtggtgttaatatatctctcttctcggatccaccgttgaaaaccccctgaagagtgtttttttttccgggtttaaggtcttttacgtttcgttttttcttgagatttcgtcttccgctgtgagtttctgttctcgcggcgagtttttgtgtagatctgagggttttcaaggcaagagaaagtgtcggtgatgtcgattttctcactcgcgagctcttctggtaaattctcgtttatctattagcttcttatactgtctcttccaagtgtagtgatctcgatttttaaggaattttgaaattggaggaaaaaaagttgtgatgtttcggatttctaattttgtctatgggacctatgtgatatctagttactttgtttctttatctgttaggtcactctgattttggttagtgaatatcaagtcacaatatagatttggaatgtagtttggatttgaacttatcgtgctcaagatttttaggtttatagtttctaaatatatggtacatgatctttagctctggacctatatgttagattatccaggctcaaaaaggcaaagtatgttggaagtgatttgggttttggaccatgtctttgtatattttcatgaatatagaatagtaggttgaattcattaggttgcttaaagacattctttcaaaattactcccgaatggttgcaatacctaatcacatggctagctttagttctgttcttgtcttagctctatctcactgtttttaacgatataacaatcccagattcacaaagagatgacctaata

SEQ ID NO: 3775 - DNA, 351 bp, Arabidopsis thaliana
agaatcaaattctgatagaaatattttatcaaactggagaatcaatttgtacataaatcttatatacaacaagttttaattgcatgatttcctgtaaacataagtttacatgaactaggggatggtccttcgcaagtatgagtaacaagcataaacagcattatatatgaaataaatatgagcccacctaaacccattaagggcccattaagattggagatactgcttttttaagagaggtcactttttccacagtgaaaccctaaggaaacttcggcaagctccagagaaacgagagttccgtaatcattttctcttgttgttcctgatcgcgtagctcaagcgaaaaaa

SEQ ID NO: 3776 - DNA, 2000 bp, Arabidopsis thaliana
ttttagatttcataactatttcacatatatccttataaatttaattttatacatataaaattaaataaacaaaataaatttaaagtattaatagaaaagaaatcctacatattttttttcttcacataacaatattatattaaacaaatttaatacaaaatgtagtaataaaagaaataaagttacatgaacacataaatgttacaagaaataaaatactacaacaatacaaaggtcaccaaagtattatatatatacaaatttgatgtgatcgaatgtttttttttttttttttgaattttgtttttgggtatcattcttagtagttcaaactgaataaactcattaatttttatttttattttgctagattttgcatatgttgttgagctatctcatagctctttcccttagttgctgcacttttattagtagattaagaatttattcatttgatgaaaacaaaatattaacatgtggtttattactttcggacaatgtgatgaaatttaattcaccctcatctctacttaaattgatttgaaatgaaaacatttatagagattgtgatgttagagagtacatatgatgcacaagtttattcagtgtttttgtattctatttggaagttgtgacttaatttgtgagtttattattattatttatatgtaattttatattgtaatgtaatgttttatttattaatcaatttgcttataatatttatttaatgtatgttttatagttatatatataagcttttatgaactaaacaatatgataactataatgcaaaatacaaattattttgaagttgaatttgaagttttatcattgacgagaacactttcaaactttaactatggagttctgcaactgacaaaagtaaaatatccatgtctgcttaaagaagtaattgatttcatttctaaaatcgtgatgatattccaatattttcggatccaaagatgatacagattttgcagaagaaataaaacgaactgcccaagagtaaaagtggacaaaaagataattaggagaaaaatggtatttttgcaaatttctctaaagttttagagttaaataaggattattaatttttccttttttttacctgaaaaatagttgagtcattgttagtttgttactcattttacttataaaacttttaatcatttttacttgaattacatttggatatatcatatatgaaaataataatatctttggtgtgtataaaacttctagaacatgaaaatttatcaatcgtgagttgaatgtttcactaaactttttaaacaattaaaagaatgacaaatatagatttccataaatgaaaaaaaaagaatggacttgcatattttcatgtgtgtatatatgtattttatttttaacacttttggcatacctctttaattaattggttaacttctaaatattactatttgagaagtgagtttacaacgaaatttgaaaattaaagctgtgaaaatgaaagttggaatgtaaataaaacccgtcttaaaattaccttttactttgggagatttgcaaaactaccttttttgtttttttactatttttcactaaaaataatatttcattaaataaaaaactatatatagtagtcaagaaaatatttttgggttataaatataaaggttgtaaaaaataaaaataaaaaaaaacaaatatgtgaattttaggcccgaatatttactttctgagcccatttgtaagcccacttcctaaaccgagttttataaaataataaaaaaaaacagaaataaatagtcaaccgactcaaaataaaccactatttagacgccacgtgtacccagaacaaaacgtatggcctgtgtatctctcacgccacctctatttttcttctgcctcctcgaaccttctttttctcacttctcataaaaaaggtcatttcaaaaaaaaatcagaaaccgtcaaaaagccaccgttgatatttcttccttgttgcttcttca

SEQ ID NO: 3777 - DNA, 630 bp, Arabidopsis thaliana
cgccgtttctgttgcgagattgcaaagattcaggtctcctcctccaaatgaatgttgtagggttttagagattttattttcctttatatattaataaaacttgtagctttataaatttcttttagtggtctagtggttactgtttctctcttcaagcatgaagtctcgtgttcgaactttttttctttgaccttgataacacttgcacacctttttttttttttttttttttatcttcaacacctaatggacaaaattttatttttgtgtattgttttatgtctctctacaaaatcacatgactgattgaggaatttggatccgaaacgatgactagagtctagatatgacatgtattaagggataaccattagttactcgagttgtttagctaagtaagagtccgtgtacgtttttcggtttcttattggctcttcgaatcaaaaatagatgatgatacaatgtaacataggcaaggacaaagtcatcgttgtaaataaagtcaatgatgtaagaaatacaaatataaccgccatttattaatctcacttactctgtccccaccatcactcactgattttattatcatcaaaaacattgagatcttcacccttatcatttgatccaacc

SEQ ID NO: 3778 - DNA, 1511 bp, Arabidopsis thaliana
tcttaaccaacttaagattatttctcttttgcccccataaatttcttaagttggaattttgtttatcggtgatgtttcgtgaaagactgaaagtaattccagaccttgtagatgagacttgaggaggattttggttttttgttgtttcctcaaggtaaaaattttcttgagacataagaaaacatctttgtatgctgacctacccataaagcgtatatattcatggttaattatgggcttacctaaaagttcgaaaattttgtctatagatgacttttggcttaccattgttaaactgatataacgtacatttctgaatttgagctctgattatgatacaactaactagtatgaaccgctaactacgcataatggtcaatatatttggttattataattcttctgttttaattagtcttacacctatatgcaaatttttatatttttctttgattacatcaataatccggattaagtcctagtaattcgttggataaaccaattcatcgctagatgatccgatcatgttacaaaaaattcgggtcaaaggccaaaaagcacaaataacctgccccaagtttgatagagaaatcaaatgcggagttttttagtgtttacgtcatgaggccctaggtccaaagttctttttggtattaatcttataccattttcgtttctaagagatggttacagaatgatacaagtagcggaaaaaaccgaaaaaactacaatgcgaaagaaaaagaacaaggaatagacgccaactcgaacaaaagaaacgacgagatggataagaaccacaacacagaaaaacaattgtagaacgcaaacataaattcaaaattgatgcatatgtccaaaattatttctagaaatgactacatttgcaatgaatggatttcttctagactatacttgttgtttagttaacgttctagactatacaaattgatttatatatatttaaaatcgtgtgatataggttgaatcgtccgacatagttggtgtatagtggtttagaagtagatactaaaatgtgtgagttgttatgaaattatacactaatagtgatgcgtaatagaatgagcaacaacaacaaaaaaatctcaacaacaacaacaatacatgtggaggagaagaaaaagtcttcgctcttcaaaaaaaaacaattgcaaaaaaaataaagtcacgtgattaaaccgagaagacagggaagacacgtgcttggctacattacaaaaacagagcacaccacaacaaacaacaacactagccaggctttttttaacattcgtctttgacaattgtccatcatcaatggcattaaatggcaaaaccgtaatttcgaactccaccaaggggcaaacttaaaagtcgatgtctttcttcttcacctcggacccatcggagagaagatactactagaagagattcattcacagtgttgaaattaaaaaaccgaaactttctcgtttcttcttcttcttctccaattttcaaaattcgaaaag

SEQ ID NO: 3779 - DNA, 2000 bp, Arabidopsis thaliana
atatcacatgtaataagtaataaatatagtgaaaaaggagaggcatgtgaaagtggggggaagaagaagagaagacagctgtgtatccgccgctctctctctttctttccccttcaagaaagttctccacttccaccgcccaccttcttcttcttcttcaccttcttctctaaccattattattaattagcatctttcattttgttgttagaaggaaatagtttgttttccttttttgtgtataactagaaatgagcggtgtgtttttgtgtagagtgtgatttggtaatgaaaatgagttttttttttattttgtgtatgtttgtgtaggtgagaggtattaaagagttgtataatgtgatagtatgagtgtctgcatcgatgtcttgagtttgcaactaattttagatatgaggctattcaatttttgattgatcacttatgtctatcttcaccacagctttactatctcaaaaaatgtacttattttcattatttttcacctaattgttataaggtttctttattagtttgttatcttgtacttttgtcgaaaattctggttaccaccaatacataaaatcatcatcttgacttttgttttgattcacatatatatgtgcaaaggaaattaacagtttcatttttaattaaaaaccaaacgagttactaaaaaaaaaagcgatgtcaagctatcaacatttaactaaacgaatgtcttattttttggagaaaaaaataaattcaaagaacatatcaaagatcacttgacgtcacgtttgtttatttatgggattttgcagaccatgcatgttcttgattccaaattatgccaacatacaagaatcacttgtaaaattgtagcgtccaaatgagtctagcaactttgttatcgtgaccaagccatcatatcaattcatgtatgctaaattcgctgcaaattcagtaaaaagtatgtttaaaatgacataaacgaaatctgttatagtgttggtagtgagtgggtttggctttggcttcgcataaactaatgcatgggtcaggttatcgatccgacctgccaagatagttccgagtttaaaattacatggttatgttaattaattatgcactatgtatgattcataaaataatttcactggctttggacttactatttttttcttttcttgacatcactaaaacactattgtttgatatgtttctataaatgtattatttacacaataacaaaaaaaaagagagaaagaaactgttgaattggagaggaaagagagtggggggaaagatgtcaaggctggtccagctcaaatcgggtaaaaactattatcaaattccaattctgtccctccctttccccaaaaatctgattgtcacataccctaccaatcagacaacgccacgtggacaccttagacatgatggtgggagaggacaacaacatgggaggcacatgattttgtgtttattatatttctccaaaacacaatttttacccaaaaacaatttaatcggatcactgagcaatgagatgtttgcggatccaaatttaacttttaaagccttccttactctttgctttataacaataataataatacacataaaattggatttaattaaatagatgtggacctttttttctaaataatataaaagaaggaagaaaataaaataaataaagaaaaagagagagtgaagaaaagtgggtttaacaataatttgctgcaaagttagaagaggcttcagctttattaacttcttgtttgctttcattctctttctctctatctatcatcatcatcctcgtaatcctctcctttctccttcagacccctcctagttgctgtttaaacaaacaaaaaaagactgcttctctttcttatttctctcatcatcatcatcaatggttttatgagatttatatcaaaaaacattgaggagctagagagaaagagagagtgtgtgtgtagaaaaagattgaaacatcatcaagattg

SEQ ID NO: 3780 - DNA, 999 bp, Arabidopsis thaliana
agtctatcgccaaaacacttttaaaggaagaatctggcacaagagcagaggttggagaagatatataagtatatcaatgttgttttcttattagtttaaattaagaacttggtatacagagaaagacaggatatgcctgtaaaaacagtttaaggcacaataactgtataattgttttctcgtttatttactagtacacatagattaacatttcaagtttcaaattggcttttttttttgcctaaatcctttgaaatcagacaataaaaacagaacataaagtgagcttaaagttttttttagttttatttaagaaaagtccaacgaaaaatttgcatatgaatcccaatcaaaaatcagtagcatagtgcgtgatccaataaattcattttgtacagaatccaagaataatttgtttcctccaatcaccaaacgccattctattcgaccataagtcttatttatctcagttttcatggccgtataaaaatattcctaggcaccaagctataggtgcgtaacgtttctaatatacgattggttttggtattattgttggttccacgaacggataattatgaaacttgtttggacatttaaaaactaaatagtagcttcgtgtaatagtcaaagctattcttaccaagtaagtggaggaagcttgacgaagaagagtagtgcgcattttaaccgaatctacctttcgaagatgtcggcgcaggttaagctctactactatttttcttatttatttataaactgtggaaactatttttttttattattattttatttatcggatgtttacgaggtacgcattatttatttctctataattaattttgctttgtgacaatattcacaattattttttttaaagaaaaaactaccaaaaaaaaaaaaatagcgaaaggaagcttcatttgttagagagataaactggagatttttagagagagaaagaaatagagagagagatcagttcgtcgttgacgatcg

SEQ ID NO: 3781 - DNA, 2000 bp, Arabidopsis thaliana
tcccgccaattttttttttttggcgggaaatagatttacaagggattttaaaagagttttaaaagatttacaagggattttataggggttttataagatttacaagggattttaaaagggtaatttacaatagattttaaagggatttcaaaaatttacaaaagtcttttaaagatttttaaaggctttaaaattgttttaaaaaattttaaaatatttacaagggattttaaaagggttttacaatatttacaatggattttaaagggctttaaaagatttacaaaggatttgtaaagatttttaaagagtttaaaagtattttgaaagatttacaagggattttaaaaccttttaaaattacttgtaaattttttaaaacccttttaaaatccattgtaaatcttttcaaactcttttaaaatcttttgtaaatcttttaaaacctttttaaaatctcttgtaaatcttttaaaacccttttaaaattctttgtaaatctatttgccgccaaaaaatatttacaaggatttttaaaatcatttttttggctgaggaaaaatttgttacgaaaaaaatttttgccgggaatgtttttttttgtcgggaaaaaagtttggcagaaacttttctttttggcgggaaaaaaaaaatttggcgccaaaaaattggcgggaaaagttcagttttcaattacatgtttctattagatgagggtaatttggtcattttgttcaagagaaggggtatttttaaaaatggacaacataaaagggtattgttgcaaaagagtagtaaaaaaagtgtaattttataaatctcccttattttaatatacaaacaaatattatttttacttgtgtataattttgtcttttgataattttcattttttgataatgttaacaattttctagttttgttttaaatatattgtttaatttagatttgacatgtaatatatataaacagatattattttttacttgtataaatctaatattttaattgacacatgttccggtcattttaaaaaccaaactttatataataagataaaaatgataaatcttattctatttataaatacattttattaatttataaagaatacaacacatatacattcgttctaaccgtatcaattttaaagacacaaatacaaactaaaaccaaattaagttcaaccgaaccaaacgagataaaccgatctattctaaaaaaaaaaaaaaatacttcctttgtagccttttgattgttcgagcatcatcaagtttacattgttcgagcattatccaatccagtataaaatattattcacaccggagaacggtacaattcttcaataaaagatgagtcgacagcgaccgctctaatcagtggaactctgaagtttctgtatttttatctttcttacatgatctcattttttttattttttattttttcacaatcttacatgatctcctagtatcacttaattatatacaacgaaacatgtgaactggaacatagttgatagaaaggaaaaagagggaaaatgtgatttgattatagatttaactcattaacaatgtgtgattgtgtgtggatgctttaagtaaacacggaatagaaacgaataatatggaaactggaaagttgaaaacgcgtttcctaatttgtctcacagatttttaatactaaaaaaaagtggaatatataaactctataataaggtcgtaatcaaattacatgaagataatagagatcatttaccataattaatctaatcaaaagcaattagtattattgacaatgacaacaaatcatcaacacaaagaggaaaataaataaataaaaaaactcagaagaatctgtctcactgatttcttcatcttcttctcttcctggacccgacattccagtgttggtacataaaagactcttcctttgtctgttttttgttcccagattcatctttacttattgactaaattctctctggtgtgagaagtaaa

SEQ ID NO: 3782 - DNA, 2000 bp, Arabidopsis thaliana
aaagaaatgcatgagagcgttaaaacgtcgaagcggcctttgcatgtgcttgtaacatggtagggctatctactgacccacttactaatattttttaatgtattagtggcctgtctagtcaatccaggtaatttaaataactaagcatatacataattcgtatttaaaccctaacaattttggaaaattttgtcttaaaacttgattacatgaaaatcgcaaatttctgaaattcagagctaatcaaccactaaactgatatgttgccataaaaatttaagtgatcataatatatcattcaataaatataaaatgtactgacgacttacaaaaaaaataaaagctagttccacatgaagtatatctatatatgcctacacgaaatatacaataagaaatgagcacgatgtatgaaagaactagttgttgtcatatgcatagtatcaattcatcattggcatgctaacaagatcaattaaaatattctaaagaaccatgactattaagctcattttcaacaaaggaacaaaaaaacaaaatctgtagtagttgtttatcgaatatctatatactataaagtcgaaagcatcatatgaattaacacaccaattgttgatttggtgaatatctttatatagtcaacacccgctagttcgtaagattaaatctttgatatggttccaatttccaaaattttaaggtgatccgaacaaaaatagaagtgatacgaaagtctaaattctagactgtgcgttattcccgcttattattttagaaagtaaaatccggaaactatactaacaaggattgcagctgataaaaattacttccaaattccaatgtgctcatatttcaaaacaatgtgtacgcccttattttaaattctaatgtgctcataattaagctcatgtttgaatatgttcacttaaaccgttattttgtcatctgtaattcgactcctccacccacaaaatatttggataggctcccgacatggaggccatcactacgtaaatgcaacagtgacaaaataaagtataagaaaaacttgattatcatcctatgtaaatatttatatatctaagaggaaccgtgataagattcttaaactgatctaagtttttcaaagtaaattgcccgttgaacatgatgatgcattgattacaagtcttttgttgtataacttttaacacacaaaaatagtattttatcaacaacaaaaaaaaaaccttcaacaaaaatgtgaggtatgatcttatgagttatgaccaacgtaaaatgaagtaaaagacaaattaataaatacttaagtgtattgaagcatgtgcaagtatgggccacttgattaggaatcgaagttggtctaaccgcaacatttgcatgtggccacaaccttcaaagtcccttgatcttattatatcattaatgatccattcacatttttttcttttctaactgtttaattttgttgtccacaaacatattttacaatacatatataaatctggccgcaacaaaaaataaaataaatatatcttactctgctcaaggttaacggtggcatacattgttgactttgcttctagttatccacacaagtcacccatttggccatttctaaatttgatgttccatttcgttggagaaaaaaacccctatgtgtgtattaatgtatgaaagaataccaaaagataataaggatattcattgggatttaacgagaaataaaaggcacaattctctcgcaaattggtcaaaaatacgaataaataaatcaactaaatacccaaaaaggtgaaagaattagagacaccccaatgtacttcatatagtaaacatttaaatatgattatcgcttggcacaattattcactcgagtacccctatatatacccattccttccatttgtagattccatattattcacgattctcatcaaatcatctccgatactcacaaccgaaataactaacccctcctcaacaaaaaacaacaaaac

SEQ ID NO: 3783 - DNA, 385 bp, Arabidopsis thaliana
ttttcccggtttctgatttcaatatcttccgacagaaaatatgattgcaacaaccggagagaaaattagtgtctgaaaatcgccggagaagacggcaaagcgagaaaaatgtggttactacttactcggcggaattgaagcaagaatttttgtggttactgtgtatttattttaaatggtttataagtacaatagaaaaacgacgccgttaatatattcaactaaagcccaaataaatctttagataggcccgcttgataaacgacgtcatctagagtataagtttgttaacagtgataaacgacttgaagactcgtgaagacgaagaagaagagcaatcgaagaaaagagggatttgtgtttgtttgttgttcttcgattgaaa

SEQ ID NO: 3784 - DNA, 854 bp, Arabidopsis thaliana
ggtcatggcttcttcttcttcttcttctttcccgaagctctcctacaatggcgctcactcaattttttccactcagaggtgataaggcagagagaataaaattcggttctttcggtcgaaccgtaaatggttttgtgatttaaacaatttgttaaccaaagtctattggattttaaaacagcagagtactaactacctgatcctctgaacaacatccattacccactcacaatataaccaatattttgtggactcccaactcttttataaatcataaaattggagccaaatcacaaatgactaatctggtccatcttatttgagaataatgggtcttaaactatgcatgttgttgtaacaaatgaaaagccctggtgtctggtgagcttgtgtttcacgtgatccatcacgtgacaatcactgacaattatttacacagtcacagagacgtatgtttctttgtgacttagttatgagtgtctatattatattaagagtactcgatcaacattttgttttgttcttatattcttattcttcgccaccttcccgagaagaccaagtctctctaggcctctaggtaagaagctctctgttacttttctcgtcgatgcttgtttatctgattgttagattttcatcaatatcaaactcaacgagtgacgatcctgtgattatagaatctgagccggggcagattttattagtctgctaattgactttttttagtgtcagtgtcgttttttgttcctgattcttcattcttgaattcaagggttttaaaaagtgattttgatgatgaaaatgtgtatttatctgtcacaggaatttttttgagtgttgagtaaataaaa

SEQ ID NO: 3785 - DNA, 550 bp, Arabidopsis thaliana
tttcttaacaaaagtttttttaattaactggtgatgattaagaatttaaaaggtacacaacacaattattaactatatatattgactggttttaaatgtgtcaaaattttggaaaagctaaattacatgagaggttttaaaaaggtgcgctcatttttgctcaaaacccaaaattaaaccctataattattcttactagtaaaaccattaataatgcataaaaattatcttatctgatctaattattacatgttataatccataaatgttacaaagaaaaaacactaatccactaattgggtggttttacaaaaattgacccttagaaaaaaaaaaaaaaaatgctaaacaaaggcccactagaggcccaaatgtatagacgatgacaagtcggtgaaccgggaaaataattttacttgagattgtttccttcctctccgattttacataccaccgggaaaaaacacgaagccctaaatttcgtcgtaattggcaacagttaagctctttgctaaaagctctagctgagaagcgaaattcgaagtgaaga

SEQ ID NO: 3786 - DNA, 1084 bp, Arabidopsis thaliana
tgacaatgactttttagtggatttgttgttattacttttaggatatagttttgtgatggggaatctagtgttatcaacatgtgtttgaataattaatattacaagatatgtaaaaggaaaaggtaattatgatttgtggaggaccagattcttttggcattactttattttattcaccactaatatatttctggaatttattaacttaaaaggataaagactttttagacaactttaaataattacataacattaagaaaatatatttttccttaaccatgttcttagaactccgtgtccattgcgcgttcccacgacgtagatattttctttattatactttaccctttttgattttcgtattctcgtttaaaccccagtactttcttaaacacccaacagagccacatgtatccaacaaaaactattttttcatgcatcataagtgcaaaacactcataaaaaataaagtgattgtattcatgattaatttgtaactgttttgttttacgtttttttgtatttggagtatagatacgattaaaattacaaagactacaatgctttttatttatgattgtcttaaaatacgaggactagaaaacaattaaaatataaaatagataagatatgcttattcaaaaatgtaacgcgttaagtaattaatatttttggatacatccatccatatatatccttctccattagcttttgttcttctgttccaattccaattccttctgaaatattcatcgcaattcgtatcggtaatttttccttttgatcgcattttttttttatctttgatcttccgtattaaacgtgctcgatctatatactcaatgatcttatatgtgtatgatcatgtaatttggaagttgaaatgtaaatcatctattccttggtaaattattcttcgattttttttctgatataggttaatggtaattcctgtgatttttactgatgtaatctggtgttgattgttgtgaattcttgatctatgagattatgtcttagatttgccaaatgttaagtttgtttgatctttgacaaaatattgtaggtttaaagtaaaaaagca

SEQ ID NO: 3787 - DNA, 1722 bp, Arabidopsis thaliana
agatatgacccgaaacaaagatcttctcgaaaacccatatatctgctctagcagttgactcattcgaccgcctatatgtcttatttgaccaggaagttcagccatttgagattccaccttccaaatttccaatatcctcagctctcagctctctacgggaaagcaaaacattcataagtcttgtcagtaaaaggcgaaaacaagatatactaacggcacaaacggcaacctactccaacgtttcacagtgaaatataagttctacacaccttaacagtacttactacttaacaagtagcatcctaaactatccacatgtaacaaagaagcaacaatgatatcaaacaaagctctttgaacaactcatttaacaacaaataatacaagcttcccctttattcattctagtcttacttgctgcaaattctaggtgaaaaaatcagttctacaaatgtagatacgtatcatatcaaacgatccatttctgccaaatcagcatcaatgttcaacatatcagtccaaagttctaaaataaattctctattaggtgaagaaatcgaattcctttaccaagaaactgatgtcacgaaagaaaagacttttggctgttcacaaaaccccaaacttatggagttagttaaaatatccctcaaatagaaaactaaaaaacacacttgaaacataacctagtcagggttttagtttcgatacggaatacggaaatagaattcgcacaaggcaaacaaagaatctgcaaatttgcatgctttttgaatttctaaacaaacattgatggatcaaacgaatcaatcaacagatttcgagaataagaaacaaaaactccaatcttaacaaaaccccagaaacgcaagagcacttgaaaatctaaagcaattatatctagtaaaattgagaaactgttgtatatagctcgatcctacctgagagatagcgagatcaagcgccgagcttgtaaaggaaaacgaattggggaagcaaaaagggagatttcggaatccaagctttctattctttggatcgaaaacagatgatatctcttctcaacaaaaagttgacggcgcgactgagattctccgttcaagagcgctgactgtgaaagagaaaggcagcgagcgatgagagaaaagaggggaggggaatattttacaggggaaaaaaaatgtaaataaccggtaccggttaaatctaattgatctggtcaaacccggttcgagttttcctatctttctctcttctggtcaaacaatatttggggtttattagaaagcaaatgcgtcaattggtgaagaactttatgaatgtaattaagggcgagatctgcaagctcaggtacacgtgtcaaatggacggtcaggatttgaagagcacaatccattattccgtccgttgctcttctttcccatacgtgtcaaattatttcgctccttcacgaaaaaatcccgccacagtgcaaaatttcaagtcgcctttattttaaaaatagatattattttattattataatatcgcatctaaagcccccccaaaaaaaaaatcctattactcactcatacgctctctcgtcaaacaaaaaaaaaaaacctaaaggtaaaaactcgctcctaccgttttccccaaactcagtccgagtcaaacaattctctaacgatcttcttcttcttcttcgtttctttgtcattcttcaattgcagaaacttcgac

SEQ ID NO: 3788 - DNA, 2000 bp, Arabidopsis thaliana
atgttttgttgacatactaaggagaactccttgattgattaaaaaaataaaagtttacaagcataaaattactgtgtccactaccaattaaacgagatatatatatatatatgttcttgaattcaatgcgagaaataagtaaaccggtctctatgaaatttgaaagttgaaaccctctaaacatttcaagaaaattagccaatcattaagaaatttcattaatttgatcaattatgcgcaattcgtcttgaaatctaagtcaattattcctcgagaaaatatatgactgcatgacatactgtaaagtttacaactttctgagacctgtatttttgataaacacttatgttaggagttacggagaattaaacttcttgtctaacatttgctccaagcaacccataataatttcaataatttgattgtttttgagtagaaaattttgtaacatcttattatctaaaaactttgaaagttgatataattttaaattataacatgtccagttgtccacagttctatgtaattccacttatgatggaaagaaagaaaaaaaactaaattagatgatctgcaatgacggagactattcatttattaatagtttaactttgacactttcttcctaccaaaagaaaaacaaaaatagctttacacgttcttattaattaattcagatatgacagatatgctgttggattccaaaattaaatttcgtgatcgagctctacagaacgtgacagagatattagtatttatttatttattttgttaaacagaaacgttagttttgaaatatatattattattttttgccttttttagtccatttaaagttctggaaggagcaaaatatagtagtagcatacgaagatttccacaaataaaattatgtaatcaaacattctgattttaaaaaatcgatattaaaaaccttagcaaatttaacaaacaaactattccagaaaaaaagaaaacgtaccaaaaatagaagttaagtatttaaagtaggattttgattttcagaaaacttgtaaatagttaagtaatttcatgaacataaataaacaaaaaaaaagataggcagttaatattttctactaatccaacacaactcagaatgaaacatagaaaatttagattttgagttattattgaataatatttcttatattatcatataatataaaagtactattatagtcatttcgtgagtggtttccagaatgggaaaacagcatttttcaactacaactatttggttgccgtttttttcaatccaaactatgatcttttgcgtttatatattaacctgaactcaaaaataaatcaaataacaagtatgtattttatgaactttagccgatttcaacatgtagctgaaaccatgtcatcctttatgttttaagatttacaaaatacacataaaacctgtggaatatttctgatccttcatcattaatagattgacaaaataatgttttggtactatctccttaagagttgtgctagtcgataaatgtctatgctcaaaatatatcatcccttatgcgattctctgtttgtgtgtcgcttcccataaacggatgcatgaggcatctcttgtagtcttgttcaatatatatatatatatatatatatatatatgtatgtatatatgtttaccttagttatatatatccttgaatagtaaaattataagagactatgctgagcaaattaacacgtgttatttttgttttgtcaacgaagatagaataactataatgagaaaccatatagaataagtaattattgctttatttagataggtggcttatcaatatttgattgtgatgtgatctcatgtcggcctatataactgactcatttgatttgccaagctgttgaactatagtttattacatattttggcttgtttgacattgtgggtttctcctatatatttaacgttcactccaggtacaaggcatatatattattactaagcggtaatggca

SEQ ID NO: 3789 - DNA, 728 bp, Arabidopsis thaliana
ataaatcaatcgataaactttttttttttgtaatgtttattttattttgttgccttaataatgagggcaatgatccatcatcttcttcatttctgtcgatgctctgtttctaatgtacagtaggagaggaaaagaaacctcatgaagaatcttgagccatttcttttagattcatctgatgagaaggataataatatacatcccattgttaacatttaactctcatttatttattttgaatctatgaggcaaaccaataaacggcacgcagtttgaaggcgtcttggtaatgtagactacagccagttccacttttcacgtaattgggccttttgagttaagataaagcccattagctcgctttccatgtggtttgccacgtgagtatcacgtgattgggttgggagttagaatttggggaaaaccctaggccagtcaattctgggaggagagaggccgccggaggagagagaaaaagaggtacgagcttacgttttgcttgctcgatttcaatctctctgcataatggattcaatctgttcatcgtaatcgtttattcaaaagtttcgatctttacttcacttgaaaccaaaattcgtagtgttgtgtccgaaattcacgctgttcaaagtactcatttttgaaacttgattttgttcttcttgtgtagttgggggattgctttttgatttctccttctccatcttcgacctcgagagaagctaaaa

SEQ ID NO: 3790 - DNA, 783 bp, Arabidopsis thaliana
attttcccttatgttttcctgaagcttaaatgtttcttagtcttggagaaagctttgagattttaaaattggatcttctttagtttgtgaatctaaaggggtttagttacttgttatataaacgaacgtatgaaagaaatgattaagtatttttgaggtttttctttttaattacagagcacatggctttgggttgtagatactaaaccaagaacaaatcaataaatggtgtctgagaagttagtgtctaatgatgtcctacatgataacttcattggggcttatttgtctcaaagacatcacatgccaaatctctctatagattatgtagggacatgaagttgtgtacctaatgaaccacaagtctctatcactgattaagtcataccttcttctcaatgatattcaaaagacaggaccacatgatttgattatatactgacaaagtcacaaaagccttcaaaaaaattctgtggcaagaaaggaaaatttgactagttatagtgtctatctaacaaacaagtggtcatattgatttctgtcttcacatcagaaatcatgaagattgatcactatagggcccttacttatcatgccgtggtccggcaaagccatgtgcttgcttgttggtgtaaaaatttatgagctgaaacttttgaaaccaataaagggttatctacaagtaatgttcttatctatatatactcatcactgactcctttctgctctgcaagtttctcacattttccaataaagcatctaacttacaattaaagacaatcc

SEQ ID NO: 3791 - DNA, 1268 bp, Arabidopsis thaliana
ttttattctgattagttagtaaatttgtattaaagacaaaaaaaagaaaagaaaatatgtaaaagaaaagatttgaagagagaaaagggaagaacgaggcttgtttttattttgtttttgtttttcctcgtcgtttccttttttctcctctgtttcttgtttagttttgttttgtttcttcttcttcttcttctatgtttttgtttgtttgtttcgtcaatgtagtttctttgttgttcgtcgattattcaccatctaaagtcgccgaggttattggaggctttgtccggtgagaaatatggccacgtggcaaaaaattaacttattgtttgacgggtcaactgaaatttagtttgcatttgccattaatgggtaaggagaagagtactgattaaagaggaaaaaactttcttctaatttgtaaaaaaaaatacaccaagcttttttcttatggattggaagcccaagattgaattatggaatccaacaaatcaaaatcgatccaagcccatttctgctgacatattttttactcgtattatattcagaaatgccacaattttgttttgtgaaaaatagaaaaacccttgtctctcaaaatggaaaacgagtcggacaacggttcagcactaaggagaagcaagttgtaataccatatggcaaaatgaaacgtgtcatttttatattggatattagaaactttactccatgagtgctaaatttcggaaaaaacgacaaagacagatttttttaaaaaaatcttattttctaccactaacgagatgacgacgaccccgacaatgcgtagaatttttcccatatcatttatatattttaaaaaaagaaagttatattggtttttaacattctactaaaaagagtttggtaaaagacctttttcttaatttgatatgaataaattgaagaaagtcaaaacaaaaagcccacttcaaaacaaataaagcccacttcaagtttctggaaggtatataagaacaagggcaaaaccgaaaataaaccacaaagtaaggtccttttaacaaaaataaaatgaaagagagcataaagtgagtctttttgtcatatcctttctcgtctgtgtctcttcgtcctcattagcttaagcatcatcattctctcacctaacaactccacacaagattcttcgcatggaaagttgttcttcgacttctcttctctaactcgctatcttttaactcacccagctccactgagtcgaaaatttcaaacctttactcgtttccttc

SEQ ID NO: 3792 - DNA, 1062 bp, Arabidopsis thaliana
tgttttcgaatatcacggttcaactttttggtttccaatatataattattgattttgaacagaacataaattttttataatgaaatttctaattcgagaaaaaaaaatttagtcacttccgatccacaaaatctgagttaagaaattgaaaaaaaagagctaaatgttttatgtttatggaacattattttaaatgttattttaggtagtcaaatgggttatctttgggccagacattagtcattgaggaggcccacaaaggtatagaactagagtaacgaagccttgccttgaaggcaataatcgcttctcccacatcggaagtttgaggatggatactcgtctgtgacatagtataaataaagaacatggtcgaagcttgcaaattacttacctggacggggtcaactcgtgatcaagaagacgagtggcctaggctagtgaattccattgcacataacggaagggtgcttagcttaaggtcttcccttgtggaagagcctgcgtcattatttgtggcagagggggtttgcgttcgcgcagcccctaccattcccagtagttcaatcttttgttcatgaatacccatggcctaggctagtggcttcctgcacttgaggtgcgctaagcctaaggtttccccaaatggccaagtgggagatcctgcgtcattatttgttgccttggggggctgcgttcgcgcggcccattccatccgcaatagttcaatctttttagctctctggtaactgttataacatctgaggtctttctttaattgttcacgtttttggtggagctattttattgaaggttgttaatttgactttggagatgcaatcttctaatcaaatctccacgtgagaagcgaggattctctcctcgtcattatttatccttcccaattagagtaatcacacttttctgtcacatatgaattattaaaatcagaacttaagcgaaatccttcgaccactaaagaagaaaatccctaacaaatctcagagtttgtgttaatttcttctttccttacatcttttccagaagaaaaaaagctgaaag

SEQ ID NO: 3793 - DNA, 2000 bp, Arabidopsis thaliana
gtctatcaccaaaatacataacgccaacaaaacaaactcctagtcttgtacatctatgaagccaatgactcaaaacatacaacataaccatcatgaagccaattactaagaaaaagcaacaaaagaaagagatagatacagagaaaagagaaaatacttgagcaagttgggactgagtcagcttcttgtcttctcgggcttgcatgatggctttcttcaacttagtgggcacacgatcacctgattttaaaaccatataaaggtgttaacgataaccagcattacgaatcaatcaaacacatatgtagacttcctctcgctaataatgcaaactgaagaaaatattaataacccaagagaacagactagattactagaatgactgtacccaagcaaaagctggttcttatgggatccaaatcaacaacactgatccccatgcaacaaacaataaaacgaaacagatcaatcagataacttcttcgttttctaaagaaccaaatcatctacacaactaaatcaatcaaagcttagtcatcttcctatctgacaatgctctgattcgagggaacgaagcaagggtttggtgggagattggatttgggacaaacacatatagaattgggtcatcgatttggtgaaacgaactcggaatggtgagcagcgtcgagagagacgaccaatagagagagtgagaaaatttcccgacggaatgaaaaataaagacacaaggattttttgttggttaaatatatcaaccaaccactgactgccacgtaggaggctctctccagaattatttgttttgattatttttaatcaacaacttcaagagaaccctatcaaattgtgatactcatatcatgacactgacaaataaaagagaccatgaatatggttaggccatatgcgatatggcttcaaaaaccaagttgggacaatcttatgtttagtcttaagtttgagttcattttaattcattttagatactattgtttgatgtaaaattaaactttgataaataaatgtacctaaatttggattgattttttcataatcatgtttaaaatttttggtgttatgcaattctgttttgttttgtttttccataataagcatctgaacatttttacaatatttatatattttaagaaactgaagttttaagatgtattaatctacattaaccttttctattttaatgttaacaaatattatatattataagtacaatattcatcaaatactataacatatatgtgaaatgtaaatatttactactaatcaaatatcatactgcatatttgattgcaaaagagctaaaaatcattaatattgcacattaaaaatagtcaataaactaaaatcattaaatacacaaatatatcataacacagcaagtgtgtaccattattaatcaatagatttacgctatacaagttttccgaattatgtatgtgaaataaatcacaccaaaaaaatgtatttgaaatgaaaaaattccccgcctctgtaatttaagttttttagattaaaacagctaaactcttttcattaatttattagagatacaagatattgttatttgttaccaataccaatatgtaaatttttctgagtaattattataattagttgaatttggctaccatatgccaattttcaacacataaaattcttttaaacgtgaaaattccaataatctaagagccaacaaccacgaaaattaaacctcgttttagtctaaactctaaaatgagaaataattagaaaccaataaaggctcttaaagaaagactaggtcaagttcaaagcaagttttgctttgtgtggtggtcgtcgtctctttctttaaacacacttgtttttttctttttcctttgaccactccaatataaacaaccaagaaccagtgttcctcgtccattcactctctcgtaatcacacacacactcactcatacgaagccaattgttccacacaaattggaagcgacgaca

SEQ ID NO: 3794 - DNA, 2000 bp, Arabidopsis thaliana
tgttctgcaacttttctttatctttcctatttttttcaaacaagatcttccctatttattacagtcaaatctttaagtgatccaacatcaattttcttccaaaaatttaaaaatctatcccggcctgcaatttctttcactatgttaagtcttatgacaagtatctataaaacaccacgtttaaaactactgtttaagaaaatatacaaatcaagtcaactattaagacatgtaaacataattgaaagtttaaaactatcaaatcacatgtgatcccagattcttcacatggtagctaggcctaggctcaccttctaatagaagtagcaaatggaatttatcaattatgtgatctcagatcccatacatattattattataggatctcgaagataaagtaaacagagagaggtaacaaacataagaaaaaatctattagatttagttggtgaccaaatgatgttagtcaacaagtggttatcaatttgcttaacacatttttttcttgtaaactgcaaaatttgcacaaactaatttcttgaccactccggtttaagaagattggtttgagtctttgtctctctgagaaataaacaagaaaaggacatgaaaggtattcgatctgccaacgtgacattgtgagaatgggtaatataaattccaaataagattctctcttaatttggattatcctcctccatatgtaatataatttggaatctcgtgattgcttttttttttctatttgtaaggtttcatttagaaacagaaataatttgcatcccaacttagatactactaaccttatatgggcttatttggtagataggcaaaacttttacaaaaagttgtaaataaattatttgtcttacatgctttaaataaatattaaattgtatgttatcgaatagatgataaatttgttaaaaacttaaaatcgtcacaaagcccattgttataaaatttaaaatatatatttcttccaacttagggggtgttattggttccaaattataaggaattttgatgatttcaatcaaatcctagaaagtaaagaaatgaaagattttaaacgattgttagagagtattttataatcttgttgattagtttttcataatcttgtaaagtttctctaacaatctctttattttgataatacttttcatgactttccatgactttattttgtgaagaaaaatgtagaaagtcatgaaccaataacataataatttaaatcattaacaatcattaacaatcaaagattcttttgttttaattgaataacacaaaacttttaatgactttataagagtatgaatctaataaccaaaatttatgaagattttagattactttttacaaatcttaaatgaataacacaaaaatttaacatacttttaaaaaatcttgattgaataacaatagattttacataacagtttaaatcactaaaacttttttaaaatcataaacgaataacacccccttagtaaacatatatacatatgaggaaagaaagatatattaaattaagactctgcatgggtagctttaatatttgtttcaacaacgaatacaaaccaaccataagattagagatgatagaccaataacccttaaaaatatgaaatatcgttttgtccttttacccttttagttataatagaaaagacatgaaatagtgtatagctaaatttttgtaagactttgatgttaaaagaaattttatgtagacaagaaaattatcttagcaaaacgaaagtaataagtttgaaggaggatacaaatgtttataattgaatgaaaatctattgaaaacaaaactactttaatgtcaaaaattaaataagaagtaaatatacaatagacagttgttggatattattatttcaaatgggccaactcttcaagacgtgaagaagactagaagatagctttgtcagattcacatctccccaaaaaaaaaacagagcaagaagaagaagaagaagacaacc

SEQ ID NO: 3795 - DNA, 1390 bp, Arabidopsis thaliana
aataaatacatacatacagaagaagctgaggtaattctacacctagagccctcttggtttatggtaaaacaaaaaccccatcaatccaagaatcaggcaaaacaacggagataacgaacaagctttcaacacacagatatgagatagttttatctatctgttgctaaagttttcctcaaatggggtgaaggaatgagagtgagtagaactatagttgttcaatagttgcggtttgatcagcgcggtaagggtttataccgctgatgggtatacatagtaaggtaaaagaccttctcttttgtggtgttctaaggtgtttatttttttattttttattttggctcttacaataagattcctctttgtgatatgtaaatttgctccgatagttctaaggtaaaagagcatactctgatgtatatatagttgaaatgagctttttagttctacggatgaatctcctccaccaagaaaagaaaaatcttcgtttttctttttaaaaactttaaatgcatcgttttttgttgaatgttcacaaaagtaatctttgaaatgctttatcattgtacatagcttaggactgaatcagcgtaataacgttatcaaggtttcttgctcaatcaagctgctccaacttgtttatggtcttcttcacttggtactgaaaacttttttactttctgagacaaacaacaacagaagatgaatcaaggccttgctcaatctaagatcaagctgtcttacatctatgagaaagacttaagaatcacaaagaagaattcatagtgaactagtgaagcatgccatatggaaaaacaattgttcaaaaactccaattgaggaaatgttggaaaaagaaaagaacaaaccttagatagaacacattctcagagagattgcagtagaattagacatttctcttgatcgaatttcgattccgaaacacaattgagaagattcacagcttcttgtcgtcaaattggtaggggaagctttttctccattatcataaaccctaaactaaaagtttctgcaaaaacaactattttatcgaactcttaatgggccatcaatgggcccatacttataaacttaaacccttttccaatttcagtcgtattttacaaaaaccatcaccgtcgttatcacagtaaccaaacaactttcatcgccgggtaagctccattcccaagctatttcgatctcgtttcacgtcgatctatttctagtcaagttaatctcttcttttagggtttaattagttaagacttgcgtttgattatctcaagttcagaatttgtttcttgatgatctaaaggaaggaattttatacttatcaaattgaggatttttgtttttggatgcagagaactgattaacatataagaaa

SEQ ID NO: 3796 - DNA, 2000 bp, Arabidopsis thaliana
aagtcttattaactaaaatcgttcttttgaggcgatctttgtaggaaaaaccaaactaggatagatttgtgctcaaatgaactaacatagaaatctaaaactgaaaataagagacctcattaagcttattgcacaaaacaaaagtatgaggggaaaagatttagattgtccccaagaatagaatgactttagttttgatttcaaagaaggggatagactatggagttaagtgacaactctctacgttagtctcactgttctcactacatgattatatataagagactacttgctcatctacttaacctaattacatgaacttgtgttgggtttttccaatatcatgaacttataatctttggttttgttaggaatgctcttttaatctcagtgctaaattatgcttgatatttataactttttttttttttttttatatttataactttatacgtgctgacatgcacttgaggactttgaggtgtcgaatcaagaatcatgatgataaggagtttagggatgaaagcagactatataatcgtataggtgattaagtaagcatggttatttaatgactgctcagtcacttcatttacttgtgtattaatcatgtttactagttagttttcgtccatttccaaacgctaatttgttgttcaatgactgctcactcacttcatttacgttaaacgtttcttacttgtcgaatgcatacttacttgattttgacctatagttacttgtcgaatactgtgacctcgtataagtgatcaaaggcgttacaacttttggtggtcttttacacataagtgatagttttcaattatttttcgagtcaaagcaattagcaaatacttttttaggaaagttttttttttctttttttttttttgggcaaaatttttaggaaacttataaataataagttacttattatggaatcatgtactgtttttttctgaagtcactcatcactcgttcgtttaagtaggttttgttttgtcactgaaccgaagtcaaaccaatctaaataccaaagctggtttaatgtctctgaaattcgaacaaaaccaaaagcgaacggaatcttcggtttcgataccgacgcttctttgatgactcacaacgaaagatatatttgagggcaacgggcacaagtagggtcaggcaaaactagtggagttgaacaatcgataacatattcgggcagcttttcagatctgcccgtcttttcctacaatctcgatcgttgtttcgacacttgtcctcattgtattagcctccttttcactgttgcacatcgtgtcgtttaccactcctacacattttcgtggttctgagttgacctatcactacagtgtgagtggaaaacatgaaaacggcacgatgttaatgaatattagagaaggacggaggctatgaactgaaaaaacgacatggtgtgtccctcttgggtctagccgtttaggcctctgttagtcatttcgtctcttccttagttagaacaaaaaaggagagacctttaacaattttctgagggtaagatccagagattgattgaatcagcttactattttatataattcaggtaaattcttatgtttctttccctccagattttgaaagtttctagcttttgttgttctgtatctactcgtttccgggaaaatgcttttgctatgtatgttgagatgtgatagtagaggttaagattggtttttctctgttctgggtttgctttagattctagggttgtgattgaattctgattttggggttttggtttagtgaattccgattctcaaactcttggctttggtactgacttttgtgctttgttgttgtttcagtttgttgttcctcagacttgtaactaggacagtcttctcatgaatcatgacttcttcagtacatgagctctctggttttgtctctctttctgaccattttcattatgctctcgttttattgttgtatcttcctaactgattcttggtggt

SEQ ID NO: 3797 - DNA, 2000 bp, Arabidopsis thaliana
cgtatgtaatgcaaaagtatgtgttattttctatgcttttttattcaaatttttagttttggataactcttctttattgcttttattcagggttgtttttgaccaatttctgactaaattcatggtcgaaaattggacagttttcttgtagtagaaaaacaagaaaatgttaagtttgttacctcaagttcctatgtagtgccgaatagatgataacgcagttatatagttcggattttatttttggttgaccaaaattttcggggttttggtacgtagatttttgaactacaaacaaaaacaggctaaatgaatcattttcccaccgccgagaaccaaactcctggtcttgagagactcttccttttgaagttacccactacaaaaatcaagctactagccttggataggtcgatatattcattttataggaaaaccaagaataccaaatgaagcattttcttatattttctgtctttgcatggtgaaacttgaaagaaagaaaaaaaaaagagagcagaagagtaaattgctaaatagagtggcaatggaggaggagtatcatggatcacgtgaacgatttcaaggaaaatgatcggaaagagggaaataattgcaaatttgtgtatgggccgttttacttcttcaagcccacttaaaacttgccaccaatttcaacaaaaccaaatagtgtttcccattcagatagtaaatagttactcaaataacgttaacatcgagaaaaaatgaaaaaaaatctgtaagccatttatcatacaaacaatatttttttcttattttaagtagctggtttcttcatgcttgattataaagataaccaaatatcactttctttttcttttcttttcaattaatatcattaaataaaaagaagaaaagctgatactaataccaaaaaagagcaagatatttcaaaattttgtattatatcgtttaaaatgtcagcaatttgtttgcataattaagaaaagcactaggccaaacctttgttcagatatctaaagcttaaacgaacaaaaaagcttaaagttgaagttagtattttttttctttaaattattttctatattgacattttttcacaagagtattgtgaaaataggcattgtttaaaatttctaatagaaataaaaacttttttacttcaactaagccccaaaataactttatatatccaaaggaaaaacttaactaaaaagaaaaaaatccaaaggaaaaatataatatctgcaaaaatgccatagtgccttcaaattttaagaaatcctattttcacaatactttctataaataattctttttatgcaaattaagtttatatttttatacaataatatgatttttttttcttaaaaggtaaaaaaaatggaattttgctcacttttatgtaattcgttaaagcatttggtttcagacaaaacaaaaaacaattcccaatccatttttttgtttctttatttgcggaacccaaagggtttggttagagagacgtcgtcacttgagagctctctcactcttgctaccaagaagagattctccagtctctgtgcgtctttctctgtggatcttacttcactcagatccaggtttgtctccttctctatcttgttctcatcataactcgaactgagtctcttctcctgcttagtcttcgtttagttgctgagaaaatctatgaacttgaagttactctgtttcagtgtctcaataatgcagaaactgaaaaaagttagggtttttatgatttatactaagttacttaattaggaatcacttctcactagtcactaaactgtaatttagtgagcttttggaaaaagtttagatttttaatagtgcttcactgattcctactatatatagtagtctcttcacttattggcctttttgttttggttgcattgattatggaatctaaacattttattgtaaaatttgtagtttctttggaacattttgtgttcttgaggtgtcaaagg

SEQ ID NO: 3798 - DNA, 2000 bp, Arabidopsis thaliana
tcatggagctcgtccaatggtgagaaagaactcagcaccaagttggtggaattatcaacatcataagagagttcttctagctctttggtgcaagtgacatgtgagaattacaaaaaatgggttaagaattaaaaatgcactcaaattattggtttgttagaatgaaagtggatcacaaatagaatgtggtcgtggagctagaaactggagggtagaggctcatatcagaactcacctcaaagtccatatccgtgtcaaggcaggcgtggacgaggacatcaattaaggccgtagtactgtcccgtattaaacacaataataaaatcgtaccttgaaagctataagaaaatagaagagagtgaacaatcgacaaatgacaacgagaaacatttaatgaaatgaaaatatctatgctccagacacagagataacccacgggcagccaatgaagcactccacttgcgaatttgtaatagaccctacttgacaatgagtagaagagccatatcatgtatatttaatatttaagttggtgtgttgtagaatacgtagaattgttttgtgccataaaaattaagaaagtgtttattttgttttcttagctcgtgtataatcaaatttaagtagttgaattcgtggaattgtagtaagtaactgtgtgcttcgactaagtgtatggtgtgatggtgtcgtggtgacatttcttcggttcttccaaaggaagttaaaccttgcactgcccgcttgatcccgtttgagagaaatgagtccaataattaaagatatcataaatttcttaagttaaaaacagtgtgttgaccgatgaaatattatacaaaaatgtcttttctacctaattgagagtcacacatctttgatccaatttttctctattacatctttgatacaatttattacatctttgatccaaattgcactctattacatctttgatccaatttttctctctatttttctaccgattacacaataacatattaatttgtccataaagattgttatgaatggttcagtgttacaaaatctccattattccaccttgcatattgctgcggaatgcccaagaaacaagactaaagaggcgaataaatcacagaagcgaaaacgctctaaaattcctaatctaatagacgcattcgcctctttgatttattcgccacaaacaagttttgttagtataacaaataaaaattttcccttcgcagaaacaaagtcgagattcgacaaaacgttcaccattcgaacaccaacaacgacgaaaagaagctaattaataaaccaaacagaagagaaagccttggcctgcaaataaccgtcatgacttagtgctggctgcaactaacgccatgaatggtctatcaattaagaactcttttgatgtaattcactacaaaatctaaatttttgacccgctacaagatttaattgggagatacgttgaatctcaaaaaaaatcgtaagaaactacaatcttccttcctataggcatgaagcttgttgtatgcttcgccaacgttacgtgtatgacttataatgccacgtgacactctcttagttggcggtttttgtctaaatcttttatgtgacgtggtgcgttctgatattcttattggtcaattatttttgctgatgtggtatgagaaaagtcaaaatcgtttcaaggagatttgttatcttagctaaaacaaaaagaagttattacaggaatagaaagagagagagacgaaaatttacgctgatgacgtggtaagggaacgacggagtggggaaccacaagccgttcttgatattcaacgtggtttgctcatggcggcgcgtggtagactcgtggtggcgcgtgggaacagaagcttttcatctataatcagaaaatactcattgaaaagtccatttccctctattttgttctttcttatttcttgcaatttcatctctctcatttttttttctgataaaggtgcaatctcatctcttgcaat

SEQ ID NO: 3799 - DNA, 2000 bp, Arabidopsis thaliana
atttctagctatggaaactaatattctcccttgagttggattaaccgcatgacacatttatagatccaatacggtagtatgcgttgtcaatctaactattgacagtttacgctcttgctcattaaaaccaaatagactatcgtagattttgtctaagagttgcacaaaatgtcttctatcctttcttttcacaaggattgcatatgtttgactttcttcctcgtaacatcaacgcctacttcgtaaatttttattttattttgtctcgataaataataaattcatatttcatgacaattgttagatcctcagaaatctgaaataccagtatgctagaaatgccacatatttgtaacttcttttagattcaacttgttgtatttcagcttttgcttcttagtaaaattaatttcggtggtttatttttgaaaaatcacacatacgacatcatttgatacaagtgtaaaaactgtttagtacaatttttcaattccttgaaagctaaaagggtttcatattctaaaacgcataacaaatacgatacatattcaaatgcacgtagatgtatataccgagatacatgtggtttaacctgctcaatggtgaaaaatccaactctacaaacgttaacaccataattaattgttttcatagtctaaacgcaactaatttcctgtaaaaagtatcagtaccaacatggcctatatcaagtacacaaaaacatcattaactgttattccaatttcattgagcattgagttgtatcagcatcatccatgttggttcatgtgggtcattcacgagaccaatggatggtgacagaaaacatgcattttcaattagcaggtgagttaataaatgaactaataccacttttattattataagcttaatgagtgtatttggatattttttgttttagttaaagtaaacatacataatgatgacaaaaaacaaacgatattttattttgtcaacatttcctatacgatgcatagacatgatcaatgcagtgagatattttgtcaactaatcatatcaatgctcaatgaaatcaaaatggatattttgacggttcacggtttgattggtctaacacaccggtccgacaaggctttggaaaccattttttatatccatctgattaccaagaaaatatactgtataagataaacacaatcaatcaatagtatataagaccattctctaaacactatctttaattataatgtgagtggatcactcgtatctcggatttcagcccaatttgttttaacatgataggcttgttaaacgagaggctggctcatccatcgaattcctttgacatgatccaaagttactcttatcgcaaatagattagactacggttcaagccataacacttaaatccacacttcatagtctcttgaccaaacaacacacttatgcacactatctttttaaataaaacaaccgtaatttgggtcgatacatatagggttccttatgtaagcccaaaatgtaaattggctttaatcagccattaaatgggccaacaaggcctttaaatcaaaacagtataacgacaaaaacgtacttggacgtcaaaaacagatagacacgtggcagtttattgttgatagacaaaaatcgtgaagccgcttcttggaatggagattcttcactttggtggactagagactctttgaggtctcaagttaactctttaaagtttaaaccttttgacttaattcaaagccgtacaactttttttgttcgccgccgcgtcgccggaaaatcatcaccgttagtcttcttctcttccttggtttatctttttgctgctaaaatcaaatttagggtttaatcacttcactgttgtaacaattactgattcttactcaaattgattcgttgaggcattgtcttttcgaatttgatagttttaactgaatcttcttgtattagcttcaagcttatatactatgtgaatttggtagcaggtatatgcgataaac

SEQ ID NO: 3800 - DNA, 2000 bp, Arabidopsis thaliana
cggcatatcccgtccccaccgcaccaccaaccggaaggaccatggcatggatacacatttgtctcactttatatcataaataaaaaaatattatatgttatccagatttcgtatccaaaattttctaacaaaatctccattttataattctactgacctttttaaaaggcactgttgtgacttcatttcaagagatacgtaccaaatctttattatcaaatatatcgtgacgatagacatgtacacacatataattgtagtacgcattactacggaaagaatattccaagagcttaccaattccatgccgcatacattggcgtttatcctaagttagacttaggattcctaacgttccgaatttgcgttggagagcaagttcctgatctgcttacggaaaaatatattcaaactcaaattgcgaatgccgagaccatttcaatttttgggtttttgtcgaagggatgatgagcaaattaaagctagtccacctttttaataaaattgcttgtgaagaagaaacaattaggtccaatattactagagacaaaggcaatttataattttaatatttttggtactgtttaaaaaaaactatcagtaccaattgaacaatttctaattttgatatttataatttagttaaaaatatgtttgtcatattaattctttttttgctcatattaattcattatccagttttttagtcattacatttttattttttttttgtttagtcattacattgaattagtcgaatcagtacataatcgtttcatcagagaactagtgaattaaaccgacccagactaattggaagccttaattttggatcttatattgtaggcatattaactttttaattttcttacataaatccttcatatgaaatgtttgtttttaaatggccatggcccagaaccattgcatttttgggctggatagtggatgtatatgtgaattcgtcatcataccaacctggtctggcctcttattagtgcagttaagactaaataacccgtttggtagggagtagggacatttattatgtctggggtcgttatcgccttatcggaatcaaattgagtttaaagacaaaacagtatgatcgattaattatcaaacacaacttgtttataaatgtatagatgtcgacatccacatggtatcataacttcttctgcaacatatccctcgatatcatatccaccattaatctaatttattgcagtataacgagtcgagatatgttcatgaattttcaaactcattaaaaaattgttgtaattttttgtttcgtaagtaaattttgttttttttctctttcaatttaacaatgtaattttctggatgaaaaatttgcaaacggtataaaacttaacatttcatatgatttttttttggataaaattacaattaaaataataaataaaagataataaagtataacttttgtatattttcctttataaaaagtaatgaggttgttagatggacgggaagacggggacgaggctttacagagtttttctatatccttgttgtttccgagtgggaataagctcaacaccaaaaacacgtgcttattttatttacacgtctctcttctcttactttttttttttgggtccataacacgtagttttttttttttcaaattcataacacgtatatgaatctcagaccactagaagccaacaaattatacgatcattatagacaataatgagaagacttctagtttcgatcataatatgtttagtttatacatatacgtcacgttttatgcattatatacacaatctggtcaacataattatggagtggagaaaataatttaagccgcgtctcgttgtcgaatatatagtaagaatacctgaaaacactttctattcataaaccctttacgacaaaacaataaagacgtctctcgatttatctttgtcttaatcaggaaactatttgacatttctttatcgattattacttcatattcgggt

SEQ ID NO: 3801 - DNA, 424 bp, Arabidopsis thaliana
acgttctttgaagatcctcatcacatacatataacttctacgtactatatgtgtggaaatattaatcacattctatgtttgaaatatataaaataaaatcaatgcccccaatgttggaaatcttcaatgtgatatcttaatatatatcacgaataaaaaagtttaaatttctcaatctcatttttaatctttaatctaatttcttaacacatcaacgaatctttaatctttaatcatgtagataattatcagagcacctaaacattgcgccgttttgtgattatacaaagtaacatcgtgctgtttttgacttttgaaaaccacagatccaaaaactgtttactttcctctaagagaaagcaaagccgagtgagtccaagcgagttttgagagattcgttgactcactaccggagaacgacgct

SEQ ID NO: 3802 - DNA, 2000 bp, Arabidopsis thaliana
ctaaataacccgcatcgatcaaccatcatggtcatagagccaccgatctagccaaccaaaccatccgaccagtagctacatcgttctgccatatcggtcatatttttttatcgatcctaatcacaacccatctgatccagaagctgcattgatcccaacatcggccaatgaaacccaaacattatacttaccctttgcaaatcctattctactgggaaaataatatagtgctcatcttttaattgatgaaacccgaacattgcattttgagaaatagtatgcagtcgcaaaagcaaaagcaaaagcatattcaaatgtagaaagaaaatataacatccttgtaattctttaactaattagcaatcttcaatgattcacatcattttcaacagagtatgaaggagttaacattgcaatgaatctgcaaattacttgtacatatacataacgcccaaccagggttagataggagaagagaccaaaacaacaaatgtgtgttcttccatgatctattaaaaagcttcaatatatagtaacgtgaaaaaacctgattgattagtcaacggctttagaatcattagaagaagatgcctcaccagattcggagtgttcatggttatgatcacagtgatggttgttatcatcttcttcttcactgtcatcctcatcaaaaggcttctgtttatgaaagatgcaacacttcttcgaactcttcttctgcataaactcattgtctacagtcccatctttccatgaaactttcttcttcttccggttcaaccgaagcactaatctttcagtaggttgtgattgagaaacagggttttctaatatgacagaagttgttgctgaagaggaaggccttgttgctgtgctcatagctgaagattagctttcaaaatctgcataaaagactaatttcataaggtaccaaaatacaagaacagagaataaaagttcttaatagtaacaactaacaacatgcttaagaatgacaagagctaaagataaaaactaagaccttaaacaaaatcgtaaaacagaacaaagcctttagggttcattctttaggtaaacaaaccaaacagatgctatttctctaaccctaaattcattgcctacgagatctgaaccctaatcattcctaattccaggggataaacacaaatcggtgatatgaaattgagaatcaaatgttgcagtaaacaatagagagacctagtttcgatcgtagaaacaatagcgaaacctaaacctaggggaaaaaaagattcaaagaatcaaatcgacgaagaagcaaacctgtgaatccccaaggaggaagggacgcttgttgaatcgagaaactttttttttttttcgttttgttttttttttctttcgccgatggagaaatttagtcgctccaaccaaaaaaaaaaaaaaaaaaaaaattcggtctaattttatatttattttctaagaaatgttaatatatatattagaaaaaagactaatacagtgtaattaattttgagaaaactataatgttaacttatttgggattcgaaaactgaatatatagaatgactttataagttactcatactcatagtgaggtttagttcagatttttacatggatggatttgattaaatccaattatgtatatttaagtatttaactaatgcagaatttagatcttatttttttttttgcttattattatgctgggccgcccctaagacagggccaaggaaaatagaaaatgatctggtcataaaaaattgggctataagagtaaaataaaacacacaaacaaaaacatccgtctctttcacttacactttcacttcacgtttgcgactgtgtcgtcgtcaagctccggatctcatcggcgtttcatcataattatctgtccatctattcaccgtacgactccgttttagaaatctgtagatgtcaatttgagagaaaagactgtcttcattacaacacatttgggacaacaaggatcactc

SEQ ID NO: 3803 - DNA, 1312 bp, Arabidopsis thaliana
agatgactggaagaaagcaaacgcattgcttctctgctctcctctatttaaagccaggaaaagtcccatttagacataataacaggaatccaaataggctattttctctttctttcttatttcattcatagagcagaagcgacacaaaaaagttttttgggttatttattttctctctaacaaatttgtagcgttttgggtctttttctggctgtcactagcgtggcaaatccaatgtctgcgcacacttaggcgcattgtcaataaaatttctccggccaccggagtgtttagcatcttttaaccggcggctaatgcgaatatttccggtaacacatattccttattctatgttgggttttgtgataacggcagtgggccttactagacaatgatcatcaataaaactaacacaaagttgaatgctacaaagtagaaagtgaagaaaaaataatatagacattgccgaatgccaaccaaaaagaaaagcaaaatcatcaaatcgaacaaagtatttttataattactctcgactcttgagcataataatctctttgattaagcatgaaacattgtttttaataaaatactaaacatgttatatgttaagaaaaattgaattatttttgtaacatggatataacttgaaaaaacatgtgtgtgaagaacagaaaagattatataataatatggtagattaaaaacattagattatacgaggagcaaagtagttagcaccagcaaaaactcacatactcatgtttagcatgtgcccaacacaacacttacaccttttgggcctcacgaatggccaagtaggtgagagagaatcactgttatttacctttttgccctcatgtatattctctcgttaaaagtatctgaaccaatgattatccgccacgtagatactctctgggtgcaccaagttgcaagagtagcatctaaaccaatcactttgaatatatccaagatgccatcccggttcaagtttttatcaagagtaaaagttccattttcatttctcataatcagattcgtattcacgcgcctattatctcgaacttatccaacacgcgcgtttaatcaaccgttggattctcaatggacggtggattaaattagctgaaaagtaaagcggtgcgttttacgcgcttcttctggctagccgccgcacgtgtcatgcacgtgatagcgcacgttagctttgaccattgtcttttgttctctattagttttttaacacacgcccccttattcgatttctcacccacccaaagccactcactctctcttctctctctctgaagcg

SEQ ID NO: 3804 - DNA, 2000 bp, Arabidopsis thaliana
gacttgtcctgtttttcgtacgactctttttttttttccactcaatgaccatttctcttgatcaagacatttcatctcccaaaaaccatgtctatttataatagcaacagctcgaatttatgttcttcaaccacgtggaagctaataaactttccctcaactgtcttctttcttataactctgtttttttctctgttcataaacacatttagtttgtatagcttccgaaattctcaatattcaaaactcgttttctacaagtcaataaacgaaagctggttacagtgaagcgaaatgcgcaatataaatgtaaggtcttttcatcacatggtggttgcaggaaattaaccacgaacgtggacccttgtgcatgcatagacaagaaactgcgaataatagtaagatgatactattgcaagttataatcaacttaatatgaacatgtaatcgtacgatgattaatacttgaatagtgaaatgaaaatgacaacatcagcaaatcaaacaaaaaaggaaaaaaaacagagtggtacctcgagaatgagactgcacaaagaaagctagaagcttttttcaaccatcggtggtcaattttttctccaaataaagaggcttaatgctttgtgaaaatataccggtaacgcgttgagtttgtcggtttttttcattgaagctgagaaaaccctattcagataggctaactcactctggcccatgacaagaagcccaagaaaaagagctattcaagtcaaagaacagagcactcttctctgcttctttcttgtgaatcttcttcttcttgcttatgtgtacaactgactaaaatgcatcaactcgtgcaaaagtgaagatgagaaataccttttcctcggcttaactcatttcctcggcttgtttcttggatgacaagatatttgtctttcctttggtttttcatcaagaacgaattacccttatagaagattaagaaaaaatcttaaagatcgaacataacttgtggcatgctatcaagaaatgaattttaacattctacatagacagagcattcattattgacatcaaacacagaaatatttggcatccagctaaacatatatttgctttcaacatatattaccaaatctctttctctcttgtttcggttaaagtactaaatcattttgaccaatctttatgcgactttagcaagcaatctctttctttatcggatctcacttgaaagaaaaagctaatcttatgaggatgtacattacatcacatactagccatttaacaccttggtgcttagatagttagatgtcaaacgcttcacactttgacgttcgaattgaagatcgtcaatgggagaccaatctaaatttctaaggattaaattcagatttggttatggacaaagggtctgagtgatatgaagatgaatgcatacatagtattggatagaagatgtttaaccaagtgcaattaattcattaaatgatgggttgttgtaactgtagtttatgtccacattaggagattctttttatttaaaagggataacacatgttcttgtcaatgaagatgtccttatagtccatcacaacggttcatgtccttgtagtccattacaacgtcccagctcataagtaaagtaggtggtcttctcagtgatatgaaaagacatgattaaggtggtctctcaatgatttcaaaggacaggaccacatgactcaaactttctgtggcaagaattgaattccactaaatgtagcctatctgatatgagccatatgtggtttgtgtctcatcatatcaacatcatggagatgatctttagacaaatccatgtgcttgttgatgcatattctgtatacctaccaatggggttatcttcaagtagtgttcttttctataaatacccatcactctttttctttagctctgcaagttctcatacttttttaagtataaagcaaaagactttcagtttcaataatctttctataaaaagatcaacatcc

SEQ ID NO: 3805 - DNA, 2000 bp, Arabidopsis thaliana
caagaaaaggtagagttgataaggagaaaaggaaacataacatacgtaccaataattattcactttggctttttgtggtaatagctatgcgacttttttcaatggctaaacagacttttttggacacttacagaagaaaagagaataagatgggagatactttaggatctcatagatcaaccgagagaaataaatgaagttgtcattttcattatttcatatctttctcaaaagtcgacacctatcgatgagtaaacttttttgctagcatcgtttgctatgtggctacgaaagtaaaaaaaatggatgtgttcatgaagctacgattagtccaatcttttagtgggaagcgaaagtaaggtgcaattaatgtaagaaattcatgatattgctacagcgaaattgtcttgttccaaacttccaagcttagcacatcgtctgatctctcaattttttcttttgtcttattttgctttaaaagtgcagtattttaaaaattgtcatttgctagttcctagtattgtcataatctttgttgttgaaattgttcaattattagccaacactagaatattattatatgtttttaagtaaatttcaagattgggataccatttgtggaccgaaagcaacaacacagttgcgctagcagtgtcactaaggaaggccgacatcaatcatatatcgcaagagacggaccttactggcttcgttatgtattctcttcggaatttatcctcgttgttcttggccatgaatattttcttccaagttttttttggtctctccaaagtccaaaccatctctcccgcatatattaaggttaagatgatttttaaaaaggagataacaaattttataattggaattattatcttagtcgggtcaacgaaaaactagtgagcagccaggaatgttgaaatataagatatgggaagaaaagtaaaatgactatgaaataataaagtgtgacttgtataacgattatcaaaacataatacacagtaactttttgaatctcaggccatcttgtgcatattccttaaaattcttacgatattgagattgatttttttggtggtatggtatccatagagtgacttgtatatctatttcttttcttgccaaaaaattgttcaataaatctattttatgtagtcactaatcagtaatcactgctgtcaaaaataaaataaaatgtaatcactaatcagtaatcactgctgtcaaaaataaaataaaatgtaatcactaatcagtaatcatatagtacgttatctttctatgaaagtaacattgtttcattcgtgtactttctagattggtctcaccacacaaaaataatgctgttttggaaagaaaagaatcataaaatctcatcgccttaacatcctttacattataattcgtattcactaaactaattaaataataaaattaatatctgaaataaaattaaaactaaagaaattgataaatttccaaataaatatcagtttctagtaaaagtaaacaataaacagtgaaaattgaaacttgtcttgattcggaaagattcttttcagacaacagatagacccaagaagttgcctgatcgacttatatttctgagtgaaatttaaaagaaaagaaaagagacaagggcatattcttttatattatctctgtagagagagtaaaaacaattaattagttcttatctttcatctgcttcatcatcttctttctagtctctctctctctcttcaccgcgtacacagtaacacagaccctttttccctcttactcaaggttcttctttgtcatcttgttgccgaatccacaaagaggtacgctttcttctctgaaatctccctgctttgtaatttttactctcttctcttctcatcttcttcagtgctctgcttttttggttttggtgattgatcaggagaataaagattcgacctttattagatattaacgactctggatttttgggtttttggagttggatccac

SEQ ID NO: 3806 - DNA, 2000 bp, Arabidopsis thaliana
agggttaaattgtaaattagtcactttttcaaacttaattagaaaagtagtcactttactattcataatttgcaaaatagtcatttttcactgtttgatttgtaaatttagattgtacatcacttttagtgtacaaatatatataaaaatacacagtgtacactttacatttgtacactaaaagtgatgtacaatccaagtgtacgaatcaaacagtgaaaagtgattgttttgcaaattatgaatagtaaagtgactactttcctaattaagtttgaaaaagtgactattttgccaacacaccctttcaaaaatcggggaggtttataataaaataaaatatatctaagagacataattaataactacagttgctttaagaatacataatgatacacgtacgtcgaccaaaaataagagcttttttacccacacagtcgcagaagatacttagaacgaaactaaaatattaaacgtaacaaagtgtcaaaattggaaaggttacttttaattgctctgtgattgtgtagtagtgtctggacttaatttccgggaggaagtacgttaaactcacgtgttctgctttgatttccgcgttcggcgtttcattccacaagtgttgtcaaaaaaaagacaagatgtaaatttttcaattatcattatcattattgttatcgttactaatttatgactagttttctattttctaattaatatttttgttgagaaaattttgcgacaaacaattgtcaaaagaacataattagtaaactgtgacaacgaactttttcaataataaaaaaaaaactgtgacaaccaagagtgaaatgctgtgattagaacttgtatgattgttgatcaaaaagaacttgtatgaaaactgttgcttaattagagaaaaagaactgaaatatctgttttggcaaaaaaaaaaataaaaaaaaaattgaaatatacttctctgtttctttttatttgatttttcagaaaaaaaaattgttccaaaagattgtttttttaggtttttaatgcaatacttattagttataattgataaattataaaattcaatacaaattattgaatattattggtttatagttattgaaaattgtaaaccagaaagaataatatatttaaaagtaatatttaatatgatttcttaatatttctgtttttcctaaaagatcaaacaaaaaataacaaaggaagtatatcatttgttgtgtgaatacttaacaagacctatatttaaggaaaagagaagtttgtgtaaaaaatttataaatatgtaatatctttatacgttatatatatatatatatagatatgtatgtatttataactagttttatagttgcattaaagtatatgctacaccatacgtttttaattaagtttatgatttaaggataaatgattaatttgtgtatttgttgaagttcgtggatatcaagccggtggtcctgataaataaggttatgaatttataatcgcactttgcaaattatcgggtacaatctgctaaatgattcaatccggcacatcccatcacaaggcttatctggagtaacttgtttccatgtacgtactagctagtcatatcggtaggactcatatgactctatatatatattgatccaactattcaattttagttactttttagcctaaagagtaagatacgattaggatcggttcaccacatgccaaacatgcaaacgcctattttgtgtaaacattttatataattttcacgaaacggatgttatgattaaaaaaagaaacaaggcttattttcctctttttcagctttgttttttcttcaataatttaaaaaatagcagacacggcaaaatcgcctttatattacacctactctctgagccaagtcgcagaaagatacagacttaaacgaagatagagatagagagagagacgaagttttgtttttattttttcataaatatttgttttctttttggatatttaaaaaaaaa

SEQ ID NO: 3807 - DNA, 288 bp, Arabidopsis thaliana
atctcgttttctttccgaaataagccacacagtgtgtatctctgtttgcacgtttataaatttataatgtacaattatttgcgccctagctagaacgggataaagtgtgacaacatataaatactattaaagattcgatatttgatgactgtagccgcctgcctagaacggggtgccttgtttgacttgccaacttcaaccacatttctttttgtttacttgaaagttaaaaataaatactagagaggaagaaaaacagagctttctttctaagatcatcaacgcacc

SEQ ID NO: 3808 - DNA, 2000 bp, Arabidopsis thaliana
tttgttttgtgtttgatcgacttgatcgacccggccaacttatgatcttccgtaaactaaagtcaaaagcaataatatttctttctttttttgtatgaaaaaagcaatgatatttcactgatctctacggagtaaaatctctttcttggacttcatttggcatagattcttttagttcgtttcacattctctttcagtaccagagatttcttctgtatgttttaaatcttggtcataccgtctttacagcactagcctctagtatcacaatagataatgattttctaataccaaaaccatatagtcactcatctggactagatagattttgaagtcctctagtttctatgtagtgagatcctccattcatttctcttgactttcgtgaggtttgagaatccagtcatgtaacccatagcaaatgattcgacaactgtattacccaatgtcaccatctcaaataaagaagagaaataggattataggaatactgatcttccatgtgatctaattttgtatatatcgcacacttatcaaaatccattgtaaattgtagttttttgcttgaaaagaaacgcaaatagtatcagcagaaaaaagctacacaaatagtaccaccacttttttgtttatctttagaaaaacatttttattactatccacacaaaaaactactaagaaagttataacatcatgtcaataattcaaaatcattatcaatgtcaaaaaaatattagctttaacaataactaaactcagccatcaagcccagataattgtatttaagtatttgagtttttaaattgcatttgagtaatttactcgtaaatcatagctcatggaattaaactaaaaatttcttaaaaaaaggataaaaatccagtaaacgttggaattttatggtaaaagttcgtcttcaattcttacgaaactcatcatagctatcaatatcatacctattaaaatcattagaatcgtctagaaaccttttttaaaagaatttacatcgtcaggtcttaagaaacaaaatatttattatttaccagatacagacataaaagctgacgtgttgacattttaatttgatggaaaacgtataaatgcacgacacgtgctcctactggaccacttgataagttacgtaacttatcaagcttaccgaaacgaacacgtgataacagagaactaaattcacaatttttgttattgataaaagaaaatatttaaattttgaaaaagtaatattaacatatactagaagctatataattagcaaataatatagaaatgaactacttatctaattttagttctaaattatttaccaataatttgttcatatcttgaaattgttaattgtatatcttaaatctttgactgaatttaactcttttaatattaaaataattaaataattaatcttaaggtatttaataaataaaaattactaaaaaaactacaataaaagatctatatccaataagaaaattaataattatattgataattagggagcatatgcgttattataaattacaacctaacctactttaccgacccaaagcctaaaaaatccgacctttttttgttttctctctctagaagtctctctgttttcatctttctctctctctctctagctcttcttcctcgtttctggcttttctgggaattttgatcctttggcccccattgctcgcttgaattacgaatcagatatcgccgatcgtcgtagatctgcgttgatactgtccggctgagtaaacagggtgaacaaaaaccaaaaacagagagggggtttaaaaatcctgaagaaaatcgcatgaatttgtttggaagcctgattttttcatcttcgatttcgagccacttcacgacttgtcttctcatctttattcttcatttctctccccagcttaatagtaataataataataataatagtaatcgtaattccaataatctcgagagtaatcgtttgatcaattgaaaaaaaaatc

SEQ ID NO: 3809 - DNA, 1241 bp, Arabidopsis thaliana
aattggtacaatggtagattttgttcataaagttagagttggtacacattaagagcccacttgtctgtagatatggtaaaagattccttggtccgaaagattcgttgattcttgaatctttggtgcttgaagaagtttaattcaagtagctatctttctcctaccaagaacgtggatgtgtctaatcctcttgaataaaacttatatttaaagaaaaataatatcaaaatcatctagaattcatatctcatttccgtgcaaaatgttaattttgggaaaatatctttttcaaaatgggaccttattaatgattgatttattattgtcctttgcctgttaattgtattgtctatggcttgtgttgttgaataaagatcttcgtcttatgtaggtccgaatcatcttcctctactcgtaaccatacgtggattcatataatcttcataatgaaagatttttctgaaaatgcatgaaccgggacaaaattttctatatcataacaaaaaaaagtggtcaaaatgaatagacaatcgtttgaaacttagatattctactatattctacttgaaacatacatatcagtcactttcagcttataattttattttatttttataaacttttctcttcttaaaagatctagaagcaaaaaaaagagctaaaaatcatttttcttttcttttggggacctaatatttgtgatcttttgattacaatacagcttgagacagcaaagacggtctcctgcaattaagacacttgtatttagatttttcacgtgtctatccattgttcactcatatactatagtctaaaaataaatatctccttttaacgccttcatatttctaaatctaccccaccactttcaaatagtgcactgagaccctctcttttttttttgataagaaatcttcctaaaattaccactatttattattttactaatataaatgatattttccaacaacgacttatctagaaatccaaatgattcaactaattttatttagtcagaaattataaataatcacattttccgatgacaaataaaaatcaaagaagttgacaacaacaacaaaaaatccaaagagaaaacgtatgagttgcttaaaccataaacctcaagctcaaaattttatcaaccttataaagtttcgttttctcgagattttgaatcttttcagctaaaaaagatcacagctttttgcgttttctggatgagtttgagataagagaag

SEQ ID NO: 3810 - DNA, 1836 bp, Arabidopsis thaliana
tttaattatattgttgttaatgtatgtttcaaataactgttatgtcctagttaatgtttaaggagaggtaatgagagataaaattttataattccaaacatcaacgtagagatttgtgaaatatttaaatccggtttgtttggttattttggaataatttcggttatttcaattagattcgggtagttcagttcttcggttagtaacaaaaactggtctattgttttttggttaacctagaaccgaaccgaactaaccaaagttctcggtaaccttttgtagtggcttcctgaccgatgaggccgtcaacttcaaaaaatattgcaactaagctctgctccaacattagagtatctataactatgttaaacgcttctgctttaagcaaaacacagttgtaagctggaatctaaaaaaatgagtgtaatgatgtttgctgaattccataaataaatactacatgcttcggttaagacttaagagtaattaatgttccttaatttctacaaatgttatataagcaagttgaccaaagttctcgatgataatttgttgaaattttgtataggcattgcatgatattatatgaaaagatgaagatttttatacagacgcaagttccccgagcagtccaagcttgtcgggtttaattcaactatgttaatacgcaaatttatatagaataggcgtaaaagtgaggcccatacaatgtcttattacaagcccagatccagcatagccaatacgtagcagtacaccatcacagctggcaccgtacccacttgtttagtcgtccaagtttgtaccaataatcgtttacacgtaagcaattgtggaccaccacactcacttttacctacgtgagcttcacattgaagcttctggctcgtagagaagcaacttgagatataccaaaaagtgcagtagacagccactacaatatcaccacgtgtcgatctgcgatgacttctgttttttccatttatacccttggtgctgttccagcctcaaataaacttttcaattaaaatttttccaaaaattaggggaaaaattgttgtggctgagattgcttctggcttctcttcttcttcttccagtcttcttcagcctaaaacagtcttccttcttcttcttcttcttcttcttcttcttcttcttcagttatcttcttccttcttctctctgttttttaaatttatttttagagatttttttttgttttgcttccgatttgattatttccgggaacgatgacttctccggggagttcccggtgagatgataagtcagattgcatacttgtctcctccatggctactctcaagggtataacagtttacattatgagcagtttctaggattcctataacatactaagatctctgtttggctgctgagaaacttatagaagcgattaactaaatcttattagctctaaaagttagcataaatgatacgaatctggtgattgattactgatatgaagatttgtgaaggttttggctgcggtggattcgtttgggtgaggcttttgtgaataataataaagggaattcttttgagttctgctggagaagcagcgactgtttcacggtggactttgaaaagatttctcttttgaatttcgctcatcactcttatcttagtgtttgtggataaatatttctcataaagtactttctcctttgcagtttctctagaatctaaagaggttatcacaacggctttgcaatttgaaaactttcatgtttggggagatcaaagatggtttcttttttatactttacttgttagagaggatttgaagcagcgaatagctgcaccggtcctgtt

SEQ ID NO: 3811 - DNA, 2000 bp, Arabidopsis thaliana
ataaatctcaatctcatatgcaaaattttcaaactttagcttatcttttggattttgttttccacttttcatggtacttatcaagctttctcatagtaaaaaaaaaaaatccttttgcaatacatgtttccatttaaagtttatgtatcttttttgttccatgtgttataaactctttccatgaccagagaatcttaatctccttataggtaattaaagatggagaagaatggtcacacggaaagtgaacttcaaactcaaatggtaattcatttgtctttttatatcaaatagttaaatctttcaaaaaaaataaaatcatcgtcatgtcacaatcaaattacgtgtctaaaagtattttggaccattcgtttcctaaatagtaatgaagaatgtgaactcttgctagctttttactcttgaaaagtatgtcagtgtcatttttatttcaaagaaaaaaaaaaaaatcttatttgtttcctttgtcaacacctgtttacttacaattttactatatttcacgttatctttgaatttgttttcgtgtagtttaacctcttggtggttcatatgagtttaaacatcagatcatgcgttctaatactaacttaataatgcaataagttttaaaaaatgttttatcacagaaagataaaacaaaatgaagatattaagtatctgcctacttcgaataaagtggaagatgatatataataaggtctctcgaacaaaatggatggtaattagaggtcttgaatatattaactctatatataaactaatgagactacattaaaattatccaccaagtggagtttgcattagtaaacatatatattaactaatgatatagttattaatctatcaaattaatatgaaaatcattagtgaaaatgacaataaaatgagctgaaattggtaacgttgcaccatcacgataaatattaccaatttaccatgctatttatggcactagttatactatattgtggtaaaaagttgatccaaaatagaagaattgactgtacgaaattgtatactaccacttttgtacaataatcatttgagactgtatatagtatacttaggtattatattttaagcctagtttaaaattttaaatttctttttctataccaacatttttactaatcaaatttatatttgtatcattctatggtcattttctttttaccgtcatttcttactcgtactatctttaatatctctccattgccatttttcttccgccaaaagaaattttcattcttgtcttgtccccaatggggattccaagagtggggacagtagagagttatggaagagcctttagagggtttaaagatgaagctttgttctttgctaaaataaaatttacactttcctaaagaacataattagagcaagcgactctggattaggcagtgttgcagttgttcttcgataaaccctccccactggccacaatgtcgtcgcaccgactcgccactgcctccgccactcgtaatctccccagacccgaaaccacaatatgtaatattagtttcgtcccaagcgtcattcgaaccgacgacttctaaacttcgcctaggatttttatcaattgagctaacaacacttggtcatctttattattcttttgtttataaaacatttcttcataatcaaaacaccatttttgaatccttaagttattaattcattatgcggaacggtcaaagggaaactgaacttcaaactcaaaatggtagtagtaattatatctttgtctttctatatcaaattgttgatgttctgtctcatgtcacaagatagttatgacttatgaacatgaaacatttggtactaaatacgacaattttttctttgattattgatataatcatgcatgttaagcaaaatttgattatgaaattttttaggttggaaatgagagactacctcaagtaacgtggcaacggaagttgaacagcaaagtgaagaacccttctgagttcaag

SEQ ID NO: 3812 - DNA, 2000 bp, Arabidopsis thaliana
acgttcttgactccagtattcacatctagacgagacgttactgtttattgtaaccaataatgtatatatgtttggtattcttatataagtttcttattgtttttttgcattgccaaagtgttttatgtgtctcagtgatcaacatcataatttgtatcaaagtcactgatatctttcttctcaaatctagtactgcataatataattttttcttagtaaatgtgctacaattttataattgttaaacttagcgtcactcatgagtcatgaaagctgatgaccaaaatcatacaggatataatatatgttgggaagaaaagagatctggagcaacacctactaagttcgctgattagttttctaatagttacttttaagtattactaataaactattacttcctctgtagtcaacgaaataagtgtagttaactttcatttgatttcttaaaatataaactttcattatttgatttaattcttttggcctaccacaagcttttgggtgtgtacatgtgggtgcatgtatttaaatatgtaacacttgtttttttatattcataaaatgggaaatgctgtacttgcttattaattactcactatttacatattccaactttgaaatattgttgattggtgaaaaaggtacttcataataatttaactaaattgtaccatcatatattcgtctaagaaaaactcaatcttttatcattgttgatttcacacacaattccaaatttgacacgagttatataacatgatacccatattcaacaaaccactagactctatatttatctttagttttaaaaatttgtcctcaatattaaaattaaggggttggttatatatatcaagaaaaataaaaagattccatgaggtggctttaatagttctgattaaaggtgttaattaattaacaagatgaataaaaggttccatttaagagtaaagtatatgataacagtgtgggggatgatattggttcaccttaataaagcgattgcaataattttatgtataactaacgaaaagtttataccgtttgattaagaaaatgagaaggtcatgtccctctctctctctctttctcttgtatttaaatcaaaagcaatctctaaccatatccaaaatcccccctaattccgggttttctttttataacaagtattaatttggacttggttcccacttatgtttcttctttttttttgccaaccacttatgtctcttttttataatcctaaacttttcatatgttttttgaaatgtcccatctagattcagttagtggattttactcaacttgtaatacgattctactacataagatgagtgaaagagttaacatgcgcttatttttaaggttgaaaatcgcaatgtacactctctagaattatagtataaaaataaaaaaaaatctaattcagatttttgattgttacaggctaacagcaaaattaatatggatttaaaagattaatactggaaaataataataattaaaagagttttaattaaaacttcccccccccccccccctcaatcccacgattaattaaaaaaggaaaccaccgaataaccgtaattactataatgacgtggcacttagatttcgaatagccgctgtaataaatattaaaaacgttttgtcattttcctttttctcttctcaaagaaaaaaataatcactctctctttttttttttttaattcacagacagaatcaaaacttgtgtagaccgagaatccatctctcacaaaccccaaaccaaaaaaaaatcaaaaaaaaaaatcaagaacaaatcgaaatctcaactctgtgaaaacctcgtccttgttcttcttctgcttctcccattccttcgatttttgcttcaatggatgtttgatttgctctctgactgcgtttggtgagcaacaagtccgtcttagtgtttatgttttgttttcttgcctgatttttcttctttcttctctatttggttgctgtctcaa

SEQ ID NO: 3813 - DNA, 1255 bp, Arabidopsis thaliana
accaagattgtataaatgttaagatatgtatgaaccgaatgcttagatatttaccttagttattagaggtgatttcatttcttaaaaactctagtttggtaagatgtatatatataggtggggctttttttattcgtttggtttttaatataggtgatttgatttggcatagtaaaacaataatacagatataggtgaattttttttttcttttggttttaataaatagtaggtgatttgatttggcaaaaataaaactattgttgaaaatgaatgttataagattaattttttcttaacctaaagttaggttgtgaaaaaagacttgcaagtaaagattgtatgagcttaagattcattgagttacacgattcgaaccgtcgatgataaagactattgatcttaattaagaaaaaaaaaaggaatctgaaaaaagtagaggtgagttgtttgtaagttggaaatcgttgattgaggatcatgtgctgaacacgtggtcaatgttgattccctttgtcgccattcttcgacagctttgtgaaccatgcatgtgagagagcaaattgagttttaactttcgtaccatgttgagattttcttaaaactacagtaaacacacataaaagttcatatttatgtagctggttactctaaatttctataagaaagacaaaattcacctaatattttgcctaaaaactaactaatttgatttgtttattggtttagagttttgacaaaggttagttggtcaaaatttatgcgtagagtggtcctgtcggtagcttcaattttaattagtttctcttaatccaatctacttgatattattactgtaaagtgaaaattaactaataaagcaaaaataataatataattttaattagcccaacactaaaatcgcaactaaataagattcgattcatcttcttccagcttcgaattccacgcaccaaaggcaaagacacaaagccacggcttttctctcttgtcgttttccacatacattcgtcttttcataggatcaatctaatatcacgatctatactttctctgtttacattctcgtttccgaggagaaaagtctcgatcttctggatctggggtttggtttggtttggggttgactcggttttgactcgggacaagtcgtctcgtgagatggatgtctctcgtttattagtatctctttgagagtctgtctttctgggttcaatagattcttatagtttcgcttagaaacacgcacaaaaag

SEQ ID NO: 3814 - DNA, 452 bp, Arabidopsis thaliana
ctctgttgagaaatagaagaaaagggtacagcggatgcgattgccacagaaatactgctatgcacattctcttctcctccgacgaaccaacgaaccaaccatctctctgctctaatcaaagtcgtcgtctcttttttttttttttttctccgtcttctacttaaagaaactgcgtgtagtttttcttaccacgaaacggcagcacgtgcaggttttaacaaacctctcgattgattgatttgctttaaagaaagctcgccggcgatgtggtaatatcagtcagatccagatgacgacgttctctacatgcgccgcctttttatcgctggtacctagcttgattgttctctctccgttcgatatgattatctatatttacttagctcgtcctggaattcgcactactctcttaaaatggatcatctgatcaaattgtgccttaattttttgac

SEQ ID NO: 3815 - DNA, 2000 bp, Arabidopsis thaliana
aaaattctgacgtgaaaagagcaaagcaaagaagaacacgaagcaggcgagtggggaagcaaaagcgagtgaggaaccaaggagcgtgagaggagaaaatctagggttctttttgggaatttttagggatcttggattatgtttttatttttatttttttcatttgttgtaaatctcttactagcctttactaattaaacataaaggctttttgattggtaacacgtgtaatgacataatgacgtttgttttcgacgcgattttttttcataatcgcgtctatatttacgtttggcgtgtgagaagcattgctgatttatgtattcttagaaaaattgattattttaaaagcatcagcattgtgattttttaccaaaatctctcgcctacattaataataataaaataataaacaatatttttttaattaaaacaatttctaagaaaatatgagaaagtttttaatttaaaagatttgaaaaaactattttaaaaaactcttcaaattaaatattttttttattattattactttagtaaattaaaaactttggttagaaaccaccactacacatgttctaaaagattttaattttaactgtatgataatcttcttttcatacagtttactataatttttccacatttttcaaaagagttatgtagtaaactaaatttatcataacttttaatatgatttttacatctatttttatgatttttacataactattaatatctacagttttttttttattataagttcaaataaaacaaaaaatacaagaatattaaaataaataacattaaatctatttttgtacatatgagatacatgcttattcttattatgacaaatcaagtatacttttttttttaatctttaccgtcattttttctatatatatgtgggtatctcatattctatatgtaatatgctaatcaattacatgatgttgatggctttcacatcaaaacagagctgacatttgccaccaaatataaataaaactgtagggcaaattgtacgagagttgtgctctgagtcacttgcttttagatttagttatggagttacaaatgcagggtttgcatcttatcttttaatattttttttcttttctactcacatatctttttttttatgtggagtggaagataattgtttttaattcatttaatattttttgatttaattcctttttaaacagcaaaatcttttaatatttgatttaatttggctaaattcttctaaaaatctgaaatttagacattaaataactttctaatatatatatatttaagtattactgagaactttttaatattatataaaaattatattatttaattaatactttaagctaccatattatcattaataatggttatataatttaaaaataattaaaatttgctacggaaaaaaagaaaatatcaaagaggtgaaatagacacgtaagctaaaaatccagcgttggtactaatagtaaccagtaaccactttcatttgtccgtctcgctcttttagcctgtcaacgcttttctattttgtcttttttctttcttctaaaaattctctcttttattccttcttccatttctctctctcttcttccttctccagttactttggtctccgccatggctacacagtaagctttttcttcgctattcgactctaaatttgctaactttgaattcgcttaggtcatctctaatttcacattcgttatttttcttttattttcaatttaatatattacaggagtttactttcctctttcgtcacttgactatgactgacctaccatagttagttagatagggagagatacgaagaccaagaagatattttctcagcttggtttctcttatatccttctgggtttcgcaaaactgcaagcaaaattgtctctttttacgatttgcggcggcgttagggtttcgtttagattttgtgattcgtgagtgtgttcaagctttgggaggaagcaaaa

SEQ ID NO: 3816 - DNA, 1456 bp, Arabidopsis thaliana
taatattttaccattgataaacaacaaatggcgtgtgaaagacgaaaacgtttgtttttttggtttatcatctctttttttttttgttcctgtaataaggctttgtggttaaccggtttatataccaataataccaataccaattatgtgaagactgaagagtctaaaaagtgcatagaaaattagtaaataataaatgttgggactctttgagtaattcgttggcctcttattcaaatgttaaaataatataacaagtttagagaaaaaaaaaagtgtggctgctgggattcgagcccaggtccccacggccacaacgtgggattctaaccactaaactacagccacttttatgtttgatttcgcttgattgctttatttaattcgtattggtcaacgacaactttaagactttaatactctattttttatagtttttttttcatatctaatttctttatatactaagctatttcgaaaagtttatgttttttttttcctaatattctgaaatgaatgtcattttttttttttattcgatgtttacactcatttttaaaagttagtcagatagcaaaatctcgcaccttttctatttcaagttaaaataaaaaaaaatctcttttagttttatatttttcttggaacaaataaacactgaaatcaaagaaaaatcatattctcgacaaattgcgaatgaaattatgaaaatggtgcgatattcgtttagcgcaatatcaagtcaacggttcgattcctacggcgaatatctaactcccgtcaatatgtaatactctaagcttttctttttctttttattaatactcaagtttaagttaatcgagtcgcgcaaatctcgaaatttaagatctataaaatccttaaaacccataatttattattccatcttccttcctcagtcttaattcttaaatgtcgagaatagtctaaagtcaaactctcttagtctttgttttctcttatctttctttctttattttttgtcatctctctttcttgatataaaaacgttctcattttctttattgaaactttattcataagcgacgtttggtgaccaacttaaaattgggtttggtgcatttcgtagtctcacttttcgttcatttgaagcttcattttttctggtagggatttttttttttttttttggtgtggcttagttaacaaattttgtgggactatcttcatgtttcatatgatttatttaaatttacatgcgtataaatattgattccagtgaatctcttaatgtcatcaagatcagaagacaatttttatttttcatcaagtttcttagatcatcaggttgattgatactctaatcagtgtgattgtgtatgtaaatgcatgtgtattattctgtttttggttttctaaatctcatgatgaatctgtgattagagtttattaaatttgattcaaaattgtagaa

SEQ ID NO: 3817 - DNA, 2000 bp, Arabidopsis thaliana
tttgaagttcattaatttagctcccctactaaccaaatcataaccgaagttatcgaatctcggtttggttcggtatatatgcaacggcattttcgtaaacaagtcatgttttttttcgtgtgagttttagaaaatacaaaaatcatatataacactagattttaatttaaagttagtataattttttttttgcaaattgtatctatctataatatatttttattttatagtttacaattgttattaagtaacgtcctgccaaacccgtcccgccaaacctgtcctgtaaaaaaatcatttatttatattaatattgatcttatttatgatatgtttataaatcattctctaaatatttttgtcgatgcaggacattgaacccacacattgtttgccaattggttaatatatgttcatttttaaaattttgaatcataaaatgtgacagaaaaaattaagatttttttaaactctatatattatataatgatgttaaaaaattgtgatatatcaaactttttataagtttaaatattaataatgttttataaattttaaatatataaataataatatttaaaaaattaatatttttgcttataaggtaatgacataataactctaaaagcaaggatttagaagatttaaatctttaattaaatattttcattaataaataattaatgtcagtgacatgacattgtaaataagtttaaatacaaaatttatttatttaaacaaaaaacggttagtaagaataatatttatttaacaaaaaactttgttttaaaatattgttaacaaatgtctatgctaattttaagggattgatttgaattttgttgggattaaatttgattgataatgtgattgactatttaaatcaaaaatttaaaataaaattaattattttggaaaaaagatttaatgctaatggcattagattgtaaataagttcaagtccaggatttatttgctaaaatggttgcaaaaatgtatatatagatagtgtaaaaataaattgaattaccgatgtatttttaaaaaaaatcgtgaaatctaatttatttacggaaaaatattaccacattatttttgcaaatattgtgtatggtaatgaatccaatccattattctaatttgttcttagtcaatgagtggtattcaatttcattgtcccggtcccacggactgactactcagcaacccaatcttacaaagtcaaagtcaacttttattttgtttctctttttttccgtttccatcccaaattcatttctttataaattatttattcctaaaaggatttgtaaattaacctaatttgcatttcaaaatatttttatctattttagtattaaattggaataattgttatttttgtattaaaaaaacactaatatccaaaattgttatattgctttttattttgcttttttctatttttaatttctattttttaatagcatcgccgtatcgtcgcatcgatactcggatttagtaaataagtgttttttagcaagagtttatgcaagtccgcttcgattaaagtatctaaaccaaaatccaaacacgtgggagtttccgttttaatttctagttatattatacccttcgttatttaagatataaaacagcaatttattatcactaattgataaaaccttcattgcaaatataaactagattttaaaaataaaatttgacttttaaaatacaatgtaatattattaatgatataaaaacaaaaaacctaaaatggtattgaagtgtcaaacagaggaagtatatgatatatatgtaattaactagtcaaaatctgctgtgataacgaccaattctaaacaattataaaatcttctaaaaattaatgagaatctactatatttaataactaaaataatagaaggatgacaattgacaactataacaatattgaagaagtcataccaaatatattaagacgtgtataaaaagggtatcataaccgaagacttaag

SEQ ID NO: 3818 - DNA, 1522 bp, Arabidopsis thaliana
catttattgtatagtggtgaatgttattgattgtgttcatagctttgttgtgtacttgtgtaaaaaataaaaaatcaatttggtgaaatattcgtttgtttcaactttcaaacgtgggctaaggtgtgtattattgggcttaaagtgggcctcttgctaggaattttatgatttcgcggttttacgaaattaatataaaattaaaaatagcattaaacctcaggactcaggagaagccctaaaaaggcgttgggtaaattgactaccttagcaagtaaaacagtaaaaactgtgaatatttacttacattttcatggctgaggttcgtcttcgtcatttaataaatttcgtaaattcctgagtcggctgcgttctcgacttgggttcgtcttcttcttctttctattcagattcacaataattgccaagcgaacaagtctttgcctctttggtttactttcctctgttttcgatccatttagaaaatgttattcacgaggagtgttgctcggatttcttctaagtttctgagaaaccgtagcttctatggctcctctcaatctctcgcctctcatcggttcgcaatcattcccgatcagggtcactcttgttctgactctccacacaaggtaattttaacattttctcttgtgcctatgtagcgagaaaatattcgattagggtttttctgataattgagtgttgtggggaaattgtttttttttaaattactctctagcagatgtaagatttatgatctgtgctaattatctcggtttttgtctaatcattaccatggagattgtgtttattcaataaaggtgtcgtttttattttgcccatctattatttagggagttggttggaattgaaaattttccctttttgtttgtgatgtaattttgtaagacattgtggaaaataatggagtaatcagccaaaactagtgtttctctttctacattttgccatggattatcatgggtcctatttggatgcatcaaactgttttatctgtgtgtcagagagagaagaagaaaagagttgtgagagatcagtttattttaaaatcttatgtgttataaagaattggtgacctaaccaatgtgttattctttgtgatgttttagtagggttacgtttgcagaacaacttattcattgaaatctccggtttttggtggatttagtcatcaactctatcaccagagtagctccttggttgaggttcgtacttagctcactatcatcctctattgttaaactttcacatatacttcaattttgttggacattgcttcagttgtagaagaaaaaactgtcaaaccccaactttaaattttctcactttttgtcactgaacttgttgagttggtcattgtttttttaactttgatttattgctgtaacttcttttcttttccgactgctgaaagagtaagattgtcctttcctaggaggagcttgacccattttcgcttgttgccgatgagctgtcacttcttagtaataagttgagagag

SEQ ID NO: 3819 - DNA, 1039 bp, Arabidopsis thaliana
atggtctatgttggtgttgaatgatcttatatcgctctccacatgcatatcaatgagcctatactcgagtggttgaatgtttttaaaattatgtcaaattaccatgtatatcaatcacttagtaatgttttagaactatgtcaaatactagtgtgtgttatatttctttgtgtgtggggatgttttgaagtatgcaattcttcacatatatatgtatcatatgagtgcattaataacatctttgatgtcatgtataacactaaaaaaatgtgatttatcgacttataaaaatcttaacatattgacattaacataaaacatatagattattgtatgatatagattaaacatgacgtcatgctggatattttggcttattggcttgtacattacttgtgattatgagtgtataatataaaactaattactagatttgcacaaaaaaaaaacagaaggatagaaaactaactagaaaattaagacattacatacattcttctatatgaaaaaaaacatttaaaaaacaaaacaaaacatttttatactaagatactaatgaaaaatcctatcaagaaaatgaagaagatcataaaaacaaaattatcggatttgaagagaataaattttgaccaaaaaaaaagaagataattaaaataaaataaaaacaagaattggccaactgtgagaacatcatcaatgaagaccaattgcgagatccgacaacaccgcttcttttgatttcgatcttactttcctgggtatgtctcaattcttcttcctccttcagttcgtgttctgtgtctgattgattactctcacaaaactcatcttttcattgtctaaaggtctaatctttagctataactcaaaatctgtatctaagttctgacaagtttctgttacgaaattcaaattttttgatacatatgttcatttctcagaacaggagatgtcaattttggcgatggttttcgtaacataaacatgagatttgattgttctgtgcagatctcatagttaatctggtttgagtctagaa

SEQ ID NO: 3820 - DNA, 2000 bp, Arabidopsis thaliana
gaagaagaagagatgccctcaaaacattcaatcgtcattagaagatccaaataaataaatcaagacaacttgcttgaattccattattcatattatcattagtacatatgcaaacatgcatgatttaatttatgataacttattatcagtatgcattattcattattcataacaatatcaaattaagaattcacaaccacatacagatgataaatcatgaaggaacataaccaagtatctcaaattccatgagagtaagtgacaattgaagaaatccggtttcctcaggaccagagaggttaacttcacggtaaaaatcaacccctttaaccgttggcaacaatgtgactcttctcccaacgaaataggtaccagttgaattcgttttgaaaacatctacatataaagattctacgggaaaattctgatcttgaaaaagttgtaattcttcatcaaactcaggatctccttcggttgctacaacctttgtttcatgtttctcgttttcatttgtccaagcttcaaccttgtattgatatgggcgaccattggtgactccgattgtaccaaagatattcacaagtagcttcacatcttcacctgtgattattatctttttccctcgcatttttcttcttttcaaataataaatctgagtagaataatatgtgtgattgatatgtcaacttaactacacctcaacaattgtttttgtggttttttctctcactaattcacgaaattcgacattttctaaatatatttatgttaaaatgcacgtgtttcatgttgtaattctttgtttataaacaagaaaaaatagatgctaaacaatgagaaataaatgttgtttgaataataaaaaaaattgaatgtttcttaataccatttcaaatactaaaaacaatgaaatatcatatttagagatttatttctatataatatctattttggtcatattcttagttatgatatttgactactattcaaaaacctaaccccaatatagtcaaaactatataaaaatgcagtaagatattaaatgctgttgaacaaaattcaatatcttatggcttgaaagtaaactagtaagatagctacaaaatgcatggtaagaagttaggataatcatattttaagaaacgaaaataaaatacctaatataagcttcgacacatacagctctttcttactggaaatcttgcatattccgaacatacatttttattttaggacggatatacctatagattcatttgcaagattgatttcctattgaaaaaaaacatgttgtggattcaaatatttgtcgctttttgttcattctcttttgtaatttcctaaacgagaggtcactaatccaaaaatcgttagcaattaactagaacatcttccatggttaacaccacctatcaattatttattttcttcaatgaaactttatgaaactctttccattttattaatttatatattaaagtttttgttcacactaaatttattgactcaatatatatctactttataactaaatactaattatttcatttactttttattttattaataatctacatatatatatatattgtttgtcttgtttattgtttttgcggtttgtatatttatatctcatattcatacaattttttagtatatatgcttaattaattaagatcgaattgtggcttgtttattatttttgcggtttatttatatgcatctcatattattacttttttaaattaatcgattaaaatttattaacttacgtaacatatttgatattgcataaattaaaaatcatatgtatataattctctttagtttaaattttaaaatgaataaagaaaaaaacaataaaatttgaaaactgaaaaccttttaaaacgaaaaagaatggctaagatgatgaatcggtctcgtacgggaaacacctacgttttggtttagtccggtttggttgaattcccagagactttgcttgaattgggtcccca

SEQ ID NO: 3821 - DNA, 2000 bp, Arabidopsis thaliana
ttatattttacttgtaactgttctagaaagatttttctataatgaaagaaatcttatagaaaattttaaaaagttactaaattaggaaattctctctataaattaataaatattaatttatcgataaattgatacctctctaaattaataaaattttacattctcaacattattaatttatagaggttttactgtattttgatatgaaaacctgtccaccaatcgtatagtctctaacaattttccgattaattttgtctattcttacgaatatatatgatattaaaaacaattataatcgttagctttctaattatggactaggcttcctataattttattgaaaagagaaagagttggtaacaccgaaactacggggtgaggttgcacacagagaataagatcactttttacaaaatgaaaagacaaaaacagtccatattccccgaacaaatcgtcagctgtgtttgttggctgaggaacgcgtaatttacaagctgataaagagagattcgttacataacaaacatttccaacaacaccattactccattacataaccggtccgaccggatcacgtcacccacccccgacattcgggtcggatcctatccaacccatttaaccgaacaccttttgtgacgtgtcaactcactatacccctattagcatttctgaactcaagtcttcttcacgcacgaacccctcattttatgtcaatctttgatatctcaccccttacattaattttttttcagtcagccccacaatcattaatgttatattgactgaccaagtaatcaattaatccatgtccttttaccaaaggacatgacatgagttggaaatttataattttcaataaaaactatatattatatgctcaagaggtaaaccaattgtatttcatatgctcttatataccttatagccatctttatttttacttaaaaatcatatcaattatacatttaacgtttttactaaaacaatagtgagtttaaagttaaagaaaagtatcataatttttaatgaaaatttacatattattaatatagatttgattattattctctatgatttttattatgccaatagtataaagggggttattgtatagaaagggaagaaaatggtcatatttataagcaaataataatgtcggataaaaactgaaaacattttggtatataaacatatcatcttctcgtacacaccacaattcttttgttttattatatactctttttttttttttggtgtcacgaaaacgaacgaatcagtgtcggctcttgggttccgaacaaaaacaacattgtacgtcggatccaaaaaacgcgcgttatataaacgcttaatttctccaggattcttcttctgcttccgccattgctcgaaaatcgcgtcttctgacaatgtgctgaaactgagtcatcgtccgagttagcaaagtgaaacttcgaagtttctcttacactaatctcaggtttgggattttgtaagaaaccgcgtttacaagtaagtgcgtttgcgtctgaaactttctttccaagaaagatttattcttttcccagtttgcaaaagcaaaactgatcctttctcgttaattccttctacgtagaaggaaagatttcggattttatttgcattgctttttctagaaaaacatctttctgacaacatcgaatgcaaatattaaaattttcctctctgtaaaaaatttctgggaaaaagttttctctttttgttttttgttagctggaaattgaaatcgcagtcgcaggtaccgcaaaaatctactaaaaacactgaaagtatcgtttttttagataccaaaatgctattaaaatggtgtgaacatatagttcggatctaatttaagatttttttttgtcttttaagtactatagtgtcattttttgttagctaatttcttctatctgtacttcaatttataaagttcttagatttatttattttgattgttttctttcaccaga

SEQ ID NO: 3822 - DNA, 692 bp, Arabidopsis thaliana
gcttatgccttcttcagtatttttttggttgggactatactaatcatggaaaattcagctttagctataggtttttggatatagtaagagtcacgaagacacgtagtgtcgttggagtttgttaatgtgttcaataagggacacctagctgattctctttattttctgtaataaacatattaggcaggtgtcatgccttagaatcgtaactaagccaggtgccaaattgggtctggacttttaactataatcaaaatttatgcccaaagttggaggtttttgtcttctgcttctcatatgggctttaggcgatatgtcttttattcatcttttatcaacttcaaggcccaataaacccagttcccactagcaaacaaaaagtaaagtacaaaaacaaaaaacagaaacagcttagcttgaccagtcttcctagaagaccgtgaaatcactttctctatcagagttcaagttttgtcgctcaatcctaaccgttacgttgcctttatcatctctccaacggatacattaacatttaccattttttccttttaatttttcgtaattcctaaacggctagtttccaagtcctctacctttatataaaccacacaagatccacactctctccatcctcaacacactttaaaacacattacacactctaatacttttaaggttttagattctaatca

SEQ ID NO: 3823 - DNA, 1460 bp, Arabidopsis thaliana
aaaccttgttgcaacttttttttttttttaatctttcctttgatctttgtttgttatgttgcttgtttgatcgtatgctaataatttcactcataaatttcaacatctacaaaataaatgatatatatatatatacaaaaacaccacgaagtttggaatttggctactatttaaagtagtaaatacaagggtttatttgtaaagtagacactttttcaaaaataatttgcaaaataggtagttttttaaaaaattagagatatagacacttttttttactttttgtgagatagagaatatgtctaatagactaaaaaacaaaatacctatcaaatactaaaataccctttatcttgagagagaataaaaataatatgagagaccatttttattttattttgtttgtctttattttctatttttctttattttagttttcttaaaaaattatattgatttttagagtatttttatgtcatcaatttaatacacaaacatttcaaacatcgttttgtatactaactattattcattggtgtacaagtgtgtataccgatatttcataactagaggtaatgttgtttttaatattttacaaacataatgattgtataaaccaaatattattactcaatataatggtgtacatgatggtgtacataattaagttaatcttgatggtgtacaaaatgattgaaactattatgacgattggtgaatagaatggtgtatacaacttttaaatgatagcatataagattggtaaacaaagtgtacacttactagaaatgtataaatcattattttagttagtggtgtaaatcatctcgtacaccaatgttagtacactgttttatatatctctaaaggtgtacgatcatgtacaccatattttcaatcatctttgtacaccattttgtataccattgtaatcggtctatcacttcttacatcaatattatatattaacttttacattattatcgtacactaacatttgttcaccagttttaacaatattgcgtataccgtcggttgaaattaaataaaaaaatgctacatatttttgaaatatagcaaaattagtctttttagattaacataaaaaatttaaagttaatatgattatatggtaattttttatgaaaaattattatcaaacaaagtaaaaatatttaagtaaaaataaaaaagagaaaaagtaaaatttgacttaaattttgtttttatcttactacataacaaaataacaaaaggttatataaatcatttactaaatagagaggaaagagaaaagtgtctatttctaaaaaataactaaaaaactacctactttgcaaattatttgtagaaaaagtgtctacttttcaacttatctctaaatacaatccgaaaactgacccgtacatacccgacccggatctattagacactcgttcttcgtcgttatcaattcggag

SEQ ID NO: 3824 - DNA, 1036 bp, Arabidopsis thaliana
aatcgcaatgactttacctgtcactatgacaatgagcaacaaaactgatgagatcatttacattaatggaccataataacaatattggagcttaccgtcatttttagccgacatgcttgatgaaacaggttttggtgattcttgaagaaaacaatctgtgatcaagaaaagtaaacatatctattaactctcaatcttagcttataattcttcaatatttcctaatttcatctgagaggagtatatgactcaaattcaataagtaacggtggaaacgaaagaaaaaaatccctaattttgaaatcaagaacaaaactgtacggatcaatgtttattatacgtttcaaaacttactaagcaaaatttagttttctgtgagagacgacttactgagattctttttgtgtttcttgactctccacaacaccaccaatggtgaagcaattggatacgttttcttgatcaaagacgaaattcacaaaattcgctagattaggtgaattggattagaattgataaaaatctaataaaataataataaactgattaggtggtgagacgtgactttgcaagagaggtaggaccaaagatggaaaatgattataaaaatacacaattattgacaattttttttttttttttgaatgtaaattgataaatctttttttcataaaaaaaatttcaattaaaaaatacaatttctcttatacatgcatgtttctacactattctctaccttctttcaataaataaaaaagtaaaaactatacaacaaaaatattcttcaccaaaactgaacatgaataatagtattatattttaatacttttttttatataagatcaacatttactttagttaatttccattcctataattaactaatattttattgattgataaggaagcaacaaaatatatttttagaaaaaaaaagttttatcctcaccgattgagagcaaagtctcactctcttccttaagctctgagaaacctccgataagcttatcggacaaaaagagaagtagacgccgcc

SEQ ID NO: 3825 - DNA, 1060 bp, Arabidopsis thaliana
ttttttgtagtttgttcttaataaattggggtaggcaattgccacccctcagcttaccaaaaaaaaaaatcatactagagtcaaattattccattgtcgactttgattagcatgtaatcctaagccgaccaatgtgtgtgtatgttgtgtgaaacatatgcttttcaagttttaattaattagtgaaggaggatttgacattaaccaaacaaaatattacaaattggtgtaactaagatatgatatatgttcatttattgatgtttttcaattttcctatattccttattatatgatatatatagttatgtatgtttcaagaattcgatatggcacgcatgattgaagaataatgattgaggaatttttctgtaacaaaaaaatttgaaataaacaaatatgtggctaagaacttaacaaggacacatgttgatatgtgaaataggaatcttataataaggaacaaaaggttgaaagcaaaagggtatttatttagtttactttcctattctgaacccttaacttctgctatcctttccaccaacaatctaatagtatactctctctcttttttttcctcttcttcttcttgtccttcgattttagaccaactaaacatatcaatatattaaagtagcatctctctctctctctctctctctctctcgctcttttatttttaatatcaattttgttgtccaaattctcatctctttgggaaaaccctagactaaagattccaatctcttttcttctaaatatttcttcattttttcccttttttgatttgggtatgttgggtcattgaatcttgtgactgccatggcagatcttttggggatctgcatagaagagttgcttcttgtagcagctttcaggtagctgtgtccagcctgcatcagatgttattaactcactacacaccaaacaccacaataacaacaaaacggcaagcattttgaagaggtaaacaaagcaagtgggcaacaaaaacggcacgcaagtttttcttccaagttaaaacaactcttggaatgtcattttgaaaggtaaaaaaata

SEQ ID NO: 3826 - DNA, 2000 bp, Arabidopsis thaliana
gtaatatggttataaaatcatttgtttgacaaattagatagttctattagactttgttttacaatcattttgttgtttgttcgtaacgttttcacagttattgtttgtaattttctagctttttttttttgctgaatttacattttattacttcttataaaatcttttacgtagataaatcacataaatatataatataatcacgtaaaacatactctagtagcgaatgaattaatcaccgtatatatagactgagtattcatgatattatcttctcgattcacgtaaccatcggagggagcgaggagaggtacgacatttgcttttgttggcggctgatcacgtgatgaataagaaagaggtgtccttgtttttattccacttacccattcaataacgtggaaacaaaacgtatagtacttaagcattttgttcttataacctacttgacagaatcaaagatacatcatacgtccctaaataatactatattccaattgtatatctccgagtaaaatgctaaaagtagcttaaagtaccatgaaaatgaatgttaacacacccaaaaacaagtcttatgcggataagaaaggaacgatgttaaccagcaacaattatcatcgttaacttggtcgtatcatcaaaacatgatagtttcatatattttaccattgcgtggacagtggacactggacgctacgtgcaggactagccgagttgggatcaaaagacacatgaatttgatgggctagatgattgatgtgggaatcatttgcactatagtacaggcttattttaaactactaaagaattgggcttgatccatactaaataaacaacccaattcgtaaaatgtagggagaataaggtggtgacaagtgataacagatttgtgctgattcggtaaagttgcattcattgtgatctgccattcaaatctgtacgaataatatgacaacccaatgaaaaaacattggacgagaatttgttgacaactacatacattttgtaacgaattcatacaactagcaaaatgaagataaactaacattcagtcgaccaatcgaaaatgtcaaatgagagtattgatacaactagagctgcacctataactctatgactatgtttctgtcccccaccagcattggtgtggtgatgcttttccacaacttctttagtagaaaaaaaggacccataaaggaatgcttttggaaaaagacaaccccactttcattatgataacacaaaaacggaatacataaaaaatgatatagtcaagtaaaattacaaaatcagtgactacaaaatttgattcgtatagttaaaaaatcacaatctaatcaaagttatatattggacgctagataacatttagccacaaaaggttaatccacaaattataaattttagtataagtcatgagatgtacacacacatggctctgaatgacgagttgctgacacaacataagaacaatgaaagggtccgtggattcgattcagaatcgagtcaaataatagtctcactcttatgtatttgcagcgacatgctttgcgtctaaattaatttaagaatcacttttttttcttcttctcatcattatttaaagaaaatcattgactcatacgtctaagtaccaagatgaataatcgtaacttttataagaatgttacacttatctgctttaactaaaaaaagttacacttgatcttagccaaaaacaaaataaaagtgaaaaccgacaaaaaagaatgatgaagaagtaaaaaaaagaggataaaaagagagttaaaaatgaataaaaagagtaaatacaaatcaaaaagcaattagtcgcgaattaaggaaagaaatataagaatgagacgaatccaaatctgcgtctcatttgttttcttcctctttcttctcagtctctgcgtttctttctcggggaaaaataatatctgagaagaagattcgagagagagagatctgaacggtttttcgcttagtctcca

SEQ ID NO: 3827 - DNA, 1031 bp, Arabidopsis thaliana
ctgtctaattacacactcttaccgggtagtttactagtaactagcaagttaatcgtattcttttgtagtcaaaggtagtcgatgattcagaattgcaaacactataattttcgttatcaaaaaaaggaaaatacattattacgttgttcaaagtaccaaccgttttatcaaaaatttcaaactttattcaatgatttctaactcaaaacaaaacttcaacatttttgggatttgaataaatgtcccttttgattaaaaagtttaggttttcccttcaaaagtctttggttactctatatagtatggagtgttttttcaatatgctttgtttttttcggcttgtgcatatgaattcatttttaggctcattttgattacataataataaaatgcaggcaagggtttaccaaggatttaagcaagtgatcccatggaggcggagacaagagaatcttccacggatgagttcttccaatatttaaatcaaatctcttcgatttcttttataaatcattaaatctttagttaattttatagactaatattaatatccatctgtatacatattaccacataatttacagacatgaggaaaagtttattcttaactttttaccaaattaaaccctgaaactacactgttcctctagataaataggattattgtaattatacttgaaaaaggtaaaagaatagggaacatcttaattcttaaatgaaggaggacaagagcattatgcaaaaccaaaaatttattatacaaaacataactacatgacctttctatttgcagttgctagcgacagcaataatactttcctgaaaaggaaagctataaaagttgattgatcacgatttgggcctaagcccaaaacttataaagtggaccgttaagttagttaagaagcccgcgttgatttctcttatcctcagatatttttttacgaaaatccacggccactaaccgtaaaggacactcttttgatttttctcttcttctacttaactcgctttgcctgactcactgagtc

SEQ ID NO: 3828 - DNA, 1618 bp, Arabidopsis thaliana
tgttgttgagtttcaagatcgagactttgtgattcagatgagaaattcaagaaatgggtttagatcgggaagaagaatttagggttttatttgttacttaagtcggagagatccaacggtaagtaagtgtagttgaagaagaaagaggattgggataattgaaaataaaaatcgaaacttttttgaataaagaagaaaatacttggggatttttttcttggaacgttgtgagcaacggtcgaatttggtggtgggtctttgtactgtattttgtattcgtatgcgtgatttattttattgatttgtataattacatctaatctggatggatcttcttgtttttattgtacgcatcccacgctaatcccatatgttttctagtctattagtcaactatatttaaaacatttaattttgttattagtaatcagtcaaaatctgcaaaataatgtttggatgtgaaattgtgtttgttttatgtggattcgccacctcatttttgaaaatggtaggttgttgtgagtatttatgttccatttttcaaactagttaccacctgtgataaccaaaaataatatcaaatagttatttatggtatttattactactattttttcagatttataggaattgatttctatatatttattatctctaaagtatgaatttatcatcaaaatacattagagtaactcattctatactttgtagaatttttatttctcacaaggtaactatttggacttggtaagatcttgacatcttgtcatgatttctttcctccgaaattattgtttggatgaacacgaggagttttaaaaaccgaaattcgttttgatggaaaacattgttgatatgcttcagtttattgaaggcagtcttacacgttttactataggacaacacacaaatgaattaccatatgaagataataatgttggatacaagttcgtaagggcttgctcaattccgcttgcattttttttatggggtgaaaactgtagcgagataaaaaatttctttgatgttatttatttatatggtaataatgaatatatgatgttctgaatttgtaccatttaatatatttggccgcaaatacaaaatttaatttatgtgacatagaaaaaagtcagaatccgattgacattcaagaaggtattatttgtaaccttttctagattttaatatttttagttttttataatcaaaagcgctaacacacataccaaaccataactacaaattagtttgaggtaataatatcgctgttgctcattgaaagttatgttactaacggtgttgcaaatgctagagccagatttggttagtgattgtacaattggtaaccatttttaacagaaactcgaaccatttggtctattaacttcatgttttatgagatgtccaattcataggttctcactcaatctcatcaatcttccattgacacataaatcctttatccacgaaaaccccatatactataataagttgtttataggcccaaatacggcccataactggtaaccgcctcagccttttatctgtatgtgtacgcaacacatttcatgactctactttgtgaggcgaagaagaagatcgtagtagcccgata

SEQ ID NO: 3829 - DNA, 2000 bp, Arabidopsis thaliana
aatcagagtgtgtaaccacaggtttgtgaattatgattgatttaactgacatgtgttatgaatatgttatatggatgttcattatagtcttataggtctattcatatgtaagttatgaatagaagaaaaaaaagttaatagtgtttcaaataaaaagtttgttaaaattttgttttgtagtcatttgtagctagatgtagacttaaatactagtaagattctgattattatgacgtggaaatgaagaaattcgttattatctatcaatagaaaaacgcattgcattaggcttgtattaaatagttgtgacaagactaaatagcgcgttttatataataggaagttaggataagaggagatagcacacacaaccacgtttatatactatttttggtgtttagaaattttaattattaatagaaaagtgcattacaattatacatttaacaaaagaaacgaagaaattagaattatcaatagaaaagtgcattgcatttggcttgttttattatagtgtggaaagagtgcttttaggtattagggtgagacttgagagagatggtacacgtaaaggcctaaaccatgtttgtatgtactttttttggtgtttagaagtttgaatgatcaagttaggtttaagtggactatcaaaagagagatagccaaatgatagtaaactacattttccgtcttaaaaaaaaaaaaactaaaaacacactaattaatgttacaaagtttagatatttgtttagattttttttgctatgagatatttgtatgttctataatgtatattagtatatacatatgtaaacataaacctatacttaataatatatctctaaaatgcatagaaaagaataagataaatataataagaatatataaatttaaatatatgtatatatagcgctagaaaattaaagttttaaataaaatatctggttttcattatttaacacgatatgaaacaaatttatatatagattttagaccgatgtccctaaattgtaaagtccatatattttagttgatggttgaggggatccttctcccttttgattactaatcagactaattgtttggtggttagtgtaattatttgtaacactaaacttctaaaagctaattatgcaaggcctcttgttgtaacaataaacaacctttaacaataaaaatctcagaagacacaaaagaaaaaaagaagtccatatatttatttagtccatatatttcatacatattgtatcatgattctatagtgtctgtttacattttatgtatctttaaattacactgaatggttaaaaagataccgaatggaaaatgaatgtatctttttggtatcaaaatatgaaacatcgttgtccttttaacttttcatatttttattgatctttccaacagtatgggtgatatttcatattagttaataatagttacaactttagttaataagtaactatccgattgaaacaaagtagatcagtaatacaactatatttaccgatttcttccggatattcgcttagggataacatttaatcgaatgttttaagtttcatgagtaccaaaacaagaaaacaaataataacaatgtgaataataatgttatcaagttttgttatatgataccaaaaatagaaaaatttggtagatgacaataataacttcattgccactctcaagttcgttcgttcgttgaatcttatctcacttctcccattatttacaactgtggataagccttttagtctgactcagctttctcaagatccgaaaacacactgacccaacccggttcgattttgcttaaccggacaagatacattaatctgcctaatcttcaattatttaaaagctaactaaacgttatacgtactaatcacttcttcccctataaataaacctttctaatttctcatctcaaatcacactgcatcacaaaacccaaatcggaacttaaaccaaaagacaaacaaaaacgccgtcgtttcacg

SEQ ID NO: 3830 - DNA, 559 bp, Arabidopsis thaliana
cgaaagcaaccaaaataatactagggtttaggttttttactttcaaaacagcattagttattaacttatatagtcagacttattctacgtcgacggccaaccggcccaaccggttccagctaggcctaaagaggaaaaagcatgttggaccaagagcaactaaagccccattcaataggttccggctggagttacgctataaccaaaggcccaaacacagaataatttcacattatgattgtaatcaaaaggtaatctcctgaaccgaaccaattcaaatcagaccaaaccgatcatgtcgagcatttgaaggagagacattgacgcaaaagagaatcttaaatctacacgcttactatttaactgtcgacgaaattagagagcaaaagagtcactcaaaagtgtgtgtgtgtcaaaatctctagcaccgatttttctaaataacgtcgtctcacagtcacacacacacagctctaaaatccctctacgaggtttttcttcaaactcgccgaaaaatctaatctttacgaagacccagatcggcggatctagagttgaa

SEQ ID NO: 3831 - DNA, 2000 bp, Arabidopsis thaliana
tcatcttcttcttcacccgattcttcaaacaatcaacaacaattgtgataaatttgatatcaaaattacaaaagctcattggagcttcttcactcgtcttcttcttcaacaacctccgtatctccgatggcgtcttcgccccacacaaacgacggcggtctcaacaaacgtaagaatatcttaaacaagatcagatcgttgatgaaacttatgtcatgggaaagaaaaatgagcttagcaatgattctagaagaatcgaatttttgattgcaggtcgagatggtggtaatgggatatgctctggttttttttattcgattgaatttgttcttgattgttttaaaagtatggctaatgattttgattttgtaaagacaaacaaaaacacatccctttaagaattgtttcgattgaattcggattattgattttgtttctatagctattgagaatctaaaagctctcagtgtttctgagatttgattaagaaatctgaatcataatcgagttatggttatgattatgaagtacaatttttcaattgtttataatcattttctacgtgatatgacgatggaacacatccgcaatgatatttgctgctcgcaagatctaaagctttgtttcttaattacaatctacaagaatgtttaaggggatgtatttttttgtttgtatttatagattttaagaaactcgtgcgttttattcttggtcaaattaataagtcaatgggtaaaattgggttcattccggttacaattaggtttagttggtttgtttatcggttttgtatatagtaaaccgattaaatctagcttcgtggggttttagctctcgaacatttagtacgggggcattaagctataaaactttctattcgaggggaaacaggaataaaactttgattttatagagatatagaccggaatcaaagaatgggctctatctggtatgatgtaatacttctcatggagaaatagaccgttttccggataaacacactaaaacaatagttacattggagacgaccaaatttaagaaggaaatgagctactttcattttttttactaactaaaaaaagttttacaaaaaagtttcttaaaaagcccaatcccaagcccaaataccatctcttttttttttttactaaacccgattccgtgggaacgaacccatccgttggtgaatctggacagtcccctcaaataaaagttgtgagagctgtttcgtcgctttgatcgaaatggcgtcgtcttctccaactcagctagctcacgtcccgattcctccagaaccaggtcccttcttctctttctgtttgcttctctatccctcaatttgctttgtgatcgtttcaccaagcttcgctactagttattatcttccttcattccattgcgatcgcttagcttcgctgtttttgatgttaccatattcgatctactaaaatccctcagattatccaatataattgtgtagtttccgcttttaatcaatttgattgaggataaaccgattagatgttcacgtcacttcgtttctgatcgaaaatgtgggtttagccatctattttcgctcgattcttgtggcgtatacatgcttaagttcttcgtgtatgagtttggatttgatcagttacaaaatctctgtttgcagctattagtgtatactaaaaagcgatttttcgtttgatttctggaatagcaaagattaagcgaaatgttgattgttagtttcattttcagcaatatgtttgtatttggtgtatgcaagtagtgggatattgtcatgaatctcttgtctcatgtttgagtttttcgcttcaggaggaaggtcgccgacacaagaagctaatgagccaccagttccgatttacattgtgacggatccgtttcaacttcctgctgatttcctaaacccttctcctgaaaagaaattggttatcggttttgactgtgagggtgttgacctctgccgacatgggaaactttgtatc

SEQ ID NO: 3832 - DNA, 1968 bp, Arabidopsis thaliana
gaatactagaaaaatgacaatgttttttgggccttttgttctggatgaatatctctgttgttttttgggccttttgttttggatacgtctgttatagcagataacgttttctgatagtttctatgtttgtattcttgttttggaataggaaagctttcttcagttaagaggattggttactatgctaaatcactcgagtaaactcagttaccaatggttcccataagtttgaactgaccataaaacaaacatatattaacttttttttttttttgataatttggagtgtttatttttggtatccaaaattccaaatattatacaagcttgttttggtatagcagtgtgctaggaaaaatatttgatgtgtatttttttgttgtccacaggaatagttgtcggtgcgttgtatttctggaagtccaaaaatgctaacgtaaattttgtgatttgatatcgtcgatgtgagatattcttttggctccaacgaattacaatcacggatttgttgggggacatattattattggcgttacatatataagaagacgcattggaaacaataataaaggacgtcttgttcatggacgagaccaaccaccacatgcgttcgattagcctctccttttgcatattcttgtggatcaaatccttccaatcactgacatcgggcttgtttgcttcttgtctatatgccatcattagttttgcaacttactaagttctagttcaattttacacgtttgacattaaataacgtacgttatgaaatcccaaaacatatgagtttacttttgttcttgcatatacgccggccatcttaatttttgcaactttcaaatgtctaattcagttataaacatttggcattatataatgttaggaaatcacaaaacaacatgagtttatatcaagccagggaagttaatagattttttttttatatcaattagtatttgggatattttactagatttaaacattgattatattttcacaaacacaagtgatttggaacaaagatttggcaattgtactactttgattaaaatttcatagaaaagctaaggggttgtgaaatttgtgtggtggggcttagtaaaatttgtatggtacgtccctagtgacggtgatatttcttttataaaattgacatatacttacaaggttttattggaactataagatcattttgttgttgtctggtccacttgtgacccttattttagctctgcaagggacgcgacaagaactctacaaaggatacgtcgaatccagagacaaagtgactggatgatagccgagaggtagaaccactctactaataaaggctttcgtcaaactataccaaatgtaaagactaaagaacatgatatacaaattgtctttctccaaccatttgtattttcaacgtatatgatacgacaattatatggcttacacagtctatacgcttctatttacataacagtttttgtaatcgctagtcatgattagttccaactttgattataaaagaattttattctatcttaattgattgtttgtcctccttattcataatacacaaaaataaaaaaaaataataaaaaaaaaactttgattttgaaacgtatttccttttatttgcatttaacttatggaatgggttatagaacaagaccagattacagcctcagaattttaaataagaatcaaaaacgaattctccaaacccaaacaatcatgccacgtgtaaacttatgacaaatgaaagtatatcgtaataatatacaccagagaacagttgattaaatccctccctcctctatctatctcccgtcgtcacctctccgactctgcttttataagacgtttctctctgcttcaccaccagagagatacatccaaaaattcatatctttccttcatttttattggcgttttaagaaaacaaagcttccccaattagggttttgtattagaaga

SEQ ID NO: 3833 - DNA, 2000 bp, Arabidopsis thaliana
attctaatctatcatcgtttcaaccatttttatattcagaccatacggtaaaccattttagacaacaccattagtcatatagttaaataacgagtagggctacaaaaaagagagttgaatagttgttcattgaagatcttctcgaatcttgacataggtactacttgataatggaatccaacgctgtagattaaccatgtgcaagggagtggttaattagtactattatatgtatgtactctcaatttctttcacttttgaatgttcattggttctttctcttattgattatttacattcccattatagattccagttttgtcaccttgtgggggaggccgattcactcttctcctcttcccttttcttggatatctcaattcacagtccgcaaaaagagtttctactgatgtcataatttaaacgcgttattttctcctatatattcgttttggtgggtttctcgtattttaacaactattgaaacaaataaaatgaatcacacgaaaaaacacactatagagtctatatcttcgataacatataacatacatgatttgatgaaagcaaactgagaaaacgtttttttttttttttttttttctgttttggtcaaagaagatgtttttattttattttatcaaattattatatagttttaactatatttttcatacgaggacagatttttttttgcatgtttgatatcttaattttttgaaaagttttgtggtttctagtacccatagttttctatttaaagtggtttcataaaacattaaaattctggtttcgatgtagttttctatacacactttaaagtgttaatagcactatttatagacagaaacgaaaattcaacactaattgattatgaaattttggaattgagttctcacgagcttgtgattatctgacttggacgtttttataaactattgtctttttttgtatcttaattttcgtggctttattcaaaagttaaaaaaaaaaaattaaaataataataatcagaaattgaaattttaaatttacattacgtgtaagcagaattaacttataatttttcataaaagcaaacaaaattttaaagactaaatgtcaaattcagtttattttcatagttttaaaatttaacacaaatgtttttaaaaatataattcactattgatttaaggttattcttaaataatgtacaattagaaactttagttacttcattaacggtaagaaaaagttgccgttacactcgttacaacagtcatattttgtttttcactgcgtaacaatttatcaaaatgtaaacatagagaagcggtagttgggcctttttctctcctttcaaaatatataatgggctttttagttcacggaagacctagagcttggaatcgtctgtaatatactccacactaaagtatatctaacactaaacaaatccaacggctgagagtcttttattcactataacacgtgatagttctccctaactcgtaaggataataatctgaaggagtgatgagaaaatattaacgaaaaacaaaaaaaaaaagacagaagacaaaaaaaaatcacgaaatctgattttcctctcttttgctcgaagccaagtctctgcttttactttgatccaccaacttcatcttcaacctctcgattttaggtacgtttttccctttctttgtgtatcttagaagtcttttgattttcacgctgattcatttctggaagtttttcgatttggtcttcatagattcctgaaatcgttagtttgaaattgattgagatctttgattctatatagaaaatttatctgatctgtttattctggaatcaatttgtgattagaggaaattgtgtcctctgttttaagtttctgattttggatttgaagatccgatttttgcatcttgatgattcatttcaaaaaatgtctaattttggtatgatttttgcttgtctcaggtaagattcttagagtgattttgacttatctaaga

SEQ ID NO: 3834 - DNA, 356 bp, Arabidopsis thaliana
gaatacggtgcgtttcaagacgagacggtggcttacgcggtggtcttagctaacgtgcgctcgtatctcaaatatctgtatcaaagtctcagctatcatcaactatcatcgttttatcacagagttttatgtctcaaaaaacctgctggctatataagaggcttttgacttttggagtttgactctttcttactagcgacagctggagttattcatgaacaggatagttatatccttatgtccaaacagatgcataaattctcaccaagcacaagataggcatttgaagagtggataacactttctcagtctttcttcttcttcttcgttgtgataggtcaggtcagggaacaaca

SEQ ID NO: 3835 - DNA, 1102 bp, Arabidopsis thaliana
atagggagaagaaggaacgatgtaaatgcaattttctttagggatagtgtgtgatattcaacatttacgaagattccatcaattctttcatgcatcaaaagttctttcatctttgttctgccccctcaatctgacaaaacatgttggtttgaatgtcaattttttgttaccattcacacattcaagttttcaacagttcaaaaaaagaagaagaagttattgagccattgtttcttctggtttttgagatgattgttttgtgctgccaactcttacatgacattaacaacattattgtgcttttactgccattaactccattaccaccattcaatttttctgtctttaattattggttccagttttgttattctggtctattattttgtattatcatcattctatcaaacagattatttgttttgttgaaggaaatgaaaaaaagaagaagaaagaatcaaatatgataaattgaggataatattaagattgtgtgacctgccgtgccgcccaacaacatgtcacatggtatcttaggtttgcaaattcgtaatttgacatcttcgacgacaattttgactatctatctaatcttaacatcactcttccatcatcacttcctattttattccaactttcttaaagaagccaaaaaaaggatgatgtcagaagttaaggaatattctgacaaggataggatgcccttaagggaatctagagtcttgaatgggcttttagaattccaagaagctagggaatctcgagtctttaatgggcttttaaagtttcaagaatcaaaggcccaaattgcatatttgtagcccgtcggaaacgcaatgaaaatgatgaatctgaagactgactcaaacaacatctctgtagggttcttcttccttgcttcttcgagtctcgatctcctctctcaatctcaggtaacgccaaaatcctctttttattcatgggatcttttataccaaattcgatttcttcattttgagatctgtgaatatcatcgtcccacgaaccaatcgaatctgttgttgtctgacattaattttcatttctatctcttgcagtcttcagcttccaattgactttcaac

SEQ ID NO: 3836 - DNA, 2000 bp, Arabidopsis thaliana
cctaatcactagagtactagacaccaatgaaaattgagatgtcacatttacgttcaactgtatcttgtcgtagggaactcgttattctagatatataaaaattttacttacagaaaaatgacttaaataattatacatatgaatacaaatgatttcaagaagtcataatcaagaattcactaaatggaatataggtttgacttgggtggtaggtttgtgattatgagtcttgtattgttttacacgtcgctgtctttgtttggtattacttggactttttttttttatagatgaaaatccaatttttctcaagaagattttcgacacggccggttggacaatattgacgtacgaaggtactacttggacttgccgtgtcttccacacagctaaaaattaaaattcaccttttcttccggttataatggttctaaaagtcacctgaattttcttccggttataatggctctaaaagccaccttcattccatacactattttcagaaagtattcagccttttttgtttgagatgtcaattcagattagaaacctaaatcgatatttgtttgtttaacggttacaaaaataaatttgacaacttgattgttgcaacaattgaaaaatagatttctaataaaattttagtattcatacatgattttttttgtatccatatacagacatacagtagtactagtatgtgtctgtaatctgtattcataaatgcatatatcttccaagtatctaaaaactcaaaacgtatcaatgtctatagtagtctagactccagttgaatcggatgttacagataacttttccacaatttatggaaaagtaataatttgtaaagtaaattatgagcacaggtttaaataatttcggccgtatggcccaaaattggattgtgtgagacatgtcggttatttggcattttgggttggatagtggtaagtaatatgcccataggcccaaaaagcccactagcaatgaattaaagcctattacactttgttttccataattctcctcattgtttatttgttttagtagtatttctcaaacaatttaatgagttgtttttcatcttaagaaaaaaacaatttgcaaagcaatacacatactgaaaagaaaatcaaagcaagtaataaccatatcgaaaaaacattagaagaaattttaaaaagataaatcccaatcaaaatgaatgtagagaccaaaacagtggacttgggatacaaaaacaatatcattgacaatgcgataaaaatatattgaaagaccagtaataaaccataatgtctttaggtaatctattaatcaatcaacaaggtgttatagtttatgcccacttgaaaacacaatgtgttgattttcgaatcaatacgtaactttcaatctacaaatgaattataaagtcattcatttttggtattaaatacaagaaatatcgtccgagtcagccaatttaaaacgttaaagcccacctttaacttcgtccccaagccaaacttttaatttctcgattgtccgctacgctccacctcatcccaaacaaattacccgttttacccctttgttagataaagttaaaactatttgttagtttctttggtaaaacgaataatatcatattctccgtctatgttcgttattctgtttttaattttcggttcgttacagcttccacagcaagctcaaatggtaatatcattaatcatataagggcatttttgtcatttaacatgagtattatattaacctcatcttcgcttcatcttccttttcgcctatcttcctggatttttctctttcgctaaaaagaaccttcaagctctgtctctctcatcgctatataatataataaaatcaatcacacacaagactcgtgaaaggggacgatacgcgttttttattttgtacagactcaaattcaattcaattcaattttattcataagttctgggtttgaaatttgaacaattgaccgagatttgggaacg

SEQ ID NO: 3837 - DNA, 1073 bp, Arabidopsis thaliana
tttatccacttcaaagacagacaaaattcagcacttagataagatttcaaagatataaaaaagactcttcttttcatctatatacggttaacacaatcaatataacagaaagaaacaacaacccagtaagctaaagtaataaattttcacaacaaaccagaagaaaggcgacaccttcgaaagcagagctcaataagaacacaattgacaatctgaagaaacactaatccataaattttattacaaaacacccaaaatcatggaagtaatgaactaatacaagttttcaaaagcttacaacaaattcttatccaaacaaaacatacacacataaactgtggcactaaaaaatgcagaggataaactattccaagagtaaggattaagaaactaacagaagtagagagatgacgaaggaggttttatcaccggaagtttttggtttccggataagaaaaggggagctgaagcaaggaaaggaagtaggtttatctccttactctcgcttggaaggtgcttttaacgttcccttacctctttcaagctttgagttaatcttggccgttggattcaactcttcggatcctggatcagatttatattgggcctatttgggcctttattcttgctccttaattcctaacaatggaattggaatcagtgatatttattttaaaaattgattttttcccgattaattgcgaaattttcgaggaaataatatttatagtattattttgtgagatatttcgtagtgactagtataatattaatgtggctggaataaaggaagtattttaaaaaaaaaacgatggagaaaaaggtaaacaaaaataatagaaaaatataaaaaagggatcttggaggtatttgaatcaaatcgaggtgaacgaacaaaaccacttttgcctcttcctcttcttctctcttctcttgcggctacgattcaatctcttaaaccctagattccttctgagttcttttttgctctgatatttgtgtttgtctcaaactcttattgttcaatatccgacaaggatctattatcagtcttcgctgccaactctgttctc

SEQ ID NO: 3838 - DNA, 2000 bp, Arabidopsis thaliana
attggatcttcctacgcaatgagttcaagttcagcgtcatcgggtgttgtccaaaaccgtggttttccggtgaagtgttggtgtggagatgatgtgacaatcttcacatcgaagagtgttgataatccgggcagacctttttttcgttgtgaaacgaaaagagatccaaagacgtggacaaacaaaaaagatgtaagtttgagtttgagtttgagtttgagtttgagtttgagtttgagtttgtgtttatgttatgtaacttagcagctaatcatatcggatttggtttgattgtgtaacagagtcatttgtttaaatgggttgaggatgctgtatacgaagaggttgaagatgttttaccaaaatttgtgatcattgcaaatgagcttaacaaagccaaatccgaggcaaatgagctaattgtgatgatacatgaactaaaagaagaagcaatgttgagtaaacaagaaatctgcaagtggaaagtgtgtttgaaaatatgtttttttggctttgtttgatcagcattttcattctttacatgatgcttggtaaggcaaaaaaaaatgaatttgttgttgcttaatagtgtaggtctatctatcttgttgtcttcggcaagcttgtaatgacaatgtagtatttgtgacttttatgactttgtaatgttggctttgttgctgtcttaataaaacttgtgagtgtttggtctttatttttcttgggtgaatgtgagtgtttggtcttgatataaggtgtgagtgtttggtcggtgtgagtgtttggtcttgatatgagaatcggagtaaagagatggaataatttcactcaaacaaaaacttgtcttaaaactatgagtgattaaaagtagttaaccaacatgtcttaaaacttgccgaaccaaaaatcaaacaacaaaagagacaacaaaagagacatctcaagttatgaaacaatccaaataccaacaaccaaagaccaatcgatgttctcatgtcaagtttgaacactcaaaccatgatctccatccttctactccttttcgattttttccttctattgtcaccatctaacctgttaccattctgtttcgatttttttcttctcctattgtcaacgacagaatgagacggcctagtagaaggctcgtgaacagcaggagcctcgacagaagcacgtcatagctcagcaacagacggaggctcgatagcaacagacggaggctctatggaagcagacggaggctcgatagaagcagacggaggctcgacaacaacatgaggcggctcaacaacaggaggaggcgggtcgacatcagcaggcagcttctttctcatcattacagtttcgaatttctcttcctcgatcgacaaaagagaattgagaatttttgttttttagggctcgtgatttttcaaatcgaattggggaagttcagtctttttgataaaacgacgtcgtttactaaaaccgaaactgtgtcgtttgcaaattatgtctctgttaacgtctaattaaccctgtcaattaagtctgttaacccagataacgacaagactaaaatggcgcggtcaacacaagtttaagatttattagaaaagtcaacaaaagttcgatgtttttttcgtttcaaataaagtacgggatttaaatcaacgttttagcaaagttcaggattttaatgacatttttccctttgttaattcaatcatcatgtgatatgtgaagataatctgctgtatgtagtaaataaattttgaagtcatctgattgtaataatgtaataatatatagaagtaaatgttacttattgggcttctctattttactaagatgcaaatgaattaatattttataatttatttattttgtcctaagtatacatgtcttttttgtcttttgtctgaatctttctcgtcggaaacacagatctcagttccttacagaagaatctccgactcgtttctttgccggcattctcagatttccggatactagcc

SEQ ID NO: 3839 - DNA, 2000 bp, Arabidopsis thaliana
aacggacaaagaagaaatgctttcgatgtatataaagtataaacgttaaagaagaagagatcaagagaagaatgagtgaaagacaagaggtctttaaaggagtttatatggagtctaaataaatgaacggttagatgaagactaaggtctatgaccgttggattagattaaaactgccatatttctcttgcttggcagatagtccaaacccgaagaatctacattaaatatgacacgtcccattaacctttagcctacatttatcattatcactgaaacgttttgatgggttatcaatcacaaattcacaatacgaaaaaaaacagtagtgtcaaactattatggtattttagcgtgtaattcgttacgcagatattattatctatggttgattttgaatctgaaaatatgatctatcgaagaaaggcctgaaattattttattatctgaatatgttttgtcggagcttacatgcttagcatgtttgaacttcgaagatgaagacaactatgccaccacacgtgtgctggccaagtgggacaaagttttgaacctattcggtaacactcacacgagatcaaatccccaccatctcattttataatgtcgtttatttatttgttagtgatcatctactgttttttaataaggttagtgccctagtgatcatctacttgtctgtgattttgtaaaaaatatatatagaattaaaattatattacgagaacaaaatgtgtacggtgtgtcctctagttgcgttacttgtgtacgttgatgatggttgatatatatacatattcatatcaggacaaaaaagcttttaaaaagaccaataaagatagatctagttttgagtaattggaggattcactaagctttttggagctaaaatggtgaatttcccacgaatcaaatctgagaagagaagctttctatattttgagttactttacacaattacacgttcatttgtaaattaagatcgtgtttgtgctgcatccaaaaaattcttggaattttaaagtaatgaaatataactaaacaaaatgaccactaaaaaataaaataaaaagcacatgagagatgagtgattatactctgataaattagctaacaaaattatgtatatataaaaaaggttttatgcagtgtaaattgtacttacacacttaatcaaagcaaaacaaaaatattaaaccgacaataatacgtaaaccaaaaaaccaatattccttaaaatcaatttgtgtttccaaccgacaagttctttgtatatatggttaatcatattttgttgtagtccgtatcctagctaaaagacgtttaaacgttcataatggatatgacccacccagctggtgaagatattcgtttttcgtgatcatatatatatgtttctttttgcccatccctgtttctattaacccaagttaaattagctatatatgagcaaaaactatgagttgaagttaagcacaatttccgaatcacaaaaaaaaaacaaattgatttggacctttcgataataggaatcagaaagaagtttgttccaaacacttctcttatataaatcccaactcatcagcttcgtgtttccgtacagtgcgtacatatacgaacgtgtcactcggcttttaacgtcaacttaatcgagagcccaattcaggcttactataagccttaataagcccaatattaaaagtccctgattattgtgagcccaatattaaaagtccatgactatggtgagcccaataataaaagtccatgactatggtgagcccaataataaaagtccttgattaaaaggcccatcaccagtggagcgaagaagcggaggagggaagagggatgcgatcctctcgtcatcgctggttccatcagtttcagtgagaatcagatcgtcgttgtactgagagctccggcattggttcacggcggagctggagagttatctaagaacggagaggttactgatctgaattgttgaagatcggaaa

SEQ ID NO: 3840 - DNA, 2000 bp, Arabidopsis thaliana
tcgggagattgaaatagaaaaacgaaaacaaatataaaagtaaatgttggccactaagcttaactatgattatgaattccaccttttactactgcaaatcactcacagcgtttattacgataatgccccttatctctctctaaacgtaataagcattttggtaatttcatgatttcacatttgttcctcctctctctctctacccattgacttgtgtggacatggtttcaaaattcatcaaaagctaaattattctttagagatgtgtgaacattaagttttaatatatgaaaataaagtacgcactaacttcttaggtttcaagctgttttctagtattttgttttttcttttctttccattttcatattcctttttattagaatacgacttcagacttcccactaattctatgattaagttaaaattatacatcagtcgaacatatttttatttgttttgatgaaatattttatttaacttctactattgaagaaaagcatatagatcacactattgatatataagaaaaattatactagaaacacatctatgaaattttgttaattttttttagagaaacttactattattttctttaaccaattattttttataaaactaaaatgaatcaatgtggtagatcaaaattggagaccgcacaaataaacaaaagattcaacatagaaacaagttaaacccaactttatagtgaaaaaaggaggaacagccatgagattgaagtttcatggaaccaaggttgtagcctatcaaaaacgtatgtgggttggatagatcaaaattagaaacttttgtttcaaatggtaaaagcagttatttcacaattcatagatagttgaatgctaaaaaaaaaatagagaagatttggtaagtattaaaaatataaaaattgatcggagtagatgtgaatcatgtgatgaccaaaaaagatttgacaaccaaaattgtctttttttttggtgttttatgtattcagccgtttcctaagtgttattatagactttacggtttcgttttctccaaaaaaagtttatgattttttttcacaaattcaaaatgtatctattatacatagttgatgatggaacttgtgcggatttttcaattttttgtttcttttgaccgagatttcaaattacgagttaacgttaaactgagaagtcgcatggattacacattgtttaactagctacacatgattagaacaagttaaaaatactaaacatattgtttttttcgccaaaaacaagaaagttaaaccgttttgacgagtgttgttataacttcgaccgtttcgatgagtgttgttatagattctgccgtttcgttctttccataattctcttttaacttcttctctgttattacaaacgttaacaaaacttaataaactagaattaacctgtttattcaaatagacttatttttttcataccttacaattatacaaattgttcaatatatatttaatcttatgttttatgaaaattcaaattataaagcttacaatagtggtggattatagttaaatgtttttttttgttttttaaatccataaattaagatacatacaaaattagtatagtataaaaaggaaatataaaaatatcacatccatgcaggctaacgttcagttgactagcagcgataaaagcagataattaattctcacatttaattttattttattttttccattaaagcaaaaaccccacactctctctctctcttgctcctccctctcttcctctctctatctctctctgcaaaaaccctaaatttcctccgatttcaccatcttcaatctccttcacaccccaacttagcctcttaatcactccccaagctaaaccctccaacgattttccatgattcgaagatacagagccttagcgatgaagaaaaagccctaaaaaccaaagctttgatctctccgaaatcggagtttctttctttgtttggtaaatttggttttcgaa

SEQ ID NO: 3841 - DNA, 401 bp, Arabidopsis thaliana
aaaagaacatacattttcataatcaaattatgatatattctaccaaattataagcaaaggaaaattataatctagtcattatttatacatgttatatttgaattcacgtttgtatccattacaaaaatttatgtaattcgcagaaaatatatatatgtcaaattaagttatcggaccggatcgggtcaaagaaaccggattggttaacaaagtcaaacaaacaaatattgacttgagtttcagattccagtaaaatcaaaccggatcgggtctgaatttaaaccaccgggtcggctccatctaaaatctgaagatcatctccgccttatcttgttgactatctctgtactacttacgagcgcaagtgagagagtaacagagaaacgtagagatatagcaaa

SEQ ID NO: 3842 - DNA, 832 bp, Arabidopsis thaliana
tctccttctccttcaccactactagtttcaatcagctgccacacatttgttagagacgaaggttttgttttttactcttactcttcgagagccaatgttaacaagccacgtgtttgtgacgtttttgtaaaaacaaaatcgcatatatttttccgcgttacgttgcgtttgcgttagtccacacgcatatatatgtaaaaaacctgttattatcggtggcgtacccaatcaattaccgactgcagccggtcgcagcgtctattcagccgacctaagaaccggtatcgccggtatcaataattgctgatcttttccttctcttcttccccagattctcaagtctctctaacttggagaggagatagaagacatctcatcatcaatctccggatccaatccaattctgcatcgactcttcagaggtatttccgatgaaccattattttccccttgtagaaattattctcctttctcaattgatgattgtccacatagctagattttgtgtaaagagatattttgtattatagattgcatctactgctattgtttcccgattgattgaagcaagtagacaagaaaaggattcggttttgtctggttctgaaatttccattggttccaaattgtcatccttgatgaagaagatactttgctatctattagaaaccagaatggctcgtgtattgcctgattctttgtttaccttttgttgattagagtgattttgcaattggagatgttagatgttctctgtttgttttgtggctactaacccaagaaggtttcttttcagttttattgggtcattggagatttttttcggttgagg

SEQ ID NO: 3843 - DNA, 1431 bp, Arabidopsis thaliana
ttccgacagaaaatactctcaattgggtactctcaacaaaaaaatttgacctttgattccttcagctacgcaaacgaagctcctgactctgttatccatggcgggggaaagaataagatgttcgagatgattagagggttgtttggatacgtggtttatcgtaactaggaccaccacaaagagcgtattatagagaaacataacttattatcgctaaaatgcacttatagtgcgcatcttgtcagaaataaaacgatttcaataacacacgccttgtgacgggatccaaattttgtcagtcaaaagcagttacttatgcagagaagggaagagagagtagaaaatagatatcttttgcgtgagcctctctttgcccgtacgattcttcgggctctatgagatatcgaattttcttctcaaggttagatttttcgctttctactaaaattttgcaaaaattctcattttgttttgttgttgaagatttcgttacaagttccttttttttttacttctcggtgtaaaattagaacttgcagggacctcgataattaactgatgtctaattttatcgtggaacggttgagaattttggtgattaagggtttcgattttgattttgggtttatcatgtttttgaaaaagtagagggaaaaaaattaagacttttgatttttacgatgttgggtttcactgtaaatgaggttctaatggcggagtaataacataagtgtgtgtttcatttactggtttagtgatttttcaaatggtcgtttgtctaatcaaaaagatatttcttttaagtttttggagatcagacagttacatatgtttatgttgctagttcttgtctgagacagttacatatgtttatgtagctagttcttgtctgaatcgtggatcaatgcccatatctctggaagcttaatgtgattttctttgagaagtgcaacatatatcttcttgtatcttgttgagatcacttcaggttgtgtgattttctcagaaattattgacctctagtcttgttactgcagtttcagtaccttttttgtttgtttgatgtaaaattagcagtttcagttttgagtactttgctcttaattttgtctcttggttgattccttttctctgatgtagaattgagtgggctgatcagtaactaagttcttcttatgcaggtaccatataaggttcaatgctatataacttcaatctatttagccgtcaaaacattttatatctgcttcgttgctttaaacgttatgttttctctatgacctatgacctgcgtttatactgctttataatctttattaaggcttgatggttatcatttctggttgcggattttatgattcatccttcaacttagaatctcctgtgtttttttcaggtaacagataaacacgaatgttttcagaagtagaa

SEQ ID NO: 3844 - DNA, 2000 bp, Arabidopsis thaliana
gtttacctctgaaaatgattgaaaaatgagatattttcctatatatatatatatatatgtatgtattatttacttacagtttgatacatatatatgtattcattcatatatatatatgcaatcatttacttacagtttaattgctaatatctgaatgattatttttaatcaattttttgatgtttttgtcccttgttgtatctgcatcatttgatatgttgacgattctttcaacgttattcatcaaaacggtaactaattaattttaggttttaaacttggaagttaaataggggacatttcactttttctacaaattttttcgacagttcaatggaaaacgtcaagttaattttcggctaatgagatattgaagctcaatggagttaattaacagatcataaatgaaacacgtgtaagggaatctgctactcttttgtattgtaggccttaactttttttatcgatcagtcggcgtgtcagtgtcttgtggtcttaaggaaaaatatccgaacctcatcatctccacgagttaaatagtatatatccttcttcttcgtacgaggttaagacaactaaaatcttaaaaaataaattaaatacttaaaatcaatgaatcgtttcatatatatacatatatatatatataatatttatgtgcttcgattaattagtacatgtaactattttacgaacgtttagttatcgcccatttgcacataagtttacaaacaaacatagaatcatcacattatatattgtgcaaaattcaaatacaagatgataaatctttacatcttcaactacaaacacgatatatgatatcaagttatcaaccaatcaagagctgtaatctagtagttttttattttttgttaaaaagttgtaatctagtagtttcattttcatctatctttttacattatagaaaaatgaaagtatagaaaaatgaaagcttatcaaaagttagtgggctacatctacattatattaaaaaaatatatatatatatatatatatatatatatatatatatatatatcaataactagatcggacagtgaccaaaccaatctcgttgtgtccaatccaagaaaataacaaaggaaagtcgtacgtttgatgatataaaaacctttttatgtttggacgagtttcatagaacatggtggacaaaattatagtactatatactatttagtatctccttttgaaaaacagtaagccatgtaaatgaatttgtacaattaacagctatttaaaaagcaaaaaaaaaaacagtgaatgtttatttacaaagttccgaagggaagaggttgtggtagtggttaggggcatgccaaatacggaaagggaggcaaagaagatcgggtagtcttcataatttcatacttttcactttgtagtaatctttccttttcttttttaatttcatcaccaatgtttctttgttcaaattcatatccacacactcttttggaaatggcactgcagcttcatgtgaggtgtggggtcattgcgccttatcgtctgaaaatgttaccctcttgacattcaatgaccccattttcttattttccataatttcttttaccattttactataacaagaatgatgcaaaaggaataggcaaaaaacagcatattattttttagtgggatcctagtaggtcacttgaagtctctatgcattgattatggattgctatatttgtctctctttttatttttgaatttcgagttagtgatcttcaatgtgtgtttcaaatatagatattcaaaggttataaaccaagaaaagaaaaagtagaaaaaaaatatatatatttcaaatcttttaaacggaccattggcaacaaaatctataaacgagttaggcccaaattgttgtacaaaaggcccattaggttaaataagtatgggcctaaagcggtccgatcaatctctgtgccattaccttcttcttcgtcgtagtgatttctctcgagagaaaaagagag

SEQ ID NO: 3845 - DNA, 998 bp, Arabidopsis thaliana
ttttcttcacttttcgtttttccgtttattaaaataaagaaagatagatttgccgcattgataaatcgggaaccgcataaacaagtttcagtcggtgaagataagaatctctaaatattgggcccgtcagaaaccaaggttttaattttattgggcctttgaaaatatactaatggtccatgaatgaataacaaaaaattattgggttgatttgcatgagttaagactggctggcagtagacgctgaaattgaatctatgattgtagaaaatttggttgtatatttacgttttgattttataataagaatgcaactgtaatgttaggcaagccaactacgtcatagatgacgccatggtctcgtagctttttcaaagagcttcatagcctgcgccaactgtcacaatgcacacaaatctatagtcaatcattgagtggacactttctctcggtgggttggtgtagagtggtaagacactcccttttctcttttccactcccacaaatttttttttagcttcgcacatactttaatactttttgggaataatattgagaaatagctttgaagtatcaccaaccacggcttgtaggatggatggtaattagtatgtcgccgtattacaatctaataacttacatgtatgaattgtatatgccaaaagtgatagtatattttaaacctcattaacgatggcagtaaataaattaacgaatgtaacatttgtactatatatcaatcttatttattaatttttcattcataaaaacaaaattcagaacaaaatacaattgattcaataatatccatgaacttctcgacaccacaacgcatgcaatcatcacataaacttacataaacaataaaccatttttcatatacttttgaaagatactaaaaattgctatataaatggtaagagcgttaggaagcaagtggtagtggaaatcacaacaacaaacaacagtgaaagataaattcagcataacaaaacaaa

SEQ ID NO: 3846 - DNA, 841 bp, Arabidopsis thaliana
tgggattttactttgctttgctgctacgaagttttttgggggcagcttaagccggagactcacctcttttgttaaaagctactttgcaaaattttgacaaaaaaaaaagggttcattgttttgttgtgcattgaggacagtttcatttactctttataaaaactctgcttcaaaaatgtgattttttgccctctctacaattggttgttgctttgacagttgcaattacttcaatggtatacagtagccttaaatcgccatattacgaatcttaaggtaaattcgttgcttctttttgtcaccaaacataagagacattggcaaatgttggtaaaaagaaataacgttgtgaatgtaatacactcaaaccaaatgattctgtcaatacaaaagcaactctgtaaacgtaacatgagaaactcaacaattcacatatgttttacaaaatctactttctgtggtattcctgaccaaagcatcaaacttgggctcgtattcaggagttattttgtccacgtacttggggatctaaatgcctgcagtaataagagattccaactttggtacttcaacacgtttcttctctcaatcctcctcacaacttcagtagtaaaaaagacaatcactttgaagggaaacacaaatgaaatgactgtcgaattcagtcaccggtaaacacccttatatgttctgttattttctttttagtcccatactttttttaaattcacaacaaaacccattattggagttttctgattatttttaaaaacagtttcgagtgaataaaaaagctcagatgcaatcatcactttcattttcttgtggtgtcaagtcaacg

SEQ ID NO: 3847 - DNA, 2000 bp, Arabidopsis thaliana
ctccacgtggagagtatacacaaaaagctacgaggacaaatgctcaaacaaaaagacataagaaggggagctcagaagctcaacccgagtagcagcatccaaagttgctaaaacagaaccatcatttacttctgaggcggtcttcgtaccaagctccttcagcaaaattgtgattctatgtttggatatcatgagatctaactacaaagtttttaataacaaaaacttaccattctctaatttgtagtcaaagctaaacaaatttcatactaaaacaattttactgtgttgttatggatgcatatttttctcactttatagtactattttactattgataagatgaaaaaaaagttgaggtacaatagtagtaaaatagcatcattctttttctgtagaatctctctggtcaatggtctttttagtttaaaaactgaataatgttctctctcacacagtaaaaaacaaagagagagagaaagaagagaagaagacaaaaatgtaggcattaaaaagaagaaaaagacaaagagaaaagtaatgaaaagacaatgaacatttaaagaagacagacaaatcccacacccaagcctcagcctcatctcttttattgttatttgtttttctaacaaaacaacaaaaacaaaagagatggtttttgggttttgttttgtctttgttagggcgtgtttggacgtttccttcttctcagaatcaatattttaccaaaacagctttctttttttctctttaacaatttttttgatgtagaaatatatagtcatgattccaaatccacctcatgccatgacaaaaacccataaaagtggaggttccaatctcgaatacagacatatatgttgtattcgtgtatgtatctattataagataattccaatttgtataatgccaaatgggttcattgaacttcttcttccttcataattaagtgttgctttttcttcttagttcctctaaatcaagaaaattctaggtgaaacttctcttatcttgactttatataaaataataactataaaaataatcaataagactaattcctacaagtcttacaaatttaaaagaaaatgaaaatgcaacattagctaatacacataatagtataagattgatggatgtattcttattcagttttatttataaatgcaacataagctaatacactctcattcagttttatttattaatgttacaccactttaagagcactcaaaatcaaaatacgtattcttatatgatattcattcatgtagtactagtacacataatagtataagatagatggatgggattggaaaatttgacaaccttttgtttaataattccttaaaaccaaggaaagaagaaagaggaaacgaaaaaaacaaaaaggaagaagacaaaaccgactatcacgcattgtctggtacgtagagccaaaaggaacaatgcctctgttttagtgttttctttcttaaagttttttcccaaaacacaaacaacatttcacacacacgctattactcacaagataaccaccagagacgtggatagagagataaagattgagagaaccctctcactcccaaaaaaaaagctttagacattttctctaaatccatgtaagtttttttctttggttattgttgtttgttatcttctttgatcatttgctattattttgttttgtttctttcttagtttatcaaattaggaaagttttaattcagctctctgtttgtgtttcttcgtctatatctatttcaaatagtttaactagattcaaaggtttttaaaattcagtactttctctgcaaaccctagttcctctgttctttaacccccttttttgttaaactgcagattctctgcatctttcaagaaattccgaatcgtgggtttggttcttctcgttacgagtctctcaaagtttaaatctttctttacaaaaaaggttacttttggttctgagtaaatcaaaatcaagcttttggccttca

SEQ ID NO: 3848 - DNA, 2000 bp, Arabidopsis thaliana
gaaaacacgagaacggacctagaaacatcgacatccaattcgtccgggagttttgctttcggtgttggcttcttgagcgattgcggcggctctggccgagttctcttagtgcctcttctggtagacgacattgcagacgaaacttagagagtgtgagattcgatgaagcgaaatcaatagctctggcgagtggcgattatctgctctctctcgctcgtgtgatttggatttgaatttgaattttgaaattctgtttgtttgttagaagacttcacacttcacaataatatatagcccacttacgtattgtggatgccgtcgtagctgatcacgtactctcactattttcgttttcttttttgatttttttttcttctttaagttatggctaacataattactattataaaaataaaaaattattctatgcatataattcttcaaattgtgggtaacaaaagtcactgttacttctatttacatcaatttttaacccaaatgaaatatgagacttgatacatcatgggcctctatttttttgtcaaaacatcattgggcctcatggcttaaaaatgcgtatgaaaacttccttcaactcaaacccaaattaactcaaattattgcatgtcgatctcattgttatcttgagattgatcattgaagtatagaaagttagaaactttcacccctaggcctagtttatggtttactctagcgtatatctgtcttacctcttctctcaaagcttaaggccattgtgtttacgtttatgtatatcttcacgctttatttttatttttttggtttaggttaataccaatcctaaaaactaaatacatatcaccgtaccatttaacgttttatcaaagttctgtggttcaacactctaaatattacatgtgacgctataccatacgtttgcgaagcttggaatttttcaaaaagtatttgatctcacatagctttattcagaacctccaaaagaattgcacttataatctccaaggcattgtatagtttaggaaatgaaatcttatgcatgacgtgaaacgatgaaagtataaatcttttttgtaaaacactagaccaaaagagtttccactattaattaacatcaatttttaatagttattttcctgatttaagaataattacacgggcattgttttaccagtttcattaaaatctagttgactttttaacgtattttatcttatcctgatctaagaataattttataggcaccgttttgctaatttaatcaaattggaaacccaaataaatagaaacagaagtgtggatattaattgaacttttaaatgtgttgtaatgtgttgaagccgcaccaggcgcatcttgttgccatgcccatgttaaggaccacaaaacatggaacatgaatgaaaactcatgcactaatactatctatatcccagatatttgcattgaaagttacactgtaaatttacatattgtccaatagaatttgtaaaattatatctatatttttttttactaactctcattaaattcacaaactataagaaattcacatatacatgactataattttctcataaaactttcaaatcataacattaatttgttgaatattaacatatatatgactaaacactgtattgaattcagctgtgatgcattcgttaattattatcttttcatcagaaaaaataaacttcaggtaggttgacgaagttttcatttattctattaaaaaaacccgggaagtgactgtactacaaatcaatatcgagtttcttgcttcaagtattcaaacctgttaggagatctaaatctaaatctttaacgggactacatcgatcggaaacttctcgccagttgtgtacatgtgctgtgtatgcctctactctctagtatctatatgaagtataaaaaattgtagcccgatatctcctataaatacacccaagtcacatcaacccaaagtcacacacacaaagaaaaacaaaagaacaaag

SEQ ID NO: 3849 - DNA, 2000 bp, Arabidopsis thaliana
agataaattaaatgagatttgtatggttttttaatttgtgtgcaaaaattttaaactacaaatatttagaaacagagggagtatgatttatgcatatgtacacacagacatatagattacatattttaaattatttaacaaaatttcaagagatgtggattcgaaagaagaaaaaaaagacaatattattgttgttagtcttaaaagtggcatcaacgtcatagagggacagagggttgtggttgaagtttactagcgagtagcaaccaagtgggatatgataccagactgttataccatcgttttcctttgattctgattacttaacaaaatttatttttagttcatttaagaatttacctaagaaatcttgaatgactcttttaataggaacaaaaaactagcgcaggaagtaaaaattaaaagagctgttgttcagtctgaataaaaggtagaatttatgtagtcaagacttttgccttggccaataatcaccacatgaaattctcatattagttttgtatgctaattccccagaaagggtcttcattccattaatagtttgctaattcctcagaaagtaaaccggtggttgctactttactacttatgtaattccatattttaggattagttacagatttgctataaaacactaggttctacaaaactctctcatacttagtgcatcttgcttgcaaaaattagggatgggcacaggacaagtatttgctacttgacccattttgtaagggtaaaattagtattcgtatttgacttgtgagaaacgagtatcttcaatttcaaatatttgctaaaaatattttactttacttgctttgttctattacgtgttttttgtaaaactatttgcaaattaattgtaagtatcaaagttatgttacttattattccctttgtttcaatataaatgtaatttaaaggtttttatattttttcacaataactgttgttttcaactttgtgtataaataataaatatattcaatactttttaaccaactatacttaattatatattttttattggttgaattggttataataaatgatgtttttatataaaagagatatattaaatgaatttttaaaaactttcttaatatgtgtgtaaaaaccttaaactacaactaatatgaaatagaatgagtattagttatcttaataatgatgagtgtttatgttttcaaggtggataaaggaaaattaccaagtatttgtgcccatcttttattttatatacatttttggatccacaagactcgatgtatagtcaatccatactacgcaagataacgcgatttagtagaatcaaactccggtcagaaaagggtaatcaaattgacttaactacttacatatcttcaatgcccatccttaggttaagatttatgggtgatttaagaagaaaactatatcacttttaccaatcctattcatatggtgcaactaattgcatgaaatttattttctcatattgattgccaaaattagtctcaaatctggatattatagaccaaaatcaactagtatgtagcttatactagtttatataaataaaaatgatgggtaaaaagaagtagaaaattatatttttatattccactaaaagggtacaatttgctacagagtgaggtaaatctatattccagtaaacttttttcataacatgaaaaacaatctccagtttagaaagataagaaaagtccattatctatttcacttcattcctctattatactttaaccaaatcattaattttgttttcttgtcattcattcatccgatactatccattcacaccaatagacacacacttgcatacttgaatcattatagtgtgaacaaataaaataaaaacattattaagacttcaagtcacgtttcccccaattaagaagcctcctcctctttcctttctctctttgtctctctgtctctttctctttctctctctctcagaaactctttctccaata

SEQ ID NO: 3850 - DNA, 1969 bp, Arabidopsis thaliana
aagtagaattcggtacaagagaagagaaaagagaaagcctagaatcgtgagatccacaactcttagaaaatagtttttgtatgagatcttctcgcaaagaggagggagagaagaacttgaatctgccatgggaggagatttcttgtgagctttcttgcggtttttggatatgtttatatagggttaagtaaaataatgcgtcgtcacgtctatgaatgcttgtatatataaaatataggaccgattggccacacaaaatcgtataagttttttagcaagtagaaaaaacggtaagagatacaaaaatagtttaaaaacgatataaagtagcggtacgaaagaaaaaaaaatcataaaacttaaaatatcgtttttagtagcatcctttgattgattattatcaaagcaatatactccatactacagcggtattggataccaatcaacccataatgtgtagtagtgtttagttaggaagaaaaaaaaagatacacaagagaaaggacaataataaattagtcatagtcaaattccattggactagtttgtcaaatagatacatgacttcacaaatggtgtatgtactacatattatttttttgtaaaacgtattgtatgtctagattatacattgtggtaaataaatatagatttgtagaatggaggccaaaatatacacagaaattggaatttgaacttatagatgtttagcactagactgatactatatattaagttacaccctatcaaaactttttcaacgaaaataagtctcattaaattcgatcgtttctctaaacattattaatgatccactaagctacatatatacatttttgcatgatgtgtctcgctgtatgtatatctttgtctatttgtggtggctattttgtggtttggttcaaattaggataacgataaagtttgtctttttattccgtttgctcttgtggtgaatgatgagtagtcgtcacgcaaattaaagtcacgtacgtaacatttttttgttgttgttgaagaacgtttctttatcattgttatacaacaaaaatttaaaattattatagaaagcgaaatcaataacttgcctttatttcctcgcatcgccattttgggaattgaaaagaaacgtgatgaactctttcatttatcccaattgagatgtggctatatatgccctttgatacatgcactataccttttaaattcaaattcatggaactaatcatatgtatataaagttaatacgtatcacatatgacatctcttggtagatattttgtgattgatttttgttccgatatcacttatctagatattggcttcgtaagccctatatatctcttattttcaaaaacttaacgtccatatatatacacataatacagtactgtgtatgtgtatatatatggacgttaagtttgggttttgaagtcaactagttgactttaaaacccaaaatactatagaaaggacgaaatcattgagtcattttcatgaaatcgagaaaccacgaatcttacaaaaacaaaatcaagctggtcctgtcatggttacaaaatccacaaaaaaaataatttcttatattgatataagctaataattgggagaaaagagacaacgccgtagcagaggcgatgctggctttttggatattaccaaactactatttacgtattatcgtcgtcgcaaatacaaatacaaatacaaaaaaggacttgattatttgggcctaatggcccatatatttttaaaaatataccgggcccagattcacactcacagatacgtcgtcgtttttgtgtcgtttggggttgactctgaagaatttctttcctcacaagacacaaaaacaatgttaagtacactagtgtcatcctcatccagattcttctcttcttcaatcggaaaaacttcttcgctctatagatcctcgattccttcgttttctcgcttatcagtgcgatca

SEQ ID NO: 3851 - DNA, 406 bp, Arabidopsis thaliana
ttttaaaaaggaaggaaccggtgttttatttttcttgatttgtatctttgttgcttgtagagtacgtaaagaaaccttcttatacagaaacaaccgtcttatagtgttgagaaacctctctcgacgttcaaaatattgagttgtatacacagagaaaaatttgtgtagttctccaaatataaatcaaacagtaaaactatgttacttcaattaattagatgttcttcgatcattcgtgggagataggccatggcccattttaaaatcaggcccgtttaaagcgtaattagaatgaaacaaaaagacaaatataattcaaaagataaggtgacgtggcgaaaatcggaaattttgcgatatttctcactctctcgtcttcttcgtctgagctatcaaactccagtca

SEQ ID NO: 3852 - DNA, 714 bp, Arabidopsis thaliana
tatcatttttctttttctttttgggtaaatgatcatatatataagtcgattgttgttatttggtgtgagtttgaatgtgatccgtgtgcgtatcaaattttggatgggaaatttgaaacagtaaaaatttgtatattcctcgtttgggaaaaatgtatgttttggttagttatatgcaaaaatgttgttgaagaagtttatacataaaaagttaaatacaaaaagatggtaagaaaacaattgcaatttcatgtttagaggactctcctatagtttaaggtgagaaaaaaatcactagatttgattgataatatgaaagtcagtgattttgcgttttaaaacgtgattctgcatgtaaaatcgtaaggaaaggttagttgtgtctttcgtaaacatgattctacaagaaaagcattttaataaacaaattaaagaatcataaatttcatttagctttttttcattaaaccaagttccacatacaaatacaacttgccaaccataaagtgaaaggagttttatttagctagcctaaaacccattttctcattttgcataatgtgaaatagagtgggatcttaaacagagtcgtctcttgagaacgtggtctcgtatggtaggctctcaattttgacaagacataataatcatcgatctctccactataaaatcaaatttactttacacgacaaagagaaaaagagagagagaaag

SEQ ID NO: 3853 - DNA, 2000 bp, Arabidopsis thaliana
aatatattgtagaactttctcaccaaaatcttattttcgaatgttttggctttcttaacaatgttacccgaaccacattagtggaataaatgcccggtatgtgataatttcattataataagtaatatggtagggtaatgagtgcggattgcccgaatggttataaatttataatgttaacataaaggaaccgtagagtttggatatctttggcttgaggtacattgcattggacacgcatagtattgagcaatgatggcctggacgttcgagtattttggtcgggtttagactcggtttttacggatttagaaatctaaaacccattcaggtatatttagactttgggttcgagttgggttcggattaagtttttcggattcggattcgagtaattcgctcatgctaaagcaatgttatagattgctcatttggttgccttaaatatctctcattttaggtgaaaatatctcaaaattaattaatagtcaatagagcgggaaataccagtgataactgataagagtatctgatcctcatgttttacattttacttttgaaagcttatttcacgaattacattttaatgtgcttgcacggttacgtatactttttgaaagattgatgtagcagaccatctcttaacgctaataatgtgggaaatcctactttgattttcgtaaaattatcgagtttctacgtatcaaatcgtgacaagtcgattgttaatagttaaaatttatctccaacgggtaaaaatcatcccataattaaaataccaaccatatcttgatcatttgttcgtaaaatgatagataaaaaattgtaaataaaaaaaatcatttctcgcactgtatttaacaaatagcatgggatatataggtttgtgtttcaaacaaattatatgttatttaagccaattatattaaaatttacatgatatcatgctatgtttaaaacataaccttaattattgatgatgttatcaccacaccacatttgtttaggagatatgttgcaaaatggtaacatttttccaacatatttataaagctaataatattactatttacatttgcaaaataggtgatggacccaaatttttttttttcacttttcctctagtttaattattaaaatatttattagtatatttttcttaaaaaatcttttactacacaaaaaacccatatttttctctataatttgatatgcattttgtttaataaattcatttttttttgtacatctcattaattatacaaatatatacatttacattcgtataactcatttactgtacatataaataaaatatgtatatttattcatacaaatacttaatatgttgtacaaatcttagtatacataataaatataataaatagtgaaaaatgtttattttacaaattataaatagtaatgttattaatttcataattatgttcccaaagttgattatatttccaacaaaccctttttaaaccttaaaataagttttttttgttaaattattatttttcgaattggtatcatcatttataaacaagttgtagtattttaaaactgaatcgtaaaattggtgtcataaagctcgcaatccactcaaaattgggcttctcccatataataaagggaagataaaatgacacgtttcgactcctaactccaccattgccggaaccgaggagacactctatagtaactcccaaatgataagcttcaagtttaaaaactagtcatcaaaatggttatttctcagtttagtctttacacgaacgaaacatttttttaccataagaaaacaacaaataattcttaaaaatccaagaacataaaaattgaaataaaccaaacaaaattgtagtggatgtgacattctagaagcatgttccacttccctcctttgtcttccaccatctcactcttcacaaaaaaaaaaaaacaaagctgaaaaataagtgagaacatcaaataccaaaaatacccccagttcccac

SEQ ID NO: 3854 - DNA, 2000 bp, Arabidopsis thaliana
aatttttcgattccccaaattcactacagtttctcgattccatcaatttccttacagttttcgagtccccaaattcgctacagttctttgaatccccaaatttcaagaaagtattctttaaccctgaatcttgctacaaaaatgagaatataattgttttgtttaccttgatgttcttgggtaattgcatgtactaatgattttgtgcaggatatactacgattggaagttgttgagccatggaaacgaggttcgggagattctctgtctcttaaaaataaattttatggcttttcccttaaaaataaatgtcatttttttgttgaatcgaaataagttttaaggcttgaaaaagaactatttacaaaaatagaaaattaatgagtggaatatctaaactatgaagactcattttttttatcctatgtctctgtaatatatgtttgtttttagtttttgctaaatttatgtttaagtggttggttaaattgtcttttatatatatatgagaaacagtaaaaaaaacttttggttatctataataacaataccaaaagcaaaactcgagaatacatataaaagaaatatagacttttgaaaacaaagctaagaaaaagatttataaatttaaaaccagaaatttcttaccaatagtaaccatttggtttcttaaaaattattggcttgaataaaatattttgaatactcacatctcttttaggtcggatatttgggatataaatcctataattgatttaggttaaaatgaaaaaaaagaaagaaacagactctactcaacaagtgtgtttttaagcaactccaatagagagttctctcaagaaatagtgggggattatgttgttaaaattaccaagaaataattgaaaatatcaatggatatgcccagaaaatgtgaaaatcagatttttactattgataattcaatattaggtaagtatgaaagagagaaaaattaaagtcataactgtccttcctactttttttaatttaccaaatatgccatgtatcaactattgttataatttcactatatatcaaatattttactatatttatataaatattattcagatatttaatatgttagcacgttatattcagtataacatgttattataattttatattgattatttcatattaattgatatgatacggtaaatggtttaatataatatatataaatttatcgtgatactatactagttaacatgttaatcaaatatttatttgtatttagcgcgatattatactaattaacatattaatcaaatagttatctacataaatgataaatattttatgcaatccaataataaataatgttgtaaattttggatgaatagtatcgtcaggtatatgataaattgtatcatgcctacaatattcataatcaataatgttgtaagacaatgacatatttgataaattaaataaaatagaaagaatatgataaccatatcataaatagttatctacataaatcataaatgttttatacaatctaatgataaatagtgttgtaaattttggatgaatagtgtcgtcaggtatatgatgaacaatatcatacctacaatatcgggtaataaataatattatgagacaatatcatatttgataaattaaatagaatagaaagaatattaaatggttttagtttttttctctttcatagttacctaatattaaacaatctatagtaaatatctatttttcaagtcttttagccatatgcattaatatagccaaaaataattctaaactaaaaatatgtatcgcgttttacaattgcgctgcaaaattacaaatctgccattgtcggtggatcttcactccaactcactcaagcttcaatcactcgactcgggccaagcaaattcactgatggatacacaaatcctccagggtaactagaggtgggtcatcagatctctagggtcttctcattcttcattcccagatccgtagaatagaaa

SEQ ID NO: 3855 - DNA, 2000 bp, Arabidopsis thaliana
gatatatctcacaaatattaactatataatcaagataaattcgaataacaatggtaaactattagaagttaattcaagagaatgaataaaataatataagtaggagatttgagttggaaagaaggatcaagtcacatgctccaaatttacaaagcaaagaaatgccatcatctcccccaactcctccctttgattctctctttatcttttctttttatcttcaattattaatgtttttaataataaaaaaccatatatataaacataaaattagttatttatctgaaaagaacattctcaatacatcattactcattttattcggatattttggtctcatgccttcattctcaagtttcgcatacatccataaactctataaaatgttgccaagaaaataaacacaatgtgtataattgtactcaatctttcaaatcgaattaagataaaatacaacttcagtcaacaaaatttttttagtcaaaatgtacgtgtgtaattataatgttggctactcaatttaaaatcaaattaagttggtgaaacaaaaaaaaagtggttatgggccgaaatgattaccggccttgaatatgagtccactggacgtaattttgatattaagtatttgggtctcttatctcttaaatgagtcgcatatgggccagttgttgagcattatccatggaaatcaaaaagttgcatggaaacagagactttaacaaaaaaaagcttcttccggagattcatacacataaatctctatcttcatatctagtgtgaatccagctattggaaatctttggatgtttgatcaagtgttgaatttctctgtttggatgttgtacatcttcttaattagttacatgcttaatcttcttcttgtttttttttttttgaataccagaacattctgaaccaaagccgtaatttccgaagacccaaaagtacaacatgtaacgcgacctctaagctttgcctagaatatttaccaattaaaataataatatttggttaatcttcgtcttgttagctcatacgtcagacaatgaaaacaaaaggtaattgatgttttcattacttgaggattagatattggtcaagcttagttgtggctatgggttaaagactaagatctcattagtaaaagtggtattgagcttgccttctcaatgctatgacaaatactgtatattttatcaatagtacaatgtaaaggataaggagaagaagtgggctttgattttgtttttgtcttcttcttcttcttcccccaaatctctttaccctacaaataaccaaaaataatctcttcaccaaaaatattatattaaagtgtcatttttaggattttctaagaagaaaaaaaaaacagggaagatctttttaagcttctctttcctctctcttctatctttctttctctttctcaatctctctcaggtttctctctcctctctccaggaggtcaaaaaattctttaaagagccgtttagaccaaacccatgtaagagatttctctctcatcaatctatgtctctttctctctctttcgaaaattatcatttgcgtcctctttttgtactgtttactttgtctttcccatttctagcgatcttctcatcgaagcttatgactaataaaactcgagatctgaaacatttctctctcaaaaaaaaaatcgaaactttatgctctgtttcttcagatctggttctgggtttctcagatctagagctctgcaatatgggtctcaaacaaaaattgaattctgattacaaaaaccctaattttcgtttctgggtacctcaaagatctgtgctttcgttagaaaatggatagattttatgttaatttcatggaaatttcgatgaattcgaggtttagaatcagattcaaccacaaagttataaacttttacaattgtgttctgttattgttttggatcaaattgtgtttagatttgactttgaatggcattgtttgtagttttataatcatca

SEQ ID NO: 3856 - DNA, 1139 bp, Arabidopsis thaliana
ctccctcctccgacgatcgtcgtcgccgcttcatgagaataaaattactataacctaaatttctccgatcttgtgagatgtcagaaattgaaattagatgacaaacgcgaaatgaaatgcttcttctctcctttgtgtcaaatggtttgaatctcgaggagtttttttttctttcgaaattcagaagaagaaaaaaaaatcacgagacggaaaaaaaaaaaaaagaggtggtaacggtgagagatgggaaaataagttaattaaccgtcaaagtgtcttcttcttcttctatttattgttttcccaagaaactcattctattgcttacacaatttatttcctaattcagaaagcttcaattttcctaacttgtttcattatatatatcattaaatgtcaaagattattctataaccaaaaaaaaaaaaaaataggtttcaaggataatgattgatcagaaaaacatatgataaataaagatttcaagaatattcaacattgaaaaacatataaagaaagatgacacattttgcctttttgatagtcgttgtcattcgtcaacggattcacctaattgttctcccgtactttttttattactgtcatctatttattgcactaatcacgattcaaaccactgtttatattcatctcctttattcagatattttcaagctgttgtaaaacaaaacaaaaactgaaacgaaatcatgacacgtacctcaatgttgcattattaacatcccttccaaggaaagattactattttattctttactaaaaactcgagtacaattgtcttttcaacaaaatttcccaattaagtttaaaattaacattaccaagtcatatgtagttatgcttgaattataaaatctggatgtgttatttgtttctttatttacttctaacttactttagtgtgatccactacaagtatataggtccaacattattaatgggccttaattttaaagcccaattccagagggtagtactccacgtgttttaacgaatgaaatactaacacgtggcaatgcacgtgttgactttcttttgtttccttccttccgtttaacaagaaaaatagctaaactttgaaatccgtcagatcgatttctctctatatcggagccgtc

SEQ ID NO: 3857 - DNA, 2000 bp, Arabidopsis thaliana
tgtgtgtatctttccaataaaatgcaattctataatgactgccaaaatcagtacttcatattatttttgaggaaatatcgtatatgtgtatctttttctaacaaaagtttttttattcaatatagaaaaaaatgagtatatttacaatttacatatcataagattaaagttgcaaagaaataaagagaagatgcaaatgaaaataatggaagaaaagaggggacagagaggaggcggaggcagtaagaaaataagaaagtgaggaaattgtaatttgtagtgttgttagggaacatctctcctttatcctttttctcttgattttttttttgtttcttcaatatttctctaaaactcaattggttccaactaattagtacattttttccaaactgaaatatcgaaacctgaattaagcgagggaaccaagccggtttcaactctagtgcgtatatgtctctaattgcttacatggttcaatccaaaccaagctacactatgcttgcacgttgtgttattttgtgaaggatgaaattataataacgaagtttgatgaattgaaatgaaattagtttcgtcacgaagcacacatccattaaaatttgattcttatattatattttcaatgaaattatataattttaccataaggcacgcatccattgtacaatgtacatgttgtggttgagggagtccacgtggaaacaaaaatgccacgtgggtaatgacaagaaatatagtcgttggtcgttgtgtcgtgagtgtgtgtgtttcctttttctcgtgcttgcaaatatgagaaatgtgacgtctccttaagttccatagacaaaggaactctcattaggtcctctctttaaggtgaaccattcattactcatgccccctctcttccttcgcttttttttttcttttcaattttcaaattttctctatttatttagttattattacgtctaacaacttctctttcgcaaatatattacgtatgatttacatcattatataggcactttttaccggtttggaatagtccgttttagaccgattatggcagcgctgatacaacttgtttagtagttgactaatttttttttatgtctaagcttcgaataaacgtaattgtaaagaaacaaaaatgagatttatcttctttttacatgaaataaaatcggtctaagacttacttattgggggttttgattattcaaatcatctggtggaactaaatcgcattgttttatggttaataatgacttggacttgaatcatcgtaggctcaaacatttgtcatgcttgcatacatatgatgggtccacaactccacatcgtaactttcgtcataacttttgttaaacagaagtaaagaactatacctaattaacttaagaaagaagtgttaatccgattactaagcaagcatttacccaaacactttccgaaaataatttgtttgattaaagtgttaattgtatcgaggtcatatgaaaacacattaattttggaaatgtgggaagtaatgtagttccacaaacgcctcaatgcgcgtcacgataacctttcatgcattgaacacgattaagaagatgtaatttctcaatattaactttaatactacttcatatcatcaaaacagctaaatgtatatatttattttttggggttagatatcaaacattaactagcgagaaaccgaacccacaaaatcataaccaacactttgatcgaatcatcgtttgacacgtgttttggtctgctacactaacaacatttttagcggacgctgtctcatcattccaccgtcgctttttatttgtgtgaactttgaacaaaaatacgaattaagaccatatcaaatttaaaataaaataaaaacaagtcctagttttatcttctatataaacacacacgtacaaaccaagcatggcggctcattactcatttgtcttaacctaaaattattataaaaaggatagagagagagagagagagctagagat

SEQ ID NO: 3858 - DNA, 2000 bp, Arabidopsis thaliana
ctgttctcatgagagtagtttcgcttattcaaactgctaccaaatattatctagtagccttttctaattggtatacaaatacaaattacacgatgtgatagacactttattgtttgtgcatactacctttagagtaggcactagccaatcatgataaaaatggcaaatctaaaaaatattaagcaacatggtaaatataaaagatttaggtgacaaaactgaaaacagaagaaaaaacttacgttttaacaagtgttattaaatgctggttttggactaaaagaggatatgggtttaatgaaaaaacttaatttttaggaaaaaaaaaaaggtggaatttgagtagaatacaacaaaaagtcttagagtttgattggtaacacaaaactttagctgttacggaataatgtaaaactgtacaaaagagctgtaaaaaaaaattgtatcaaaaagctgagagtaaagcttttcgtaacgcttttgataaagtttttgtaaatggtaattgtcaaagctgtacaaactgtactgttttgataatgggttaccattcaaagctttaaattttaaatcgcatgataacctgtaaataattattttgaatatatgttagactttattattattggttaactatgttctcttgattgaaaaaaaaatagatttgtaactcattgctgttttttttttttaagaaacaaatagagaactatataaaaatataagaaaacgttggttttgtccaagaaaaaaattgttgggttttggtgggtggcaatagaagatgccatgtacatagtgggaacaagtagccttacgcccataacatgtcggaacatcaccaataaatttctatgttcaaaaatatcattgtaacaaaaagtttttcgaatttcttctcccaacccaccataaaaacccaatcaaatgcatgtgaatgttcttgttcatttgatgaggtcaagatcaagaagccatgtaatctagaatacaacagtacacatgtgacttgttacagttttgaactctcgttcacagttttgcaagttcttaccaaagctatagatgcctctcatcccatgagccttcatcacctgatgggcttattaggtttacaggcttgactaaactctagagcctatacgtatagaagaggcctgactaaacgaagataatgaaataagcccacaaggcccaaataattaatatcttttattctttttggcaaaatgaaaaatctgacttatgggctttttaacatttacacatttaacttcatgacccaatgaagacccgacccgtctggtaatgacccgatccaacacatgagtaaaccttcactgaaacctcgaaactcctccagaagcctaaaaccttcaccaccaaatcggtgcctccttgaatagtcgccgccgtcgtctatcatcgccgcttgtgactccggtgagtattcttctgctctattgagtttattttggttgaagctctatgagatgtacgtgggtctggttttcatttctgtttcttaatcgctcgaattagcatttgatagctactgagattttgagttttctgatctgccgaataatcttcgccattgtagtgtagatgttgtgtgccttttgattagattacactgagaaattggattgttttcgtgtttgtagatgagaagctaggttattgaatcagagattatggctgcttcaatttcaagaaggatttttcgcacttttggatccttttcagctctaggacgttcctcttcaccaagtattatctcattttccaagcttcttataaaatatgtttgtttcctggatctctgattgtttctctcaacagatttgtctgcgaatacatctggaaatggtttagcttctcttactaatgatctaaaggttggtgtgtttagttaatgtcactttctcctttccttcatctgcatattattgagttctacttactactacttgagtggtcatcttcctgattttgag

SEQ ID NO: 3859 - DNA, 2000 bp, Arabidopsis thaliana
caactaatgatgcataatactacactattataaatttataatatagcaaagtttttctatagtcatgcttttaccgtttttgttacttacatacttcttgtagaaaacatctatttgccattcaactgcttaacaaacgtgtaattttatctgaaaaagacgcccacgtttaatttcgttggatgacaatgactgtatacatgtatacactattttaatctacgattggtttatataagtatacatatattgtatagtatatgcatggatagtcattgtagttataatatcgaaacggattcttttgctttaaaaaagacaaaaataattaaatatttggataggatgggttttggcttttagaaggccagatgccaaacatgccttcatcatttcgtctttcccattccaagtccctgcctcacaatgttggtctttttctgctttgatttttcgtacgtccaccttaaattattttcttggtaaaccatattaattatattactttatatcatagtataaactgtttatggtctatgccgttagggttcactttgatgcgaatctatgcaaatatgtataactgtataaggatcaccaagtagttctatcgtttttttgctaatcacttaccaaataacagaagttcactactgtaatatatgttgaattaaaaaacataaaagggtatcataagataaacaaattaaaatatgagataaaaaaacaaactaaacaaaacaaaactacagtggttggttttctacatgatatatccatatagaaataatttgccgccacatcaataaacgatcttcccacgagtcgtttcttcgtcagtccactatcacacacacgttgtcatttattctgagttgtatttaacacactttgagtttttgacctgacttttcgattttcttatatattcaaaacgaaattatactacaaaaagtagaagactattcacaacattgtcaacagaatttctcaaaataaactgttgtactcgtacgcgataatggatatatgatatatccaacgtttcaaagatatcatcaaaaatattagggtttgtttcaaaggaagaaacactttttgtcaacaaaggctcaaagctcgctcacatctgtacacatatgatgatatgatctagtatttgtatcatatatatgagcatgcatgtgtatgcactgatgcacataacacagactttagtagagtatcctagtatcttatgctcaaacaattgtgctccaagaaaagaataatgatatagtttttaaaacttggaaatttcacagaatctataacttaataagtatagcaaaatataaaaagaaacaaaaaaagccgaaaaaagaaaacatattgaaagggaaagatgatatgtcactacaacaagacacattaccctttattgtttgctttttactttgtctggtagaccaaaatctaggactaggagggatgggaaatgtaaattttagtcagtattaaatgtttggattgtgatatcgtctttacttatcgagcatgatttttgccaaatatatctcctatatatgaatggacacgatcaaattcaaagaaaccttttgattacatcgcatgttattaaaaaagcttagcaaatcctatttttattcgtttacgattttaaagtaaataatataaactcaatctactctacctttttcggatatttaaatgtaaatcacacatacacaacttactctattaaacaagagaaatacgatttatggattcaaggaattttgttgggaatttgttcaattttacggtatacaaaagaaccaaaccgaaaccaaaccgaattttaagatgtatactaaacgatgccgtttaatatataggaaaaaagcggtgtatagtcgtcgtttctcgtttaagctgattttagtttccgtcgccggctaaaaagctcattcgacgccgcctgagctttgagttttgacccgattctgacgtcttcttca

SEQ ID NO: 3860 - DNA, 2000 bp, Arabidopsis thaliana
tctcacctctattaggagattgaataattttcattttcaacatgtaccgatcttatcttggttttaagcctatgtaattacgaattaatatacgttcatttttttataatatttttttttgtataagcttgtgtatttcataagatccccaaaatgcaacgacgtggtttgatgtttcctagtttcttggaagtgactctactattttattggttatgaatattatacgttcgaaacccaaaaattttaatttacaatgacgtgttctttttctagggatcgtggaccgatccaaacagctggcgtgtctgaactgtccttaaaagcctatccaattttaaatccaaaacgttagaagattcccaaatcttttgaaagattcaaataattgaagtctgaagaggattccaatcaaaaagtccgatagaaacatttttggctacaagagttttttcccacctctaaagtcaatacttttgtgtcattttaatatatagttatttatgaaacaatctatctatataatttaccatcttaatttttatatatcgtacagttgcaaaatcattttaaaaagttttatgttgttaacatatctcaaaattagttatattcgcaaacactgtgtgtggggtgaatgtcctggtaatcaaatcggaacaaaacaaacgtattaaaacaaactttgagaaagctgaagaatcataagtcgcaagaaacaatggtctaaggatgattcttgaaattaggtctgattaccctcgggttaatacccactcaagagatttggaacaacaagtaatctcaatggtagaagcaagaaactctacgtgtcaatcttatatctagacgatcactgcctaagcaacccaattgtgtgattgactgatttcctccattaaaattttgttgatgaatgctaatcctcatttctggctaaagaaactactcaataatcagcttgtgtcgatctatatcaagtcagttacagcagaaacaaaaatgacacaaacccgccatcggatggcaaaaccaagttcttaaagaatctaatgatactaccttgatctcatccagtgactagaaaacaaccagactttaacctacaatatctcaggatctaggtctccctaaagagcttagaagagtaagtaatttcatgtaacacacttagctttagatatcaagttatatgacactatccttggtggattaatttaccaggatcaagacacttgcatgaactagcggatcaaagccttgggattgctcttaaacatgattggttcctgagaaatctgtgcataagattcgccatactcagattaaccctaaagcgaagcctacgacggtcgtgctcgtgtgttctctcgtaatcattgaggtttttgtggagtctgaatcttcaaaacgacgttttgtgtttttacgttataaacttctaaacgactacatttcaggttccattttggtgatgagaaattaaaaaaaggtgccctcacgcaggatcgaactacggaccttcagtttacaagactgacgctctaccactgagctataagggcaactttgctcagttatctgtgatgtgcaaaaaaattcaaaacctcaaagaacagacattttgggccatatatacaaaaggtaaaaaatatgggataaatgctaaaataagatagagaaatgttgcaaacaaaaagaccataaagtagcaaaaacaaacattttgggccaaactgataaagaaaaatagtttggggatacaaataagaaatactaaaatataaaaaagctgtggggaacgttgcaaaataaaattccccaaaaacacgcgcacgataatgattccctttactcttgttgcgtgcaatttccgctattatgcgcattcgtcatcactttcccattcctctccgatcagttcttctctctctcacactgcttttgcctccattgaacccttcttctctctgctcaccggaatatttctctcacaaaag

SEQ ID NO: 3861 - DNA, 2000 bp, Arabidopsis thaliana
cggaccacaatttttattcatactccatatatctcttaccctatcgtttagtgcctctaattgcaccatcatcgcttatccccaaaagaagattaacgtttcatgtcaccaatttgatccgacaaggtttaatcttaaagtagcatctttcacctcaagagcatgtttgatggaactatatacatatatatattgaaaatgtaaagttggtccgagaacgacaagcacttcagacaatgaaaatgtttaatggaatggaagaaattcgttttggtcgatgcagaaccaagcccggcccgcatggtaatgtctcgttcactatttgctttgacgaaaaaagttatgaatggtccaaacgaaatgattgctgtaacctgtaaatttggtaatgcgtaatcattcaatttatggtttgtgaacaaacaatgtatacatatagtattggttttaaatttcatgtactaataaggaaaagaaggagagaaacgatggaaatataaaaagaggctttttagggtttaagcctttaagagaataaagggacaaataacaataaggaagtgtcgttttctgtgtggaaggagaataatgaatagagtgtgggcattgtgtattgtgtcattctcctaattccaaattcattgcttcaaaactactcaagaatcatatttgcaagtagtggtgtttggctctacaacgttctctctttaccatgccatggaattattccttgaaacagaaaaaaagagaacaatcatcaatattccttttgttaaagatcttgatcattgggtctccgttagactctcactcaagtctcaccaatcagctaaaggtggaattttgataatcgtttttttaacgcttattaaaacccaagagagattcatgcatgttataatccttattcatataagttttcaatgtaatatgttttacacgtcactgaatttggtagaagtttgtttatgaactttgttgctcagctaacatagactgtgtttttccccccttacaatatctacccaatcaatgttttcttatactagtcaggacgttttttaaccaaaacgattgaactttcagacatatcactctcttttgtttttgtgcagatagatatatcactctctaatccatattagttctcttttactttattttattttatttaagaacaatttagttttttattcatctttattccatgtcctaagaatcgaagtgaatagttaacagtttgttttaatacaataatattagttgccgtcgtttcttctttaaatcactgttttctttggactttttacggacaaccaatagaaagtgcaaagaagcatattcaaaagttcaaaatccattcggacatgtccacgtgtgatctgccactctgtaaaaattccacgttagcatgacggacacgtggatatagttatgttctgcgcacaccacgagctaaccacacctaggcagcacgacctccgtcagaatactaacggccgttctcttccactcgcgtagttctcaagcaaaacactcacggcgttggaaacgtggaacgttgcgtcctagtccagtgtcaaaaaaacgggaccacatgagacaagctttgatctggacagagttctgagtgtgtcagaccttcaacggcacgtgcgtctcacacgcgtggaaaatataggaaagcaaatccatttggaacctcccaatgtgtcttgcagatttcatcttcctttttctttttcctttttaccatactcctcttaataacattggtcaaagatcagtatataattagttgtaattatatgaaaaagatattttaacatgggtttgcgtgatagagcgacacgtggataaactaacgaataggagaaaaggggtaataatgtaattttgtaacagcattcactttctgccagtagttccactgtcttgtcctttggttatataaacaagaacaacgcaactttgtctggtacttcagaagaagaaagaaa

SEQ ID NO: 3862 - DNA, 1470 bp, Arabidopsis thaliana
aaacgaatcacatttggtgtatttccaggtatgatcaaacttacttacttggtgcaagttgtgtatgtaaatatggtaatagctgagtgtacttgtctgctatttcgacgttgttattgtatttttgttttgaagatgaaccgtgagtctacaagcttttttacacaactcttttgttgcttttgtgttttgtctaagcatcttgtgaaaactagttgtgaaataaatggtgcgtgttatgacataagaagtattatgcttataatatttgatagatcattactttctttgattctttaaggttgatagatgctagcttttatatagaatatagtttttaaactgatttctgctttataaacgaagaacagacgttgaatctagaacatgaaaagctccccttaaatgtgaaccagatcagtggctaaattaatgtgtttaggaatgatttgctgtgtcggtttagttgtttgttttaacaactctattttaacatagaaaagctgtgtgtagtgctctgatctcgtgagcattcttgtgcgagactaagcttgttcttgtgagttgattcacgtagtggactgctgggacagaacatgacgataagggaatcacactccgcgattcttgttcttcttctgatctctcagatctcgaattcactctgtttactcgatagtttgttaggtgttcacacattgctagatagttgtagattgatgctaaattgctaatatcgaaacagtgaccctagggatgacttctagagcatcacttacccgtccttggcttaaaccagtctcaactacctctccctttgtaaataaacttttcaacatgtaaaatgtcatcttctgcgtgacggcgttgcagacaacaatgaccaccactataggtaagttttgctttagtgctattccatattgttgttctgacaataataacctagaatccttcatggtttgagctcatgttgggtcgtagtgagaatcaagaaatgaccaatctttttctcagcagtatgatatgaatatgaacataaactggataccacccattttgcgtcggtgattgcgtttaataagactttattttcaacgccctctcgctgaaaaattattagcaacgtcatacatcaaaagttgttaccaatgaatcattttagttggttactgtcggaattaaaccagaagagatgaagagaaaaaaagacaaaagcctttatgtcatccctctcacgtcgtctttggcggcttcaaagccttcatatgattctgaatcacacacaaaaaaaagaaaacaaaatcaatggtatgaatataataatttatccattccaataatttaatgaacctaaaatattcatttactccaagaaacagctgacttactagaaacagttgacttttcttcttcaccattcctataaacccaatcagaaacttcgcaaccaaatcttacagaatcacg

SEQ ID NO: 3863 - DNA, 2000 bp, Arabidopsis thaliana
ctttcagccgatttgatctttcgtttcttgtggtttgacttcacttgaagcaagctcttttattgatcttattgtctcctttatgttctgatgattccgcattgtgaaatcactagagattttggggttgtgatatgaataatctggggaattttggggtttggggattcgggttcttctccttatctatttggtttgcggttctgcaacaagctaatggactcagacccataagggagactgctcggtcctggggcgatgaggtttgtgttgttttgatatgatcgtttcaaattgttttcaatgttccttgattttgtgtatcagctaagtctttgattagtttgctgttcatgtgttcgttgacttgattaagttgcaatagtagaatttctgatagctcagaatctaggatgggaattagattatgcagttttcgtctctctatttgccgccgagttttcgatagaatgggaaggctgagactgttttgtgatcttgcagtggctctttggcaaaaaagaaaaaggtggagcaggaccgttttctgcgtggaatataacaggaacatatagaggtttcgtggcattgtattgttgattttctttctgcttcaatatcataaccttgaagctcatttccgtgatgtatttatgttacaggcacatggaagtttctagatactgtaaatagctcttcaaagtttccagatttcagaaaagaaagtggtaactctgtcattgagttagtgacaagtccaacaaaaattactggtgtgcattatgttcaggtgaatagtcgctcttcatagtcttttgcatcatggagatcgtgctttttgatcttagtaaaaactttgcaaaatcagaacttgtgttaactttgaatgtgaacagggtgcagttgttttccatgacgtatttgacaatgaacacaatgtgggtggtgcccaaattaaagttgaaggtgtatatatttggccctttagacagctccgtcttgttgctaacaggtataactacatttttttttaaaatctatttaactgctttcaagatccagtattggtagtgttctctaatgtctgtacgtttaatgattgatcagcggaaagaagagtgattcaggactagaagacgattatcttctctccaacccctatcatctggtaatgcctgatgtgatccactttgccacaagatgatggatcatatttctgattcttcgttatctttatttgatgcgttaaaatgtttggagagctgataagtgtcaacttttctgctgttggacagctcggtattttttcctcccaagtatttcaagaatctccaagagacagaatattgaaacagaaaacttgtgagtaggatctggatttgtttccatatgttttactcttctgctacatctgaccttcatttatgttgcattccagctccaatatatgagatggagaagcactgcaatatcgaaatagctgcccaaatatcccaaagcacttctagtgaaaacagtatgtatgccttctaacacttggcgttgaaatgatgatgctggctcagttcttgccttcttagctaattttagtctgactttgagaacgagttttacttattttggtagatggggacaaagatcgttatcaaattgaaggattgatggaaagtcctgcagtagatgatgaagtagattgtttttcgccattgtcgctgaatgcaacctccataaacgtcgaagtctactataacaaggctgtgaactatacattgatggtcacttttgtatcctttgttccaatctcttttccattccatcagaaaatgacaaacacatggcagttttagcggattccttaacttgttattgtacctaggtctcgttcctccaggttcttttattgatccggcaaatggagcacagtaacacacaatccgtaagattctcattgtttgtttatctgatctttctaagagaagagactggatgctaacttttgg

SEQ ID NO: 3864 - DNA, 2000 bp, Arabidopsis thaliana
aaggtctttgcagaaggaggatatgagaagatattccgacaaacctttgagacagatcccgaagaacagttgctaaattcttttgcatgttacttgtcaacatcagctggcccagttatgggagttctatatatatccagtgccaaacttgcttactgtagtgacaaccctctctcctataaaaacggtgatcaaaccgaatggagctattacaaggtaatgtgtcctacacctttcatttcagaattatagccattttgaagacaccatattattacttttgtgatcattaactgttcgaaatctgttggctggttatctggtcaatgcttgagacaatgtttcgttataatttgttagtagcatcaactaaggagccttcgtagagtgattcatttggatagaaaaataatctggacttgttaacggaatcataaatccatggactttttttttgtgatagtaataacatgattgcatcagcttctcatctcttgtttcatcgaaaccaatccgatacgattgcatttgcttattcattgtaataagctttgctacattgatgattgatgaacactttgtgtcttcttcttaaataggtagtaattccattacatcaacttaaagcagtgaatccatcagcgagcatagtcaatcctgcagagaagtacatacaggtgatttcggtagacaatcatgagttttggttcatgggttttttaaactacgacggcgctgtcacgtctctgcaagattctttgcaagccggtgctttaaggtcggtgtgatacataactggatgactgatgaccataaaagcatgttgatctccacctcttcttgcttagtcatatcagaagactcaaatttttacattattttgcatttaatctcaatatcctatttactacagaaactagctgaattttacaaatttactttaaaatgttttatcttttgatatttttatgagaagacagcttaattgcaatttattcaatagcagttgcttttagtttctatgttgaagaactctgaggtagtaggatcaacaaatgtgaattcaacacgtcccagggacaacggactattagaaccgattcaaattgcttccaccagtgacaactgaaaaatataccgaaccagtagatctaagaaacgaaatttactcgcacccatgtacgaaattgccgcacaacttttgatatttactaatttgccccaataaagttcaaaatacacaactcctttgacttctgcaaagcatcagctcgaaaagtatttttttttttgtgttaaagggtttatcagctcgaaaagtatttcattatcttttcatcgaatcagattcaacttacgaattataagagcatctgattaggatttattccaaagatcactaactaaattcgaaatttattcacagaagttctagtcactaattttgttgaagacgatttttacatatttagaggcgtgataaatattacagacaaaaaatgaagttagattttgtttcgtacttcttcgttaatctaaagagccaaagtactgtgatctaacactgtcgttgtgttttttttgttttgtaaatttggcaaaaactccctccaaaaaaaaacttagttgactgagaaaactaagcaaaaagatctccgatcggaatcttcttattcgccatggatgctctttctcaggcgatcagttccgggatctccgttccttacaagaacaattcttcttctctcgttccttctcacggactcacctccttaatcctccggaaatcgagatctccggtgaatccctcatcacgatctcgcgtctcggtgcgagcttcggagattcaacacagcaaaacctcagcttcatcgatcgatctcagcgatccagattggaaattaaagtatgagaaagatttcgagcaacgattcagcatacctcacatcactgatgtcttacctgatgctgaagccattcgttcaacgttttgtcttaag

SEQ ID NO: 3865 - DNA, 2000 bp, Arabidopsis thaliana
aatctcattattcatctttgaccgtgagctcatgaacggcaagaaataatctacgtactgatattgagttcttcctttgggaataatcaacttgtaaacttagcaataatagaatcgactttcttacacttaatggaatcgacttcctctttccgactaaaaggtatcagatcacggcctttgatcttcgctgaacgatttgagcaatgtagaactgagattttggtgaatcgacagcactttaactgatttaaagaacgcaaaaagggagatcgatggtccattaaacgctaaggagagaagacgatgagtttaggtttatagttgtatgttcacatgagggaagatgcgttttatgaactcgtaaatgagtttcttgacatatttacctgacatggcatcttaatttttaaaaatagatgggacaatttgatgcgctgatgtggcactctcttaaagtatttttgttttgctgatgctgatagctttagaagcctcaaataacatcttttattagtaaaagattagataaatatccgcactacgtgccggtttatgtgttactattttatataatattttttcatataaataaatttgaatgcattatttttgaaacataaatatgacttgtaattatttttaaaagttcagctatattaatgaataaaaaaaaccaatgatatgattatttatagacctaagatcctaatcttttcactatcatggatacatacaacaacaatatagaatatattgatacaatagcatgtaattatattacttgtgtggtttaaaacttgtctaacttgatattaaacaaaaaaaattttgttccaaccatatcatgatatgctagtaatttaattaaacactttagatttctctttccatatagctaaagagtctcatatttttaactttttggtatgtctaatgtctcaaaggttcattacacgaaaaaaacttgcatgtcattgttaccaatttaccattagacaaaaaaaaaaaatatatcatatttaattaaacactttagatttctctctttccatatagctaaagagtctcatattttcaactttttggtatgtctaatgtctcaaaagttcattacatgaaaagaacttgcatgtcattgttaccaatttaccattagacacaaaaataaaaaaagaaaatgtcatatgataagttgtaaaatagtgtttgatacttgagcatgattttgtattttttaaagttttaaaaaggtagttaaaagtgatattaatggaagatttaacacaatagaagacttttcattttccttcaattagttatgctaaattttttgttaaataatgtagaatgacatatttcattttcttgtgtgatgatgtgacaatcatatggagagagttggccaactttcatatatatgattatcatattatcagaaaaatataaatcaactaaaacaattaatttttaattgaccaaaatctaacaattgtattgattagtcacttcatgtaactcttaaatttcaccactctctaaaccactattagaatgatcacatatcttcaattcattttttgcctcttatatatcttctaaaataacatattctatcgaaattcatttcttttattaattggtaatagattgtcttgtggaaaggttgttaaagggtaatgacttaggttcgaggaacgtcaagcgcaccaataacctaccagacccataggaaagagattagggttgatgcgttgcagcaccagctgagtcccacggaacggattgttataatactatttattttgtttgcttattattttttcatatatactgaagatacataaaatatcaattcttttttttagttgataatttcataatttataacttttaaaggttatatatgcaaatttctcatagatagaaacaaatatctctctcagagaagtaaaaacaaaatttcgttctgtgtgaagcctcttcttcttcgatcaacc

SEQ ID NO: 3866 - DNA, 2000 bp, Arabidopsis thaliana
ggttttgtaattacaattggactaacagaagatataaaagtaattaatctatattatgatcggttaactaccgattaaattaaaagaatgataatgtgaggcgttaggtttataattatattgagccttaatggataaacactatggcctgtccaaaatataaaattacacctgaagattgtgattgctgcattgaaaatattaacaaagaaagtgctgataattgacaaatgattgttaatttagaataagaagtagtgtgtagttgtcatccggaattaaaactgaagagttggttttaaattttaattacagttggtttttggggccttattatgtcttttaatcagtagtttaccgattatattattataatataaattaataacttttatctattttgttagtcaaagtcctaaaatatttttgaaagcccattaatgtcctaaatcggccctgttccaaattttttggcttagcaaaatggtgatatccgattataagcacggactaaaaagataagataaggttttgttaaagttttattgttaaaatttatatatggtagtataaattatatttaaaaaagttataattagtagcgatatatagtatgtttttggaatctttaaaaccaggtcacatggaagtgtcgaacaaaagaataagataatacaggtaattaacaatccttagtgggctgaacgttgaattaagaaataaagccacgagtttggttttcttgttatttaatttacgtctctctctatttatatgtttaacgttacacttattaagatcgtaccttagggaaaaaacactcaacagacaaaaaaaaaaaggaaggcgcatcagtgatggagaagattattgacgtagcttatggtgcatcagtgaaggcgggtttgacgttgttggagaagaatctgttgccggatcttgtcattaggcggctcatacgtctgcttttggccagtcgtctccgttccgtttacaaacccacggcggagatgcaactctccgatctcctccgttttgttgactgtaagtgacactgaaacatatatagttgctccttttcaacatctagattttatttatttatttgagattatagtttacaaagctattatagagaactagcagattttattaattttgctttggtgttattgagtgattattatgacgatttttaaacatctggtgtgtgtgttgcaagttgttacacttacacatacatagtttgtgtagggttttgactgtatacacttaacatgacgtttttaccatctccaatgtctatttctctattttttcttactttagagtcgattatattttaaaggtattttactttaagatcatctctaatagttgtttctattttcttctaaatatattaaaaaataaggatctttattttagaaataaaaatatagataagttgaactgaaataaatacaaaaatatagtataaagataaaaatagagttgaaaatactctaatatatgttttaaaatagagtttactctaaaatagaggagaaagataatgtatatctctataaagtaatctaatgtctctcctctattttaaaagaaattatatattagaaatttacattaaagcaaaaaatatctaaaatatagttaattctaaaatagaaaaacatatagagatgaacattagagatgctcttagcgccgcacaactgtgaaacaaaaagtagtttagagatattgttgtcgagtgatccacgaaaacaaaatttcttcttcttttaatatatttgtataatttttaaaaaattagatgtcagtttttttgggttaattggatctccggtctctaagcctctaagactaattcaaatgaaaaatatatacatttggataattagaacattttatagtttgtcacataatataatttgcaaaatgtaaagaaatgttttataaatgtcttgtgaatgatgtatacttcagctctaaagaag

SEQ ID NO: 3867 - DNA, 2000 bp, Arabidopsis thaliana
atctgtctatttttaaataaataaaagttaaataatggctaaaccaagtatgggacatcaagccaatttagtattatgcctacatgggaatgcgttatactttatttacttataatgattagaatcaaatgcgattatctacaagtgcactcactcacacaagaggcgactactataagcataatttataaagattcgttggtgatgtgtattaaaaagggaaataataggggttggtgctttgtctttttgtaatgaaacctaacaaatgaaaatgtaacgaaggaaaagacactttgcattatgatcaaatgtacctttaagaaatattcgaagtctctagttgagctgtggggatagaaattgtagcttttaacgtgaccactttggtcccacccttaacgaaagaaaaggcggggacgtgtttttgttttcgagtcaatagtcaacgtccgacgcagacacaacacaacacaacacaacaataatgtaaattactgctcagtgttcactgttcagaacaatattaaacacgttaaagttgttctatctaataagttacttttgtccattgttaggcagtgtatcggatgttcggaataatattcttctttaggatacatatactatttatttatatggttctaacgttgcattcacttcacttgacttgtcctatagacgagtttggccatcgatgaactgtatcggtggctaggactaggagagtagcggtaggtgacatatgattaatatattcaaacacaagtttatgtatacaccttaactgagcaataatcaatactagaaactcaaaaaccttttcttgcaaatataaatcatccacctaaattagccagaaaagtatacgtatcccaaaagtacaaaacttttttaattatcgtttttatactattaacctctaacgattaataattagcatcaatctccaatgttttttttgcgaaaattttgtttcatatttacagtcgccttcactttttggtcttctaagtttcttccacaagatccaatattgattgctcagcaatataataatacatagaagtttttctacaaaacgataataaattgaaatgttgtggaaatttgatataagaaatttaaacaccgacaccgagtatgtaaataagcatcgatataaccaggaaatatactataaattttgtttccacgtgggaacacaccccgtaaatgccgattgccgacctgccaatttttcttcgaacacataaaccacataatgagattggaccatagactcttttttaacaaccaaattactctaccaaaccccaacggtaaaatgacacgtgtgtaagtcagtatttaattttttacggaattctcttggatttacaaaaatgcaatcgaagaataagctagaatatgtgcacatgacatgggccatgttcttgattagaataaaatattagtactacatagttaacactaaaaatgatgcattgtcttttaacagaatcaatcatgagggaaacttccatcatcgcaacaaataaaataaaaaaaactgacgtgacagataaaaaacctcactaaaagccatttcccaaaacttaatgcatacataaaaattgaaaaataaacggataccacatataaccatttctttactttttcttccaacatatcctgaaactacattacacaaaggtaccatatagttaaagaaaaaacagtaagatcattacatttttagaaaagcttatagaccagagcttaaatgtaacaataaatatacaaattggtaatggtcttaagtctattagtctatgcacaacggatataaaacgcgcatacatatggcttttacacacaataataatataaatatacacaaccatctctcccatacacatatttcttcccatcgtcactagtcacgaccacacaaacaaaaaaaatataacatttagagagagagaaaggtacagcagtggcaaactcgtaaataaaga

SEQ ID NO: 3868 - DNA, 2000 bp, Arabidopsis thaliana
tctcttcaaactcaattcatggttaatacaccaattttcaaagttgcaggaaaaaagaagaagagattttaagcttctcaattggaaattgataagccattagaaagttagcgaaaaggatttcaagcatttgttttgggtttgggtttgtgtaaattagcatatactatatcattttttcgattagatagacaagtttggtttatctacttcacaatttgacagaaaaaagagaggaagaagattaatactctcaatccgtttgattttctccttgggttccctatgtgcactatcctttagggtttagtttttgtgaacgtagtcgaaacaaaagaatccggtggagaatataacagaaacaaatctaaaaaatttggcggaggaaacgtggtggtggtcggaaaaagagaaaaaagaagaagatacagttgataggggtaaaatagtctttctcgctagcataaagtactctttttcaaagcccaacctaaaagatctcaaaatcaaaaattttaataaaaaatgatctgttttgacaataagccctttttcaatagaccaaccaatgatttcatgacataaaatacatgtttttccaaaaacatatgaacaacgtaaatccattttgtaagactaccccaaaaagaacactaatataaaatatatagatataaacactattatgtatcgacaaattaaagtaaatttggaatactatgaatactaaaaggattggaatttggaacccttttgtactttttaaagaaaataaagattgacacatggatttttttaatagaccatttcaatatatgtaagacatatctacaactaaagattagagatttaagacatgtaaattcacttctaaacataaaaatgtacttattatatatagataatccttcataagattgatccactataaatacaacagattgaaacttttcattgttcagttcaccaaaacaaataatttaatcatgagcaatttgagaggaacaaataggtttatacttgtggcagtactcgtatcatttgtgtttttaagcatcatgaatgctgaagctcgtaaagaaattggatatccaaaacaaagatttggtgaagaccgaacgaatccgtacgaggaaataacaccaccactaataggaggatgtgatcctaaaaatcctcaaacgtgtctaccaaaacagccagcaaatccgtaccgacgaggatgtttaaaaattacaagatgtcagcgtgatgtataagctttttcgaactatatatgtaacaactaaagattatagttatccaaaaatcaataatcattaaacgaataattatatggtttatcataattatttattttaagatagtctaatagtcagaaaatctgaattgaactgttacgtgtatttcgcttatgcatacaacaaaacaaacttatcacaatttaaggttgttttgagtttttctctatttacttaaaatacggtaaaaaaagcaaaacgcgtttaacaaaaataaaatattcccaaaaaaaacttttatgccctaaagttgattaaagacctttctacacgcatctaatcatctcttctcatcaaaatcacaaaatcacaaattcgattttcctcttctcttcttcttcctcctcctcctctcggattcttccttaaagtttccacctttcgccaccgagaaaacattccggcaaaccctcgtcggaatacttaatctctttgataatctttctctctggtgacgttttgtgaatggtggaaactaatctgattggtgataatcataggctcaccctttcaactaaaagggcgagctttctcatcatccctctctctcaagactctgttttctcattcggttcttgcaaagaaggctggtacttccgttgcattggccttgacccgtgaaccaatcaatcatcatctccgatcatattttcaataataatttctgtgttttgattttttgagaattttgaaaaaaag

SEQ ID NO: 3869 - DNA, 2000 bp, Arabidopsis thaliana
tgtaagaaaacaaatactttaggggaaagagagataaatgacaatcattgtgtggttgaacgtataatatagttactaaacaacaaataactaatgagctataggggtcgaagtttgacaacaacaacaacaaaaaaaagaagctataggggtcgaaaaaactttcttgcattgtggataatctctcaataccaaaagtagattttgctggtaacgaatatagtagtcacaattgtccatttcagatgggagtgaatttcccatatgggttctttcgtgaaggaatgggtacattatatttgctattcaagaacactaatgggacgacccattcttagccctgaaccaatctgcgacatgaaccggagttcaaaagaaccaaatcggtactaaccgaatgaatcatgcaaaagtaaataaaaacaaaaataaaatgtcaagagaaagcatttaagtccgtgaaagtgagaaaaaagagataagaagttgcagtgtcccttgtccacccaatccacaatttctgtttttatttatcttttttttttttgggctatttatctacctatacttttgtttatttctttgcccaaaaaaaaatactagctttttttttgtctccaatttctaaagtattattttatttttgtttttttattcttcatgagtggtaccaaaattgattttttggatctattagttaggttatcttcagctatctctgattttttttcttatattcgtctaaatctatataccatatcgttttgtccatggtccaagttcaacgtgcattaaatgttatattcggtcgaatttgaaaatatgcagaataatacataagcttcggtggttgaagtcttgaagatgaactcatatcagtatgactaatatagtactatttggtacccattgttataatttcagtgttaaacgttatctatacaaatgagcaaaagggaaatatacacacaaaaaatcagtactaactatctttaacatcattttttcaagtatatgcatgatgtttatatcgaattatgggtagttggacaaaaataaacctctgtaagaaaatatcgaaaaaatattagttacctatcgttacgaaattgaaacgttacaacttacaagtgaaaaacgactcgaaaaatattactttgaaaatctgccgtttcaaactaatatttttctccattcttacaaacgttacaaacatattaaattataaattaaacaaaagaagacaacaccttacgtttctttttcagaaagtgcaatttatgtaactgatattttttatttgattacacaaaaagaaacttattaacttcggaacgataagttattctttgacagtagtagtataatcaagtcctaaataaaagtcaaacgctacaacattcgatgattaactgctaaaaactatggtttattggcttatcacatgatctaaaacgagtaagaaaattaaatgcaacttaaattatatgaatcagtaagaacaaaaacaatgtcaaaatcatcggtccctgatctccggtgccggcacccacccgttcaaatcaactatttaatttccgaccatcctattactctattccattaaatttttaaactccaaaaataacaaaaattaaataaagtaaacgtcagagatgccccaggcaaccacagtcaaatttgcaacaatatggttacaaatctttaaataatattattattcttatcattaatcaactcccaaatgacagtccaattaaataatcacaaaacatcataaaagtgaccaaaattaaataataacaattgttttttgggtttcacatgttttataagcaaagccagtgtggtggacctaactcttcacgctgtcccgaaaaagactcttctcttctctcttcctctttccttcacacaactctctcattctactctctgttttttttctttaatcataacatttttttgaagaacagagattctttttgtttgtgtaagag

SEQ ID NO: 3870 - DNA, 796 bp, Arabidopsis thaliana
tgtttccagaaaattttgattcagaaaatggaggattcgttgacgacgatctgagattcagagaccacgagggataaattgcaggaaccctcacctgcgatgtggatcgacgcgattcggccagcgaatatcctattttttagttttgtttgttaatttattcatcgatgaaaacaaaggcttctgaattttttttctttcttttttgccagtgagccaactcacaaggattcacattttgtttgtttcttcctttttaattaaaaacaaaatgtcagagccaatgaaattgaaaaagagccacgaaacttaaagaatatcatcaaatggaaatggagagtacatttattctttttaactccctttttcttatgtgttaattagattaaaaaaacagaaaacagagaaaatgtgtttaatataatcagaaattaacaaaattagaaagaaatgatcaaattatagatgttgaaaggaaaaaaaggtatattctaaaaaaatggaagaaaaggtatctttttagtttttattatcataaatgtacgacatcaaatttacatgtccacttatttatttactggcaaactttctggcgacgctgaggtggcaaaataatccttacgtggcaacatataactggttgtaaatacgtatcttcaacagtgtaactaccaattagcacaagataacactcggtggtttgcctctattaatagggtaacttcctctggttatcaaaaacaaacagtcttgaaaaatcaaagaagcaacctctaaacaacacacaatttcgaaa

SEQ ID NO: 3871 - DNA, 1254 bp, Arabidopsis thaliana
ggaagccatctgatatattggttggttggtttgagataaatgcctagctcatgtctacatatatatagcatccaagtcaaacctctacaaggctcacatgagccgaaactagtatgaactttcttctttacacatgattctcgtttcattaatattttttattcgtgatcaaagatgataacgtattttattcgtcagtgtgagaccatgcataaactttttaaaaattcttaatagcttaatgccttaagaccatcgtgttttaatgcttctacatatattaacatgtcctccttattaatcagtcactcaaaatgattaattagaagggatgttttgctttaattgatacatcctaataaactcagtaaaccttagggtatgattttatggatagaaagaagatattaatttggctattaaattaactttaaacatctatatatacatttttgcagccattttgtgaaataaattctgtagttgagacttatttacaatggttgccactggattttaatatttgtttttaataattagaaaaaaaatcttcgaattaaatatttgacatttaacaatttttctaaaatctctctacattaactacacgattggttactaaaataaaactttcaaaatatttaatatcatttaattactacaaaattatcattattgatattgtttttctgcatgactattacaattcaattataatcatcaaaccgcagagatatttgatagcatttaattactagataattttaaaaataaatgattcataaacatatgataaataagatcaacattaataaaataaatgagtttttttacgggacgggttggcgggacgggtttggcaggacgttacttaataacaattctaaactataaaataaaaatattttatagatagctacatagatagttacaaattgcaaaattttatatatattaattttaaagtataaattgttcccgcgatataccgcggatgaaaatttagttagggtatgatttttggtagaaatcttaatatatcctatccaacgagaaaatattataactcaaccttattcttattttcctttaatatttttaatttgtcagatgaatttttggaacaaaaaaaaaaggatctggtggtggtggccaagcaaggcttaggctatagcacgacgactcaaccagctaattaacaagttttaaactttttctccggagctctgactcttcttctctccggatccaaaa

SEQ ID NO: 3872 - DNA, 1363 bp, Arabidopsis thaliana
tgataaataactatactctttagttctttcttttttttctacaaccacacattgaattaaacaaccggtctagctagagatccatacggggaaaatattctttacatattactcatctaaattcgtagacctagcactactggccaaaaggtccgtttggacatttaaacaacgtggagccaaagagagtttgagaagcaaaagtagcaatgtggaatcaaagtatactttacaatggttggagaaatagagaaacaaagtagcaatgtggaagcaaagtataatcaaagcttttaacaattctctcgtgctgtgctatatttcggttggaaaagatatatatatatatatatatatatatatatatatatatatatcaaacaaagtgcaatgcagacttacaatgctatatatatatatatatatatatatatatatatgtatatatagtaaactaagaaaagaactactatgtattattttttattttttttgttataaatttattgtaggaaataattgttgtacctgaaggaagatgtagctcaagaatgtcgatgtcttccgttcttctccatcgacaaaagggttcgatttcatcgtaaaagtgtgtctgtgaaccttccatatttactgccatttcgttaaaaatttcaatgaacacgaaaaataaacaaaaatatattactgaaaatctctctcttgttttcaatttgttggaaatcaatattgcctggtgattgtgatgatgacccatctaattgcttctatttatataatttgttctgtgcatgcagtttcttcttggatctcctatgtactgaatgattcgtttattacccttaaagatttgctttaaaaattaatttatttcactctttcgagtttatatagtttgttgtatcttgtgaaattggtgtttcatcacatgcacatatcttcgtctatgtggttccaaatattcttttgttctttttattttaccatgcattgctttattacttacacataatgacaattttgctggtcattgattagaacatcgttttaatatcgaatgggatgtcgagttgaatattttgacaacgttcgttggctgggtcatgaatgaagtcagaataccatttctttttcattaaacaatgctatttttttcccgcaaaacaatgctattgggctcattttgggcttaaaatgttttgcgtaatctcaatgtttgtggggcttttagtttttagcccatgtatggtttgataactttagtaactcgtgagaaaaaaaaaagcttcgttctcaatcccaattcgaaatcctagctgaagtctatgctccataatcaaatccagttcatcagagatcaaag

SEQ ID NO: 3873 - DNA, 2000 bp, Arabidopsis thaliana
tttatcaaaatatttttaagcttttatcatatttttctgacaaaatacatcacatcagttcactaacttggattcaatattacatgtatcaatcaaaatcttagtagctattgttaggttgggcctaacaacactttaaaagcttaatgggtagaattcactttcacaagatagcttatgaaacggtggcatggtacccatgatcttataagccatttactttttttgtttctctcattctttttttgtgtggtatatcctagtgatacttagtcaccgttctttcaatgcgggatgatcttataaactgacatcgatgcccatgtccatgttaagcctatctcaactgtctactttatgtttatgggtcatttctagttagtttattttggacgtttactcttggttggtccatgtggctttgttccacctcggttggttctgtggacgtggaccaaccaaaaaagttgcgatgttttatggacttacgattattcgctgcactaactgttagatttaggtctacccataccttaaaaacctaatggtagaactaatcttcaaaaattagttttgagaaagtggtgtttttcagtttataagccaattacgatttcttctcccttatgatgtgatgttttaatgatagccatttgatagttgttttctcaacaagaagtgatttgatgttaatcacgtggaatcttatcggctaatctacttaattaaaaaaggaatgcagatatgtttaaatataagagttgtttctagaagcattgattgatatagatttgttttacttccgacatggctccacatgttgttcttatcttatattctcatcataagagatgttttttctcatgcgatgtacctatacctgcattagtccaaagtccaaacccacctctcttttattctttcccacgcttccatatcttgtgtccggcaccacgtttccttttttttttattaatacgcaaatttagaagtttctatatagtaacgacataatttaaccggtaggccggtacaggtttcgtagtagagaaaatcaaacaggttttgaagttaatgttacttatcaaaagttctgaccatcttatctcttttagaaaacaatagaaacaaacattccttgacccaaaaatcaaagtaaaaaccattttctcacaagcaacatcgtaatgaatcgtcaatcttcaaaataataaatccatgatattcagtcttcagtcaataatttaaagaaaatgtattttagtattatcttaacataacttaaataagaaaattaagaaaaaattaaacaaaacatggtcgatatataaaactattctgtatttctacaaatcgacgacaaatccacaaccttgactaaccgtacaattcaggctttgacattcgtatttttttgacatttacatttgaacaaagaaataaacacatgacataattgagaagaaaatcgaaggcggcgtttcttacttcatggttgtgagtcttttatgacttatccaatgttaggtattcttaaatctagattagtttcaaaatgaattacacttcactacaataatttatttatttgaactataataacatatctaacccactggtctaatttatatgtgctgatgcagtaataatttaaatgaaaaaactaatgtactacaaactccaaatactatttcaacatatcaaattgtgattaatgattgatttttaatcaatgggaccttgtggactgctctctccaacactctttcgactattattttcgtaaaatcaacttttttgaataaatatctaaacaaatccttaaagtcacgtttgattctctcaattatttctcctttaacactcttttaaacattattatatatttaaaacccttaaaaaccacaccacactccaaaaaaatcaaacccaccattcaaacaaaacacaaaaacaacaaaaaaaccatttccccaaaaaaaaaaaaacaaaaacagagg

SEQ ID NO: 3874 - DNA, 657 bp, Arabidopsis thaliana
aaagattatgtaactttcctctgctttttcttctttcttccttatcttgttgcagcgtttttttttgtttttttcctttcttctgattttgctctgacaaatacctgttgattaattgatttatttacagacaattactgttgctaattacttgtgctgaaaatattattaaaattgcagagaagatcttttgtaacaataagagacgtgatggcgtcatatgagtggtcccattagctcttgagaaatataaaaatagaacctctcactttttatcttcatgaagtaacctctaacaaaaataattagacagaataacccaattcaatattgacggtgctgatgtggcagcagatattagttttgtgaagagggtgtttttgttattgtggaaagttggagactttttctagtaatgtgttccactttacgtaacaaacaaaagtgattgcattcccggtgcagaccgtggggtcccaattgtatcgtcgtgagtcgcgtgaccgtcagagtcacactcacaaacatttttggacatgaattgaaaattattataattaccagattttttatctatcgtcgaacttgggactgagaaagtagcagcttcgtttgcttcctctgatatttttctacactctctgtctctctctaaag

SEQ ID NO: 3875 - DNA, 2000 bp, Arabidopsis thaliana
tgatttgtcacacgagcgcttataaatgagagtgtggggaggacagtttcgtcccttttttggaagttagaatcattacactattttggcgttttgcttgattatgatgacattatagaataaaatgttctattatacgaaattaatacatcactaaacatacttttcattcagtttgtatttaaaaagttacttgtaccaatatagtattctatcaggttgtttgtttttctgttcaattgtacttatacaaaccttccaaaaaaagtgttacacttgcgatagatagttacacaaatgtcattctctatgatcttccttctttatttgaaaatggtatcgcagtattattcgctgaaagttgaaccttcaaaccagttaccattgcagacgacattttctctacaaaagttaaagtgatagtaacatatctcgaatttaattgaaaagtttactactcaagtagtcaagttcctgttacccaaaactatgtgtataaagtgaattttttgttaattatgtaactatgtatacaccgggtacagctgcacgtagggtttgtacataattacgaaatatctctataaaactgcgacagaaggaaaaaataatagaataaggctttaagagaagtttggtctatccgtctatgtaagtgccagagaaaaagaaagcagtttaaaagtgaaaggagggattaattagtgggaaaaggtttatcgaaaactaataataatacttctctgattattaaaaagagatggaatctgccattaattgacactcatgtcccaatcgtctctcacacgtacgttcgtttttttttttgtttctcttttgcaaaaagctatagagacaatctctcctccactttatttttagtttttctttcagatacaagtgagagtgaacaagagaagagtgttaatgtgaaatgtttgtggttggtgtgaaattcatgtaaaaatatgtatgtattaccttaacattaaagtaaatttgaactctttcaaactatcacattgaatgctccaaatcttgttgtatatgagtatcaatataaaagaaatttagatgcttatactatgttccatttttactgaacactacttaaccattagtccataaatgtggaattagttagttgctggcatctttatatcagaatcaaaagttttgcatattgggtgacagtgagtgcatacaccaataattcaccgatcaagatccaaccaagtaagaagaaaaatataacatgaattatcttgattttttttttaataaaaataaaaatcaatgaatatatatgcttattataaaaaaaaacccagcactaaacagaagatcagattagacttgtgttttaaaaatattgagaagagaatcaagagataggtggttgggggtaaaatgtatacaaatgttacaataaagtcttaagaagagtttaaaaagggtaagtaggatatgtagcttgcagaagacttgatcccatcccctaatctcacgttaattaaacacctctctcatgtacagacaaaatacctcatttctttaacttaaacttaacaaaagctactatgagattaaggattttgtgatgccattattttatttatttttagtatcctcttgcattaattaactttttttttataaccacatacaataattaaaagtagtattatttgtttgtatctgttatcgaaattgaaattaatatatataatttttataataatcagaagaagaggtaacatggcatgtgagtgcacagctgtgaccactcttcccttcaccatttgataaataccttcttccatcttccttcttctgtcttttgactctcttctctctctcctctctttctgctttcctcaatctctctctttctatctctagagcttccacttcctctctaatggtggaaccaaaaccctagattccccctttcatcttctctacttcccacacttttctctctcacaaactcttgagaa

SEQ ID NO: 3876 - DNA, 2000 bp, Arabidopsis thaliana
actcatacaaaattgcaaattagtctgatttcgattggaattacttgttgagcggtcaaataacttgacgttcaagagaatacagaacaaaattcatacaaaacagatataaggattagtggtagtgaaaagaagaatttacataaagaattatttaaaaatattggggccaaaggaatcataacctctcatgccactaaaccacgagctaattgatgttgtttcttttgtggggctttttctctattactctccactattcggtcctttatttattaaacagaatcaataaaatatactctatagtcttcaacagtatgatatattacaaatttataacacacaaaatcacactataggtgataagatttgcactattaattgcaatggaaaaatgttctaagaataattatttcttactagaaactattgatcttaaagaaatagtctcttgtgcaattgaatggtagctagggtataaccaattgaaacattttaaaatatgacttgtgtatatttttttctttaatatgtgtatatgattatttatcaatgaacatttcaaaatagcattttctcgttggctgaaataatcaagctaatattttgcttaagtcatacaaatctactcataaacttggtggaagaaggcagtgtaatgatgaaaaggatggagtgtgtgacatggaacatgatataaaggctcatctatggcatattatatgaaactaaactaattaaaatcacataaaaatggaaaaagaagtgagcaacattatggttacaccttaaagtttgttattgtaatttgtaaagtcacttctctgttcattcccccacgcctctgcctcgacagtgaacattggatcaaccaaattttacaaaagaccatttcatatgcgatgcatattatgactaaattgggtcccaattattttgaccacacaccccaccatatgaaatatttgtatatcggtttggaataatttctcccaaaattcctttcaatataattgccattcttttgtaaaaggttttgttttttttttaaataaagtattaatacaatacacaacaaaaacaaaacaaattatcccaaaattccaaacttgatgtgattatagactagaatttctattatgttcgtttttattagtgttgtcactatatcactaactatattcatattcagttgcttgtcaattatttttttttgccagtcttagatttattatttattgcactgttacatagacgattctacaacggacaattccttccgactcttattagatctagttgcttgtcatctaatatttaaattattttaagaaatgttatacaactaatatttaaatcattttaagaaatgttatacaacaatagtatatagctaaatttttaaatggaagtttatataatactacactttttcttcattgaaatttgtgaaacatctcatagatacaattcccatttagaaaattagcagtgatcataattctttctaaggttcaaaatccccacatggagctttaatgaattaaaattatgaaaccattagaaacaaatagatataggactaaatgaaactgaaaacatatttttctaaatattagagttttattctataaactgaacttaatttttttgattatcaaacaacatgtattctattagattaataatgtcacttacacaaatcactacaagtcatgatcacaattccacaaaatcataagattgatcataaccatttaataaatcaatcatctattagaaaaacatcatatgtaaaaaaaaacgattcgacaaagatgttttaaaaataataagcatcaacaattaataaaacttaataaattacctaaaagcagctttttcttttcttcaaaaaaagccctttttcttcctctgctttagcatcgtctctttatcatctaaatgtttcaacttacttacttctccttctccattcaaactcaaaaaacctccctcca

SEQ ID NO: 3877 - DNA, 2000 bp, Arabidopsis thaliana
aaaaagaatcaaactttcataggaagatcatgtcgttgtgggtataatgagaaagtcaagtgtgattgtcagaggaataatcctattgtaacctatatatctctaaagccaatcttcatgctagaatcataaaacataggtaccttctgatgttttccagccgttcatcgaagtctatatcaaaagatcgaccagattttccttcaaactgagtattcagaccaggtgcctctgcaaacaaatgcaggagtttcttgagcaaacctttcaattgaaaccaactttttgagataaactgaagaatgcaaaaatgaagttatgttcgagacaccatgaaggagagcagcaacatctgttacgtacaatatgctttaaaatcaaattatacttacttctgggtacagaaacagactgtttagaagatgatttcctgcagcaaagaagtccatatgaaaatataacaacagcaatttaaaattctaaatgctttaaacaaacacaaaaactatttatacctttgctgcaatgccgggtctttctcttcctgtgatgcgatttcacatttttgtctcagtactttgaatcaacaaaattaagttgaacaaagaagaatttggaatcaaaccttttttgagccgaagccacgcttagggttagaatccgagcaacgtattcgaaataggagaagcttcgagttaaatgaaacggaggtcgtcgccgctagtgtcatcaacatcctctgtttgtattgtcctaaccaaaacagagaattttctaagaaagtttcaaagaaataatgagaagtaacggctacgaagagaaattcgtccgccggagattgacgatgaaaggtgagctccgtgatcgggccggtaagataacgttagtggttcttcttcttcttcactttgcagattgtctattatatgggccgaatggcaaaacataattttgggctaggcccatataatattcaaatgttaatattccaaaattgatgggtatttttgataatttaactcgatctatataatttaacaaacgaggatgattttaagtttttaactttttaagtgagaatagtgattaagtgtcaacgactcattggataggatgtgtcataaaattagtattgaaccactgaggagtgaaaataaaattaaaggtagaaaaattaatttaggaaaaaaatattcggaaagttctgtgaaaagtcttcggatttagaacggagacagcgagaggatagagcgcttcttcggctacaacaagctttcgctaatggcggtttccttctgatcactctcaccggagccgtcatcttctctgttttaccgatttttagggtttgtttccggataaactcttcgtatgctttttttttttcgttggattcgtttctggaaacgtatccatttcctgtctagagatcatgtgaatttctcttagaacagaactcagatctaaattaaagtaacggtgcttgattcattaaactcggaatgcaaagtcccttgcgttttattcactgaaatcttagtcgattagatcttgaggtctgtttgttaatcgcacttttctggggaattgatcgtagaagcaattacgctcatgggaaatgatgaaagttatagctaaactttactgtagaaccttactctgattatatttcatttaaaaatgctatttggttggtaaagagaaacatcacaacttttcatacttttctatttttttcagaaattttgattgtggtggaaacttgttgtggcaactctactgagaaagtttgaagaagctggaatcaaagatatagctagagttaagagggttcatactaacttgtgctcgttttgtgatgtgctgttgttaacgtttggaggaaaaagttgtagtgtattaaaattcagcgtccgagttctggggcggagttgccccatagcattgactttacgcctctacacatagtccgaagggctaattcagctcaaaacatgatg

SEQ ID NO: 3878 - DNA, 1262 bp, Arabidopsis thaliana
tgtttgagtaccttgatttgagtttcacatcatagagctcccatttataagctgatcactagcgtgtagtataagatgggttgtggtgactataagagtcaacaagtcaaagtaaatgattctttttcttattattgtcatttctcttaaacaacatatatttttatttgggaaaagcccacgttaaaattaacttgaatttgaatcaaaatttagttatttgatcagtgatccacatatcaccagttgagcccaataatgagtgtataaacgggagctccttaaaagttgggaaccactagcctactacaacttggtattagaaacaaaaggaattcaagaatgagattcttgttgtagcaaagcttaacgcagaatttcggtcaagcttcgatttttcttagttaaattacttccatttttgtttcataatattttagtgcctgacaagtaagtgtaagatactcttgtctagaattttatttactagagagtgaaaacaaaagggtgcagagaattaatggcttatctgctgattcttacacaatcagtttgttttgttggaacagagatgtgataagtaagtacggttttctgcagaagcaagagagtttgtgaggaacagagagatgaaatgatgtaagtaggcaagtttcagttctttgtttcccaaaatgactctaaaattcttatacacagttgtaaagttcagaaggaaaagtactaaaatatgaagtcaacgacaatctttagagtcaaccttccactaagagtgttgattggtttgatgaagcagtgaaggctagaaactgaagcaactagggtttgggaagttactgttttaacttgtaactgttcgtttgttacttctttggtaaggaagtaaaacggtgttgtcttattgacccaaagtctccgcggcttgctgaataatcacaaacctattaaatatccaactccaataggttcatctttttccggaaacagattcatgaaaacttaaaaatttataattgtattttctctggttttcgctttcacatgtttattctaacatttttatagttgattcattttagttaacatcaatacaagttgatgttactcgtctagttgaccttgacttgcaagatattgtattattttacaaaaaccaaaatttgactggcttggctggtttcacattcattcattagtactcataaaccaatcattaaaagtaagaaaaaaaaaacagagaagaaaggtgaagaaattggata

SEQ ID NO: 3879 - DNA, 1569 bp, Arabidopsis thaliana
ttccagttcaaccaaattcttatctgaatgactgcaaatgtggataacgtgaaaccacaaaaacagtaagttccaaagaaattaaacacacataagcgagatatcagtagatgagactcaattagataataatcatccatacacatacactttagcgtgaaaagaagacctcctatactccagaaattccgagtatagccatgctatcataagaggaatgactccaagcagaaacgaaacctgcaacagaaagaagaacaaaagaagaaagattgagaacaataacagtaatccaaaaaaacccacgaaagttgtgttctttcagccgaatacaaaatgtaaatctacgcaacaaggttcaatccaaatcttccaaactaaaagaaaaagtacgttgcttcaagctgaagaaaacacagagtggctgaggtagaagcttagtaagttattagtaattgaaaacacttgactcaatgttgagacattacaatctttgtaaatgaactattatagatcattgtgccagcagatcatctggtgggataatcaatctcaccactctactttacacagccaacattaatctaaatctagcaagcaaccgatgaactgaagaatgaatcaaccacattcatataaaggagaaagatagagagtcctaatcacattaagctacaggccaattcaatcaaaatctcaaaatccgcttcgggaagttggagaagaatgtaaatcgaaacttgaatcaccgaagatcatgaaaaattgtacctgaccaggcgtaattggctgtgacacaaccatatctactggatccataaaggaatacccagagattcaaaaactagatactgcaatatacactccaattgcaattagtttcaatctaggggatgaagagagagatagacagagttaattggggcagtggcaacgaagaagaagaagaagagatctgaagtgaagaagctattgcttcaaggaagaagaaaatggcggacgcgacgtcgttttcgtcaaattcaatcgtacggttggttggtttggcgattgcctctcctctaattgttaaattattaattacttattaattactaattaagtaaattacagaggtaatctgattgtggttatacgcaatttacagctctcactgcacacaaacttttctttctaatcgcaatgcctttgcttacagaaatgcatgcatttaggtttggttttgacaacatatttgtgtatctaaagaggaaaaaaagaacacaaaaacattagtgtggatttgcctatagataaacaaacgtagtggacctttctggtaggtgagggataagttggtaccaaacatcaatgttcacatatttgtttggtgttaaagcatttggaaaattttgcatccatgttgaaacgtcaaacgtgtagatgtgatgacatttaaatgtctttactctttattgggtttagatttcatttcgtcaaccaaacccactccttgggcccaaaggtttccacattatcatcttaaaccctaagggggccactagtaagtggaaacaaacacttcgtcga

SEQ ID NO: 3880 - DNA, 2000 bp, Arabidopsis thaliana
tactaaaaagatgcgaaaatgttcgccatttgtaagtgtcgcatgggtgtaatgctttgctgacaagacatatgcattcaaattcgatccttggtatatttctagaattttactcgataatccaaccaatgtttgacaaatgtatgtcgatggttattcccaagagattggacatatcaatgaagtggataagctgtgtaaggatgagaagcgtgagaacgattgaaagtgtacatgttttctattcattgcaaccttttggcatatttcgtttgattatttttagtactaattcaaagcattcactgtgttggtaaaatgtctttatcacattaatgtgttgttcactatattaaacaaaagtcactcaccttatttccaaaactatacaaatatatacatataagaacttaactagtgtggtttggttttttccaaatgtttgtttatgtaaaacaacggacatcaacctaaaactttggagtttagtttagtatcaggctagtgggcataattaggttcttctacatgtgatagtgttaaagatacgaaatttcaagaaatgtatattgagacatatatcaaagattgaacgatatcaaaatagatatatgagttatattgctttgacctacttgatggatattttcatatataataaagtgcaaaatgtaaactcaagattaggataacctatatgagcaacaaaatatggagaggaattctgtaaacagtccgaattagctttcaatgtatagtttgtacttaaattttggtgacgcctactaaacagtaaacacaccataaatcgacacaaactacctgtaagcttttactgactatcaaattaattcaaatagatttgaaccgcaaatcagaatgatgtaagtaagctagaactcaaaacgaataaaacaaatcatacaagttgacttctgcatgatatacaaaacttggttgaagtccaaaacaataaattcagcctatcaaaataaatggcctagtatgagtagcccaatgcatcaaatgggcttttcaacattgggatatgcgactgggttggtggcatgcccatctgtgtaaaacctatattatcctaatctctgagaaacataaaatagtattttcatcagaagttgaaattatagccgttgtaagctcatataatggacgaatatagtaatattgagaatcactaaaagtctctgttccgtcgcttttattgtccaattgcagtgactcagattctctgctcaactctccgctcctccaccataaaagagataaacaaaaagcctactaatacttaaaaagcctactaatctactatatgattagtttttgattactagtaattgtgttgacaaaatcaacatgttaatagtaaacagaggatgtgatgagtttacgattagagggtgttgattgttttaagagaaactaatcgaccgttatgaatggatcgtattatatagttatgatgatctcacttgcatgtgaacgatcacacttttcctggtgatgaaaggtaacttccgcagttccgatgtttacttttctctaaccaaaattgtataaaaatgaataaaatacattgaatcctacaaagcgatgactcattcttgcagtatctccgtaaaacgctgtcgtttcattaatatcactgtccacgaccacaaagaccacctatctcattcgctaatgaaatttccgttatcttacaaacaaatgaaatttatcaaaattgttttctctcacttgtgttaatcagacaactatattattgcccagaatcatacaagcgacatagtactaggaatattttcgcagaagaaatatccaaagttgatgatttatctgagtaaactaacaattataaaagttattaatcaaaaatgaaaaaaagaagtaaagaatgatattttcctttataattatgagagcaccaatgtcatgtcggtaaaactccccccactcacttcactcgctccactccttca

SEQ ID NO: 3881 - DNA, 2000 bp, Arabidopsis thaliana
ttggcgatcgatttgcttctagattgcttgcgaaagtctcttccctaaatttacaatctgataaaacaaaaaaaagttggaggttttcgatagagaagaagagatcgggtttaaattattaggatgttgacgaaccgtcgatgaataatccggtttaaattattaagggaaccggtttgtttttggatttggttctttatataccggatagtattatgtaactcatttccaaatgattttaatacccaaagatttttaaactattttacctttgaagaacaaaatttcgatttaaaatcataatttttttttatttttttttttaaatcttggaggttgtgggtcaaagtccgtaatcccccaggcctgaaaccacagcataaaatattagtttcgtcccaagcgtcactcgaaccggcgacctctaagctttgcataaggtctttaccaattgagctaacgacacttggttaaaatcataattaaataagactgatgttaaaaatctctatattatttggaatttgatacacaatttaaaaccaataactgatactctattatactctattaaaatcaactattaggtaacaaatatgtgacataaacattttgcagtccgatgcaaaatatatctttcaatctcaacaatatgttttttcttggtcaacaatctaacaatatgtttaattgcatcttcaaactaaagtcccaaaacatgttttgttctttgcacatggttgtttgtgtggaaccacaataagacaaaggatcgattgcagaatttgaggtcttctagctagttgaccgactaagaatcaatggaccacttattctttaatattatttttcccaactggtttggaaggacttagtgaagaagttacactaaaacttctcgagtcaatcctcatatggtttcttttggcaattcctatctctgcaaaatcaaaggctcttcatatcaattaatatggcaagcaactactttgagacatggcaagaacggaattgttgatcacataataagcaagctctttctcatcaaactacctacaaagttttgcgctctacaagatatttgatcaatcataaaaatggtgatctcgtataatactagtcttcttttagggctaacaaatgattcagaagattacaaatgtgctttgtagaaattagcaatatagtgctttgtagaattttatgaccacaagattggtaagatcatttagtcaaatatatgttttatctcttcttattgattgagatgattatttttctaatgagtcgatccacatgtctaattccaattgatctttgtgatttagtttcatatttgttttctttaacatatgaaatttttttgttagtgtagaaaatctaattttcacacaattaaaaataatttttacaataaattatgattagcaaacacttcaaaaaaatctccattacttaaacacttcagtttcctactactaattaaagttgtttccttttgtttaaattgtgattttgctttaacaataaagatgacggcgcataaaatataattatatataatcatgcattattaaataatgaaaaaatggaaaaaaatgaaagaaaaagaaaaacaaatgttcgaccgttccttatttaaagccggaagtcccatagccttgtggtgtttactttttccaattcggagaaagccaaaagagagaacaaggcaataaaaagaagccaccgtcgctacaaaaagtcgcgatttttattttctctatcccaactgctctctacctttcctcgaaaattccttcaaaacccaattctcaagccttcttcttcgtcgtacctgaaaattctacaatctctggatctacgcgtctacttctgaatttcgatttgggtttcccgggagctgaaattccgtgacttttgggttttctgatttagggtttgttcctcttctcgttctttctcgggttagttttttttttttttttttgtgatttttg

SEQ ID NO: 3882 - DNA, 856 bp, Arabidopsis thaliana
atgttttacgttgaaaaatgtattctatttaatgacatgtttttaattatgtgttttggtcttcaattcgtccttcaatcttttgttgtatctttgaatcttgcttaatatcatcgggtcaatgaagctgggcttgctcaccgggttagtgggctggctcttgcgttgttggtccaatgttttattgattgatatattttttaatgtgattgcattatagttaggttaaatatagtgtttttaatgaagttgtaaaatcaataggtcacgttgagtcgttgacccgtattttatacttgacccgtattctccagtaaaacgtgaagaatcgtaaaaaaagaactatcatatagtataaaattcacatcacataaagtcactacagattcgataataaatgcattgagtcttgtgattctatattttctattcatcgcccccaattaagctacgtaataacagggacataaattgtctttttaatagattttttaagtcggcaagtactgtcttttagatatttcggttgtcctatgtagaaggtagatatgtaaagggtagattaaaaaaggaaatttaccttctacatcctatttagtatatttactatactaaaaaaggaaatttacctaactttctcattgaaaattagttattaccttctctttcaaaaagcagatcaaaatctctatccaaccatttccaaaaattcaagtctctttagttttcagtcaattaattttcgtgttttaaaggccacaaagtacccatctggtccatctcgatcccacacacgacacaactttacacaaaaagaaagaaaaacccaaaaacaaaagaagcaatcaacaagaaa

SEQ ID NO: 3883 - DNA, 2000 bp, Arabidopsis thaliana
gtcaacagtgccattggatatatgatgtattacatatcatggtattatgtaaaatgatcgagatcaaatatcatggacattctataagtgcatcgaggtcagttagacttagtatcgtggagcatacttcttgaccaccttactgtcggctaaaatttatatgtaaatattctcttgatacctcataatgatgtgacgtacgattctatttatgatgttgcactgttatttgttagatacacagtcattattttcctttgatatggttgtgaattcctctaatatgattatgtttttcttatatgacttggtctgaggtaactgatttgaacaagctgctgttagatttatcaccaactttatagaagaaaagattctgccactatgagaaattggcaaataatatagagaaaaatgtagtcaatttaaaataattattcctttatgagtgcttacaaattaatgatattttggcaaaacaattattagtattttataagtcaatgtttattagcaaagtattgtaaagccacgtcaattaagattatctaaatcaagtagcatgttcattaccattagatggattaaaaatatatttaagtttattttgttgggttgtgcataacttccacttccaatattgttccattttaaaaagtataatatgcatatagtagaacatacatcacaattacctagagaaattgttcagaaatgaatatttattcaatacatttttaagaatatttcaacaggaaaacaaaaaaaattgcagtacgaatttcattggttaattagaaatatctccttttttgtcttcatctagaaggaatacctaaacttgatctgaaaataattattttttactttaattttaaaaaaaaattagaagtcaaactgaaaacatttgagtacaaagttttttatttagagtgatggtaaattttctcaagcaactatatcatagaagataatctgcggcttgtcagaaaaaataataataatctgccactatgccaaattaccgaattatatagagaaagaattagttagtattaagaaacttgttccttagataagtagtgcttacataatatcagtattggcagaaaaagagaattagtgacataatattaatattttttcaaaaagaatattagagttctaaaagtcattgtttaatagtatataaatcaattaacacgtgcattatcattagatagataaataatatatttaagcttgttttatgtggttatgcgtattatttcacttcgaacattgttccatttaaacgaaaatatgatatacatataagaaatacatcacaattacctaaggaaattttgggcatatttttaaaaactatttgttatttaatttttttttccaaaatttgtcatagacccttggtttttgcccatgctgccaccccctagagacgggcctggttctatggtataatagagagtaaacatttgatttatgcttcaaactccttctatttcctttcaaaaaggtaaacaatagctgatgtagttttacattcaactaaaaaaaaaaactacttcaagcgaaaaatattataacttggttttaaattttgttcatcgagcagtatgtggagggctcgtaggacgttggcttgattgttaagtgttgtgattgttggtcaaaaaaagatatagaaaaaaagtcttatcaaattagccaccagacgaaagtgaaatttacggtccgagaacatgcgtttaccacaaatggttgtagtcagggtgtcatatcataagaaccacaacatgaggatccatagtgatgtgaattgttgactttgcctggctacatggtttttttctgtctgaaaaaaaaaaggccaaggaaaaaacaaatgtatccaaaaccctataaattacaaagtagagaggaagaagaaatgcacaaatttcagaataacatatattcactaaatacttacatgagagattgaataagaaatggaa

SEQ ID NO: 3884 - DNA, 2000 bp, Arabidopsis thaliana
attgtttgattctttctggcgaataatatacacttattttgttctttttatatataccaattgaatcctataatcaatataatattagtccactaaccacgagcactttttgcagattgactttccaacgatttataatagtaatatcttcataaagaaattcattagcattctacaattttcttcataaactggaagtgacaacaatcggacataaaaatgattcaacttttccatgacaatttttgtttctttggtgaagaaattaatcttttctaaataaactttttttattgaccaaaaacaatgtatcttttaaaagattgcacggattctatggttgaatatattctagatttagtttgtaatagcatatcgtcaactagacataagtctatattcctcactagctcgtgttcctttcttctttcgtcacggttagttcagatccggacaagaatcctggattgacaaaattttggaaatggcttaattaaactattgttttatctttcttacaattctttgaaacggtgatatttcatataaaattctcaaaatttttaaattagtgtcgttaaattctgtattagcagctcaaccagttaaatataaagccacgttttgagagaatcggattatatctgaaattcgataccagttacgaagattatattacatttgattttgaagttgtaagataaaaaaaattagtgtcattattgtatgaacttcgtgaagtttatttatgtgcttcacttttagttaataatgtaatatgtataacaaaaacaaacttgtatgcctatatttagtacaggtggattgaatcgtatcaatgtcacgtaaaagttttatttggtttaatgtctcacgtaaaagttgcttttacttttcaggtgcctagccgtgttcagaaatcagagaccaaaatcttatgggggcaatatgatcaaatgtaatataccaacagttagttaatgcggattgttgacaaagaagaacatttcatgatcggatattgttgacaaaaaactactgtaagccaaaaatgaacaaaagaaattaatgataattaagtataagacttgacaaaaccaagccgacatgagctgagtcaagttcatgtcgtcaatgttatagtgatgattgacgaatatccaacggctgagaatgattggaccgcagtggaatggacttttaactataaaatgggacgaattattcatgattgcttaattgaaaattcacattgttattttgttatttatttatcattaaaactctacttcttttctcttttagtcagttttgataaaattcaaaatttcgtttgttacaatttgaatagtattttaaaatcaataacatcttttttttgtcattctaaataattaaaactcaaaataataatttttaaaaaatattgtttatatatgtgatataatgtggtaaaatacgaatcaatatattttcgtataataaatttatattccttataaattatcgtcaaacttcatattaccaatgtttatttttgggttaaaatctcacactattttttttttatacttcaaaactcatatattttttgaacaatcatgcctccaatatagaaaaaacaaaattgacggatacaaagaaaaaaaaacaaatttgacattgaatataaatgcaaatatttttttgaaaaagtagaaaaaataaaaagaagatggggtttaaaggcgggaccggtccgtcatcaatgccacctccctaactcctttctctttctctctttcagctacttgcaacaaaattgcaaaattgtcgacagaaacttctctcaaatttagttcctttctcatttatccactgctcttaatccaacttcaatatctctctatcctcacaatatttgttctgtttctccttcaactttcaactgataaagtttaaacctttatgctctttactctctgatctcaaaagggttttgtttagttctcctcaaaacc

SEQ ID NO: 3885 - DNA, 1596 bp, Arabidopsis thaliana
gcaacccctaagcccacctccccaaaaacgaaatcttgtctctcgatctaccacatttatagaaaacttgctcacaaaaaccagaatttggggaaaagtaacggaattcggaaagcccagatagaattgagaggaaacagaattgaatctctaattctggatttaaagtgacgggaaggagaagatcaaacgctaatctgattcaggattagggtttgagagaaatgaaaaggtagaatcggatcagatcttgcgaggggcgagtagaggcatattgtgaggtttctttggaagaaaaggtggtcgatgatataatctggatgccgattcggaagaagaagcaaaataaaaatcggcgaaaatggaaagggaatgataaaaattaaaaagacaaaactaatcgcgaaacacaagggactttggaagtctttggttcttgcttcaccgttgtttttgttcagaaaggacgatgtaaaaacggtgtcgtttgacaataagtactactgtgtgtaaagtagatagatagatactctgaactctgaatactaggatattataacaatgtttagttcgtacgataaaataatggtttagacacaaccgtttatgtttgggtcaaagttacaaaatttgcgtcacgtgagcagtcgactgaaaatcgaagatagtcaggcgtcagtaggtagaccgagccacaactgtagtatattgtattagcaatttagcatacgtaacgtacaaatacttgttgttttagtattttggtgatgttatcgttttgtgatttaaataaaaaaatttttgtttttattcaatcaaaattctaaatttttttatcaaaatttgatattactagtttaagatttgtaaaaaataatctaaaatcttcataaatctgaagttattggattcatacttttataaaattattttgaaaagtttatattatttaattaaaacaaaataaagtatgattgctaattaattaaaattattgtattattgatttatgactttctaccatttttttgtgttaaattctatcattttcttcacaaaataaaatcatcaaaataaagaaattgattgaaaaagtttcaaaattataaaaaactaatcaacaatattatataaaactctgtgtttaaaataattcatttatttacgttcgatgatattattaaagttaataaagtttgggatcactaatcaaaattcatttccgagtaaaaaacacagacatcacatcactgtaacttttgtaccagcgaaacccacattaatattggggttgtttctctttatggcccaatggctatatcttcgttgtaactaggtcacgtgagccattgacttttcgcccaatatttaagcccatttaaaggcccaatatttaagcaacactcatatacaacatgatgataaaattaaaaccgttgaagtatgtaattaagattgagatgacggtggatgtgtgaaacagctgcttccggtgtgctagtgccccgataggaccaaagctgagaatataattgaatatgtggacggttgagttataattaggagaatctcataaatattattgaaatatcaacg

SEQ ID NO: 3886 - DNA, 2000 bp, Arabidopsis thaliana
acatctcatatctgtgttcaaaatcaatctttttgttcgctaattgttgacataaagagtctccatttcacaaacgtttatgatcaacaatttcttgtacaagtaaaagatcataataataagtaacctacgggtaggcaaactgttttttggtttagggttggttcagattttatggttttttggttttacaaaaactgaaaccatatagtaaaaggtatagagactaccacaacacaaagagctgtttaaaagacttattcttattgataataaacttttgttacaagtattatctcagttcttacttgatctaatctacccaaaagatcaaccccgactaagaataactaagctctaattctcttctctgttttttatcactaacccgtgaagacgaagagaactacacactcaccttcaagcttttgcacggctttgaagtttttacttagtatcgaaaaatatcccagagtgctcaaagcggctcaccctctgctctagaatatttatatcaattccccagaaccctaaccttaggatctccgagaatctcttgatatggaatcttccttgtttccaagcctattcctttctttattcttcgatataatatcttctatattttctcgatgaaccttgtctttgacacctctccaagttaacttccatccttggctcttcacatcattcgccttagcttgccacgtttgctctcgcatccatgtctgcacatcaagcgtctgatgaaacctgatgcagcgtcctgaaatccatcaacgatctgatcaccatcagctgattgattcactctgcatcttcatatagaaatcgtatgtaatttagtttggtcaaactttcggtatcatgaatcatatccctagttgtaactaatggcatggttctcaaaaaattcttatacccaacaagaaacatagtgcattatgtcccaattgatgtatttgttcaattggtttcatgaaacaatacaacgattgtctaaaattgggtagggaagagtttaggcctgacctgaatatttgctgaataaggcttgggtcaaaacttttgtaactgggctttgaacaccttattgggcggaagtttgcaaagcccaccagataaatatttgcttgatgagtctctaaaagtcttgtaaagattgatatttaatctatgtttatggttaaggttatttcagaatattgtggagagcaagtaaaaaaaacaaagataggaaattatgatataacaaatgtggatgatttaggtttaggaaatagcattttgttcaaatatgtggagaatacaccataaatgtttattttcttatagttatccaagaggttaaatggtttaggtaatcgtaattaaagatcaatacgctaaacatatgtaattattttttgcgtcagctggattttattatgtcaatttcaattacttaaatcctaatgccataattcagtagcaatttaaataataaaataaattaatttggatatctattcaaatgtactgtctcttcgaagataataatcaaactttaaattcaacaaatatcatcaaagcatgaaaattcaattgtttccagctacgtattaatagctttaatgtggaaaaagaaatattaatagcttttttcatggaaaaaagaaaaaaagaaagaaactttacttttaatagtatatttttgtctgagccaataaaagaaaaataatattttggtttaacatatttgtccctcgtgatagatttgattcgttcgttctccttctccttcattaaagacttcacgatcccacacctccacacacattgactcacacacacacacttctctctccaagttcagaaaaaccaaaaatgggttcttgtcggaaaaccacttctggttttcagcaaacccacttcttgtaataaaacagacaaaactagaaagaagcaaaaaagcttcgttttttttttctctttctccaaaaaaaaaaacccccccaaat

SEQ ID NO: 3887 - DNA, 1803 bp, Arabidopsis thaliana
tcccattgagaaatctcatgaaatagagatctgagtttattatatcaatcaagatgattcagaaatctaaaacatattacataaaacaaagacgcttagtaggaaaacatcagatcaagaattcttgtattcttaagttcccaaaaaaagaaaaaaaaaaaaaaaattggtcagaaagagagatgatgtcttatatccctcattttttttgcgttactcaaagggaggaaaaataaacaattaacaagttctttaattttttcttatgaatagagataccaatactaaaaaacgttggcttttgtaatgaagaagttttagtgataatataagttaaaattaaaagtgtgtaaccaattagtcttttttttttccgtcaaaaaaaagaaaaaaaaaaaaaagactaattggttacacacttttaattttaacatatattatcactaaaaccaattagtcaattacacaaatttagtaataatacatagggtctctaatatatattaagctttatataaactaatgaggaaatctgtaaaaatatacaaataagaatttccaaagtagatcctatgtaatttcgaagcgtattactgtgcataagacagtgttaaccaaaaaaaaaaaaaaacatttccgagatgaactgtgttttgtcctcaccggataagaaagtggaagaatgaaccactacaaagtccgcgtcgaaagcactcagttataaaagtaaaattgacatgcgattacattaaaaataccaaactcgcttgtccatttttattgatattgcttgctaatggaagccagctacatgtccgctttcttgtttgactttctttcttttctctttgagttctcttcaatattaatagatgcattttatgttttgcttcttctgagtagcatcgtgaatcaagtcgccattatcttattcagcactaatataattatatatagccagaatttctaaatttcaagaatgtagacaagttctagaaacgccgtccacagttccataaattctagctagttttctgtaatatttcacataacgattcatagacttttctgttcagacaaatatatactttgcaaaacagaacatcaagctcagtagctcacaaccaaaattctctgtccaaatttgaagtaacggaacctagtgtcttgctgggtttgagacttctcaatcaccatatagtcagaaatacctatgaataagattatcttgatgattttttaaaaaaagattttcttcgttaagcttttcttttgtaattagttataaaccttctcactttcaatgaaattcacattcatataagtttaaattttaaattaaaatattggtcagctatagactatagtaagtatattaaataataataacattttttgtggacaaagagaattcgggttttggggttttggcaaaggaaagaaatggtcatatgtggaacactacgtgccacttttcatgcaataacatgcaaatattaggtcagccactaggaatagaataagttgaatagttttttacgatgataagagtaagcgggaagccataatagaccactatcccaaaactttaatctgcttccaactcattatgggaccaactaatacaaaatgatatgtattccatgttccaaccactccaatacgaattacgaagcaagcgtgtctcagtgtctgagtgcgactgccttctctctatatataagagatatacatagtgaattaaacatcttaattatactgatctttatcatgttgactagatttaagaaacaaaataataag

SEQ ID NO: 3888 - DNA, 572 bp, Arabidopsis thaliana
ctgctttagtttcttctgttgttacttcatagttcaaatgaaacgatgctgtttactaacttagtcaggaaactattgtcgtacaagtgtttctttaatgtgttactacgtttaagccaatatagatatctaataacttgtcctaaactaaataactcgcactacatgatcattgttattattaatatagatttatttcgatttgaaaaatcctaacacgacatgatcatgttttcttcttctccttattatatgtgatccgtatcaaatacttaatcattgtttacgtcaatgcttgacattaacaaaattatcattaagctaaacagataaggacgcgagagatagagatagatagtgactaatatttttgaattatttaatgcagtttgagagaaagagacgaggaagaagaagaagaagaagaaaggaagtgacgaagaaagaatgagaagacgaagaaagagaaaacaagatccgattcaaaatatggaaacttgaatatcttcttcttcttcttccttctcctttctcatctctcactttgagggtgaattttgattttgtagaaa

SEQ ID NO: 3889 - DNA, 1810 bp, Arabidopsis thaliana
tttttattctattctctatcagtcttcgtctccttcttatttgctttgtctttcggaattatcttgtttgtgtctgtgttttgttgcgcatggcttaaacaagaaactacatcccctgaggcaaaaaaaatggctcgtttttttggagcctcttatggagaaagggggtttatggggagagggttttctacttttaaaataggcttttggaagtttctttttcttctaggaacttgtgtgtaagagaaacaaatatgtaacgaacagaaagaaaaaaaaaaaaaaaaaaaaaaaaagagaatgagatttgtgaataacttgatgaaggacttttgggactctgggattataagagattaaagagggattatacctcatggctctcgtgttttctgattctttttcgtagttgtgttttctttgattttgtttttcatctaagttttaatgtatatataaaatttcaaacatggctttcttgtatttgtcaaatccccaaaggtacatatattatcaatatttaaaatgttaaataaacaaaactctagacctaaaactatttcaggttttcccactaaccttaacaatgattcaagattattgatgttttgtctgtgaggacatgtatgtggccgctcttgccaccatattcacaaacgtaattgtatgaagtatggaccaccttttcgctactacttctggatccccttatgtttgtaaagtgtatcattcccttatatcactattcactcacatgcattaaaatatcgaatgctgcaaaggaaaaaagagttatttttctctttagatatcatttgggttatgcatattacttggattagtccaatatgtcgtgtacaaccattctcgctgcaaaacaactacaatatgtcaacatagtataacacatgctgatctggtgagattataaattgtgaagtttgtctttataatatgtacatatagtatttctttgattatgacaagtgtgtagaaaatgttaggatattattctaaatcccacatacgaaagattagataatgattatccaacatataagttcaatctaattttaattagtgtatcatttggggaaaaaaaatcgtgcatatctggttgcttggtccaaatatctatattttctgacggtccaatatttatatacgtaccacataaatacacctatacgaatctctttactaatacgtcgataccgttcatagttaatgacgttatttactgccgagataatgaagtgatgatgtaggttatttattgccgagatttgtgaaggcagtggatctcacaatccctatcttttcctcttcttttttttctttttttctttccatatatagagaagtttaaatttaattgtaccattaaaagctcaccaaataccaacttatacatacagtcagtatctatatcaggaatttatatgtatgtgtgtataccgaataatagtaaactcattttactaataaataactttgttttattatatatttgataaacaacttgttataaattattttaatatgttaaatttgaacttattaaattttaagtaatattctagtgacggaagtatacattgtatttaaattgcatagatgtaattacttattttaaaaacttatagcactattcagtgatttacttttccaacctaaaatcgaggtgtagaatgtctactctggaaaaaaaaatcgcctataaaatatcaatatcaatggtgagttttgttctatgtaccaagtttctctaaaacaatttgtctttctattaaaaataaagagtaccacg

SEQ ID NO: 3890 - DNA, 477 bp, Arabidopsis thaliana
taacatttgagcaccatacctcaaacctcgagacgttggtttcacgcaaaatcaccttttggagttttttttttttttttcttataaacaaactaaaaaagttttggatactttttgatgacgtttcttacagaaaacaaatttatctttatcttagtgacgttttgttatagcacattattactttatgacctgttttttttgttcctttgtcaatgattacattgtcttgctaatattttcatacagaaattttattttatattctatgatattatcctctcttaaaagctggacaaaccccacggaccacgagtcttccagctaagactttttttagttcccaaaagatcgaacttggcgctactttcattttctcatctctgtttttccaacatcctaagaacagagttcgttgctccttttgttttctttaaagaaaaagtcagattcagatacatacatactctgaagaac

SEQ ID NO: 3891 - DNA, 1379 bp, Arabidopsis thaliana
gtttcgctcctccttaatctcacctttttctgtgattctaaacaaaaacggtaaccgaataatttaaatcgaactaaaccggaaatgctaaaactagaaaatcgaaacagattaaaaaattcgattggtttcagtaattgaacaaaccgagatattcgtgtattcgatttcgaacccttgttaaaagtttacccgagcaatggagcgaagaggacatggtcgtattcagtctctccagtgtctcaagtccgagagaaaagtctggtcctcttagtgaaccaaaatcaattttatattgttgtcgatttattacggttcaatatttgagatgacggtattaagcacaggttttgtacggttcaatttcggtttaatcctgttttgtaaagttaaaacgtaaaatcccaaaaccgagaaacttgtccttgtctttcttttcttctccaaaagagcttgcttagttacttgctttcctgaatctgatccctggttcgtttctcttctctccttgttaaattaagagttaagtaagtttggcatcgagtgtctgttgttgtgatccttgtttattctcgtagcaatctcactccaaagcttctaagttataatccttattttaggcatttacttgatcccaagattggagtctattaactagattatgcctaatgccttaagaatattaactttttttatagctatagatatatattttcccatatttttaggattaagattagggtttaatgattgaataatatagttatacaagtgtgtgactgataaaatgaaacaaacgaaaaatctttcccggtgacatcatcagccgccggcgactagctttctaactctggtttgcaaattcaaagggttggttggtggctaattttgaacatatataaatgtcattttaaaatatttttaatttcattttcttaacattgttccaccaactcctcccacattctctccgcctctctcgtttacaaatcccacctcaaaggtcgactctttatctctcttctcaccaacccaacttctccaatggcttctcagagttcagtcgccgtcatttcctccgccgccgccagaggtgaatcattcccagattcaaagaaaccaatcgggtcagttcggttccaacaacccctccgtctctccttctcgtgagtttcgtctctattctaatcttcgattcaatttcgtcacttttgagcactcttttgattagaaatctgaatcattgctccaatcactggtcaatgtagttgacttaggtctctgtaatggttaggtactgtaagtcagggaatatgtcatctagaatctgcgctatggccaaaccaaatgatgctgagactctttcatcatcagtagat

SEQ ID NO: 3892 - DNA, 2000 bp, Arabidopsis thaliana
atacttttccaccatccactgattaataaaaagaaagtagaatctattagtttcatctctttggatacgcaaatgtgctagaatctattaacgagcactataattcataatttatctagccagttattttgaaactcttaagatattttggttcattatggtttaatcttgtttaaaccgattaaaaccgattaccatgcaatattataacgatcagttgtatgtaaaactcaacccgattactgtaaattcaaaataaatgacatgattttatgtgtttacataattatgaatatatttaacgtttgagccattcatattgcatgatgttaatctattgcaatttatgcagaattcatctcaaaatattaagtttatagcttcaaactagtagagatattttctatggtgaatttgtgactgcatatatccttctgaggttaacatatcatgtgaatgttgaacttacaagaaaagacacaaaatgtgaaaactagttgtctttataaggattgcaaaccctttgtgtcaattgtcaaaagataacgcagatgttttatctttctaaaagtagcctgttttatattgaaatctaatgactttttttaatgaatacttgagtgtgaaggctccagcgattacggatgaaaagtgaatgtttcaaaagtatgtggatcaacatgtaattatgttagaattttgtatatatatattccaagaacatattgtcctgacatgcgtcaagtacttagtgatttagaattaatatggaaaataaaatgacgcaacgatgattatgtttagtagagactagagagaggtggaacttttgggtgatgtcgttgtcgtcttcgtgacaccaccacgacaatgtttgtggtaactggtcaattatggtgacctacttttttgtatgtttttcctaacgagtcaaaacccgatattaacacattcctctaaaaacaactgatattattaagctttcggctttgattagaagcatatttagaaatggttttcgacgtgaatatccttatcgtttatttatcataccgatggataaaacgaatagttgcatgaaacacttggtctaaataaacatacggttatagttttaacaaagtggttgtaaagacaaatggtttacaacaacacttggcttttacaacaaatggtttacaaaaacaaatggtttacaacaaatggtcattggtctagtagttttgtattttcatttgagaagaattgtcgctggagactagtgatcaactcctctcaaacacaaaattatcaaaatcattccatttagtcagtcgaaatggtatcacgatccattagaaaattcagttagttagatattcgactcagttataaaaaatccagtaaaaacggcttacatacttgttataaaaaaacccctcttttttttggagaaatatagaaaatattttaaattttcaaatgagtgaaaatattttaatctttgaaattagcagtattttttgctactaatgcatactgatatgtatggaatattaaacacagctaggaaaaaagtgaatgaacctatgttgaaaacatttacctctgagctataatggtcagtaagaaattaagagttattctctcacggattcacagtacacccattataacaaaagactagtcttctctgaccttcttttgttgccacaagaaaaaaaaaggtttcgtcaaaaaatttcaatttcatgatgatgaaattgaggaattacctgaataaattgtataaagaaagcattatgattttgatattttctcaccataaaaccaatactgtaaaaatgatacaagttgttctggataaaagggtccacattaaatttaaaaagcccactaagaagtccaataacaactccagcgtatgttagcattggatcgtcaaacataaacatttcctttcttcaactactactctgttttcacttttcgatttgagaaaaaaaaaaacgatcacgaag

SEQ ID NO: 3893 - DNA, 780 bp, Arabidopsis thaliana
gttcgaggtttattgaaaatgatcaccagcttctaactatggtatcttcttccctgcaagcgaacagtggaagatgattgataacggaaatatcggaacatcactcaacaaaccaaaaatttggacatcatatcgcaacaaattcaataggaaaaatactgaaattccaaaacagaaaaaccaaacggaacagagcaggaactcacggactgagagagaccgtggacggtgtcacggcggaaaatggtcttggacggagttactaatcggcgaattgagatttgagaggtggtagtagaggaaccgagagaatgtttctctcaaaaaaatccccaagtgtttccgatctagtgtctcttttgtccaaaaacgacagtgtttaggaaacctaggagaatgaatgacccgatggtccgaatccgattcgaaattggttcgaattgtaataactaacatacaatattccggtttgaatgataagaaaaaacacattcgatccggttagaacaatatattaacaggcccattaaaacatatgggccgatcttgatcaactgggctattcatcgttgatacatgcggccgcacaggattaaaatccagttccgttttataaaaggatactagtttccaaacgaacggtggttgtctcctttccagaacaatctaacgctttctcgaacatcttcttcttcttctttctcgaaattatttttccagtaatcaatttcttctcttctagatttttacaggaactaattttctgctctgaggtatcag

SEQ ID NO: 3894 - DNA, 1741 bp, Arabidopsis thaliana
tgatggagaacactaaatcgaaatcgaaataaaccctaagagaaagctaatcagatgacgaaagattcgaactttcgatgagactcgtcttgaatctctctactggatttgaagaagagtgttttccttatttattttagtttataggacgaaagtaaaaataaaaggagatttgggagaagatagtaagtcagggacttggatgcaaactacgaatatttagagacttacccaacaagtcaggatattaaaaactgccccgaatgtatagctttattatgattttagtctcaagttttgtgttattgagttatggatccaatatattttgaagatttacaaaaactccttattgcttttacaaaattggttggtcatacaattttaagttttaggagcttttaggataccctaattgctaaattatcatcatatcatatcaataaaatgtgttgcaattcagaacataatacaaagctttatagagatatgcaaggcatcatagagaaattaataaacttacagtcggttaatcaaattttataaacaaaattatcataaatcgattcagctcattacacgaaatggtaagcgtaaactatgatgatggtgtggtcgaccattagctcgattatgtaacaaagtcatctagttatttagcttataaatcatttcaagatgtaattcaaaaacatatgcattcaattttttttttagttatctgtttatcgtatcagaagttcaatgaaaatagtgtatgaacaaacaaacacgattttagttatttatatttattgttcattttaaaattatatatatattagttttttttaatgtgtaaattgtatttaatattttcaaagcaacaatttttagtattgaaaaagatttggtggtcctaaaagtataactttttcttttaataacattatttggtactaaaaaacataaagaaaatgatggttctaatcttttggttaacctgcttgtttttctctagagaacatggctaatgtatttttttcattgtcgatggttcaaatttgaaacttctcagacctcttttcgtttacaaggtcagaaattcaccggtcaatctattgattttgaataatatgtacattttatataagctttagaaagaaaaagatttgtgtccctaataaataaggtcagttggtatgaagcagcggcaatttatttttcttatgtagttgtatctactaatataaaactacataaatattacttatgagaaaagaattcatatgtaccataataaaatttattgcacatcattcacctaccgatcttgaatgaaaaaggcagaattagagcgcacaaccgcaacatttgcactgcctacctacctaccccatccactcaaccggaaataacaactactaccaaaccacttaacccatcggttcaacattggcacatatgttttcaaaatcgtacagatgaataccataaggccaaaacagtagagcagcaattaggtacagactatgtgagaacaaactcaaaatcaattttcattaaaccggttttcaaagcttccaaaactcaccaaccgattactttgagaacgaaccaaattaaaccggaatttaactgattcgtcaaatggtctttaactcaacaactctctctcacactcttgtataaagttttgagctttaagtctcagagtcaggttttggtgggttaattctggtagacaagaatcaaacaaaca

SEQ ID NO: 3895 - DNA, 1963 bp, Arabidopsis thaliana
tttgtgatgagcttccggtggcaacaaaaagtggcgggaaggccatcaagtgtacgtatgaaaacaaaatctaaaataattggactaagtctccaagcacatgtctttactctatggcataataataataataggaagtctatgtggttaccgaaatgtaggaatcccacttccttagttgttcacttgtttcttttccacttccacgtttatatgagctaaacttcgattctagtttaattaatcttttggctctacaatttggtcaattggttagcatccagctaatgccgtcaactattaagaaaactccaacaaagagaaatcaaaagagatgataccaaagaaacataagagaagaaagagagagacatcgtgatgagaaagattggagattccaaaggaatcgaaagaacaacaactatttggtcagagcctttttttttttttttgatcagatttgatcagtggcttaaaaaacaacaacttctacggtctctcttcgctgttctagatttgtttatctgttgaattatattcggtattgattaataggatctcttcgtttcatgccactttcctaattttactacggtcaaaagtgtcgagtatgaattttatgtttctaatggcaatatgttgtatgagtgttagcgatctgtctactagctagtttattgtttcagagttatctgagttaatgacatattatttatgccactatattttgacatattatttatgccagaaaaaaaaaatatatgccactagcttgttttctctaatttaatactgttttaagttctcaaaaatttcaaaaactacaagtcaaacttttctgtaatgcatgttacatacataatattttactaattaattttatttttatagtacgtcttaggtacataatcttttgcttattagttggactatcttactataataattattcgtgaaagttattccacaaatctatccatcggttgcttcatgagattaaatatctccgctttcgttttaaatatattagccggactcaacatatgtaagaaacaaatataattacatgttaagaagttagtaaacaataaattaaaaaataataattaattttaaagattaattttaagctcatatattttgatatatgtataaacttcgcatattataatcaatatattcataggttgacgcatttacaatgttaaaataagagaaattttgaaaaatcctaataacatttaattattttattcagaacttttcatataattctccttaaatctacatagattcctttcagatatcatttacaatttttttttttgttaaagcagatatcatttacaatgttcaaatataagatatcatttacaatgttcaaatataagaagaattttgagaataccaacaatatttaattattttattcagaagttttcatatttttcatatggttctcctaaatcaacatagattcttttcagatatccggataattcctatgcacacatatttttccaatttatttcctcatcagaaacaaattaattaatttcaccataaaatctcataactcataagagtcacaagtctactaagaaacaaataaataaatacttatatgttgccgtgtaagaacaaatgccaccaaatacgcaaaaacgagtgtggataaaacgtgttctccacccgccaatcaaattccatcaaaatctcaatgcattcctcattacatatctttagattaccatccaatcataatcctcaatttccagttctactaaaccggttttgacccgatttgatttttcagcctcaaatctgacaaatcatattcacagcgatctccttcttccacatcgcaacccaatccctctctgtctcttcctcaattcttattctctctcgcaaaggtttggttttttgaagacagagaggagatttgagattttgggtttca

SEQ ID NO: 3896 - DNA, 2000 bp, Arabidopsis thaliana
aatacaacacaagagtttcgtcggaagagtaaataatactcaaatagggggtgagtgatacgagccacatgtattcttgaagggtagattattgcaaacttggagtaataaagagaagaagaatgggtttgtagtagttgcgtggagtatctttatttgggtaaaactttaatttagaaataaaattctgtacggacaatggatcgtgtcccaatcagatttcttgtggctgcttcgggtctggttttgggtccctttgaaaaattttagtggtcgacactttttattttactctggctcgtgcctcgagggtccctctattcactgtttcttcgtatgaaggtatgcttaaacattattttatttttaaaaaccctttaattttattttcttacctttaatcacggttttgtaaattgctttttagtctatggaatgatgattgtggcgattgaaatcatatgtttggttctgttgttgacgttggtgaagtatatgtgatttgtaatgttgagcttatgtattaaaatgttaaatgataaataacctcgtaagaaagtgatttcatttaaattttattttgagttacatattcaattggttttataaaaaaatacttcagtgatgattgatacccccattgtgtgtgtaattgttactgggattgaacaaaatttatttgtgcatgacaaactttccaaattagtgcatagattgtaattgtataatggactacatgtatctgagtagatatggttcattaggttacaaacctctttttttaaggacacaatttttcgacaagttatatgccacatgattgactactaaattttcaaaaattattgcactaatgtctttgaaattaacaaattattttgtcatttccgagttggattcttacaaaccaaggccgaactcacaaacttatttctttcagtaaaaacaaaacattgtcctcagaaaaattctgaaatgtcatcttcccaaatgtttttacataaataaaaataatatacagttgatattattttgttctttctgaattttgttatgaggtaccattaccatatagtacgtagatttacaaaaatgaaaatacgttgtagcccttgatgttcttcaggtcttctagttagtttttgcagtaaataccaaccaattagttacaaggagtataagtgaacaaagtgagacaactcattttatgcttccctataaaaagaaattccccactgacccaaacacacacttctcttctctctctcatctcattggagacttataaatcctattacctcaccatatccaataaccaccacacacagaccaatatccaaaaaaaaaactaaaactaaaaatataatatatatcgttttctttccaaaaataatcatttaagaaaccccatcatcttgatagtattataaaattaataaacctctccctgaaaatatctcatccttcaccaatcaaaaccttctcatgtcttcttctctcctcgacctttgaggtggaaaattaaatatattcccttagctttttttctcctttagttttcttcttcttcttgagttttttttcttttgatcctctctaatttccttgttgattcatcgactagatctaattcttctcacaaaagactgagtgtgttctttctttcaaatctttcaaaaactagggtttttactgtcttgaaatcatatttattcttctaaatttagcaaaaagaacacgatttactttccatttcagtcgtcttgtcactctctctctcttctttaaagtctccctttttagcaaaaattctctctctcacaaaatttatttcctctggcttcttcttcctcctcctccatctcttctctttactctctctttaatcatctctcattcttgaatcttgatccatcaaaatcaatcccgttctcgaaagatccattaaaatcaaaacctaagctctctctcttgcttctagggtttttttgttcgttgtg

SEQ ID NO: 3897 - DNA, 345 bp, Arabidopsis thaliana
ttccaacaactatatggatgtgatagaatatttttacattttatttttctgttattcacttatacatttggatgtgatagaatatttttttctgaacacacagatcttatcttcaccgatatattagctgaagcctgatacatttacattccttatttattttttattcacatgtatgtactaataaacaaaacttaaagactttgtattatgcgttacgaatatttttcgtcaggattgaaaagtcaaccctaggcctttagcttccttcttttatataaacagagaaacaaaacactttctttctcagcctctctgtttcatcttcttctctaaactctcaac

SEQ ID NO: 3898 - DNA, 2000 bp, Arabidopsis thaliana
actattaactatgaacttacattcgtaatattcgaaaatatgtgcgtgagttagtcttgtcacaagaaaaggaatcatattctttttttcattaaacaaaaattggaaacacatattatggtataaatcaaaagataattcgattacttgccccatttgcctgctttactttcaatttgataatatcccatcaacaagagtcttgttacatgaccaaattttcttctgttctcacgttattaagtattttgaagtgaagtgcactccaaacaaacgtctaaaacttaaggtttgtataatcctcaatcaaaaacattttacaacttatttctatttttttatattggggtctttttcccagctactaatatacgatcacttaagtaattttttgtaaaaatcattaaaaatcctaataaactcatttgcgtagttcaattacacacatacatatgtagtaatataaatattattttccgttttaaattatcgtaaatggaatgtcatttagaattttaattttattcaccacaaatgtttttttctgttttaatatatttgtttgttaaaatttatattttcgtcgctaattagtccactgaaattataatccacaggctagataatccactgatttcaacaaaggtgaaaaaattatataactaatatttgtccattagtagtagctaattaattgaaaacgtttgttctctgaatcgaaagagctgcataagagaaaggggacacgtgtcaaaaacagagtttaatatgaaagcgaagacaatgattctgttttgacttatttgtcatttgctgagctgtctttagaggcgccgagtagccgcgtctcccgcaagaaagttccaaagcaatacttcttctttcattgcattcatttccccaactgtctcaaactttgtgccgcataagcaaaaggtacaaataaaataataataaaaataaaggatggcgaaaacaaaattacttgtatcaaacaagaacattttgttaatttttccgagtgaaaacatcacttgatatggatatgcgattttagttgttgtaagtttctctagcataattgataattcctattaacatcaattttgatatagcattaggacttcaatgtttttatttttagggtttgttctttttgacttcattagtctagtggtactttaagaccactttttcacctcacacatggatgatccagacctagtcaagctaggagtgacttttatgtttatataatttatacatgttaaattattttagttttcttttttaaaggagatgaatttaattcggtgtggatcccgtctctagaaaatatagggtctttgggcttgaacttccaaatattcgaataacaaaaaaaattattttagtttttaacccaaaaagaaaacatttgcgatcaaatgttattgtaaacaacgcacactaaaaagacatttacccttttcggtgaagagacacagggacagctacatgcgacccaaaaaatgagcttaccctctatttcacatatgtaagaatatactctaattagactcagcatgtagtataaagaaggtgttgacaaaaaagctcaaataattcgataaactaacaatgcacgggtactaattaacaaggaattctcataaaattgaaggtaaatttaaacaacaataagagcatcccaattaggtaagagatttagttaagtaattgcgatcaaggaaacaagtacaacagaagtggaagtctgtctctatatcactttcttccctgatgcataaacttacctcttgttcacaaactttgttaacattttgataatgcaatgaaatgaaattagaaattcaaaacaaaaatagagaaaagtacaaccagtggactatagtccaattagtcaaccaaagtaacaatgggccgagctgataatatttaggcccaaaaaaagcctctggacgaatcagagacactggaaatgaacgttcttcttcgca

SEQ ID NO: 3899 - DNA, 1366 bp, Arabidopsis thaliana
atatgttttttttattgacttggtttattgttataattatgcttacgactttgtctatcttttttgcttataacgtggtgtactactttattgttataattatgcttatgatttctcacaaaatttaaaactaacgcagcggcggcgaaacgaacatagagacttgcggcagcggcaacagcagcgacatccaaacgaacataaataaagcgtcagcggcagcggtagcggcagcggcagcgacaacgaaacgaacaacaagctgcggtagagtttcccgccgccgctgccgctgccgcctgcggtgaacaaacgaacagactaaacataaaaggatcattagcgattatgggtgctaaaccaatataatagctggccttcaaaagtgggtgaatccgtcactaccaaggtacttagtcgatttcgtacactcttatcaatcagttttacttatttcttttccaagttctcggttcttttataggaatattgcaacaaaaataaatgaaaatttgaagaagaaataagttttttttgtgtgcagagaagtagaaataagtgaaactattttatcacaacaaaaccattttaaaacaatcagagattgataaaaagttcaaagcccagaaacaaaaacaaaactacaaattgtgaaactcttattaatctgacaaaacaaaaactaagtacctggtctctagatcgaattcgagcagcaacaagagttcgaagccccaatctcagaagacagaacccttttcatataataaatcacaaaagcaaagtgggttggtttagtgacagttggtttgattcgatttactagatttgattggttgacacattatagttggttcaattcgatatgagattcgaattctagacctgtaccatttactattcctctagatttagaccataaaccggcagttttcattttcaaaactcgaaattgatcaataattagaagattttttttgtagatccgaataaaattgaggaatattatattgtttatttcttaacctctagcgttctaaaaattcaaaacagttaacgacagctcctgcgacaactgtgcagtgacaaaaaaaagaaaaaaaaagagttaacaaattattgcccctctttctctatctctcttcttctcggtttctccgtaagcattcagagttctgcaagtaaggttagtctctgtttctgtttcttttcctcattaatctaaatgcttcaaaaacaacatgatagtgaaatcgaatctaggtcttgtaaatgcatattgaattcgctctctttccatttttaaaatcttgattataatctagtaattgaattttgatctgtcaaagcagagaagaaggaagct

SEQ ID NO: 3900 - DNA, 2000 bp, Arabidopsis thaliana
ctttttagctttatctgatatgagtgacatcccaattatcaattgtgacttaattagtaacctgtgaattgatggatatgattttgcagtttcatccttctttaccaataaaggactggatacaaatcttgtggacaaagttcaagtgatgacctcagtcttacctgattaatccctgctttgtacagtcatttagggaatgtcacagtcgttttaaagggttaaaagtttgaacctaattcactattaactaaatccaagactgatgacgaatcttcctgatagaagaaactggaaaccaaagtttggtgttcaccttttcatgtccaaacaaagccacaaaatcatatgatcattggttagaagattatagtaataaaccacatataaaaacctgattaggttaaacatcatccacatctccttgtttatatcatcacttggatccaatcaacgaaaaccttgctaatcacctcagatcgcattaatcactaatatttttcatggtattaagttccattgtcatatagatgtctcttgaaatggtagcttaatgagcaattttaaggttatggatcaatttcttttgatatttggtcagtttttttttattccaagtgcaatcgaacctgcaacttctactagttttacatccaaaaactcggatcttcaaccacacatggatttaaaggttatacttcattttatagaaatatgcactaaacataaacgcaactatatagccaaatctctaatcagtcataccaattttgcttggatgtttggaaagaagatcaaattcaataaatttgcatagtagaaacatacatgagacctaccccacttgtagtatttgtttttcctatttgaacataagaaccggtcacatgtcttagtcaaaacataaataacttgtaacaatggaagaagcatgaaccaacaaagttaatatctctacatcacacaactaaaccttggaatgtcgttgacccaacaccctttctttataaaacaatctttacggaaattctcatccaacgttagccactgtatctctttccaataataactcaaaaaaaaaaaaaaaaaaaaattgtattcctctcctgaacttctgtattgtatgttcctgcttgaattctaaatagagagagatagatgtttgagagtctcacgaaatatcaaacatcatcatatttagttttgtcatcttgtacttattgtaataattaattaacagtgacacaacacaacttgggtggatagtagctatagatactttgtaagaccgtgtcccttggaagaaagaagagggcagaatctaaggatggcatcacacaatacgttttctttgtcagccttttttgttgttcaccttatttccttcaatacatttccattttatggtgattagtctgcgttagtgatcgataaaccactaaccaattttttctcgctctgctcttttacttaaagaaaaagaaaactacaaacgaagtaatggatcgtctaatatattatttaagccaaaggaggagacaagttctattttagatcaccgacatcaagactgatcaatatccatatgcaacccatattgtcatattgcacgaatcatacaaaataaacaattaagaacatgatataataatatttctatgattcaaaagaaatgtttctacatataaatgctcattaaaaataataataacgtgaacatgaacgacacattggccgactaacttagacaaaggcggcatgggctcacgtgaagccgacctttctaaaaaatctccaagccctttaaaagattcaaccatcccctaaacctctctctctcactccaatttctttcattaccatataaatacaacgccttcacatttgcactctttatacatttctctcgagagcagaaacagagtcaccggtaaactcatctccggcgacataaaaacacaaaagttcatatatttagattctggtgactctctgctcta

SEQ ID NO: 3901 - DNA, 590 bp, Arabidopsis thaliana
ttcaatcaaatttcttcgaaattgacaaaatcaccggagattccagatgccggagatttttttgttccgataagaaaacagaaattattcaaatcggattgaaattttcgaaaccctaggcgaagaggaagagaaaaggggaagaagaaggaaactagccgttgagtaaatgcttcacaaagcgcaacggttctcttcttgtccgtgaaacgataggttttttttttgtcttgctttctcgattaaattaaattaatcagataagataagcaagattaatgttttgaaaaaaaagataagcaggattaatgttggtgggcctattaatattgggcccaataaggagcgtttgtgttctttaaagtaatgggttataaatgtataaatgaaagttttgttggatcattttgcaattgttttaaccttccgacattttcctggatagactgaagaaaaaagttgggagtgaaaaagaggtgaaaagaggagactttgacttcttctgatgaactttcttctgcacttcttctcattaagcctccttgttaaaataatttgagatggcgataggaaacccagaagtagcaact

SEQ ID NO: 3902 - DNA, 2000 bp, Arabidopsis thaliana
tccggtacgatggtctctagcgagttctcaagccaaggcggacacgtcctcttgtcactccacctccgcggcggcaccacacccgcagccatctcttctaccggcgatttcacaaccgcagcttccactgatgcaacatcattgatctgaatcccgccgattacgacagttgccgccacccccaagacaaaagaacacttgtttttccgtggctctgtctcattttctgttctcctactaaacaataaaagaacaaagatcattgatatgaaaaattatcaggtaaataataacttttcatgaatagaagagataccaagagatctttgacgttgtcttgagcagtgaagctaatgattgtgcagaatttgaatctaggggaggaagatttagacagcagcttattctccctgccattgttattcctctgttttcgtttccttctttttcttaagaatccacctagaacaaattttattttattcctttcacctccaacatatatataactactaacccattcttacttgggtcactcattttttcttactatatatgtatcctcaaattattacatttcatatgcgcatgcaatacaaaccacatctaaatttttcttccaatatgttctttctctatacttaactaaagcccaaagaatgaacttaacctagaaaagatggacttgacccaatagcattggtccgttggagatgttaggtccatactccatacaaagacaaattgaacaaaagtcgtgaatctgtttgctacgtctgaataacaacgtacacgtatcacgccttgcgaacaaattatttgacaatgatggccaattagcatgtgtcatcacttgttaccacgtcaacaaggttcttgtcggtccgtttaattaatagtaaccatcgttttcaggaaaaaaatccacataaaaagtttctaatggcgaaacaatattcaaatatttcctaacaactaccatgagactgattctttttctcttccgaaaaattaatgagactgagtcctaatttttcttatagttaatttggtgaccatcaaagaatgtaaaagtatttaggaaacagcacaaataatctggcaattacggtctacaacatgtttatttacttatttttaaattatagaaaaatttaatattttaatatcttatatttaatgccctaaataacactaaatcacacatataaatagcagagatataaatatagaaaaacattccaagcatttttcagtacttaacatttatacagaaaaacaattaaacatttttcagcacttaataattaacatatgtgagaaattcataaactctattaaatattcatgaaaataatgtatttttaattttataagtaatatctcatgtgtcgactttttttatataaaaaagatgtaaaaaaggtcccaagttactaaaattcaattttgtcaacttaactcaaaatctttttgctattagtctaaaatttcagatttcctttcttgctatttttcaaaatactatgtttacttctcatataaactgtaaatatatcccttttttaataagaaaaaaaatctctcacttcaaaaacaaaaaggaaaaaaaaaagcaaagagaaaaagtaaataatacgccgacgtttcgtgtttatgttaagcttcctttttcctttttcctttttctttttgccttttaaataaccgtcggactcatatttctcgcctccgccggcgaacagttttattatctctctctttctgcgtgttccaatttcttccacaaaaccctaattttctcttaaaccctgaaattcgtgtaacctttcaacaatctcttcaattttgttttcgattctgaatccattgtttacgaatctctcatctaaagctacattcttcgttaaatcgtttttaatcgactcgctcactcgtgagttgactcgtcagctgtttccataattgcttattgaatttttatacgatgatgtttcaat

SEQ ID NO: 3903 - DNA, 2000 bp, Arabidopsis thaliana
cgaccacaatatcatcaatgacgatcgaaccaaagtagaaaatattctttttctagctcgggaatataaaatcgtagggtttttttttggtcatcacgagagaaccgcacattgaaaagggaaggaagagagatatttggcagagagagaaaacgttggaggaaggattgatatttgttggactttggatcgaaaaattgaaaggtaaaagaggtagagaagctctggattccgtctcttcccgtcgtcggcgacggtggttttgcccgttggctctgaggtatttctttcgcagatctccatctctccatttcatttctctctttatggtctcgaatttgatcagagtggatctaatttttcgttttgattaatataaattcatttggtatgcttggattcgtctgtttgggatctgtttgagtcggatttgatgtgttcggattatttgattgaaatttagggtttcttaggtagaattattgatttagtattgattgatatatcctcgaattggatatgtttgttttccagctttttccagcttttttcagatctgtgaggtataaagtgggccaatagttaggtgatgatggcaccacggttcagatattgtgctttgttatcttatctgcattttaattattgctgctaggtttttatggtttcgtgaacgatgattacttttgctaatgttgtttatgagactgtaatgtaagttgagtccatttttagagcttgcctggcttttggatggttttcttctagctattgttgtgtccatctttggatttcttataattttttaattgctttttcattgctatcaggttatatcaggctttaatttaagtggattgtcatcttctgagatatggaacaagtttttgtctggccaagctgctaccactatcggcttttctcattccaagaagcgctcgattggcggtttcttgtacgttctgatttccttgtgggctctttcgttaactgcacttagtggtcaaaccctcttctatgatctttaggggaaggtgtgaggcaaatttctgagacaggtatggctttcgattaaacctgttttattctacacgagtcttccctccttagatagtttgccattggaactttagtgcgtgttatgcatttggtacaagttgaatttcttgtaattatcccaattgtagtttttaataggtttcattaagatggtttagactttcttatgagtggcaaaataagaaaatttgagaaatggtaaaactgctaattttttttggacaatttgaaaaggaaaaatataaacaaacaatgaacacggaagtgttgtatgccatcacgtcaaccccacacttaatgatatcttttgtgcacatattcatatctatcagaggatatttacatatccgacattttcgttttttttgcagggctgaagtctgcaaattcttccttcgcatagtcctagagaaacctctttgttcctctctttcatatcttgttcttatgggtgctggttgaagaaagatacatcaatttcttttctttttcagtttacaaatgtcgtttccttgagtctgaacccctgagtgagatgttgtgagcatagggtccttcctattagccaaaacagtctttcttgttggttccttcgcgtctttgagttctcagtatgtgttttcctcttctcttgctctctttcttttgcctaaatggtcaacccgtttatgttcgaagtaaataacggtcagtctacccagctggagaatcattgattttactgccttggtgtcaagtacttcctacgaacgactggaagattaatgctatataaatctttcagaagttctttacttacataatataaagaggctactttgcttaaccagaaaaaaaaagatggacaggtagcttagttttctctcaacttgttttttaatatctttttcatcgggccccttgatttgtggcttatgagtttagttctcaatgccttatga

SEQ ID NO: 3904 - DNA, 53 bp, Arabidopsis thaliana
gtattactaaaagaaaacttgaatgttttttttttccttttctttagccattc

SEQ ID NO: 3905 - DNA, 512 bp, Arabidopsis thaliana
tttcaagcaatattagtgtgttattattcaagaatgatcataagatttggtacataaataatgatactcttgacaaaatacatcaaactagacccaaaaaaacatttaatatacttatatacatgtatcattttcatgatgaaacaaatttgaatgtatgctgaaaaatgttatcaagtaaggatgtaatcttttgccaaaaatagtaaggatataaaatgtatcactgaaatgaatcaaaacgatattggcacaatggtttaagaaaaataaaagtcttattaaagtagacgagctcttagtgggccgattagaattggaaaaaggcccaatcattgtctcgagtagaagtgattgtgaatctgaaatttgctttcttctcacagagaaccctaaaaccatttccgcggcggcgtttctcggaatcaatggcgagtctccgaagagtcctgctcaacgtaacttcctattgccaacgttctctcactcaatcgtcgtattctacgtcgggg

SEQ ID NO: 3906 - DNA, 499 bp, Arabidopsis thaliana
tatcaaagcagtgacgtggtgaaatttggaacttttaagaggcagatagatttattatttgtatccattttcttcattgttctagaatgtcgcggaacaaattttaaaactaaatcctaaatttttctaattttgttgccaatagtggatatgtgggccgtatagaaggaatctattgaaggcccaaacccatactgacgagcccaaaggttcgttttgcgttttatgtttcggttcgatgccaacgccacattctgagctaggcaaaaaacaaacgtgtctttgaatagactcctctcgttaacacatgcagcggctgcatggtgacgccattaacacgtggcctacaattgcatgatgtctccattgacacgtgacttctcgtctcctttcttaatatatctaacaaacactcctacctcttccaaaatatatacacatctttttgatcaatctctcattcaaaatctcattctctctagtaaacaagaacaaaaaa

SEQ ID NO: 3907 - DNA, 2000 bp, Arabidopsis thaliana
aatctagtgaattaatgtattcacctaaatttgagatataatattttctggtgtgatagacattactcactattcaatgactcaaaatttaaaacatgcatgtcagaacacaattaaattcgaaccaattgaatacacatttgaaattagtgtccttataattgaattttgatgcgcaagtcattttgatgagaaaattagaagatcaaaaatggacaaatcaagatacatggagaattaggatatgaaaaatagttttaaaattattgtctatatgtatggaacattagaacattttggtagagagtaaatgatcaaaaaaatctggttatctgaggtgtaaaaagattggctactgcaataaacatggcacagatgttagaaaatttaaagttaaatgattcaaagttttatataatttgggacaattcaaaatcttgtgacttatataatgtgatattaatgtattcactaaactacaaagtaaataattaatttacttttaaatttggtagaggttgattttgcaataatgactattaaatgaataaagttcaaacatatcacagtagacgtttaatttcgaactacttatgtatataaatcgacaatacatttaaagtatttaaatgcgcagttaaattgaagccataaaatttgcaaaccgaaaatttatgctttcaaactgtaaaccatttatgctttcacactgattaaagggcccttctataaacttttccattaaatatttttcatttaaatattagatgatcttaaatggtttactcaaagtaaatatatatatatatgaagaattaagaaagtgtggagcattttaaaacttttttttctctagttttttttgcttttttttttgggcaacgttcgttccctcgagtctattaaattttttgccatttttgttttttgttttttcagtgacaaactcacatggatttcatttcagattcagttagattttattatacttcagcccagtgtaggaacaaccggaacccaaaatctagagagcattcatggtggggttcaatagcccatgtaatagcccacttcccggcatcagaactgacaaatccaaaattgaattgaaatgtgtttataacccgattagttttaatattacggaacaaacaaatcaaaaccataactcaaactaaacgaagtcatataatagatatgataaatttatattaaacgttttattaaatataaaagagtgttaaaagtttttatttatctaaaatgaacatagttaaacgaaaacccaaccaaatctaagtacaattgttcaaaaccaaagtgaaccaagttgaattattgtttttaattcacaaaacgatttgttgaaataagggctgaagtcgtagaagctttaatagataagaaaagaaagagatatgttgatattgagaatacccaaaaaactaggatttctgaatattagaaactagagaacgtaagaaattctttgattttttctttgattttccgaaagtaagaattagagaatactttttctgaaaagctattttttttttttttaattttattgatcaatcaactgaatactgaatacaaaagaaaacctgatttatttataataaaactcaatttatttataatataattcaaaaacctagataaactctaaaataatcatataattatctcaaataaccaaaatatataaaatcaataatatgaaagataacgatagaaaatatttgaaattatcctaactatgtgctctgcatatttaagggctcaaagcttcaaccaccaattgtcaatgcatctcccaatcaaaatataaaaaaagagacgaaaacgaaagtacacgtgcttacacatccaacactcgtaatcgtaactattgctacctacccttctctcttctacttaaccccaaaggccccaaaaacacaatcaagaaaagctctgtaacattattatcaatcgaaattccaaccgactcaaca

SEQ ID NO: 3908 - DNA, 837 bp, Arabidopsis thaliana
gctcaaggttgtctttgttttttggtttttggaaagttggtgaaacgattggatgctcttttttaatctaatttcgggtagtagccacgttcttgtacaggtttctcccctaacgtgtctttctttgtaatggaaactagagagaaagatacacaaaagggttagagaatttggttttggtagagacgaagtagagataagagggggaagtaaatggggaagtctaaaacattagggcattcttttgggggtttagtcatgattatccgaagctaatttttttttgtatattagtgcccaaaaatgaaattcaattttctgaaatctttttctttttgtcactgatgtttatatatcgaacaaaggaggtatacaaagccggcgagtatacggacacctgaactctgactataagaggaagatactgatgcctttagaaatgaatctctgaaccgggaattataccggtttgattaacgtcgaaccgtaatcaaaattttagggctccactaagcgggaaggagcgcctctaagaaatttgaaactcaaaaaaatcaaaacacccgttgagaaaatgcccctataaatccccataattacttccttaccacaatgcctttttaattccctttcgctttccctcttctcccctaaaattcatttcgtttccgatcgcacttcttctcaaggtctgctttacttcccgattcttagattagggttcgatttctgatttgtttaggttctcgtcgttgtttagggtttagattactgacagattgctccatttcttttgtttagtaaatttaatagacgtttgttgggtgatttaagaag

SEQ ID NO: 3909 - DNA, 2000 bp, Arabidopsis thaliana
cattgtctgttgaggttactatactgttttcatttcctctttcttgttgcaggcagatagaaaattcatgtgtagaaaaatgtcattacggttaataccaaggtagaattacttctttacttgatagaaaaattcatgtgtaaatctttacttgttttacacttgttacttctttcgaaattgttccaagaattgttgtttctgtcctctgctctttctttgtcaaacataaggaagaaagaaatctattttgtctagtaatttaaaatagcaataattggccagaaacggataaaggggtcgataaaattagtcccacaagcccatttgcacagcacgctcgtctgcaaaaccaaggcttactactacctttatcgttcaatttcttaagttttacacttatactcctttgggctagcttattattctgtaccaaaatttagttactccaatgtgaatttgcctttttgagcattgttaatttgcaaagtaacagaaaaaataaagaaaattgtaatttgctttttgggaatatatatacatcaggcttttgtagacttacaaaagttcttgggaaaaaaatcgacatttaaataaaatgtagtttgtcagttacctgggcgaagttaaaaatattgaaaagatttaggagtcaaagactcggtcagggcccagctctcaatggtagtagtggcatgggtgagataagactctctctctcgctttctcttgttcctcaaaagacgaaagacagaagagagttatatcctctgtatttcgccactaattcttccagctgtgttcttccatgtgtcacgatctaacatcgtcacattttcatacattgatcatcaacggttagtggctcaaaccatactagtagtctcagtaaatccacagtctccacccttaaaataatccttctaataacaaaaacaaagaaagggaatgtcaaaaatatggcagtaattggtttactttttattttacttgtaagttggtagttggtacataatcttgtttgtttggctctgtgccaaaagttatgtttctcgttattatttttggggatagttagttttcagggattgtgaaaaataagcaattatcacgattcaaaactcgaatttcaaagaaatttgggtttaaagttatgtggactgtggacaatcacagaaatgaatatgctttaacatagtttcggtaggtcccccttttagccccaaagcttctcatctttctttgtctttttcttgttgtgttttgaacgcgggtccactttccaccttcacatgggccgactttcaagcccaattagtgtgggctaataacatagtttttttttacacagacaaagctcctcaaccaattgatacgaataaatacggcgttgtcatcataattttacacaaaatgaaaatgaattttaattaatttagacatagtagtactagtatacacagaaaatcataacaatacaattatatttttttacaagtgaaataataatgaataatgatattgaaaaccatttggtcctatctcttcctacccataaatcttttttgtagttattttaacccaattaaaaagattcaataataagtgcacaagagaaattttgtcaggtttcaggcatagagcccagtaacactcaataacaaattcaaggaaaaaaataacaaaaccccatttcaactcaaatagcttcacagttttactaatctctctcatcttcttcccaacatcaaagaagacctttacttctggttagaatagaccaagaacactgagtacgacaaagaaccatgatgaatctttcttctcgtcgcgcctcttccactctcacattgagcttcactgttctccttttagcttccacaggtataaccagaagaagaagaagagtctctcactcacttacttcaaagtctatcacatctacttacactcgtttcaaagtttcattttttttagtgatttgtttctttatcttttgg

SEQ ID NO: 3910 - DNA, 2000 bp, Arabidopsis thaliana
attgtcagtttactatcttttgtaccatatattttagagcgtttttcttaacgttatcatatatttcgatagcgtttttctaagaataatgatatagtcgattttaagagtatgtacaaaaaacataggctactttatggtttctacaattgatttgctaagtcaattttatcatttgcttgtacatcagtgcatgaaaggagaaaagggaaaaacagtaaacagatatgtattatctacatgaatggacatatcttagacctcgtgaagtaccttaaaaacttataggagaaagagggttactacttactacctcatctagacctcgattacgcgatcaaagcaatactggatatcagatagatgtggtcttatctatcaaaattgtttagtccgttttcgagtttgggacaaatctccttagaaaccagctagaatggcttaatctatatataagataataataagtttaacaccaagacttgccgaagttaagttacatgtaatgctacgagattctctgatacatatgttataaagtgaagttaaaacacttttctcaagaaacacacttacataaaaattagtcacgaaggtaaacaagtgctaaaaaaaatgaagggtcttctccaacaagaaagaccgttttaacactactacttggggttcgtaaattaatacaaaatcctggaataaaaccatttatcatcttatatccaaccaaacaaattaatataaacactgttaaaaaataagaaatgaaatttaaattaatgatagaaataatcgaattaggtgttttgatttttttttctgtgactacaatatatttaaaacccaaaattttacaaaaatcgttttagtaaatcggtttaaatctgaaacaaatgctaaggaaagtatttaacagtgattgacattatggaaataatttaattttttttgtccgtttaacagttggacaatactagattaacaagaatcaaaatgtatctccacaataatgatgcgatataaatgatagtataaaccaaaatctttttacttaaacactttcctatctctaacataattactttttaatttcccccattcaaataacacctaagtattattttacctggtttttactttttaacacaatttaattgcaaacaagtagtgtgttttattagtttaaactttaaagtctttagactagagagaggaagtggcaataatactaatccggttcagtcactaaaccagtgtacaatatatggttggtcctacaaatgataatttttgataaacctaaaaaaaatggtgtattatatatcacctgaggatagggatacaagtttcttttagggtggaaatccttatatataagtgtagggactactcaccaaaatcaaacaactcacttcaatttgtaacggtttaaactcggtacaatatgcggattttgattcggtataatgacattaaaacaccactttaacaaaaaccactagacaaatattagtcatttcggttcagtttcgtttaaaaattacgaattttcgtataattgagtttattattccgtttggtttaaaagaaaccatacaaaacaaaacaaaccaaactaaaccaaattggttatgtttcaaagattctttctaagtctctcaataaaatgttatttgttttgtaatgtaaagaaaaaaaaaagaattgcagaaaaagagtggatagtgttaagaagatgatcacacacaatttccatagccatttatagatagctagaagagctaaagaagattcctttttttaactctgctggaaaaatctttttgtctctctctctaaatctaaatattatatactactactctctctctctagaccccattcacatatttaatctttaactcatttctccatcgacgttcttgcacatcccactttctctctttcttcaacttgcaaaaaagattaaaaatccaatctttcgtttctgggtctgttgaaaaacg

SEQ ID NO: 3911 - DNA, 836 bp, Arabidopsis thaliana
tattattttggttgatatacaaagaaattgcttgtattcgtcccaaattctgatactgggactggcaattattttttcatgtaaaaagaagaaaaatctacatatgttattgcatccaccaacaatttggtttgcccctaattatatttggtcttgatgtttgtaaagaaagagtgtgattaaggctttcacgtatgttgatgtcttcattgatttggacttttgtgctcctttttccttttgtgtttggatcaattttgtttgtgtagaaaatagaaagaactaccacagaagacagaactactgtcttgaaacatttgtttcgtcctttctcgtaggattaattgtctttagttggcagagaaataaaatatttcgctcttattgggccttggcccaaaatagatatagagacagcccaaatttaatttaacccgaaatagtccaaccgggtgaatttgacagcaattaaaaaacccggcccggcttcttatattaacaagaggcttggcatcggttaatcggagcttctttcctctcaagtgaagtgtctggatcttcgtcgctcaacgcaaatccctctccggttcatgtaaatttccaacttatttttgtgctcgaattttggttaacgggacaaatttcacacttttacggagtatggaagcagcctttgtcttctgggctgttgaattgcgattcattgtgtatgcccaacaatggtttaattgggaggttccaatgattttttgtgcttttttcttacttaatataaccactgttgatgtttcttctgtgtccttgtatcgccacagtggataagcagcctggggaag

SEQ ID NO: 3912 - DNA, 2000 bp, Arabidopsis thaliana
atactatactatttcttatgtaattcaaataaaatatataatttaatttatataaaatattaatgcccgtgctgtatagcacgggttatgatctagtctatatattgttccacctacattgattatttaagtatatttattttatcgaaatttgctaattttccataaatcgatctattaatttaacaatgttattttgaaaaaatggtctttggttattattgtatagttggcactgctttggaagttaatccataattattaagtactattaaatagaaaatctctattgaattgttctatttttttgggtatcgtcataaattgataccatttaaagagatactcttaaaatagaaatctaaatttactttgcaactgattagtgatactatgggtccatccatgatggtgatactaaagtattttgttcagatgattactatcccaagcgacgctccggagacgcgtagcacgtgaatggcttcgacggaatttattacaacgttgtacaatatggaatgtggactagtgttgtgtgtgtgagtactgtcttataaaaagtggaattcaatttccaaaaagattgaaagatatttgcagttgctattattatagccaacgccacggttaacctaatatgacaaaaatcagaaagacgcgtaaattgattattttatgttttcatatgtttgaataagctatcttccatgtagagagaaagagaaatctctttttcacgaattaagaaaatgatacaagtaagattctttacaagagatataagatcatgcatatctgattctagtagtatctatacacgatcttagaggaatagtatgagaatatactagcatgaattgggatttactgctttagatagtatgaagagcttgcatttggagaatgtaacatttatctctttttgttgctgtctttcactagacaaaccaaacaggtctatctttgaacatcaacacaggaacgcatgaagttgctagaagcgttgtggctgatctacgtacgtctaacttcctatcatcctatgtcacgcaaggatatgaagggatcaatatttgccaaacagaaatttgattaccatttaccaatgtgagctttcttctatttttttcactcgtttgctttgggcttcgtattgtttcatccaaatgtaattaaccaaaaaatctcgtatctattgtaatataggcctcggcaaataaaccaaactgaatcaaaccaaatcgaaccaaaattggaaattaaccaaatggataataaattctgtaaccgaaataactgaaaccgaatggatacaaacagaaatataatattttgggtaaccgataatatccgaaatataaatatattttcaaaagtattagttatatctagaataaataattaaaaatacttgagaatatatataaaatagtaaaaaactcgaaaataacaaaaatatccgaaaatatccaaaaataattgaaagatccgaaaatatttaaagcaaaataaccgaatggatactacattttaaaaccgaaagaactgaaatcaaaccgaaccgaaccgaactttcaaacgaacgcctatactataatgtaatctgaatgttctatcttgaccgtcaaaggacgatccactggtatattatttctcataagccagcccaaattacatttcaaggcccaaatccattagcctcaaaaagttaaaaaaactataatcaacggaacattccatttttttttataatattcttaaatcaatttatgtattcaccgtgcttcgccagacaccagagacgcttactaaagcactgagaaaaaactaaatgagattttgatcacactcacacaacggattgcgaaatagtaatattttataatcgccgacaaattcttcagatctccaaaattgaatcttattataaaccctaagatttgcatctgatctgctctcgaagacgaaagcttcgagtactggttgaagctaaagct

SEQ ID NO: 3913 - DNA, 2000 bp, Arabidopsis thaliana
  N_region (426)..(426): n = any nucleotide
gtaatgcatttttttttttaagccccaacacaaagaaaccacttattttcattgcattttttttaaaggattgcatttgtttgttgtggttatattgagttatctatctatatatatttgatagttatgcgtttattacatataaaagaaaatttgtatgtttagatgaacaattgacaagtagaaaatttgtatgtggttgtatagttaagctcaattaatatgttaaataaaattttagtttgaatgtaatattttcatttatagtgttaggtattgtatgtctcgatctataaagttaatatgacaattatggctttagtagataatataccaaaaaatctttcatgatagtagaaaatataccaattagaaagatattatattcatcttattaaagatggatttgtttgcggtgctaaactnttgatttttttttttttatcatatcatttctcacaaatctctggggatgcagctcatgaatagaccatttcttcagatatgcaaatgggctgtaagtatgagttcatatccaagaaaatgtgttggagttttcgtacatcaggtgaatcgaatttagaacgtgttaacgtcacatacccgtctctttaccactagcccatagactcccggactacatcccaagtatagttaacaacaaaaacatttcattcaaaatatttacaacaacaatccacattaaacttctacaactaatcaaccaccaaatacgtgagaagataggtcctgagattaggtttcattttcttttcttagcaaatcaattccaaatttaatttcggagtgaccacaatttttatgtttttttgtactttcttaatgtttttctttctgtctacatccttgatactttcttttaccattaaacactctggatgaactttgaaacaaattaagacagggctataatagtcaatttacgtgatggtctatttgcaaacatcatagattgtccaccgacctaatttttatttgaagtgttatttattggacatattgattttttttttttttttttaactattcttccaaataaattcctaagggtttccgcaaaataaaacccattcaattaacatgttttccaaatttaccataacttgcaaaaaaatatagatcaaacctacaaaatcaaaattttaaccatcaataaaatttttacaaatattttcaaagagaattcacagttacatatactagatcttgaagttttaaaagtatatttaaacttctcatcaagattcaatttgatatataatttatcatgatttaataaaaataacaataatgacgttatattatattgcggcattgtgagttacatttgacttaaattaatttatttgtaaaccagcaaaaaaagtaatcatttagaagaattttttggtttttttttcacaagcaaaaacatctttaaaataaccacattcatgtataagaaaaactcataaaaacaaaaaatgttatttatctattaaatgatatactaagaaatatacacacttaatatcctagttttttaacatcccaatttattatttattataaattacaaaactgttatatataagatgttgatcgtcaaattacaaattattcctgattacaaattgtttaagagaatagtcatatatctatttatgtatataatgattacaaaaaaccatatcaaacaatattaaataaaacataaatcatttgtaaacagtacattatgtttaatacaaaatatatattttggatatatatataggagtggaaggagggaggagattgtttgtctgtccgtgtcttacaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggtt

SEQ ID NO: 3914 - DNA, 2000 bp, Arabidopsis thaliana
ttgaaaacacttgtatttcctttttgtcaggataacacttacgtttcatgcaattatttgatataaaatgtgtagagagatatattaatcaaaatttggtgtgtgtttttttttctaaacacattcaaaacttggttaattaagttggtcacttggtagaaatttaaacaaaaaaactatggatccgatttatttatttgtccaaccaatacaatatttgacagttgttttacgtgaggtttaaactaattgtaagggtaaagcgataaatacaaacaatacgtggggattagttgctgaaaaaaataagtcacgagagggcatagataaaaaaccaataaaccatatttgtttttgtttaacgaagcactagagcttcatgcgtgtagggttataaagttacatacacgcgtggaaaaatacgagaacggtggtggggaattaggtctctatcgtagttaccgttaattaatacaatatattagaattttgtagttttagatttctctttttatgatgatattttgtcgtgcagatatttatggaagcgtgagacgttcgtgcggagtgagtaatatagataatacagatattgatgtaacaaaaaaaaaagaggatatgatttgctttgggacgttaaacacgaaaatagtcgactttaaagggttgagtaaaataattagagaaaagcttatttcagtgaaataatgcggtaactggtaggatttgaagctcggatatgtgttgatgctttggtatttttcgtcattgcattgaatatatatggtgcattgaatatttgaatatttagagattaagttacaacagatcctaaaaaaaaaaaaaagaaaaaaaaaaaaaaaaaaaaaaagttacaacagatccgaatatttaaattatacggaaaccgaactatacatacatcgaacaaatactaatttactgtaaattatttacatgttgcacaaattttactgaattcgtagatttctttgacatcaacatgagaacacttagaaaaagcaacaaatctagtcctccacaaaacagaacttttgttagatttataaaagattctcccctaacctgtaaaactcaaattttaaaacagttgacgtagagtttgatctattgcaatataaattatttgcacgaatactattaggtgggaatgtgagattaataattaggaaaaaattagtctttaatataatgattatgcatcctcttttcacgtaaagattagtctcatagttttgtcttctttagctttttctcctctttttttcttctctttgccaaatttcttctctttcgcttttacattttctccagcaaaataagacaagatctcaatcacttcttcttcttcaattctatctaaagctgtcacgagaaagccagagaatttctcagcttctcattttgtcaagcaaatacaaaaagaacacacttcttttttatttccgggaaaattcgtttttatgtagtggtcgtactaaacacgcttcctttatgtggaatcttaaagcagtccctttttttagttgaattcaacagtttttttctttttttttttggttccggatccgaccatctctgcaacatcgtactttgagagacaacactgtcgaagaccatctacgttgtcttctttacttggagaactctctctgtctcttctctgtactttctcccttctctttttccgtatctgtcagcctttgattccgcttttttgttccttcaccacatatacatgtatgtatcttcttcttctaccttgaacaagacttgattttgccactagttatttcagaaaaattaatcttaatttcactttgaatttttcagcgttccaagctcatatccggtgaagtttttggaggatttggttgttatggagcatagggttttctcaaaaagaagattcttgagcttgaaattgaagtctttgaattcttaagggaattttatcgaacactttgtgggctaataac

SEQ ID NO: 3915 - DNA, 2000 bp, Arabidopsis thaliana
cctgaaaataacattaacaagtattgaaaagatcggttctttcggggattggcatattgatactcataatcaatatccacctgctgagtataatattcaaaaaaaaaaatagtataataccaattaattaatgtctattatctacgcttattgttagtattattattttgttgatcatattattggtttgttgttgcagttaatatttgttgggaaacaaagttattagtttataattttacttctgtgttttttttttgtagttaatcataattattgttcccaaatacttgatttgtctgtatgtataaacaaataagaaaatatgatgatggagcgtaactgcgtaagtgggttcaaatagaaaaaagggatacattataccgaaattctccctgagaataaaaatgagagaggacaagagaagaaaaatgggaaagaggacaaaagtgaacaaaacgggagggggaatggaatcaaagggacaaaaaggacaaaacacaagacgtgtcgtaatttgagtacacataaagtcaattcctaacggtatatcccagccaccgaccaccgacctacctttcttcctccactaatcctatagtaccgtataatgacgtatgtcccgtattccgtaatagtaccctaattaaatagaaccagttaaagtaattttccattatagtatagttaaatttcattgtgaaaaaaaaatatatatatatatatatatatagttaaatttcattccataattcatcaactaaactctaaaataacagcgatgaaataattttctgtttctaaaattaaaatgtacaaaagaaaggtaacagaaaaaaatacatttacaaaactcatgacatggatgaagataactaacataggaatatataattctatattattaaatttttcatacaaccattcgttgtgtttttatatgatgctaaaaaatcaaattgtatatttcaaatgttgaagtaacagattaaaaaaatcatatatatatatatatatatatatctatagaattcatttttcgtttcctttaataagtcatctagctactataagaattgtagtagccaaaacgttgtccatgtacgactctatttgtaaagttattattattatacttttgataaagactgttcgtaaagttttcaccatgcaatatgaatctttttatttacatatgatatgattttagtctttagatattaacttggaagagtttgggggcaatgatatatactatataataactgaatctctatctatagcttactttgtctatctggacagaggagttcaggtatcttttgaataaatttatcagaaaatttggttactaataattttggtatgtacaaatagaaaaatatatcgagggagtatatattcgtagagaaaatatttaaaaaatagaaacacacagaggtttgggtactataatacatatggatagtagaatatatgtatagattatttaaaaataaaaataataatagaataagaatgcgcatgtcatctccaccacctcttcttccgcctatcctcttaaaaggtttctgttccattaaaaataagaaatgatcatcacacaacatacagctttcatcatccccccaatatatataaatatatatatacatatatatttctttttctttctttttttgtagaaactgataatttcgaatgaaacagatttttatttttaaaaaggaaaagaaaatgttgttataagtcggaaaagaaatccacagaagcatgacaagtttatcttctaaatccaactaacctaaattctctccctctctttactttttttttttctcttgtcggtgattttggatttttctcctctttccatcaccataataccacctgcaagctccctccttctctttcctgctccgacatatttattctctgcctctctctctctctcaaaacccatctcgaaagtctttctctttcgagggtttagatcctcc

SEQ ID NO: 3916 - DNA, 2000 bp, Arabidopsis thaliana
gcctttctcttgttttaaattatgacgtaatcatgtttatctcctaaaccacaaattacaattagtgtcctcaatttttctgcgcattttgtgtcagatttcattcctcgtgcaaactatacaatttcagttggtgatttttttgtttttgggatacattatttttttgtaggaaaacaaccaaataccatttatttgagtcattgtccattttgtctttcaattgactatcaattacaattgattatgatcgcaaatcaactggttttgactaattctattgaattgtttgaacctgttccttctcaatgagccaagaatttgacatgtttgaatagacacttaataaaactttgaaagtttgtaatttaaaaataaattgtagagatgaggaaaattccatttaatgttaaaattttacaaacgaattctcgattatttaaagatgatgacatgtataccttgcaaacataaatccctttattattaaaagggaagtacaaattgaatttttttctaatttggcctcaattttgatttcaattttggattttattctttgctattcaaaattattaaggctaatttggtcttaacaatctcctaaactttatatgatccgattcaatctaaaccgtttaataaaattaatttctttcaatctaaaccgttcaacaaaaataaggaatctatgtcgtttttgaaatcaaaatataatcacatttcatctctaaaaacagtatattcaatcacgaaatcaataatcaataatatccaaaccatttattacgattcttcactaatcactagaaatttatatttataagtttaagatatcaaatttattcaaatatttagtataagaaccaaataaattgattgcccgcggtaaaccgcgagttaaaacctagtttatatgtaaatgggtggaaacaataaacaaaaagcagctgaattgtttttaattttagcgtaattatttacttatttttctaggttttgcacgtaaaatgaaaggaatataatctctatttttcatcatgattagtagaaactttaacaggatccgacgtaattacatttttatctttttgtttgcgttaactaagttatccagtcaaacccttaaaatgtctcggcgacataaaaatattcgaaaagctaccatcgtatcatttctatagatctccctaatctatatgatatatcacatttctttcaaaattctttttttttttttttttaacaatttattgagatctatcatgtagattagggagaactatagaaatgtcaataagcacaaaagttatctttatcatcaaaagctatgcgacaacgctcaacaatcgacatccacgcatctagcatatgttgaacacataaagcaacccgactaaatcagcatactccatggatattactctttagatcaccaagaatggtagtctcgtttgtcctttagatgtcgaatctttttttcgaaagcttgtaaactcgaagttctttgaagaacaaccctactcccaatcaacattttaacatacgcataatttcatccaaaacacatacaaattgtttaaaaccacattaccattcattttatagcatatacggttggaagtgctagtttatgttcttcagctcaaaagagtggtagttattctgaatagaaaacaaaacatctgaaaatggcgggccacgtgaaataaaatagaatatgatgccaattgagacaataatatatatacatagtcgtaataagagtgataaaagctttgtgaagcctacctaatctaagcagggccgctcgctcccaccaaaggacaaatctctctcccgcactcatctctgttcattggttcctcccaaaaaatatcaatcaaatcggaataaactatacgaatcctccaatataaagctccaccctttctctttctatctctctctctccattgttgactgtctctcttccctcgtaaacatcgctgtctctaaag

SEQ ID NO: 3917 - DNA, 2000 bp, Arabidopsis thaliana
cagtcttcactcatcagaccgaaagaaggaaaaaaaaagagagttaaaaagcataaaacccattttccaataagagttttctttttctcttcttcttacgtgtacgatcccaatctaacaacacaaaaagggttcagttttcttatctccattttgatcatgtcaaaaaccccacatgtccacccataattcctcctcagtctttttataaacaaaccattttcttgcttttgctcgcaaaactttaaccttaaaaaccaaaccaaaaaaaacaaactaaattaaacttatggatgtgtcaaatgagacagtggaaagaaccgatctccggacacctttagtagatccggcagacacggaggtgaaacctctaccagaggtcgggctcgagagcgtattaacggagagtagcttgtcataccggaggcgtgtgtacttaggagcctgtatagagttgaaagtacttttccggttggcactaccggcgatacttatctatttagtcaactccggaatgggtatatccgctcgtgtcttcgccggtcatgttggtagtcaagaacttgcggccgcgtccatcggaaatagctgcttcaatctcgtctatggacttatggtatgatttacgttaccgtacccatatgaatatgatatgaggagacatgttggtattatatatgaagatttatactaattattattttcatttgttataagcgttatcgtatatttagtgaagtaaatggtggagtaaattataagcattataatttagttggaaattaaggattaaagattttgattttctcgttttgtgtgttgacataacatataaaagtactcatatattattaacctaacctaaatggctaaaagcttagcaaaccacgtttattttgctaaggataacagcctgtaaacgatgctgtatttttctatcttatattcctatatcctaatttgttcttacaatttaatgattacataccatttattcggttcttttgtcttatgaatctttaccattttccttcaattttttaatttttattttggggtcaactactaggcacgattttaattttaattttcctactaggcacgatttcttcaggcgttgaatttactcgtattgatatataaactattaccgccatggtaactatgaatgaagttaactactcgatattcttagggatagaaacttacgtaatgcaactaattgcattaacacacgatcacgataagagtttttactagacgaaatcactatggtgagtttttgtgtgaaaaagttcaacttttggattttgtaagagaataatctttcacttccttagaattccgtgaaacgattcctttttcttgtcagctagtataacttaacgattaattgtaactgtcgttttgcttaataaatgatataattgcattttttgtcgaccaaaataaataattttttgtagtatcgtttgttttgcaagtcattcttttgaatattattgtatgcttatgatgagtagtcaattaaatatttatgattttctctttggattatagtgtaaaactgagctttctaatttttgcccatgtgagcaatttgtttgtttacctaatattaggactttctactgttttctcttactttatactagaatttgtaaagatcttctacgttagatttgttttcttttgtgtgcaacacgttctattgtttaatatgaataatctacaatatgtacttttttcttggatcatcatatcgttctttgttttattgttcatttaagaaaggaaaaaagatataaaaaaatagatacccattttcaataaaactttttcttttttaattatgtgtacaatctctatttataacacactaaagagcttcattttgattatctcaaaaaaaaccacacagatccttaaatctccaaatttcctcctcagtcttatcattatagacaaaacccttttctttgtaaattttttcccaatct

SEQ ID NO: 3918 - DNA, 2000 bp, Arabidopsis thaliana
gacaaatccacattgtattatttggacaagagacatgacctttaccttctcctcacgcaaccggcatttgttgaagtctcccattgtccctcctttgggccctacctttaatgccaaactaacccattgtatttggtattctacataaaagttgtacactaatgtacgatacgattcaactacattaaccgtatgttaaattatatagtattcacttgttgataaataaattatgtttgaacacaacaaaacttagtttctatatccgctgctgttttgttatagtcgtcattcgtacgagtaattctttatgttccgcactaatcacgcttcttttgtaccacttagtatgtgattttctcattcgtggtctttgaattgtattagaggcaatttagtcttttgtgagattaggaggtgtgtacggaaaagtgtgtgagacaaatgaagttaatgtggaggagatctatagtgggacaaagcaattgaaagtcgctttagaagcaactaaatgccctcttgacttctccattctccttgcgatttacgcatttacctaattgcatcttttacttgtttagcttgttaagttcttctacaacattaccacttttgctctcttaagttattgcaacttgacaatttgttataccctttatcaaaaaaaatacctggcaacttgtttgagctcctgaattaatcacatctcttaaaagacgttttgcgagtataacatgagcttttctttttatagattcattcaccaatcaaatataaaaactataacacaattaaaatgccatgtagctaggtatattagcaagtcgtagaacagaaatggaaagacttgatgaaagcacgtcaattcaatttcatctcctataaataaattgttgtaggaagccaaccgttttggaatttcttttctttcgttttacgtaagactatatagattcaataacgtgttggtttagaaacccatacttataatggttgacaaaaagaagaaagaaaaaaatataaacatatacgctaaaagtgtttaccaaataacagggttatgtaatttattatctggattaggaaaagatgattggaccatgcgatggagtagaggaatctgcagggcatttgtcactttcatggaccccatgaaatcacatctcttttaattgaataatcgaaatccagttgcatacgcatctttgtctacgattggtcgtagcacatatacgacatatgccataactacaaactaacttaatcttctaataatattgttaacgatcgttaatactaaaaattactaatatattagtcgtgttatctatgtgttatgaggtgtgttaattgttgatgcataatgaatgaacatgatctctaatttgtttacctcacactatgtgattcaagggtggaagtcgttggttagcaaacattagtgtctcaggacaagatagctcaggacaagatgtccgagcggttcagaatcagtaatgtttttttccggagactctactcgttgagtttttgcttgtactccctggtgtttgtgttgtgatgtagttttgttgttttacttagtttttgatcttttatgtaatttgtatttcgctgtaacttcggtaaaaaacttgtgaaaatagtataagtacttaacattgatacaaaaaaaaaaaaaaaaaaaaaactcatgaggtcttgttatatatatggtgatcacatctttaaagaaaatgttatagtatttgttttagtttaaacaattttttatgtgccaaaaacattattaaaaagagagcaataccctactctaaaatagtaaagctaccaaattcaattcattacgacatggctcaaaagaaaaagtatttcgaatattatacgatatcaaccccattatcattgctataaaataagccaaactttacctctccattttcaataatctctcatcttctttcgtctctctttctacggttcaaacattaaaaagatag

SEQ ID NO: 3919 - DNA, 400 bp, Arabidopsis thaliana
ggttacctcttttttgctttttgatcgataaagtgtgatgatgtctagcgttaactcttttcgtcttcgtagtcgtagtcttagggttttggtggcgacgatactttgatttatcaaaccgaacttcttctttgtgatcttcgatgaatcaaaagttttctaagggatattaattaggttttgttaccggcgataattaatccatcttcgatgcttcttctttacacttctgactttgtttctgatgttttaacctctgtggagagcttgatagagtgacattgctctgactaagcgttttagttcaacgcatggttgattctctttttactaagtaatgaattttgagatccttgtttgattgcagttggaaggagtgaattgagaaggtcgggccaat

SEQ ID NO: 3920 - DNA, 2000 bp, Arabidopsis thaliana
agtttctctgaatccgagacgaagaacgtgctttatattttctttttgggaaattaaatgagatagctagcttgtctggccagacacaatcatatgatttttttttttttttccaagaaaggatcgcaagtggatattccaaatttttattttatttttaatcaacctttgaaaatgaaggcttctaagaccatctctatctaaaaacaagaaaagtttctaaaaaaaatatatattaatattttaactaaaacaaatatattaattattatttaataattgaactaatagtatgatgacatttgtccaaattggatgagaatagtttctcaaagtttctcggaagagaaactcaactctccttctctcctattttttctccttcctctcatattttttttttgttgggtatctcattgagatacttccaatgaaaatgctctaactatcttttttttttttttaatatcgattaaaaagtgttgtaggaaacaattgatagtgttgctttcatttttttcttacagattttaaaacaagattttgaatgtaaaataagctttttttaaaaatatattttcattacctttttgtttaggaagggttattggtttatagatttataatgaattgaaaatccgaacaaaaatcatttgtaatttaattattgattttaaaattttaattaatatcatgtgttattgattcaatgatttataaatactagttaaaatcctttgttattcgtttagtcatttgtttttggatttgagaatccaaattatgttttaaataaaattaaatggatttgaaagagaaaatagaaggattcaaatccatggataaacacatattattttaaaattcatatattttaattttataattaataaagattttcaaattctatataaatttataaatcaatagcactcctttaagctcgatatcattgcttccagtctctagttaggctattataaaatttaacataattcggttagatatttaacataattcggttagatataatccggttataaaccctttttttcttttacatattttataaactttcccaaatatatgtaaggtatatcaataatatataatttcaatgatgtttatatttagtatatttaaattttcgttaacgttttcaattgtactcttacacaatttttggtgttgtttttgaactaaataatcattttagacacgtataagtatttttataggcattatgtgttccaaatatactatatcatcgtttttaacatcataatctagagttattcatactttttttaatctttgaactatatattatttttgatatggatagtcataatatccatttttaaaggttaagattactaatctttttttttctttggaacaccggttaagataactaatcattctctcgatttgaaagatatttttttcacaggtgaatacatttaaacttttaacatatatcaaaacaaaacaaattttgtagtgccgaattcattttgctatcatctcttcatacatattttttgtccaaaacaaaattacaagatgataaaaatttaaaacattactattacgtgattttagattgtcttttttttttttttttttggacaaaagattttagattgtctaaagtcatatatttctaataaaaattttgaaatattttatataacaagtttttaatattttataaatctaaggaaatgtatctaaaaacacttgaaatatcttaactatctacatctatgcgattggaagcagtagagatagtaaatttcgcttgaaagatctaataggctaatactacttttctaattttatttgtttcgcacgagagtctctctgcatttccgagttttgctgaaatcaaaatcaaaatcaaaatcacgacaagaagaacacaaaagtgctcaatcgtctcctcacgatatatatctgctgaatcggaaaactcaaaggtttcaccggagaagaaa

SEQ ID NO: 3921 - DNA, 2000 bp, Arabidopsis thaliana
atatatatatatatatatatataacatatattctaaaacaaaaatgatcgtaacatgtgtgcagagataaaaaatagttaaatgatgctaatggtccctgatcgccatttgagtagtagcttgtcagaagtcactgactactagtgatcaaatatactctctcaatataacatattcctccctaacttataaacttttcacattcatcacaatgtaatgcattacttaactacattaggtggttaaaactcctacttaatctcatcaaatgtttccggacaaatcatattttaaggaatataatagaaatacactgagacttaaccatttcaaaactttagtatacattacacactatatacagatatactgtctaactgataatgttattttgccctgtatgattactaatcagagtttacgtctaaaaccgtccaaaagaatcccttaacttagctaggtagctttagcttatgaaactttgacagactcaatcaattcatcacacacgataaatacaaagaactacctctattaaagacgagtaatatcaaagtacgaggaaatgtgtgaaacctgaccattgaaccaagtgactttaatgctatcgccagatgaaattgattgcaaatgtatgatatgataggaatataggaggacaccactacagataatattgatttttatagggacatcagaagttaatatatcaatcacttcaaaacgtttttcagattattaattgtgaaatcgaccaccgtaacattcctttccaactaggaaaaggacaatgatgcttcgcagatacaacatgtggtaccatcaccaattattattatttttatagggaaaaattatttaatggcacacaaaaaaagaagagaaaattatttcattttttgtttaaatctgttcaaataatatctttgtcctaaacagataatatctcatttttcatattaattatatattttccacgttatgaaaaaagaaaaactgatatttatttgtttacatgatacatttacaaaccaaaaataaaataaaatatacatcttgctttgcttcgatcataacaaatcacaatcataattgatttatctgttgctatcataaaaagtcaattaaaataatttagaaaaattaaactttaagataaagtttcaaataatataggggatattattaaacagagatatgtaataaaagaagatagacagtaatgtttttttttttttttttcatccgatagacaataatgtttaattaatataaaatcataagatcacacattggatttaatattatacaagtatttttgtgatcagtagacatttaatactatactaatccaacaaaagaaaaaaagatgtagtaggcccataaattggcttaggtttaatgggctttaggcccataaattgttgtctaagaaaaggccttggcctgattggtaacaagttgacataaattaattcttcaaaaatctcttctgcaatctcatcgtcacagtcacggaaatggcggaacacgcaaaacgacgcgttttaagagcatattacctactcatccatgatgatgatctgttgtaagaatcgaattctctccttccctcatctcatctcctacctagatctctctcttctcttcctctcatttccttctcccttactaaatttccttctctaatctctactttgtccaaaagcatttaactttaaccggaaaaatcttacatttttttcctcctggatctctctctctatatctgcagattcacactacagctgatttagatctatttcgtaagtgggtctttcaaagtcgtctcctttgatctactttgattcagggttaggattaaaaacttctcctttttctatagttgcttcactgtttctattccatggagaaagttgctagctttaatttgccaacttactattcttatgtgtaataatcgtttgcagggtcgttgatttggtgataagtcagtagaa

SEQ ID NO: 3922 - DNA, 1261 bp, Arabidopsis thaliana
gtttgtagtttatggttactctcttctcctccaaatattattaatatataagtgtctcaaaacgctttactgaaatgaaaattaattaaaattgttttttttttttattgtatgtttgaacttttaaattttagttgactacaaattccataatgtcccgatataaaatgtgagatgtgttcttgtttgaccacaataaaaacactatgagattggtagaaaattatcaagaaatagagtttcacccaataccaatagcgtttcacctagttttcatcatcctattacaaaaattcgatggtaaattacaagcggcaaagttcaatgtaactaatgatacaccgatacacgtaacatgttcattgaatgtttcattaaaccaacaaaaaactattgactcatgccactagaaaaattaccaccgaattaaattaaagagagcgagaggcaaatgaaacgatagaaaataagacgttcaatggtcttgagagaattaaatatgtttctttatattcaccagtgtttgaacatttgcagaattgtgcagagaaaggactaaaggagaatgaacaacattttattggacaaggaaactctattttcacgatttcgcaggtatgtctttttataatattacttatttcataatattttgatatagatgattactcaaacaaaagaggtgaaaactcttgtaaattttcagtatttaacctgcaaaacagatactacttttttacttgatttatcaaaccaaagttaagacttacaaaagcaccggtgacaatccgacattgttgccatgcaaagactcaaaccaatttgaccgtcgacgcttttttagtatttcaaaaatatttttatcaattcatgaattatgattattgccaaacatcgattcagtggagactaggtttatgaattatgaccgtagaacatatgaaaactgtgtaaaactattgtataatttatgtattaaattttgtattaatcaactgatatgcggtcggaccggatccaaccggcgatcgaaacataccatttatattttttctttttctattttactagaaataaaataaatagaaacctccgttgcttttttggcaaacactgtgagagagttgaccaaaatcgacccagtgggaggactaggtttatcgaaagctccagttttcatagataaatccagtaaaattatacacgcaaattctagtttcttagagcaaagctttgttgaattgatagcttgaatttggga

SEQ ID NO: 3923 - DNA, 2000 bp, Arabidopsis thaliana
acctgttaggtacatgggcccactgggacccaagatttcttatctccgaacttaacgccgtttacacatttccttccaatatacacacaccgaactagatgccgtcaatccaacgccgtttatggtttatcctcccctagacgttaagattttgacggtttgtttttattatcctacaaaacataactgaaaaagtgtaaaacagagactcatttgacgttagattctgcaagtatctctaccgtccgattggagcaagtgatcagaaatattattactaatcaaaaattgatgaacatgattttgagggcaattttccttaagtaaaaaaatcataaagagacgataatgatgtacaaaattatctaaaactgagtataattatataagctatagattaaggtattaagaaaagaaaaaaaaaggtagatccacctgccacgtgacagaatgtcgtatagttatagtttacagattatctccactaacctaaatattaatttatatatatagaatccatgactatagtctatagttgaacttttagatttaatactatgaaaccaaactcaactcttttaaatacttgaaaatagataattttaaaattaatgagtaaagatatattcttggtaaaaaaattagtgtgtaattataacattccatataaaaaatcttagatttcttcaaagataagaactaggaaaatcaaagtaatttttgtaaattgtttactaaaactgaataagaaaatgaaagttgcatatatttttttcaagaatctgcaagtaaataaagtgtaactttaatgagatgtaattttggtttgacatggaatattctgattgggtagattcaggagtcatgtgatgatacatctatgccacgtggtaagatctgagggattacaagcaatgtaaaagcgtggcgaagaacctggtctaaaaagatgaaggtgtcgaccgataatagccggtgaagagaaagagtataaccggtaggaccggtggggaaaaggtcaatataggcttaaaaagggtttaagcaaaaaatgtggtcgtctttcttaagggtttttgtttttgtggcgtttcacagagagagaaagaaataggagattgtttttgcttgtggtgagagaagatcgcatcgtgtgggtagcgtttcaaacaagtaaaataataaaaagaataaaaagtttccgtcactttctcgaggaagaaggggttttggtgtgagtcctttctttgcgtttgtcttttcattttccgatctcgtaattgtcgtgttattcgccggaaaagttaaagattcagatttaaaggtgagagattttacagtcattttttttttagtcatcctgattctgtctttgaatttcataaaaccaaggagattttcgttaccttggtctgaaaatctctgggtaaatcccaattttacgtttttttaaaaaaaattcgtcgatttttatctttcatcgctttattcttcgatctgtaaaatccgatctgagatttagaacccttttgaacacccgtgatctggtggtcctttgatcttgagatcgaagtttttcgtccatacgattattttcttaaatttttttttatggtttagggttttcctgtggtgaaatatttggaacgacggtttgactctcaatttcagatctcaaagttgtttagggttttagggtggtttaagcttttttcaatgggctttgacccaaaaccttcaaaatcattcctttttttgcttcatgcattatttccagagacaaaacccttttattctgtttttttttttaaatttaaaaccattggctattttatctcgttttcttttgatttcaatgtctctttctaatttgatttctcaattttatctacaggttgggaattacattcacagaatttcgttgattggtgtgataataagccattgatcaacaatcttcttttgtggcaatcacataatcgtgttatgcattctgagaa

SEQ ID NO: 3924 - DNA, 1000 bp, Arabidopsis thaliana
cgtttcataatactaaagatctaaacattacaagtctttatctttattttcttctgaagatgggtttttgctgaaatgatagttcttctttatttccgatacttgcatcacaagaaaacattactaccttatttaaacagaaaaattatatgtattaaatttgaatttcatcaaaatatttcaaaagaaaaaaaattaccttatgaaaatgcgtacaaggtttactataagttatcagatgcagtggacgaaagaatatgatccgttagttgagtcgatcattctaataagagcaatcacgaatgatccacaccacctacaatctcatacgtacttgtccagcttcactgcacctaccatatccttaatttagttggcagatattatgtagatatatgtatatttcaacttggtgttctccacaaccacccatacatacaactttcgacaattgatgagacaagtatacaaataggttgggttttaaagcatttagtactatcctaaatagaaacgagaagggatcatttaatgatgaccttgaggaaataaagttggtttgcatttagtttcccattgatatttatgtgaatagtgaccatacgtaactgtaccatacttttatgtttccaccatcagggcaacacaataaaattgaatgccatctaaaacaaagcaaaaagatttactataattattttcttactcatgcatgtactcccaatctcccatagatattttcgaaggtatttttgtggtaacgtacaagtcttggcttcgtaatctaaataccgaaaaagaaaatgcctctaacttcccttcctctctctatatatttcaaccactctctgtctctcttcctctttgtagtttctcaaatattttcttcagagttggcacgacctcattaataataatcttctctacacctatcaataagagatatattttagagtttcactttggtgcacaaacaaagctcgtacaacattcttcgtat

SEQ ID NO: 3925 - DNA, 753 bp, Arabidopsis thaliana
taccgcaatttctgtcttctcgtttcttttctaatcccagtttggttagagacaaaagaaatagccgttgctaatgcgtatgggatttgtttcttcgaaccataccaaaccaaaccgaaaatcaagaaccggtaaattcaaattgaaagtgaaactttcttaacaaaattctcacattaaaagacgaattgagtttaaaccacggttaaaccatgctaaaccgagtaaaattacatttatatatttttaaccggaaatgttaaaccagaaccggttatttaacactattatcctcgaagaggttacttgaacacgattctcgttggcttcagacattttccatcttctaggtttctttctttctcagcaatttccaggtacgctgtttctgtctattcaatttctgcttttctgttgaattcgcattgccggaggtaagaaaatgaagtcaatgagaagaaaagaacgatttttttttttaattcccaacttgtgttcgatctctgagcagctcttatctgatacaaccatttttttggatataatatctaaatttgtagtctttagtttaattcagatcccaattataataatgcccttttgatctgatccacattgcgtatcaaaggctattattattttattcccagagttcaattatttagttggtagaatctctctgtgttgttgtgaatctgtctgtttatgtaaatcaattcaaaaggttgtgacttttgtgtttgacttaggaaa

SEQ ID NO: 3926 - DNA, 233 bp, Arabidopsis thaliana
agctttaggtaattttctcaaacacatttatggattgaagctttaggtaatgaatgagctgaatttgcatataaaaaatcgatactttcattttccagaacaaaccaagatttagcataaatgttcaaaattgaaactttgattcctaacttcttggaatgattcatattgagctagatttagatctgtatgattgatatgatgggtttggtttgtttatgagtagagagaaa

SEQ ID NO: 3927 - DNA, 1581 bp, Arabidopsis thaliana
tgttgtgttcttgcttaaggaggcaaaaactctgttgcggtataaagaaagaaaacaaagaataaattataagatccaggttcttctgtatactttgatccatcacataaattatatatatataaaaatataaaaagtcagcagaagcaatggttcaacccgatttttgaagatgctttgtttccttgtattatacaaaatacctacaatttgtaatttactccgtaacttgattcttttttcctttttgttcactcaatttttcgtagaatgcagtagtaatagttagctatatggtcacatactgttgtggccgctattttgtaattgcacttttgaaacaatggatcaaaagtttctccatccatcgctaatctttgatacaccggtgattcggtgaccggtggcttttgacaaagtcttttagacaaggataattcatcgatggctttgtcaactttcgtgtctcatgttaacttcctttttattagacaacaaaatttttgcaatgatttgatttggtcgaactagaccaaatattagtcaaacttaatcctttttaacgggatggtaacgggatggtaagtttgattaacgttagatccaatttatcctagttaacgcaaaagttgcttaataatgtacttcaaagaaataaaatttggacgtttcccaaaagaattttttttgggacaaaacaaataagtgagagaaatttagactttattttttttcctttaaatcacaatatcaaaatcttacaccattaagttgtgaatgactcaatataacatataatctagttgtttgtattagtgtcgtcattgtgttacaatgcagatttcaaactcgagtccttgagttacaatgcagatttcaaactcaaaatagtaaaggttgtacaaaaaaactcgcacaacaaccgatgcattagactagtggtttaagtgcaaagattggatccatgtgtttcttacaagtgcaaacgttagatccatgtggtttaagtgtagtccatgtgctccctagggaaagtgttgaactaatgttttttttttttttttcgtctgaactaatggttttattgcagggatattagaccaatgtactcgattgatagaagagatgctttacgccgatgtatttgatatcagcacaagccggttccgggtcatgaggaactagggcccaaggcccaaacccctccatgttaaaaaacaaaaaacaaaaaatctcgtagatgacagcacaatcacacatttgaaatatacaattccgatattcgctaaagggtgtttgtcagattgtataagatccattccgtacaagaagatcctgcaccaggaccaccagaaaaaaaagaaagtaaaggggtggatttgaaaaatataaaacatattggggaccaatgttaaaaaacaaaaccaaatatttgctgtatatgctaagaattcaaaattgtacaaaacccagaccccattaggtcgatgagagagatataaaaaacaacaaaattagacgagaaaatatctaagaaaggcgtcggaaaattgcaaacagatagatatagagacgacgaag

SEQ ID NO: 3928 - DNA, 356 bp, Arabidopsis thaliana
gtttctgtctacttgcctagaaattgaaatattatttctgtcttgtacaaagactaagacttatcataattcagtgacaaccacaaaaattcaatcttcaaaaatatctttgtatgtagtgtaaaaaagctttcgaggaaaggaagggccgagtttctttattatttacgtctcaattgtcttgttaggagatttgattttagccacttaaaagaatatcttgtacagtaagtcttctatgcaagtcttggagggaaggaagacgaagtttctcctctctttctcacactatgtcttgctgatttacttctcttaaaaatcttcgtctcttctctgagttccctctatcgtctccc

SEQ ID NO: 3929 - DNA, 2000 bp, Arabidopsis thaliana
cattatcaacaaatgatgataaagagatacaaaaaacattgtgaagatgtgggatatgaggataaacatagagagataggatgatatattcacacgtgtttcccacttcctcatccaacttgtcgcggcgcctcgtcgccggttctttcttctctctttggtttttttttctaaaacattttctctatcaagcgtttatgtttcaacaaattttatttaagctaatgttttttcttataaccaaatcaaaattttattcatcgatatagaaattaatggttttttgctaatattgaaatctaattttaaagtatatattaaaaagtttttgttaaaaaaaaatgaggatactcatgttggagagggagagcaaacggattcttgatgtttttacgatcgattaaagtgaagacgttttagtggacatgatatatttctttggtatgacatattttaaaagtcacctctaagaattcaattttttctagatattatcgtcattcgtcaacattatatcgtatgatgttaacaaaattaatggttggtagagtactcgtcatttagaattagggctaatgaattgatcgttcataatgtcttgtcgagggcaaaaacgacgtaacgtgacaaaacgtattaacctttgtttctttttcttttttttttgttatttcagaattcatgaaccagagaatttcattaatccactagctaatcttgaaattattctattgccttttgaaaaagttgtaaagtataatttgaaggttgcaaaattttaattttggtttttagtgtttgagaaacaaatcaaaactgcaacattatatacagaactatcttcccttttttttttaactaacttgaaatttatgcaaaacagttcaccaaggtgtcattaaaagatgtcattaaattcgaaagtcggttcatgaaagatgtcgtcatcatcgtaacatgatgccaccacgcagtcagcactaagcaggctatttggctttggcaccttcattcaaaaataaaataaattttaaattcctggttcagtaaaaatgtggaccgttgttttgggggcagccaatcgcacgaatatggtggctacgccacaaagttacaaatgtacaactttgtcgggcttttccagattcattaacatcaataggcaagtaaactacaaaatgcaagttgcttaatcaataatgttgtaaagcttttacagcatcttttataccataaaatgtcaacatcatggagtttactccaattaagttctcgtacactttgatttgaataatcagtacaaaacataaccaaaccggattagatgtggttttaactattgcatacatttccggccaatggattaggattactgaaagaacattaaaaacatatatgtatgacgacgaaaacaatttcttagggcttaggttatatatatttcgcagaaatgtataccaaaatgttggagaatcgtgaaaaagaatatacctaataaaccgtactaaaaaggctgaacatctgagattcagcagagcatcaaaagataaaagagaatatgctcattaatcataggtcgactgttttctccaccctccaactttaatttttgaaatctcttgtttttatgtgcccttgataattattaatcaccttaacattaacaacttgttaatgcctgttaatccaaaagtaaagcaatcaaagaactatattataagattaataatgtaatgattcgaaacattacaataaagtataacgtaacaagcttagatatggtgggtaaaatatacgaagtaaaataaatggtcccaagtatatgaatgaatacatgtatttacagatatctctctcccctatctccttatgatttgtcattttcctcacccataatcctataaaataatcaagaacctccgagggagagagacatacacacagacagagtaagacatatataacatatatagagagagaagacctaaacaaagagacat

SEQ ID NO: 3930 - DNA, 2000 bp, Arabidopsis thaliana
agagctgaagaagaggggaaaaagaagaagcttgaagctgctgcaacaggtttgattttgatttaagcaggtcaagaattatgtatgatttcacctttttcttttaatttccttaagctcataggtgagagtgagcagagaagaaaagagttgtctcgggcttttcaaatggtttcggagggtaatcaaaaaaaaaaaaaaaaaaacagagtaaaaagtctaaaaactgcgttgaaaaatgtaaaagcgaaagatcgtctttttagagtttttatttttattttcctcttacatctgatttattggatattttttacaagaattgatacattaaaagtacttttttttttacgtacattcttagagagtaaatacataaccgatcattaaaaagaagagatgaagaagtgaatttccacaatgttttaaaccttcagaatttatattaatggggtttgcaaatgattggaggtatacaattacaggtgattcacgtcattattgttctcatcgatggaccctttgcatggtttcaattttttctatgcgggtcccgttttttattcacacccattttatcaatgttttttttttgttatggtcttcaattttttatatttggttgcattgaatcttgctcctcataatcggaagatttgaccagtgttaatgatattatatagtttgaacgttaaagtatgttaacatgttagtcttcttttttaatgttatcatattctgtttaccaagtaggtttattttaaatctcaatgctctatatactatcttattaaacgaggtaaacttaacatttttcatgtctagtaataccgtaagattctttctatgtaacgaatgagatttatatatatatatatatatatataaggaaatttgtaatgatgcctaacatgcaaaagaggccaactccacgagcacatagagagagtcacgctttaaaccaaacaaaacaaatttgttgacttaaaccaaatccactctctcattttttttgcctttgagtttctgactactgacaaactctttcaacgccctagaaaattatgcttttggtttcacattgtttgttttttgttgtattcttttatttattagtaattgcgtccacagatccaaaaccaaagccattatcatcaattcatccactaacttaactatttatattatactatattttatttcaaaaccccagaataaaacaaaagttgtatattggagtgggcaggcacctccacaaaaatgaaaacttcccgttaaaattcaccgttctgttttacggtttttatttatttacatgacttagtatcatagattcatttagtagtaatataagactgcgtaagagtgtctgcagaattttcacaatcagtttcaatgtttcatccaaaattgtatcatacagttggatcatacggtccttgaaagagctaatagtgaggtgggcttgtgatgattaaataggcccagtgattataaaaggcctcgttacagaccattactaacacgtgtgatgcgcggatgcggcataagatactgttaaacagagccgatgccgacaaaaatgaaataaactatttaagctttttaattaatgatttaattaattggttttggcagtaattgaggaggaacattcaaaagacagacactttttgtcatgttaataacagtaaaaatcctctaataattatgtctcaaataagataaattaaaattgcaagaaaattagtactgtatcttgtatttttagaaccatattaatttcaagaaaatcaattaattattcaaagatttggttcgtgacgtaaatcaatttattaccataatgatgaaagcgtgaaagaatttaaccagaaaaagccataaagacttctctcgctatcaatcacacacatgcaacagtacaagatttgtcagagtccacagaaatcgatcttttcgagtcaagattttcagctctgttcaggactccggcggag

SEQ ID NO: 3931 - DNA, 1551 bp, Arabidopsis thaliana
ctagctaattgaattaccaacatttgatcaagataatatactaggtagctaattaatgagctcatttttttttgtcgtcaatgggctaatttattaattacagtatgaactattgactattattctaaataagtgaatatcacgagtatgtacgaattattggatgtatctatttgtattgattgatgtaatatcaaatagtatgaatttggagtaaacgtgggtttggggttgaagcaggtagggcatgtcaaagtagggcgtctttcgttatgtccctttcctctaaatttgaacctctgtcattgtacagaaaaatcgtaataacccataaatgtgttttaaaaaacattatttcgagttttctacacatattctagtcatgtttaatttgaatcttttcttatttaagtaagctttagacatttttaacctaagttttcttctcccttcataaattttgagatctatataatgttcttacattttggatcaagatcttcatattctcattccaattagtaaaagattttttcaccttttaatctcttatcttttatttatattctttagttatgtttatgcttttcatcatatttagtggttagtttttattatttatttattgattcatgacttatgctagattatgataagaatttatgttaccacttgataaatcctccatttgacatgtgtttaatgctagatttatattgtctccaaatttacaacttcgatgtcttatgataaatgccaacaaccaaatttcagataaagattagcagactaactaagcttattattcacttgcaaggtggagtgatgttgaaagaaccctcacagacacgtcattgggaagactaaatctctttttagcacgttacacctttgagatcgcgtttattccatatggagagagagcaacaatacgagacatggagaggcaccattaccgccggcgcaactgcttccaaatattgacaaacaaatttgaatctggatcttctctattcgtgaacaaggagatagaagctacgatgaatgcatggaagcttggtttgctttaatataaacactaaaggggagtagaactttcttgaaaaattgtatgcaaattatttaccgaatgttaaaagcttttttcgaataaattttacattttcttaataataataataaaaaaggattgttgattatcttaatcacaaacaatttattttagctgaattagacaattgttagtaaaatgattagagtgtcacatattaatgttgttagtgtttcatgtcatcctagtgatccaataattaggccattctatagctcttaacgttaaaataaaaggcccattatctgaatatacagaagcccattatcaatagatacattaaaagatactgattaatccagagggtttatatctacgccgtctccattgattatttctccgtctcttgaaaaatccgactgacactgacctcaaaactctcctctcactttcgtcgtgaagaagccaaatctcgaatcgaatcagcaccacacatttcc

SEQ ID NO: 3932 - DNA, 820 bp, Arabidopsis thaliana
aatcaaatctttgttagatgatttgaggtaattacttctaatgttctgttgttcccattccattgctctttattccacacattgttaattgtttattcatatcgttttttagtcattcttttcttctcttcttctttcgggttaaaaacacttatgttattttttgagtttttctaatgatagtaatatgtttctggagattctcttgatggtcttgtgaaaaaattgaagaacacatactatctctctatttactatatactgtaagtcaaaataataatccaattttttgttgatgtgtcattaataaataaataactatcattaataattggattggttacacattttaaattttatttatgtttggatatccaatttttttttttccattgctaatttaattgttatcattatgatgttcatattcttttcttgtattggatcatattgtatatctttattttccaattgtaaatattcaaaataatatattttcttggaaaaaaatctattgtggtttctctttttttatataagcaactatttaatggtaatatgacatataataataatttaaaaaattagatagtatttagattttagactattagtggaaaattttacaaaataaataaatcccaactatgatagaaacccaaattgagtgaaaatagaagatgggctttaaatcggaccgacgcttattgcttactaatacaaatcgcccttccttaaggtctgaagacgaaacgaagaacaaacactgaaacaaaagagaaaaatcccaaagctagaaaccctaatcccaaacgaatca

SEQ ID NO: 3933 - DNA, 2000 bp, Arabidopsis thaliana
caaaaacaatgatattacaaaaaaacaaatagggtgattaaacgctagaagatccgtaaccattttgatgacaaaaagatatggtactaagatgaacacgtttttgagaatattcaaaacaaattcatttccgaaagattatcaattttcaagcatacagtatgatctggtaaactataaatggtagaaccacgataattaactagtcgattctatatgttatgacatagacttagctaggagcatatccggcagaccggcactaatctaatgatttcatgagttgttattatctaaactaattaacaattaatagaatgaaatatagttttatatttaagtttttttttttttttttttttttttcggaatatcaggaggttctgggccgaaacccgtaatcccttcaggcctgaaaccacaacatgtaatattagtttcgtcccaaacatcactcgaactaacgacctctaagtttcgcctaggatctttaccaattgaggtaacaacgcttggtcaagtttaaatcattgttgctttctgtgagattttgatccctataacctaatttatcttatgagaaattaaccttttttgataaaggataaggaaaatagtaaccttgtataaaaaaattcattgccattttcatatatatatatatatatatatatatatcctaaaatgtatatctctaataaaattagaagaaatgataccaaaaataaaggtgaaatcatgataaaattttgtttttttttgttttggttcattgagtttgccattaacgctttttttttataaataatttcgtctacacaaattcatccatataatattttcttttactgcatcagagtttcactatgtatttaggttttttatgaattttaaaaaagttcagcatcaaggtgaagaaaattccaaaaaaataaataaaacggtgacccaaaaaaaacttgttgtcttcaaaaccaaaagtactcgacaaatcaaatagataaatcatgaatcttagtacagtcaggttttatcgtctacgataagttccacaataaatccaaacactaaactgttcagatctcagatagtaactttaaatcaacggctataaattcgccatttgtactttcatttacacaacagagaataatacatacactctatctctctcctattcgtaacttatatttctctctctactgtgtttagaaattggaatcttctctcttctctatctccctctctcttaaaaagggaccgtacacgtctctctctatttccagtaaaaaatcgaaatttcgtataatttcctcagtcccgtaattttctccttttttttcttccccaattccttcaattttcgaattcgcctctctgtttcgttcctcgtagacgaagaagaagaagaatctcaggttttagctttcgaagcttccaaaattttgaattttgatcttctgggctcttttgtaaatcagactgaagatatttagattacccagaagttgttcaaggtaaagcaattcagatcagatccaccaattttttttttttttttcatttgaagtttttgtgtttgttgtttgttgttgggagatatttgaaatctgggttattaaagttccgacctaatttcatattgtgctattaccaaaaataggaaattttgagaatttggttttatgttgtcatcatttaataatattagccttttgtgggatttgtgctttttgttgtttgtatcaaaagtctcagatttggattcactttttgtgtgttttttatagtcaaagctgattcatgctatacattacacagcttcactgtttagtctcagctctgttttcttgaaaacaggaatggtttcagtggacagcacggaaagataaaagagacttttttttccagattttgctgatccaaaatctgaatagttgttcatgttcttggatcaaatctggaaagaggaagtttgttggatctagaagaagataaca

SEQ ID NO: 3934 - DNA, 636 bp, Arabidopsis thaliana
ttatgctttctatcttttgatcaaaagacactagccctttaactcagatcctttgtcgattttacatctagtatttatttctgacacgcactggtttagtttcatgatttcaatattatttttttgtcgtctcatgatttcaattatcaagcacaaaattgttaaaatgaatagtgtaggtgcttctggaatcttcaacgctagcccaaaagccaaataacaccattttccacaaattgtccaatttccatcttacggccaacaaaaaaaagagtaaaataacaatttaattttgtatcgattgcgtcgtcgttagttttcccatttcctcataattcttcatctctttcctttctcatctctcgattcctttctttctttccatattccattgatttctctcttcttataaaaatacagattctctcttcttagaaccatcaccgattcgaacagatctaataaatcgtttttttcaccaggtaatgacttgttgttttcgccgatccattagttttttctttctgttctatagttttgatgagatttaagcaacagatctattgatttttgattccatcgatcggttaattttgtagatttttttcgccggagtttgttttgatccattctgtt

SEQ ID NO: 3935 - DNA, 1058 bp, Arabidopsis thaliana
tgattctcaaacataagtcaaaagcttgtgattcttcttgtcatcaccaactgcagaacagttttcacctttggtttgcttcaaagactatctatctgtttagtgttatttcatataacaaactcagaattaataaagtaagtttgtgtagtgaacaagaagctcttttattttttacggcaatctaaagctctgatatcaacaagtgatgaatgagaaaagaaaatgactacttcaattgaaccatagcagaagttatgtttattacattataacgtatgcgagcctcgttcaaacaggaatggattcagaaagaaaaagaaaaggaacctgaaggctgaggagagatttgagtgttaggaaagagagaagaggcaaggtgacaaaagttcccactggatcgaatcgcatcagcggcaaccccggtggccggcgatggcgagcagcgatgaagacgcatgtgatcatctgggcggggctgggtttttaaggaatttctcctctatttgggcctttcttttttctattttaaggcccattttgtgactgcttatgggcccatttgaatacaggagaaaggtcgccactattgaccaagtcatggttgctgccacttgattgataaagaaaaacgaaaacaaacaattatgtgatttagatctgagtctgaccaatattgttatatctttaggaatttgtttgtttgtaataatttataagtcaatagtcaaatgaatggttatcgtagacttttccaattgccattttcttgtttataaaaatatccataatacacagacttaaaggggcctctgactccattatatctatcgaatcatatataccagtcgtagtatgacgcgttgaagaacagaaacgaaacgaaccaaaaagtcttctccggcaactttagatcctccagcagcaaggtactcactcttatgaattcctaacatatgtataattactatacaaccaaggtactaatttgcatgccttcttatgttccggtctaaccacagatcatttctcaatcccatcctttgcctcaacccaat

SEQ ID NO: 3936 - DNA, 2000 bp, Arabidopsis thaliana
gtataatgtgcaacaaaaaattaagagaaaaaaaatagtcatctacttaaagcaattttatagaatgccatactaatcatttatcaaacaaaatctgttcagctctgatgttttgttgttataatgtttcactatgcaaaaagaaatacagcaaaaaaaacgtaagttagaaatgattcgttattactgagtctatacaactataattcaataaacctcattatttggaagttgagtacacatgcatttaactttgttgattgattatctgactatatatatataccgtccagtgtccacagccttatgataactaagataaatagaaatgaagcatctaacatcccatgtgaaaataaatcttgtgtgaaattttatctcgcatacacgttcaccatataagattgtaagctaatgaatataagaagtgaaattaaaggtcccaatatttgcaagtatatattgtgtttttatcgtttcactagttatgtagtttctttttgataccccgatccaaattttgtaattacgtagaaccattatggtctatttattagtctattgattgtcttagtcaataacgcatatgtatcaccgaatatggatcattaattactgaataaaacacccaaaaaacttgttagcaaatgaaccctatgaataaaagaaggggcataatggaaatttagataactatccttcaatgatatacaaagagacccactccctctccacattttctttttcaaataaaaagactctctctctcccatttacatctcttcatcttcttctctttctgcattttgtgactaaatttgttccgatctccgaaaaatatgaaatcttattagaaaaataccggaaaagaaacagattagtacattcgattcagcaccttcaagtaagcatatccacacctcttctggtcttttatgatattttttcttatctttttttaaaaaaacttatataattgatctttgatccaagttgtctctgtttttcaatttcgggatttggaactatatattgtaggatcgtgacaattccgaatttcagatttcgatcgatcatcttttcaagtattagtggtaaaactcaacgtctctttgagaaactcaaattctttgtttatattaatcgccgttagttttccatattggattgtactattaaaaatttaatggtatgtggtaaatctttgatttgatttctttcaagatttaggtgcaactttcaagagatgtctttattgatgtaactggttttgtgagtcttttagcttagtcgaatttatttttatttttgaattttattcgcctgcaagatcattcaagtgctttaatatagtgttcattttttttaatttatgataatgttttttttttaatcaaatttttggttagaattccacatgttcttataagagagctactagtttggtgagcatttaatatgtgttttttttttatttgttgggtagtttttatttattgacatcataaagtttgatcacattgtaatttagatgatcataaacctattagccagattaaaaacttgtgaaaatacagacgttgacctttatttggagatcttccaaaccttctcaattctgttttctcttattatatttgaaagaatgttgttggcaataataaatccaccattgaatatcgtattattgaatataaacaatgtatatatatgctctctgtcgtcacaaggagattatcttatcttgttagttattttatataatctctggggaaatggttttcttgcaagttagggctttatttttcgctttaaacaatgaaattgttgcggttggattgttcaactgaacttgatcatatttcttgttgattattgagactttaacgtgtgacatttcattcatatatacaaaaagtatactctttaacaccaatttaaagccttaaattctcagcggttgcagaacacaaaataagaggaattgcttgattatagct

SEQ ID NO: 3937 - DNA, 2000 bp, Arabidopsis thaliana
ttttattttattttattttatttttatgtctttttgttaactgcttatgatgctagatattaagaggaaaatgaagtgatccagctggcataaattaaactaatcattttatattttgtcaaaagagaaattattggaagctggtgagctactacatcaccattatctcctgtcactacttttaattttcaaatcctgagtgtcagtctttgaatgttggttctaaatctttactagatttgttttttcttttcataataatatttaaatttaaataacaattaactgaaatcgcagtgggatgatttgaatcttggtcatctgacaatttgtttttttaccacgaatttggaaaaattaagtttaatgttttgaccattaattttattgatgattttattaggcaaagatgattggtttgggtaacaatttgaatgatcagaaagaggagggcacatggaagaatggaatggaccgaagttaacggagatgaagacaacaagtcgaaacactcatcgcaaaacaaaactatataacacatctttcatcacatgttgtttgagtctatcttccacatgcgttctacacataatgtttgtgtccactttatattattgacatttaacagctattaattatgatgtagtggacaattactatctcaaaattcttgttttactagcagctagattattaaaattagtgatttatatgtaagtttttgatccacatttttttttcagtattgaaattgatatatatgtgtagactagcatttcactgttatatttacccatacttgatcataattaggtcaagtgtactattcagtacaaactgcatgcgtcgtgaatctgtgaaatcttattttgaactacaaatacaaatgtatcttttattgctctaaaagtttttaccgtctagtaaaatgattacatgttggtgggtaaaatgaatcatctctgcgttgactatgccatgaaatcattgatgccgtacaacaggcatcactgtttctatcataaaaattgtgtaaaagtgtcaaactttactaacgtcactcatctaacagttaaaaaaagatgtgtgaagtgtctaaaactttactaacttcatttaacagtgatttaattattcctcatgagacataaataaatattcgaatgattaagacttcacttcagataacgcttaagaaaagtcttttgaactacgttgcttacgtgtcaccatctaattataggatattaggattaattaacttaatcaaaccacatcgcggcatctgtgtacactgacaattataccctgacacgagcaaagccagaaagaatgtcatcgacgcacattatccaaggctaatttcgtcatttaccatattcagactaaagccatcagcgtctgtacaatttcagactggcggccactcactgaacaaagacaacttccttctccaccacaaactaataaatttgtattgataatttgatataatcttaatatattttagcaaccaaatgatgatactatgatagtccaaacatattaataaatctccttaacaaacttttaaaacctcattaacgaaaagtgaacagaatcttgagtaaaaaaaaataaaaaaaaaatcgtgcatatattcatatgcggtggacaattatttagaatttctctacgcaacaaaaaaaaagtaaagaaaacctacttacaactccggaaaattatttatatatttttcatgtggaaaatattgtaaattaagcacaaataatagcattgacatagacaaataataaagattttgagtaaaatatacctccatggtccaaaaaggaccaaaaccattgaaccactcgtctcgtctcttccacataaaacaagaacaacaaccaaaaaacgatgtgacatatacttagaaacaagctccatatcaataatcaaaaacacgaaagccaaaataaaagagagaaaaagaagataagttgttctatgttcctgaa

SEQ ID NO: 3938 - DNA, 544 bp, Arabidopsis thaliana
gcaacaaaaaaatgaagaagattggtcttgaggattgaaagatgagtggaacaatggatgttggatgactcaactgtcgaattgagtcctctggttttggccttcccactgttttgtttttgtttgctgcacaaatatcttcttactatactagtttagataatttttgtaagttttaaaatgctattagtaatttggtataaaaataattcagtcgcttggatttgatatgttggaagactttgttttgtggtagtcatttgttaccgtgtgactttgttttcgaggactatttaggcgatgacttcgaaagtcaatgattattagtcgttacccacatgaattatacatgggaagcacaattactggcgaattttattgttttatcaatattctgtaaaggttatgtatattaagcaacaacttggtgaataatcaaaaccaaactatgtattatgttaatgaaaatagaaatcacaagtcatctacatattttgctatatatttatagtttctaaacgcttgttaaccaaattcagacaca

SEQ ID NO: 3939 - DNA, 2000 bp, Arabidopsis thaliana
gaatactaagaaagagcacaaatttcagagagatgaatggggcatgtgataaaagcgagcttacctcttcttattataaaagcgaccacgcttgttttcttgcaatgattccgtctactttcttgttaatttatcatgctctctttaaaaaatacacagtaaaaaataaattcatatcttataaaaacagatttcagttatttttcttttttcttttggtcataagatttcatttttctatgttttactcctcgtacataacatatcatgaaagtatattaattacgtatctattttccatgatattaatcattagtgaaaattgtgaaatatcaagagtcgagattttatataggcaaataataaaatactaagttattattgaagtaaataaatcaaaaatatttgacgtatgagattaaaggcacaattttaccgttgttttaaatatttatacattgttttgctgaaaaagttttattaaatttttatatacattagataaattgggtgtttgcatgagagctttgtattacatattctatagcatttaaaaaaatattatttcgtttgacaaaaaaaaaaaaatttcaaatgtctatactaaacgtgttttcagttcatttcgcttagtttggaaaaacacacttgtatcattctgttttttttttctaataccaacacaaccattgtcatctatactacgattctttgatcattttttaaacgccgaatggtaaccagtgggtacataacatttgagataattgaaccttaattttaggtgtccttcattctcccttcatctatgttggtcactacttaacgatacataattatggaactaaatgtaatgtaaagtttcatgatatatacacatagaaaaagtaaaaacaaaaatggttttgcattgaatatgacagcccattaatttacagctgtaagtctatatagtgcaaaggcagtatctctataaaaatcatcaaactcgtagaaaaagcaaaatctagatgaataaatacaagaggtacttgtataagcaacatcgagatttacaaatgtttgttcgaatcatgggagaatattaatgtactatatagcagatttttcattcaaacttttgtcttcttttcaaatactttttgtttttgttttttgacatagaattttctttcgtataattgataccacaagagttattatgatcagaggttggagagcctttacagacacatctagagattacatgtaaatatatcgtattcgtataactcaacttatagccaaattaatgaaaatgttttgtttttaacgaatagcattggaattagaatagtaaaggaataatttgctcgagaaacgaaagcccactcgtgcgagcaaaacgtgactcgccgctaaaccatgtgcttacgcttaatttaattaatttgctgataaaaacaacaaaaacagtacttagacattggataaaaaacaacaaatcagtacttaaataaagactattaagtacaaatattagccggcgaaaaactcagtatagttgcggcttcattttctttctataataaaaatccaacaaacattacatctttaattttactaattaccctttcaaaatgtccatttgttaatactataaaagagaaaaatatagatggtaacagtaaaacttgttttgttaggtttggtaataaataaacagatatttactgtgggggaaaatactttaatggaaacagcaatagtagtatgtatgaattggttcgatgtagttgttgttgtcactcccgaaacataaactctcacaagtagctatcaaaaacaaagcaaagagagttaagcttctctcatcatcttgccttgaaaaactacttccgtgtctccctctctgtctacacaacactcttctctattttctttctttctctctatatatattcatatctcttctccattctctcttacttcaaaattcatcacaaagagagataagagag

SEQ ID NO: 3940 - DNA, 2000 bp, Arabidopsis thaliana
gtttaagcaactaggacttttagaaaagagacctgaaggtgagagacatttcattgcatggccagggcccagaggaatattgattattaaggggtcttttgagttagccaaacttgcgaaatcattccacatccatagaagtctagtatggggggttttgtttgccatagttgccccattcctattatgagtcagtaccattgccaagcaaaatcagctagaaaccaatccccaactttggatagaataaacattttaaagaatttgtcacattgaattatggatagtatttactactgactgtgaatgttacccgccacatgcctctggagattagtcggaatttggctccggaatcttttggagtaaaatagtcaaaacatgacggagtaaaaaactaaaaaaagcatattaactcaatttacattttcttaattcttatgggttactttacccaaaattgaaccaccgtcaaaatttgagtgcaacagtaaaaatcagagtctcgaatccattgggttctccaattttcgccattgcaaacagctaaaattccaccaaatcccagctcgaatttggaacccagatcgccgaatctcgtatggtggcgttaaaagtccggcgggcacctcacgtaggcctcagccgtttccgcctcttcgcagactcttctgaccttccccaaaggtaaaatcacaatggcccttgattggtttttgcctcatcggctctaaagtttactgctttcccctgagaaaatgagtaaaattactactttttcatatttggtattgttagcaatttgaaagtaggaatgattagtagttggtttagtttctggtgattgagctgctttagcttgattagggaatgagtttgaatctctctgcataaacaagaattttgcattgtttttgactgttgtagtatctccggttatttggcttgataagtaggcaatgatcagtttttgatatctatagttttgaagatcttagagatgttaaagttttggaggctactgttccttgtttaaacaaatttgagtctgaggtctctgacttgtggtgtggttgagcatcctgttttacttcatgtggctgtcgtggtgacaccgaatggcggtgtatgcttatatccttaatctggtttataggattcactctaatgacttcatggaggttgataatgttgtttaggatgacttgtgatcattgcttatttactatttttgcataattgtttatttactactaaggtcatccccatctcttcttcttcctcttctttattggttggttatgtttttataatatagttttccttcacttttaatattgtaggttcagtgaaccttttgttctgtgtctggccagatccaattctatctcctcccactgtccttggaaatcccaatgccaccaccaccaagtagacctttttctatataaattcttctttttattctttaataagtaacccccttcaatttaggctttgtttctaaggcattttctttcctgtaatctgggtttttgtgggtccaacacactctctctctcttgattttaacaacttggcaacttcattcaatttcaagttccaaaacaagagagagagagagagagagagagagagagagagagagagagagagagagagagagagagagagagagagagagagagataaagaatattttattgtgtccatgagttggttaggtgatcctccaattccaattggctatccatctatcctcttcttttatttatactctcagaaacaagaaatcaaaaaggcagcacaataatactgtctaaatgcttctctactttctcatcacttgtctctctttctttttctttaccaaatctctttctcttcctccatgggcatctgaaaccaaaaccttgctctccttctacttcatcaagaatccctttatgaacaccctacatcagaccaaacacgatccagcctctccggtgatcgaccaa

SEQ ID NO: 3941 - DNA, 1288 bp, Arabidopsis thaliana
gtaaaaaagaaagcttatgttcatcagctggatgagtgtagaagattaagactgtgtaaaggttgttatgtagtagtacgcaagcttatgttgtcatggataaatctggttatattttgacattaaaccggtatgcagattgctgaaattttagattttatggatgacgtttccggttaaattggcttattttctcatttgagtcaaccaaatatgaaaaaaaagaaaagtaaagagagaacaaaaagaacacaagactttgcattgcttccacaagaaaacataataaagtcaagaataagcacatacctctaatagtctaatttaccacttttttttttactttgacttgctcttccataaaattcaattgctgtcgtcaagaatccgtcactggtgacgatttcagtattgagctcttattactatctagatgaacaatgtatcaaaaaggcttttgtttggtctctagtgcatgtgtttgaccaaattgaattttctcttcgaacaaggtaatgattgtattcgaacttggatctgaagattacttttgtattttagctttgcgcaagtttgaagatttatttttttataaaaaaaaagtcttgaagaatgtagttttttttttactatacaataaaatatgaaaaaacagtttaccaaaggggaagaattacttatttagagctctttaaggctgtattttccaatgattagtctaaagtacattgaaatccttaattttatattttttgattaggatacagttggttaggtgttgatataaattattaagttatgcctgtggcaagcaagtccatgagaaaccaagttgcttgatttattctgtgttgtgtacacatgtgttgactatgctacttttgttagattcacatttttagcagtagaagtttctaagaaatgagaactatgtgatgtattacgggaaagacgatattacccttgttattcaacacccgtggtatgcattgtgccggcggtcgaagggtgatattgaaaatgtcaacttgtctcaagtcagagaatcagtgctctggtagttgtgttagatagaatattagtttagacgacttcttttggtcaaactactagaaagtccaaccttttaggtaattgctcttatataaatatacattacttctaagttctcaaccttcattacaaatcctctcaattcaggtttcttttctaacaagcaaaaactccaacctttactttatttttgttttgttttgtaaccctctcagatcttaattctcaaagaagt

SEQ ID NO: 3942 - DNA, 1511 bp, Arabidopsis thaliana
tctcttttcttaccatttgcacagcctcttccctctctctccttcttcttgtatggtcgtaaattcgtaatcatgtggttagagtctctatatatgtacaaagaaatgaaaaaaaaaaagttttgaaataagttgatcttaaccaaacccattaaattcaagactttagattgtgtgttggtctcaccaaactttgaagtgagtgattgaattttcgtaaatacaactacattcagtagttatgacgtgaaggaaagaaattgaattctatgtgtgaatctatggctcgtgtgggcctccaggagataaaatcatgccaaatcacatttcttgatttggtttgttaattagctcttcttacatctaaacaaaacattaataatactcaccaacacgtaattaattacaatgtcaattttggctagtgcaattattacgagagctttccgtgttgtaacttgtcatttggttaaatgttttacttaacaaacaaagtgaataataatatggttatgttgatcagtctctatcttttttcatgatgctttttctaggtttgcctataagtcctctatatttggggggtcttttgaattacatggaactttataaaaactttaaacatttatttcaagagtagtctgttgtatttaaagtttagttaaaagagtattcaacgttgtatctggtcatctggcactttaattacttaaatttataaaatatgaaccacaggtttttaatcacgggaagcagtatcgactgaacaactactacaaaattctacaagtgttgtcgtgtgttgattgaaaagtgtttttgaaattcgttttcgaaaatggaattgcacgagctttgattaaaataaaggtttcttttggtcaatagttctcacttaacgcaagaagaacaaatattagttgtcttcacgtgatcttccgacagattcaaagttttaattagttgggacatcccccaactgtaataatatctttttctccatcatcatcgtttcttcttcggtacacgtggcagccacgtgaaccactcgatagccacgtgatcatcgtcaactggttctgcatattaagcccaataacccatcaaggcccatacagtgagcataagcttttaaaattccgatccattaaatcaaaccggttaactcccggttagatctgtatattttccggtttatgtttattccctaaaccctgaggcctgagctgatgatatatccttttttccgacggcggaactcgattatacagttttcctctctctcactctctccgtagtctgagactcgccggaaaagcttgtattggcttctcttcgatttctggcggaagtaaggatatcacgtgagctatgaagttcctcatgcaatccatttctggtatgcttttatggacttttcatcctcgtgactaactagatagatcccattttgcatctgtcatgaatcgatctttatccttttgattcaatcgactgcacattcgtcctta

SEQ ID NO: 3943 - DNA, 812 bp, Arabidopsis thaliana
atcaatattttgtaaaatcatctctctaacacttgtttataactttagtttgtggtaacttgtattcgtcttccatgtttctttgttacgttgttttgtgcggaatgtcattgagatgtatgcgtcaaagtagactttcggttattgaaatttggtctggttatttgatttataccggatccggtttactcccctcgtatgagagaccttcggaactatggagaaggttttgactctctcttcagtgatatgatccgtcgcaaatcggaatctgccggcgagatggttccagtcgtctttgttcccttattgatagaataatcaaaaatccgagtcggagacgacgaagacccgagttccagctattaactatgcagataccatcaagagagcatagtttcattctatttctcttcatatctggtaaaaatcctcgtcgcacgaatttgccctctctcgaatttttgagcttttgaaattttatcttttgggaaatgctgcagcttttgtaattggtgctgcgtctgtacctgtacctgattctaattgctacgctctcgacaattcaagtcgtcttgtcgattttgtatcctctttctattttattaaagcttaggatcaattcttagtaaaaaagtttgctttttgttgcattggtttgatttcgtgtcttgtaaagctgcttcctttaacttggtttgatcagagcagctggatcggtcatccatttgaatatgatggcaaggttgtgtatatgtttctcattttttagtgttgagagttagttttaaggactttggggttgagttggt

SEQ ID NO: 3944 - DNA, 2000 bp, Arabidopsis thaliana
acttaagttgatgattagttgcttagttaatatgtaggtatgtgtatataaagtgacgttatgttagcatataaaaccatgcaagatgttcttgtcatggagtaattaatgaatcattaatcaagcacttagaaatttgtctttaacgatgatgatggaatatgaagcgtgtggacgtgtacgcgctagtagtaaaagggaggaggcagattgagtcatattaagggacggagagaaagagagagtggtcaaagagatattgaagggaagagtattattggtgggtttatgtgtgttttcatctcaattctcaccttttagtgcatcaatcaatacaaaagtatctgtcacacaaggaggaccctcccttatgggtattgggtagggtaggctttctctagaatagaacgtgaatgaatcgaacaatgtctctattgctcccgctccgttaccataaccggaaaccaaactgaagatgacttcaaaccaaaaagataaccatgcatgtatttaaatattagatgtaatctaactttctcatttccggcgttattaattagaaactagacattttttatgcaaaaggtttaataagttttctgctcgttcttggcctatctatatatttaaaagaatcggggaaactctatatacgtatcatgattaagagatgatttatctttctagtgatcatgcaggcagatttatccaaagatgaatattaataaatttgttgtgttacatatttttagagaattagaatatagagacttgacttcaatcacatcatgcatggtgtaatcttactatatatatactatgttttctatctctttaatttcagtctgtaaaatttatttatggatttaaaaaaaaaagaaattgactgtatagtgttaaacctattatatagcctctctttttctcgagcacagttaaattttgcatgaatgtcatagaaaataatgatagcaaaagctttaattttggatgttttaggagaaatagtcatattttggatgtttacaaaaaacagttgtatttattttattttttgtcaatatctatagtgcatgtcgtttctacagtttctaacgtggttcatgtcaagtagttatcagttttttttttttttttgccataaccataattagatgatggataccaccaacgaatcatttataataataataatttaaatgacaacaaagaatttgaaaaataataaaataaaatagaaatgacaacaaagaaataagccccacttggccgattgaaagaaaatatccagttgactccaaatagactagaaagagaaagaaagagagagagagagagagagagaaccagagattatcgaacacgaagcagaagacgattcgtggaagagacttggagagaatatttctcaatgtctcctctcccaatcttccatcgtcttcctcacgccacgttctcttcctttctcctctcactggttcgttccctccattgacgaatgttgcattttgcttgttacctacgactgcttttgattctctttctccatttgggtttcttccgattactttaatacttcttcaatttggacttgtcgtcaacattttcttgctaaagtatggattttttgttgttgggttactgttcagtttgactttgatttcagagaacccattctttgttgttcttgcgtgctacattgcttttagatctgattcactaaatccgttaaaataccaaatctttatcgtgtttgtctttttgtcctctaagagcattaaaacttggtgtttttcttgtcctctagttctgggttctctaatcgttttctcttttacttgtcattgtagtctcaagctggaagttctaaaacatcagtggcattcctcaatgccttcaaatcagaagatatcattgctcgaattggactatggtggcagcttataagggctgttgtagttgtacctgtcttcaagttcctggtgcttctatgtttggtc

SEQ ID NO: 3945 - DNA, 2000 bp, Arabidopsis thaliana
taaaattttacaaatttggaagatgcaactaccaaatagtaaaaaatggtaggaatggtggtaatcaatctggtagattatgaaagagtcaacagtaataacttttcaaagtaaatactcttgttccttgccaattagagtagtcaacgtctctggattttccaaattgtgaaactttcttttgaccatactttaaggttaatatttattaaatacccttaaatgattgtggccagtagctaaaatattaaaaacgttatttatttagacccattagttttattatttcggtcttggaatcggagataaaagtccataagctggcattagatctttcatgcacttgacaggtgttgcaatatctcaagatttatctatacgatagattaaaacttgggttgtccgaaaaaaagaagaagatgaaaatacaaatgattttccgaatattatatcaagaacaatactccacggctctgctgcctgcatcacattactgtattctgaatctcataattttcttgcacgccaattgtttcttgcctaaaatggaaattattattttttggatctgttaccgatacctttaccaactagccatatttggtaatttaaatttggaagttccagttagcaactactatattataaatttataaaaaaaaacctcggaaatattaagcagtccatgtgcacgagttcccccactaattaattccacaatacacaaaaccttctccagcgccaatagagtccaaattatctttaacctccacatgaggctgcatttcttttctcttttggtctgcatatctttcacgcaactatgataatattaccttttaaagttaaaatatgaataactttgttgccagaatttgccaattgacgattcctcatgtatgaaaagaatcataaatcttaatttatttgtagttcattttgaacatctcaaaattccgtattaactattagcagcacaagatggttgtcattaagagtgtttgacaaccatggacgaacgtaactgatctacctttatctcgaaattatgccaaatataactaaattatatacttcgaaatcacaagttttactaatacgtggtcttatagtaaaacctgtgattttgaagtacatttgattaacttggttatatcaaacatatacgattatgttatgtgattaagcatatgaatttaaaaaagtttatgctaacaaacatgtgtcaaccccaaagtcttaccattcataaacagaaatccacttacttatccatattccacataatttgcctaccgataatgtactaattagcaacaagtggaaacgaaaataagtgtgattaaacattacaactatgattaaaatggataaggttacagaagacagttagggaattggtcggattctatgaacgaaccttccagcgccgatccagcccacttcaccgtttctctcaaccaatcacacagtttccctcaattattttaataataatcatctctaaggtattcattattttattaacaaaatattcccccaaaaatttagtggagacattacaatattattattattgcggaaactcggagttttgagggagaggtcaccaccgttacacatggcatgattcagcttcaaagattgtcaatttttgaaaactcattttgttttctagttttggtgagaggtgggcagatacaagtggataacaaagttttttgttggatgataaaagagacagagagagacgacgcattttcctttattttctcggggaaattcaaagttttcgaattttcttcctttctgggttttcgtcaaaggagcatcttctttatgttcttttgaaagaaggctctcttctctatttctctcccctcttccggggagtttttgattttttaggataaaggagattcctttacctcgattttttgcttttcatttttattaaatctccgatttttgatttttgggggaagaagtagaagaagaag

SEQ ID NO: 3946 - DNA, 2000 bp, Arabidopsis thaliana
ttgagccaccccattggagagagagagagagacggagaaattctcgagaggaggcgatttgggcaaaaacccagggttcagacttgggggacacgaacggggtcgataaaattgggccttttatgggcccgtaatgtttaatcattgggctgaaagctgcaacatagtagcccaatttcaactcgtaaagttttccgcgttttttcccctatcacggacaaaacaggcagccctattgacaacttgtttaaaaagaagaaggaaaaaaaaatccatatagagacgtaatccgatggtcgatggagacgttgtaagaaacaaaagaattgtagaataaggttagctagaaattgtcaacaatgggttcatagaaaaactcgtttgaatcaaaattgtgtctaaacaaaacctttgatttggtgcgtatatgacccacgcattgtaactttaatttaagtcatgataatatttaatatataatgtcatgtcatcactgtttagaataaaacgtttagcttacgattcacgtggaaacaaaattattcagagatttcatttcatctatttatagtaacattcgtcaatattaagtatcatacaattaataacgggtataaatggcaaaatcctagactaaaaaggtgaaactaaaaagaaaaaagtagagagagtatacgtgtcgtgaatgacggagtaataaattatgcaatagagtagataaaaatacaatgttttcgtcatactcttactctcttaatttaataagatatatcctttatgtaattgttctagtaattgatcgatattaacgcgataactccttacgaatctcactcacgattgcatttgcatacattatagatgtaggagatactcggtgaaaatcttagtagactagaaagcaattgatcaacatttagtaacaagctatcaccacaagttcactaaatatagtatatatttttaaaacaaataccaacacttgcattaaaagcacataaatggaaacatttaagaggacacatacaagtcccattgattatttttattttttgaccaaatactaacacacctttaaaaataagaaaatgctaacacttgcagtaaaagtgatactactaaatatagatattttaagagaacatgatacaattaattcttaaatactgtattgttttaaattttatacttttatagtttctaattattaaaatacatcataatacacaattttcataccatatgtcaattaagagtatcaataataatagtccacttatgtgtagatatgtcagacctatttttatgaagtatcataaataatgtatgcacacatcacaatcgtaaacaaattactactctttctatttcataaagtttgatgttttaagttttgcacataaattaaaaaaaaagtaacttttatatattttaattattattctgttagtttaataatattattattacctctgtcctttcactattgactacaaacaaaacttacaatcatatttttacaaaacatcaattttgatgaaacaagtaaaaatttcaaaacatcaaataactcagaacagaatgagtaaatttttagctcactgttttaaccatagtgcctactatctttaaccatctccaaaagacaccatttgtctttttaactatactaaaacaatcaaaacttttaaaaccaatcatatctcattttaagaaaataggttaaattatctaatataataaataaaaatctaaaaaggttgccacgtaaatagaagaattgattcttatttatttttttcaaaagtggaagaatcattttcttctattttaaatgtaaacagaccaaaagagaaaaagctcactcacacaaagcacctccaattctctctaccatacaaaaaaccaaacccacaaagtctctctctcttgctctctcggtgattcgattttcagaaccgaaactccggcgaaaagattatggcgggacagtcacgaaa

SEQ ID NO: 3947 - DNA, 1452 bp, Arabidopsis thaliana
ttgaagatcatcgtatggaaagtggagaagaaaagggttttggtgtgaaaaatataaggtcgatagagagagtcaacgtctggtttgtgaaatccacggaggtgtaagagtcattgcgtaactgtggatcatagcacttgcttattgtttattgataatattttttttagttaaaagggaattttatttgatttgatctgttcacaccttttgactttgaagaagtctagtgtgtctttttgtacttttacaactaggaaataacaccacttctaaagatgaaaactttcactactatacaattagtggtgacaatctcttagaaatgattagtatatagagattttaattaaaaatcctaacaattgtttttgagaattatatggtgatatatcttatctaaaacttcaaaatcttttctaaatgagttaatataagctaatgttttgactcctaacatcttatacattaaagtttctgagataaatctctattcttagtaaactaaactaataactgatccgcctaatcaagtatcataataaattgcaaaattttctaatgcagaatcatcacaagttaaatttttgggtttttatgtttagtcttcttttactttttatattacaggagatacaatagtttacacgaagcctgaaagtgattccaacaataatgaaaattagaaatttcagctgtgttattactcatagttacttgatgatcaataaccaagacatctaatatagaataggcatccaaaattaacattggacaattcgtatatatgatataacgtatataaaacttaatctcgaaccataaaacgagtattatctctaaccatttataaatctaataattttatggtggtaggaatctaataatattcagttatctagacaaagcaagaaaaacgatatcaattgacatcgtgacaactataactatctattatacacatcgtttaaaaaaaataaaacaataccattaaaatccaatcgacgtatgtaaatcatcatcgttgacttgccaaaataaataataggaaaccttataaaatttgatgctaactaactcgggcgggtttcatccaaattaaatagaaacattgacggaacatggagtgtccaatacacacaagatccaatcattacttcgaggagtcacttcaaaactccaaataacaatgacccaaacaaatttcattggacaatgaataattaacacattattatccacaatcaggatcgtataaactaaaaacctttaattcggggctagtttagaagtcatcactttcccgtgggtcattttgtaatttacatttcccaaattatctcttttagtttctccgacgatgcctgaaaaataccaaacattagttacagtcggaatttcgaaaaaccctaattcagctaaagtttgatcgttgatctaaaagctcgagtg

SEQ ID NO: 3948 - DNA, 383 bp, Arabidopsis thaliana
tctgcaaacaacgatcattatcttactctgttgggcaaacattttagatatttcattacagtttccagtgtctttaagactttaaactctgtttgaggttctgttgtaatgaatgacccgatctttctgttttaaacggatatcgtgtttcttatggctatggttttaattcctctgttctcgaatcgatccagtagaaatgttagccatcttctccgaaattgattttcagttcttttttagtgaccaagagtttatggtgaaaaaacatcgttcaaaatagtaatcacaaccttttatatgcttgacacgtggcgggacaagggacacttgaacttctactcagtcgcaggaactggacggagtaggagagacaaagaagg

SEQ ID NO: 3949 - DNA, 1270 bp, Arabidopsis thaliana
caaatttttaccaaacgtttccaaaattaatatacgttttttcacagctatattttattcatttaatgttgtatagttaacattttcacaaaagaaattgcaaaattgaatttttttttaacaaatgacttgggttctctacagttgtagatgggtattaaggcttactttatttcatttaacgagtaagttctatttgaattattaattgaagatttaggtattaattaccatagtctaaaataataataacaaatattttgagagatgatatacgtataacatacaaaagagcatgctagcttttagtttttcatacatgaaattctttttcaatttttatttctctttttacaatctaaatcagataaatcatgaagataaagacattaatccaaatgtaaatcaaaactatatacaaggcaaacatgaacttgaacctgaaccttaacccagtcggatttcaaagaaaaatgaagtcaatgaacaaatctcacaacatcataaaagtttataacagttatctcgcaacttccaaaatttgaaaaatgtgcctacaatataaagattgtgttgattgtattgattttatttttcctaattatgcctaaatttatagtattgttgccattatcttcagttagcaatacattttagcgaaagtatcacatttcgacgataaaagtgtgttatattgtcatcattcactcagtcatagatattatacaatttgaaaattgaaataattaatatattatttggatttttgtactaatggccgatacttgtcatcaaatgtaggttaatgttcaaaacttgattcttcgaccttaaacacacaaccgtcttaagaactcatttgaagatctagttaaatgaagatctagaagaactagatgatgctaataatgatgatgataataattttgtcaacaaaagggtatgacaacattagtaatgatctttgtggctgcgcttcaggcaggttgggttctcctaaaagcagtatgatggtgggacaagttggagcctgatagaggttgttgtcagagatctctggtggatacaagaagacacaagtatgtcaaaagagtgtaatgcgcacacgtcactgcttacgaaacaaaaacatgtctcaaaataagaccgttgactcgacggccatgtggctgtatgtcaagtgatccaacaactataagtctataaatgtggtccatatttttccctgcttttaatcaaaaattcagaggaaaaaaaacacgatcgagaa

SEQ ID NO: 3950 - DNA, 2000 bp, Arabidopsis thaliana
caagtgttttatttattggtaacatatatatgatcttgaacagaatatttttgtagtaataattgtatgtttttatttgtaggatctataatggagaagttagaaaaaagcaagatggatattcagctcaagagatgaatgagtttttttttttttggggttgtgtaagattcaaaactcaaacttgtctctttgaaacttgaacaaaaaatgtgtttttttctttcttcttttacctttttgttcggggttgtttgggaaaccgtggaaagtgtcgggagatatgtgtaaaatctggaaagaagggaggaaaattttggaactttgtataaattatggggtccataaagtaatcaattttgtcacttgtcaattatttttcttttctttatatagagggaatatagagtactttagatatttgtttaacttttgctttaatttttgaggaatgatgttttcgtttaatcattatcctctagcataatcattgacatagaattattctttgaatggaagctcaaagctgcatttgttaccaaacaggcaatcacagctgttaacctaaacacaactgacggattataaaattctagcactgaaatacctatttaaaactttcactcatttttacacaagaagtttaaaaaaaaaaaaaatcaggtagatatttcgggtaaaataaatactcccatttgtaccaaaataaatgatgtttaacttttttacacaaagatcagaagttattatatttttttccgaaataaaaacgtaatttatttatttatacatattcaataaatgataaaataaaatataaatagtcataaggaaaaaatataaaaattttgcatagaaaaaaaagaacacgggtcaatttcaaaccaccaattattctgatatcacagatgtcaatacgcgtcagagtgtgatatatgttagttatatgcgattttagtaacatttttggaattttcagtgttgaatatcacatgtatatcgttgatcaaattattttagtaaacatgttttcaccagttttatttgaatttatagtcatttcaccaattgattctagaatatatttaaaattcttaaatgatataaaggtagttgaaattagataacctaacattttttatgttaaccaaactttttaattaaaaataatatatttataggcacaacctattgtaaattttttaatttacatagttttaagtaaacgagataaaagaatcagttggtgatcttcaaatcggataaagtgttatgagtgtataggagattttgatacaaattgaattctttttggagtcatatattttgtctatgctcaccacagcatcggaagatcttccatcacaaaacagttcacatttgtggtggacacgagagatgaagaatctgtctcaaggtttaatcactgtggtattatatagtaaaaattttatgatgatattaaatcatgattttggctatgttaaaatttgaggtttttggttctaaggattttttttgctagatttatgttaatatctaaagtttaagaaatttgataataattatagttacgtgacataattcaaatttatgatgaactacatttactatatatagccctcgagataataatgttatacatttatttagtagatatattattagataattcaaaacttaaattacattattttgtttatatatttcatattatgttaaagtttaattgataaatgatatttttacgaaaaatttgtataatactaaagataaattttaaaaacatcaatttcgttttatttttattaatagtacataaagaaaaataaataaattaaattaatttgtgactattttggtatatgatcaatgctcgtctttttaagtagtaatcgtgtctgttacaggtgaatgaacccaacaaaaatcttcgacgagcatcttctgctttcttcatctctgaatgatcaatttctagaatcagatcggatatttcg

SEQ ID NO: 3951 - DNA, 1915 bp, Arabidopsis thaliana
tcttaacaaattgttaaagaaaaatcaaagaaagtgagacgaaatgaaaagaaagtgagattcgtcaccacaaaaggtcaatcgaaggaaagaagaagaatcagaaccaaaattagatagctgacgaagaaattgcaaattgcaacaaacgattgtaggaatcgaaaaactctcataagagaaagatgattcaatgaaagactcatctccgatgatatgcggaagctcaaatgatatgctctgataccatattaacaccggcgaagttccggtaaaacggaaaagaagagaaaagatcggagattaaactgaatctttattaacagaattaagtgtttgttacaacgttcatcaacaaaataaactaaagtttagtttatatatacacaagataaatgatattaaaccagtatctagataaccggagttaaccagattaaaccaatcaccaatatccactgttttttttttctcatataggctctagcaacacaaacttacgtacaaactacaaagtctaatttcaggtccacatataaaagactttgactattcttttttcaggtcaactaagtctagacgaccacttctgtctagcaataatatgacaacttgatggataatgacatttgaagatgagtgatcgatttttctagttacacttctttacaatttctttgtttttgtttttttctttttcttttggctcctgcaacacaagattaagtcttaaacacaaaagtttccaattacatgaaaggctttggtaataatatggaaactaaacggattaatggcatttcaaaatgagtgattgagatttcacaaataaactcttttgtcactatgatgtcatatattttaagcacaacattattgcttcaaaatatataaaaactaggaaactggatagtgaataagttttaataattttaaaaggtgttattgtttataaaaaaaatattatgtaatcttaaataggtttcgtaaaattatttaaaattataatttcaaaggacaaatatgggttttaattagtctgttagttaattaatcaattcttcatagttttttaaggtattgtggtaaataatttttagttactatgccatccatctttttcaaatttaactgctaccactttagatttataataatctaccattttgccaaaaacaactactcctctattcctaaataatatatttaggaaaaaaattggttccaatgcaatagttattagttattattgatgaattataaatttcaagaaaaataattgtatactatattaattaaggttatagaaaatggtaaatcgtaaattacaaataataatgcatttataaattataattaacttttaatattttttattgtatgtgaaaactcaaaaaaaaaaacatttgttagaaacagagaacatattaaactcaagtccatctctgttcctcttagcgaagttaaactcttcaacttcaagggagagaacaagaaaaaaaaaaatgcaaaacaaccaatcatctcttccaatgaaaatgtgccacgtatacatgatcggaaacgttttgactcagttcactttggtttaactcgttatcggattaaaaataaaaagcctctctttttttgtctcagtgagacaatcgactttctaaaatcggtaaacgatttcatctcttaaagcttctcctccattcttcacacgagtcaatttaattgagggttttgtttgatcgattcttgaatcagatcaatcttcaaaaactagggtttgctttatctcttttgtatctccttgcttctcataagttcaataaactcaaaattcgttgaaccttaactaatgatttttagggtttatgtatttgattttgtgaaatctttggtttaaattgtgtccacttctatgtag

SEQ ID NO: 3952 - DNA, 732 bp, Arabidopsis thaliana
aaatggagggtttgatgtcaaaagattgtatttgagtgtcgttcaatttattggggtatgtgtttgtattgtagtttgtatgccaagttaaaatacaacaggaagatagatttaaacaaagtatgataacttgtctgactgtttcccacacgacacttttgactggtttttagtttatttgacaagattcgtgtgctgtcgtcttgctgttgttgttgttcatgtgcaaacttgaagtgtaatagcctgcaaacagaatctccgatctaggaaccaactaacaataatcaacaaaaactctcgatccaacctagcacagaagcttgcactcgatttgctatagtgggtggaagttgtattgtacttgtatttgtaagaactaagaaggatccatagttttttgatcaaaaagaaaaaggaaaaagaaggatcaataggcttgatgattactgattatgtagatgggtatttttattggctttcttaggcccaaacaagggatctttatgggcttttattacattggtactgtcagagtcggataagactccgaccgaattttctaaccaaagtgagtctggttcgaaaagactgcttcaatgaagccaaaactatccaataactcgaaattgactactcttttcttttgtctctgttgttgattcgcaaaggcgaagattatccatcttctcagttactcctactggaaccaaaagctcagaaccttaaaac

SEQ ID NO: 3953 - DNA, 1615 bp, Arabidopsis thaliana
ctctctctgcaacgaaaaaattagacatttcttcatgaatcaaaaaaagaaactattcttgattacaaaaacaaaatcaaaagagaattttgacaatggacccctgtgatcttaatcttttagagctaattaagaaatcaatctacaaacagaaaccaaaacagagagggctgaatcgataagagttttaaacataccaagatttgaaaacgtcaaaaggaagtaggtgatgaagttgtacgagaagcttggtttcctcacatatctggctggagaaaggaaagacctttggtaggagacagttttgattagaggaagacgaagaagaagaaagttttgatttgggatcaaattcagattgtcgtagccccaaaaagaagaagaagagaaaaagtctgttttgttttgccttagaaaagcaacgaaagttcttaagattttgttcgtgttctcttacttgccagcacaacacactatttttacttaacactaatacaataatgtattacctgactctttatgatttgttttagctgtattgcaattttcaactgtattatatgtttcaaagtcttatggagtaaattgatatatcaaacacacatacatgtcttgtgtcttcattaaattctgaaaagttaaatacatagtagattgtaagactatttgtggatggatatatatatatatatatatatatatatattttcttaaagatcataatgtcaaagtttcctaaaatttcagttgtatgaacggtaacttactatttttcctccacacaagggtccaaggagacatgtgcaagtaataaatgcaacacacataggaagacacacggctaccatcttccaccatggcaacaatgcgatatttggcaagatttgacggactccatacattactctactaccaaatcaaaagtattggtctcaagtacacctaaatcactttgcaattagccagaccactgtttcacaactaaacacgtcttcacccaaaaaatcggtctacaaacttgggacaggtaaactttagtaaaacattcatgaaaatagtgagtatacttggatccatatctcaggtctaatccaaacactctttgtgagtctatgacaagggtatatataacctcattttggagtccctaatagcataatctccttccagattgattcatccacctctttttagacgtgatgatttactccgtgttatcgtattatcaatcatttagattactactaccaaagagggctcgagaaataatatcgtatagttgcaactttgttgcatgataagctttgactagtcttcatcaaatccatagcttttgcaccgctcagcttttccgtacagcatttttgtcaaatgccatttttacttcttttcaaaattagtgaatataatatggaaaacgtgttctccctgtgacctatggaccttttatgggtgtaatatttgtggatatggaatttaaaatttcttaatgaagctgctatttagcgttaatttttaagtagctctcccttttccttagaacgtgtaacacttttgtatatgtagataatagtagaacgaaaaaaaactctttgtagagagattctgcttctat

SEQ ID NO: 3954 - DNA, 2000 bp, Arabidopsis thaliana
ataaaaaatatttttagattttttctttcttttgtatataggataaagaaagaccattcataaattgataaatcttgccagtaccaaatttaggtaactagtgattctgatccacacgtatactctttttttttgtacatatatttaaatggggaatctaagctaatggaagaaaataaacaataaaaataaaaaagataaacagaaggagaaagtagaccaaagttacatgacaactaggaaacaaaaagttcgaaaagaaaccggatttgttctgctcggttaagttccggtttagttcagtatgaacaaataaaagtaaaacaaacgagggacgtgtgtatggaagaggcaaaggctgagaaacttttggttgggacaatttgcttaagtaatgactaatgaatgacccaaaagaaaaatcctattaactctttcttcttaagccaacttgctttcttcttcaacattacacattacgtgtaactgtaattaattaaaaatctttacacattgaattattagtttttgtttattcgttgatttaggcatttagcaattcaattcagtctttggaaactgttcttatgactgaccctttttaactttttgattcaatttccttaaaatattagtttttattttgggttatatggtaaattacacattgccgtctcgtcctaataatcctcttttctgttcccatttgtgttgttgtgctttgcttccttcctttttcctcattctctcttcttctccttcttccttctcctccaccacaaagcggtaggtttctctcttcaacaatcggtgagtctctttcgttttcattaagaatcttcataaagttttgatttttattgttcttagatcgatttatgttctgtatctgtttggttttggttttgattttgatttttgtgtcttttctgggttctattgggttttcaaagctcgatcgaaatagataagaatcggttggtgggttttttgaaaaatagttttttttttgaaattttgtgtcaaattctgtagaattgttgttgtggtgaatttattattcatcagaaggtaaaaaaattattttttgttattgggttttagatgtttgaatcggatctttacttctatgagcttgttttatgagaaagtttgattctttgaggtttttgaattgttttttattgtgatgatgctttatcttcaagctgtgggtttcttttgtctttgcttttaccttgctgtttcaatacatctttgcttggtattgaggatttgtgaaacttcatacgctgttgcatctatgggtagttgatatgtcattgatgaggcagtgcttattttgatatttctcttgtttttctgaattgccattgtggtggtagttgagtaaaatgtttttcactcttttccttgtttcaaaattggcatgcttgttacgtggtcctggattttgtttgtacctcattttcattgacgctttgtttcgaagttggcagttaggtgtcaatttgataatttagacttgaagttcttttgtgtttagaatggttgatcatatgaattttctatcgcatctgtcctcttattttttaagcttgttaataactcatgtgtcattagtttcctactgaatcatttgtgttttagttaggcgtcgcatctagaagtaagttgcatttagtagtagttgcagcggtcttgctttgagtgacttttgcaccttgtgctcttctaggtgaagcagattatatgactgtatatgcaatctcagggtgccatttattattacaattgtaggagctatgttttgattgagtgtgtttatatgtttcttattacagttgacatcgtgtagaagccttttccttgtctttgttactgaaagatctactgtctttgttgttttgcagtctccccattaggcacattgttgagggcagggtagtctcgtgagttctcttctcctgagtgtaactgtggttaaaagcttagccaag

SEQ ID NO: 3955 - DNA, 2000 bp, Arabidopsis thaliana
atatgggtgtcagctctttatacgtgggtcagctctttgattaattgagtttgcttaaagctggggttgttaggatttattacctaaacaaatccttatgttaccattattaatcgagaagcatcgttagtaactagcatttgtcttgaaagaatttttactaaaacctgccatatttgacatattgactaaaagttattctcttaggtattaaaatcatgtaagtcgtcgttttcatttagttgtaataaaatcatgcatgtgctgataattactatttgtttttaatttgggagttccgaaccttttgtatataatttctctcggtattagaaatttaatttaaaacattatgattataaaataaatttttcgtatgaaaaatagattaaaatccagaatgccaacctccttaatttatactactctttagttgtaactaaaaaaatagtatttcttccttttgtaatagcatgtgcttgataactacaaaagtttcaatacatagtttaagagtttagaactctacctgatatcaaatctttaagattctattttaattccctgattttggcagtaaagcttttaaaaacgacaaatatcaacaacccaaattaaaaggaggaataaaatcaaaatatttttaaaatatgagatttacaaaaaatggcgtttgtaacctttttaaaacaaacacaaactactttaatatgtgtatgaaatcttagaaatacttcataagtactgaataaaatccttacaaataccttataaacaccttgtaaaacgttttaaaacttatcaaaccttataaatatttgaatcgagttaacattaagaagtatcttataaactttataaacttttcagaattaatgagaggtaaatttgaaaataaacatctaaaagagacattttagaaaagagacacaccaaaatatgtatttctctaaaattctcattaaataacaattactgtacatgaatatatcaagatcatttttatacccccaaaaaaatatgtgccctcttcatatctaggaaaccaatttttattaccagaactgattctaatattttttcttatataaaaaatgttgatatcttatttaaaagtaaatacagtatgttttaggttttacaatcaaaacattctatgatattttcaaatagtcacatgaaaaaaaaaaatcgtggaaacattaatttttattttatctttttattagatagttatggatattattaccaatcaagaagcgttaacttcattttgcaaagagttttggattataaatctctattaatgtttcattctacatctgcttgagttcttcactcacccacagttagtaaaatcatttgttgcaaatctcactcgacagcgactattttttttttggacatctttagatcgacaagacccgatccataatcaacagcagctagttcatttgtttttttatttttattttttaaatatttttcttaaagcaagattttcttattgttattgtatgcagtaatttatttacatattataaatcatctagataagattaaatattaccaaaagatactagaacaaataacaaatgacgtaagaaatcaagatatattttgtttaaatttaatgtaaaagtgcatgatcattttatttttttaacgcgtataagtgcatgatcattattcttaataaaaacgtacataatcattattgatcacagatgaaaaatcaaaaaaaaaaaaaaatcaaattggtagttgaaccaagaataattgttgaatcatccaaagatcttattcttaatattctattatatataatgcaccaattttggcatattgacgtatatcaacaacccaattataggtgtctctcacccattttttaatatcaaaaaactctagcacgtgaattatgtctataaataaaggtttccaaagccctcttcctaattcactcataatctacttactcatttctactatacagtata

SEQ ID NO: 3956 - DNA, 2000 bp, Arabidopsis thaliana
cgtaaaacaacagattctctttcttttggattttggagtggaatccactgcatatactggctgatttttccattttctttacaacattaaaatcgttttaataaatcgtccacagttaactaaaaattataaactcatacaattctctataaaatacatcctattttttctattatttatttaaaatattcccatagttcttagttgcttcaaatggtcaccatttacttaagaaatgaatttcatcatattcctctaactatcattttcagtacaacaaactatatatatattcaatagctgccacatacgaccatgatgttccaatataatttgtagaatatgattcagaagaggtttggttcatatcaatattaagtctatacactggttaaagcccaaaaattgagaattcaaggttgtaaagctataaccttgtatacattgggcctagcagtccttgatttcactaatatgggcccattatcaaggcttactcgtctgaatagtgaattctaccgaatgttgggctttttatttccaactaatgttaggtttcaaaagagaaaagtgcatgaaaatcagtaaatcacgtttgtttggggtttcagaggaccgacactctttctaaacataacaatattcgagcaaattacatgaacttggattttggccattaaatttgatggtgtggttgactctcacaaaatttctacacagaaaacatgatcaaaatatgcttatcgtcgtcagatatatcaatattccaggcctaatttgtgagcaaaatgatgcgaagacgaggattgtgatgtttaatccgaattatcatgtaccattgtatataatttacctctagatgattttcagtggtaataaggtatatttaataaatgtaaatcggaagtttagcctttttaattaaaaatgcaaacaacacaaggaacacatggatgaagcaaacataaccaattatgagtgactagtagatagtagatatacaaacacatatttccgatttcccaagtaatatgaatctttgtgatgacaaaatcgttacatcattcacgttgtattaagttacaactaaccatgcagtttttattttacaagtaaatgtgatttgttttctagtatacccatatagattatactcctttgctattttaaggtgatatgaaagctctcccagagactagtgaattagttatggatggttgccccgcaaaataatatcgttttgtaatttaatatggactaatggttatctcatgacatatactaattaaaattgttaaactatagaagttatttaaaaagaagattgaaaatgagatgtggttttcattgagttattatttattaattttgaaaccataaaaaaatgatgttgaaacttgaaacatttatatttgttgcataaacaattaaacatgtcaagggtggtccaccaatacgtaacatgaacagtccgtcttaagagattccaacttccaatcccaaaatattcatcaattctgtaattgtttagtcagatttgaaataattgcgaatagagatatcttaaaaacttcattcaatagcaaacatgaattgtataacaaatgtctatttcatctatctgtcaatgtttaattattgccacactggtgatgcatatataacaaaagcgacctatatagattaaagtccttttataacaggttcatatacacccagtaaccaccaatacacatacacgtacatatatatattattgccgtttgagagtcaaactcatacacgactcactgaaggttgatacaaaatatcagcatataataactaaatatatggtcgaaaactacttatagagtttggtaggtcgtattttcaacattttaaactcaatttttatgttgacaataacaaaaaaagaaaatcatatcatatatctcaacatatagagtctaacttttttcgccaaaccaaaagaaagaagaaaccaagaaacaagaaaa

SEQ ID NO: 3957 - DNA, 2000 bp, Arabidopsis thaliana
ttaagagaaaccaaagttgcttcaatagtaattagagatggggaaattaaggtggaggagaaccacaaaagtggcacctctcatattttaaattattatggaccaaataaaagaaagagggagagagagaaacaaatactcacgaataagaacaagaaggatttaacaaacccatgatcattgttatcattagcctaccacgtcactcctcttttgtccatttcttcccacttttaatatctgttttaacttaccctcgaaaaatggagaattgtttcgtaattttctcaaccttttctccaaaatattcagattcctttcctcataactatagaaacaaacgtaacaaaagaaaatgtaatattcaaccaatctctgaataatatgcatattactgcataactagatcattatacatgcatccttatttcaaaaaattaacgagaaaaagtttataaacattttagaaaattatatataactggaatcaacaaaaaggactaattgttatttaatatactaatataagaaatcctgaaaatagggattaaaacaggagacgaagagcaagaaacagaaaatactctaaagacacgaaaccaaagagagggtgttgcctagtcagcatctgatgacgtggcatagctctcgtgtgtgtgtgtctctacaaactctaaagaaacggctataagtggaagcgtttggagaggtcacgtgatttgcacaaatttttcgttttcatgctattattatcgtattattaatcacgactctctctcgtaacgcatcatttttttcgtttaatttaccttaatttattctcacgcgcgacgctccgtttcgacgcgtggagtttttgctcaaaacatgcatgattgttaacgttttctttttgtacaaggaaaaaaaaaaacgtgtacctctagacaagagttagagagaaatgagaaactggaccaggagatgtgaatggtttcattcctactttggttaatcattgcaaatgccaataattatatagagaacggcgtcaattttctgcaaagaaatatctttactggtacttttttgtgctacctataaatgtgttggtttaatctagccatcacacgtatatttctagctatgttagatctttaatcattctcacctagactcctttacaaaaaccaatatagatgaaaccagtcccacccctctcatttaagtcatagtatatatttgtgtaacgagaatacagacaaaacaattaaattcattgtaatcatacttgaaaatatagtcaatgaaattaattatcctacatttttgaaaacagtgtctataattattatgtacattgaatagatacgtgggatattttggattccagttcatatatatgtagattaaaaataaagagagggcgataaagcctaaagaaaatgtacaaatcgtaatgtaatctagtgatgatttcctctatataggttgatgttgggtagacttttggtcaccatgatatttatctatcgtctataaagtacaaaactgtggtactaaatgtgatttatgaaagctaattaaaaagaaggcgtgaagaaaatgaaatcgtaatagacgacgcgcgtacgagatgagagtagtggaggaaagaagtaagattgagtgaatgataaaatgcaaacgctacctactaatatctccacttgtcatgcaaccagactgagttcgttttccttttcgagtcttatttttttgttttttattctactcaacacgttacacgcttctaataaactctaaacattaaaatcaaaatattttgactacaatggttattttggagctatatataaaccacctgagcctcctcagtttcctccatgaaataaaaagaagcatcttctagagagagacatatagagaaagagagagaaagctttagggtttcaaaaaaaaaaaaaaagagaccctttagaaatctcctaacaggaaagttttctcaattgctatagaaa

SEQ ID NO: 3958 - DNA, 2000 bp, Arabidopsis thaliana
tgatccacttaaaaactagctttaaagcatacggtttgtttcctgattatgttcctaaacttgttatgtttccacctgcaggccaatgactctggcttggcttcgtatgttgctggtcaaattgaccgtaccttgagctggaaggtaagagaatacaacaaattttcagataccacagcaaaaccaaaaacttgattcagattgctctaactttcatctacaaaaacaggatatccagtggctccaaacaatcaccaacatgccaattcttgtcaagggtgttcttacaggagaggatggtgagtttccatttgccaaacaaataatttcaacactctagtgtcatagaaatacctgacaaggtcaactattattgtccccatgcagcaaggatagcgattcaagctggagcagcagggatcattgtgtcaaatcatggagctcgccagcttgattatgtcccagcaacaatctcagcccttgaagaggtagatcattctcgactacaaacataaatctgtgttctcgataagtatttatgtacaagcacattagctttgttctcttgtgttcaggttgtcaaagcaacacaaggacgagttcctgtcttcttggatggtggtgttcgacgtggcactgatgtcttcaaggcacttgcacttggagcctctggaatatttgtaagcatcacatcatatatccattcaccagaaagttgcttaaaaacagtaaatatttaaaatgccttctcaatctcagattggaagaccagtggtttttgcactagctgctgaaggagaagccggagtcaaaaaggtgcttcaaatgttgcgtgatgagttcgagctaaccatggcactaagtgggtgccggtcactcagtgaaatcacccgtaaccacattgtcacggaatgggacactccacgccatttgcccaggttatagagaagaaaaaaaaaacagagaacagaaacaacacggcaccaaaacgtattcatattctgattgatcactttgcttctactctgctatatttatatctcgaaaaacttgtttctccctatatcggatcacaaaaacgtgcgtagagattctctgtaatgctatttggctacattttacctttccgtttattcttattgcttgtacaatagatgttgattcctacaataccaatgaatactaaaatctgttcccggaaaactagtatagtcagaaaatcttacattgcacccaacttccacaatccaaacacagttcaaatcttatattaacagcagccaaaacctcacagaaactagctaccaaaagagcacaaaagaatactataggagaactcagattaaggaaagacaggtttgtgagatttacaataccttattgaagaagaatgtaagcgaattcatccttcactttgtgctgggctaagtattgcatcgaaaagcccaaaataatttggctcacgaattcgaaactcttggatttatgcacttttctgaaaaaaaaagaaaaacgattggtttacgaattactactatttttctacgagattaagaacgataatatgtaagaaaaatctaagacacacaccatccatcagatttttgtccgtatctcctcatcaattcttcacctccagcttctcatccatatttctttctttccaatgcaaacaagttttcaactgttaaaagataaaccaaaaactcacaagccaattaatctatcagaaatatttaacttttaaccaaataaaaacgttgagatatatataatataagcgttccttaccactcacacacttcatctctccccagagctctattcccatcaaggtgtgtgagattctctgctaagacaaaccaaaaaccagattgttttgcgttcatggacatgttcctctctggagattagaatcgtagctatgactatgtctgaatttcacaagaggtagctaactcaggcctttttgctcttttgacagaaacacacttcggaag

SEQ ID NO: 3959 - DNA, 2000 bp, Arabidopsis thaliana
aaaaagagggttagcaaagaaattaattatatgtacgaacatttttttaatccccaaaaacactatactatcgttgacatctcgtgatagcaagacaacgtactattaattaacaacacttcactatttaatcgacgacagcttcactcaattgtgggaagttagagctcaagctttcgaaatccctctctcaagctatgggctttgggtgctgatgaaatcgagccatgctcttttcccctcccagaaatcagtttcatctgtgaactgtgatatatggtttgttgcatgttgtggtcaaatttatagttataaaaattacctctcttccctattgtcaagcttgacaagaagaaagaaaacaaattaaagacgcttgcaatgttgatcacaatcaaaatttggcggcgtttggagaagcttgcaaagttgacttctgtatttataatggattgactctttgcagaagaacaaaattaagagcaatagtagtaaataatcatagtttagttttttatttgtaaaattaattttctaaaatataatgatttacttatcgtacatctttgttatggattttaatgtatattttttagtcacgttatttttattcagtgacccataatttatataatatttattttttcctaagaactatacatatataaactaccaaatgtgatccataagtcacggtaataaactctgcaaacacatttataagtgattacataataataatataacttatttgtataagtgatatgtaaatagtgttcttcagcatttgtttgttttagtcaatctaatataaatatcgccaaaaaagattgatttttggttttgaaaaagtttccctaattgttcatattattttatccgatcctaattactttgaaaagcaaattagtatcttgaacttctccttgacaatattgaaattcgaataagaccagtttactgccacagtgccattcgtactatatgatatttgagtttattgtgaatcgatttttgatgttgcacaataaaaaaaaaaatagtagtcaaaatttagtcagaaataattgccaaaaaagagtttaacattagactttaaaaatgatcatgtaatatgtatgtattagatactataatatatggtgttagtagtcaatttatcaatcaaattaatatactttttacgtattggaacaaccattaatattttgtgcgtattggaacaaccattaatattttgtgattatggaaataaataattagaaatttggcaatatatgtaaatatctaaattatattatttttttgtattttagttaattttatgactacaaaagtcaaagagttaaagagtcaaagagtgatgaatgagcaaagatgagatgcacatggaacaaaaagccaagagattagagctggaaaaaatatgaggctctttgttcattggtttaaataacggatcatattattagaacgcgcgaaaattggtactcgtaattgctttggttacacggtaaaactcgaaatgagttaaatgcttttttttttttttggtcggacgaaatgagtgttaaaatttaaaaagacctttattcttagatttcagatttgcgtagttcttctttgtttcaacttaagatttgccttctcgtgatcacaaaatgcaaaagatcttcgaattctgaaacaacacgtgatgacgtgaacccgaatatagataatgattctctccatgcgtgcttggactgattagtaaactacaaaatatgattgacattttcatttcataaaaatatcataaatcatagtcaacacggcgaaaccaaaccctattgaaaccaaaactccaagcttcaatctaaacgcaagatttacgcaaacatttttgtcaacacgttctcctactatgaagctaccaacttgataactctaacttcatcctcaaatccatcgttcataaatagtccaaatttcgcaaatgcaaaaccaaacaaaaaaat

SEQ ID NO: 3960 - DNA, 2000 bp, Arabidopsis thaliana
ggctatttaaccatataagaataaaaatatatattttaaacaaaaagaaaaaatatatattaattcgcaatacgtaagtataggttacatcaagtattcaatattgtgacccaaaaaaaagtcaattattatcacccctgagtccaaagtccatattcacattttgggatttgttcccacttttgtatacactgtattttagatcaaagaccttggtcaaagaatcagattttcatttactagtagtattattttttgataaaaagctactttaccaatcgattaattacatttctttcatagttatactatgatcattgtattatatgaaatgtctatctacaaatgtcctaattatttgtcagtttatatcgcactattaacttgacatgactttcacttttttactaaacccattagtcaaaaagtggtggagtcaaaagtcgttgatcgttgacttgggatacatgggggagaaagtgttaagtgcccaaacaaaaagacagcgactcattagagaattacgtgttataaattaaacttttttggtattacaattcttaagtcttgcagtatttgataatttgggtaattaatcgagtctccaagcaaaatacatatataaccataaacttgaatatacttgcagcactacatatgagtgggatacaagcaatatattttttcattattcaacacattcgtcaaagtcgagttaatacgggccatgtgagtatctccacaatactcaagttactgttaagtgcataatcatcactaagtatagtttacaaacatacaattaacacattgaagtaatctgtatatatatatatatatagtgtttacaaacatacaattagtcatattattaacgaacttgcaactagtcagttattaataaacgtataattattaaattacgcgaggatacaaatagatttattcgtatttactaagcacatgagcaaaaacaatgaaagcgcgttgagaaagaacagaaaagaaagcaaaaaaaaagtgtcgtttttggtcctccatgtgagtgatctgtgatctcaactttctcacttttgcattaaattcttatcctttttctttatttcctttttcatgtttgtatttatttaatttacgagtagtttgcattatcatacattcatactatagattcgctaaacacgtaaaaatagagacaaattattagtattaaacagaagtgacaaataccattttagatgattagatcattcgattgaatagactcccattttaacgaggtcgttatcggatcaatgtacttattcaatatggtagctgcacatacaaaactagatacaatattaatctagaaatcaaactaaatatatagttgtaatattttaagtggaaagatagccttttgtctctcgacaatgggatcaccattaaaccaaatcagatagaagttgtgggagtagttatgcttaaattccttttgttttttcacataataatagcgtatgaaaatttagttacacatacacaaaaatgtctcttctatatttatttataagaaaacgacttttctaattttagatctcgcaaatgattgctattgtttttttactactactcacgtacaatgaaactttccaacaattcattttttttttacttatcacctaccaaatacaaacaatcacataaatacaaaaaaatgcagaatcatataaaaaattagacaagtagcagagaatctgcaacatgacggtgcggttaaacagtagtaagtacattgatattatcaaagggactgaattagtaaattctctggtctccatcttctctcttatcgttcacacacacacaaacactcatatataaacacatatgcacactgtcactaatgcttctctctctctctctttctcttttcctatatattgacaagcttgcgatctctgttcgctagatctgtctgaaacagtgaggggattcctaggtttcagagcaaagta

SEQ ID NO: 3961 - DNA, 2000 bp, Arabidopsis thaliana
catgtccctcttaattaaacacccaacgaaaagtacttatgaatatatccattagatattttaattattacatttttaggctgttaaacaaataaattatatcggtttacctgaaagataatgaatgaaaaaaaaaaaatcttaatatattattttatgtgtttttaaaaataataagctgtcttgtatttttaacaaatagcatttttaatatagtacgatatttaatactatatcacttttttgtttaaatcatactaaacaacacctagccctttttaaaataaataataataataataataagaccacttatgtatcctttatgtatcatgtaaaatacaaaattccctaattatataaatttaagttggcatttcttctgactattaaaagcataaaacgaaagagaaataaatattggaccaactgtcccactaaaaacgataatatgatatagccaccacatgaaatgccgagaggaataacaatatgggtcatcatcggtcgataacacatagacaacattattattaggttggaaaatttaattaattcacacacatatacatatacatattatacagttctatgacaaaaaaaaagtgataaatgttgaatatatttgtcaaactaatttggtaattcaccgaattcaatctattgattattgctatcacttctcatattcaattttttgtgcgcgaggaattcgaatctttaattagtacgtttccccgtccatagtttcaatagattacaactctaaatgattatataaaacaaacaaaacattatcatatagaacaaagattatttgtgataacctaaaatatttatcttatctttaattatttgtttctagtattattaatgactgatactgctttatttatttcaaccaaacaactttgactatagtctacaataatacacgatcaacgttataaaagtttggattcgttttaattaaaaaccaccattgaatattccaaaagaaactgaaacctccatctcaaacagaggcttaccccaaataaattccatcccacgtcatcatcagagaaagtgtctaggggagaagaaccactgtgattgtggaaagagagagagaagtgtaaagtaatcaaatagagagatttcaattttgttcagaccttccagaataagcagcaacttgcctctcacacttgtcacccccaaaagagaaaaaaaacattaaaattaaaatcttatcattttagaaaaatctgtaaattcagtgaaccttcctctgtttcctgtttcttctctgattccacagtcttaaccccaaaaacattatatttatttctctcattatcttttaccatctatttttataccaattccttttatcaaaaccactcccactttatttcttcttctctggttttcttaccaaaagaaactttcttcgtcttcctctgtatttaagctttaacaccctgtttttggtttccaacgttcaatcttcatcttcttctcgctgaaggtgtgtttggctctaacggtttaaaggtacttactttcgattcttttgattcattctctgctcatgtttttgattgaatcacaacgatttactgatcaaaacttggacaaattttctcttgcagctttcttgaaacaccaattgaatcttttctctctaccggcaaaaaaaaaagattagtccttttaggtctggaaacgccaagatcactcgttctaaaccttagattttgtctgcatttcgggataatcatttcatcgtcagggttcttcaaccaaactacatttacagaagaagaagaagaagaaaagttcgttactttttatgcgtttggataaacaaactcaagtttcttcttcatacatcgatctgattttccagatcaaacttcgaaaagagaaaaagccttctttaaatgattcgtgagttctccagtctacaaaacgacatcataaacattcaagaacattattctctcaacaacaac

SEQ ID NO: 3962 - DNA, 610 bp, Arabidopsis thaliana
tcttttcgacaaaagaatctctttttcccgagaaaaactgagctgaaccttaatgtatacggaagagacgacgagttggcagagtcagcggagctaccatgactctgcaactactgtttcgaatgtttctctgatgattattgttctctaaccaattattaacggagaggcaaatttaaaattaaaatttgggaggctttcaaaaatccttaatgggcctcattagcccattaaaagtcccaatttaaaatattgtaattgctattatagaaagaaagaaaaatgaaggtcggtgttaaataaaaaaaatgaaaaaattaacgagtggtagtcaaatacaaccccacacgagccatgtgagtgaatgatgctcaaatatcgatttgcactaacttcaatgcgcaccagccaaaataacacgtttccattttcgtattttatacattgatataaaccgtgtcgtatttgttaaagatatacacgtatatttgtatacatatattcaatttgtatatgtatatacatacaatgctggtctaatatgtccgcgtttgaacatatatatatctaaacgtctgagaaaagaaacaacacaaacatagcttcaagt

SEQ ID NO: 3963 - DNA, 2000 bp, Arabidopsis thaliana
aagacactaaaaagactcgagaaataacataaagactcaaaatcctatacctaaaacatagatgaaatcagtgaaaatagggatatatcaagtcccactttaaaaacacctctctctctctcttctctctctcttctctctctcttctctctctaaacttttcagagagagagagattttgatcgagatttagccgtccggtacgctttaccggcttatgaatccggatgtgatccggttttgtcgatccatctcgctgtcctatctcgccatcaggtgtatccggcggttctcatggctattctgttgccgttgtgtttgtttcaccgaattgatttgcgaaacaatttgatatcagttttttcttcttttctaactagaaagtttcatggtctattctcgatctgtcccaccaccatccacaatcaggtaagtgttttggtgtttcgattgggcgactgttttagtctcatccacatgaatcaaaattcagatctgggcgaattatgggttgcttggctccttccaaccgttatagttgaaacggtccggcgtttttgacggtttcaatcacctcatttgaggtccgtcttgccattccaagaagtcaaggtatcaatttccaaagtctattcttattagcaagtgatgacaagagatcagaagcttcacctcgtcgttgattgtttgtcgacgacttctttcatgcttttgttttcggaaaagatccagtgatgagaagagaaagaatttgaagattaaattgaatcctttatctttttcggtttaatagctgtctgttttcataatccggagatgtttccggttgttcactcgctggaaattgtgtcagcttctgtttgcatatttcgctgaaggggttgtgggtaccggtttactaggttatccggttcacccggtttgtaagattggtttatgaataaatatccctttgagaaaaaatcaaataataatcaaacttatggatatatagaaaacagataaataatagaagactaaattttaattatatagttgtattgttggagatggatcctaatcggaaatatcaacatgcatgtaccaataaaaataaggcacgtccaatgttgaactaatcgtctcagccaagtagaataaatttgatgggatcttatggtaagactttttcgaagtgggagtataaaatcttataagtgtgtcacgtcaaaattatataaaagtgttggttgtagtatgtaaatgttttttcgttgagattttaaaaagttttgatgtaatgtgtaatttcattatactcccaacaaaatattttgtacatgaaaatttgttatttgtttaacaacaaagaaagaaaaattgtttttgaaagcagcaaacatacatacagggttggaccacgaacctaatataatcatgcatgtatgtttactgcttaaaaaagtatttgaaaacataagcagcaaatatactttttcattttaagaaagaatttgaaagctataaaatctattattttaatagaaaatatatttttacgttttaaaaaaaactgaaaatatataaagtctaattatacaatatatagtgaactttgataagtaattaattaacataaatatcttattttctaaccgtctaatgggacaaaatattgtgtttatcaattatgaatgtttttttttttttgtatatattgaacctaaaccaaattatcaaatatcaaagcacttctaatttcttcgtattaaactttccaaactaatattaatttattacacttccatgacaacaactaggttttaaacatattattttagactgttattattttcagccactgatattaatttagctcattttctatttggaagtgacgtgtccatatgttgacattgtcaactttgtactttaagttctcataatataatgtgttaagactttttggtgtgtttgagtttttgtttggttgagaaatgagaagtagaacagaatcaaga

SEQ ID NO: 3964 - DNA, 1571 bp, Arabidopsis thaliana
cttcttggaaagctaatatggaaatcaagaacataaaaaagacttgcttagtgaaaacaaggagctacgtaaatgagaaatacctcacatacacagattggaaggaataatacattaaagaaagtcaacttaagccagacatgaagattgaataattgcgagaattgctttatttttggtttattgtgtgaatttctttgacatgttccaaccccaacttgtgtttaaaataataggttatgatcataagactccgacatgtataggaatttccttgtattaaggtttgtatatgtcttctttaaacccttgaccaaacataataaatcttcgattgatcgttagacttggagcacaaggatataacaaggtttgatttaagtaattagtttgaacccggtcgttacaaaaaaggatttactacatatgaaaaacaattacatattacaacctatttgaaacattacgtctgattcacataaagaaacattacgtctgatccacaataattatagacgtaacttatgtaacttgttgtagaataattatgtaaaagagagaattcgtatattacaacatggacaggaaaaaataaagataaagatcattttgtttgattcaatgatttgcttcttacaaactcaggtatttatacaaataatgtgcatcaaggtagccagtactaaattttaaaaatatatttacaaccacactttaactattacaaacttgttaaaaaagcaacaataaaaaataagaattatcacataattaatatttttatatagttaacacatacagtttccgattgtcaaagctccattaaaaaagcaaattgtgaaccaagtggataatggtccagtagcgtttggaaatgatctttccaaaataaggtttgatctcttttcccactaaatcccacctaacaagggatattaacaaaggttgatgtagaatttcttggttgacaatgtatagtaatactgagaatatgagctataactataagaggccagctatctcttaacgtctatgagtaagccatagatagataatgcatatacaggcaaacaaaacgaatattagggtttgtcaagaaaagactaatcttagtttatttttgaagaccaagaattttacattattgcagaggtattgcgattataattgagtgaaagtcaacaaaatgtattaaatccaccaagttgttgttaagtacaagtcgttagcagaattatcatatagtttataaagctttgacattagatcaacttggcaggttttacattgtttaaacaaagattacatcaggtgctttgatttatgattaaattgctctcttttttccacaaagtggaatataaatgtatatatctttgttagaccattcttcagtcgtgcttggatatgaatctataattggagagtattccacgccaacatgtgttttggattttaattgatcttcatctaaagtatttctatcatttgtactagaaaatcaatatattgtatcatatatttcagattgtctttggtttcaaaaatttgtatgttaacttaacttgaaa

SEQ ID NO: 3965 - DNA, 2000 bp, Arabidopsis thaliana
ttaaagttttaatcctattaaaacaacatattaataatattttaaaattttataaatattgattcaaatacatccaccatataactcaattccaaaataaaactcgttctataatttctttacccgtcccgtaattttttaattaaagtagtaattttaaaaatttaagaattatttattatatataaaagttttgtaaattgtatcattttctaatacatttatattttatagtttaattttatatatagtaacattatacataccacgtaacattttttgttttatataatcttttctaaattaggatgatttgatatatttaatattagtagtcttaaaaaataataaattaaaaatttaatccgtattaaaacggtggattaattagattttacttttttattaatgttgattcaaaaacccatccctccaaatccgtcttgccaaaaagccatttattttattaatattaatttatttatgatatgactctgaattataatctaaacattttagctaataacataggagtgcaccatatttatttaataggagaatgtactatatgacctgaatgcacttttactcaaatccaccaaaaaagtcttgcaaaaatactatagacccgaatgtaccatatttttttatgctaatttttctgtaattaagattttaattgatttcgtatataaaatattaaattgttttacgaacttatttgtttataatttggtaacagatagatatttgaatattcggtatattttgcttcagtttaggaaatctttgatgacccgtctttaaatccaataagccctataattaagagatgaatattgtcgttaaatgattttggtaatcttaatgatgtcattaaaagattctatttttgattaaaattttctaatggtattgtcatgtaattaattacaaaaattaagattacatttaaaatgtattttgtaggatttgccaatatattcacattacaatattatttttttccatggtcgattatttctacccgaaagagacggcaacgcagcccacagtgagattggagattagagattcagtcaacgatgattaacgttacttttcatagttagtacataagaatagcacgcaggtttcgtcgaggttttggattttatatagtttgtaaacatgacacgtactttggataaaacattatgaaatagggaaagtcatcatgagtagttggaataatgaatatattaaatattggtatgatttggtcttgagtcattatatcattacctggctaatgctatacgttaccttataatgaattctaaatgtctcaattgctttttgaaaaagttgatcacgaacccgccgcctcatattcataattaaagttaaattttgtttttgtcaacattgatcatagttaaatatttagacacgtctatttttattttctccacgttatacattttcttgactattcatgcaactcttgtgatcttgtcttagatatagtcaagtattgtgtatacatcatagggaatatccgaatatgtgtgtgtttgattaattagtgcacactagctcagatcatcgattagtccgcaactcgagtaaacgtgttttcagaccacccaaaattttacgacctttgtgtcccactatctacgtcgatagtaactttagaacaaaaaactcaaaaagagtgtaatttgttatgcttttggtcttctaaaatttgtattcttctaccaacatttagcacagtttcatacatagaaagttctcattacttggaattaacatgataatcccccaaaaaaacaaatcaatatctaacctagcaacaatgacggaaggaaaataaatataatcaaaaacaaacctaccaaatactgtttgttccccatagccacactccatagacataacaaacaataaactatggaaaaagatagaatttgatgtgataaaacattcattaattggatctatatatatctttc

SEQ ID NO: 3966 - DNA, 2000 bp, Arabidopsis thaliana
tataaacttatggtagtttttatatttattatttatttttaaaattgcctctctcttttttttggacatcagtctctcgattactgcattggatgccctgtatttgcaacttgttgatagaaaggattacgcaagttgttgctgtcaacaaaaagagattatgcaagttgttatgtttaatatacccgttacacaatttatcactttttccgtaaaataagttccccgccttaaattagctactctagataatgaaagattaatgataaagaaggaatcaaattattcacatgattgtaacatcaacttttgatatattagaaaaaaaaacacagaaaagatcgccaaaaaaagaagaaaaaaaaaatgaaagaaagcatgtgatgattacgagtttactgtatgcttttctaaacgagggaacaaacttcattcataactatttgtagcattttatcctatatggctataattcaataatgtacttgtatccgatacttggatttaggatacaatctcttttatttcattttctagatttggtcaattaaactaccgacactgaaataaacatttctttatagatgacatttaactaaactatgttggagagaatatgatctgatgaaatgggggaaaaaatgtttgatatgacatccactgagactatgtttataatcttactaaacctaccagagatcagatataaacatgtttattgaaatcagaaaaataatttttagagatgtcatcataagagagaataatttttttccaagtttaataaacaatcagatactcaaacagattaaaacagtttagtttatatcattcatatcttttaaaagagagctagagtctgcgttatagcaacaatactttgtatttaaattttattttcatcaaattgatggaataatagctttattccaaaaaaaaaatggtagatggacccgtgacaggcttgcagccatcggcctaaatactttatatttataatttcatcaataatttcggtgcccctaatatctgattgtttacataatcgctatgtgacacttttgctttgctttaattatacctgtatactataatgttctgccataacatttatagcaacgttaattaattccttttatgtatgattagacgtttcaagacccatcattaacaatttataggtagaaatagtcctttacctccatagttttagtataatggcagttttctcaactattgttgttaagatacataaatcagcattctatacttgtatgtaatcaactctgtacctaatgttttaaaagaaagatctaagtactgtgtgtaaaaagatttatacttctaagtaagatagtactaattctattattgaactctttaaagatacaaatgttatcaaatcaaaactgaaaataacaagtgtttctgataacgacggtccagttacacttacacatcaattgaatccaaagaatagttttagtaacactcgagattttcaaattggttgaatgacgaaacgaatactaaaatcagaaaagaagaatatgctttttagtaaagaaaaaggttatattattgtcggttaatgataatataatcctagtttcctaatgtgtatgaggataaacgtggacgagactggtgagttcatcactggcaaagcaacgaatatttaggtaattacatatacaaaattacaaaaatacaaaaacgacaatagactcctgtcaatttccgtataatatgaataatattctgattaaaacataaaacgaagatcttatctttacgagcgaggcagcttatataacccagtggaacgttttttgtttttctgaaaattccactcaaataatagaatcaagaaaagtaaaaccagaaaaagccattttaaataaatagtatcgtgtttgattttaatttcatcaacataattattatataaacacccactcttcacgagtacattcatcatcactcactagtgtcgaaca

SEQ ID NO: 3967 - DNA, 2000 bp, Arabidopsis thaliana
tgtaataaatgaataacattcatcatattttctttttaataatatcacaggaattaataattcactaaactcaagtttaataattcgccaatttcagttttgaacatgtaacatataagaatatttagttatttacgatggtataatttgaaaatatattgcattctaataacaatttgttaaccattgttttattttgtgtagcctgtaggtttagattgcttctcaatgtcaagtgtaaaggtgaaccatcttatgagttatgacacactgcctgaagaacggatgtttcaatgaataatcggaatttctatcagttattgaagtctcttaatctaatttacgttgcttttctcttattcaaatcttctctaatttcagttgttgtaagttctatgtggatcgatcgattccaatcgttgtaaaagtcgatttagtcaatgaagcgtttgtgtgaatattaaaacaaaaaatcaagaaaactgtgatcgagtttttttgtatctgaaaaaaacaacaacattgaaaaatatctatttttatatgaaactcaagaaccaaggatttaatgtatatgtatacatgtttaataaactttcttttaccaaattcaacaattttgaaaagattatcatacgagattcttctttctctctttctttgattttacgtaatttttatgaaaaactttgtactttagttagtctggttttctgaacctttaaaaatatctcttaactacgatttggtgatacaaaatgctctagagggatcgaacgtggaatttacacaagtatgcgacgttgacatacgaattaagaatacagataattaaaatacatgtggtaagactgtggtatatgtatttttatatcgcatgccgataatgctaagaacacgaggaattggaacgttttgggtcttttggactatgcactttgtaaactaacaaattattaaaaaatcgccgcaagttgcaaagttcgaggaggaagtaagaacacaagagactaactattacgtggaatctaccattaagattgttttccgaaattcagagatatacatgttcttttggttttttttacgaaaatatgatgttatccattcgccattttgcgttcttaattaacaatcaagtttcacaaaatttaaatgtgcaagtagagtagtcaaatatggtttacaaacaaaaaaacacactgattttcagaaatatgatattaattgggattttagtaagtcatttatcaaattcgtaaaaaactaaacatgcataactttttataaaaaaaataaaataaaaaaaactgttgataatattttcatatcggcagaatgtgtctagatacgttgttttggataagtcatgcaattagagaagtgtggaaagaatgacataaataatttgttaacaatttttacatgcgcatgtacaagtacatatagaaaattaatagtccaaatttttcatagtaaaagaaaaaaatgaaactcaattgcatgctttaattacatacgagtggggagagttgatttataccaaatccacttgcgttctcaaaatacattaaaatacaacactattgaaacaaagttgactacatgatgttagctagtaaacacagtcacttgttttagtggattaaacgtaagtagatcaaaccggccaacttactaaataacaagatagaaattcatgaatctatgaacgtaaatggctcttagtgcctaatcttacatgaattataataatatggagtttaatgcatcctcttgagcataagaaatcaatctttcaaagccgccacacgtcactatgcactaatcattctcttaatagcccactggcagaagcacaattaaacccttgatatcgatcgttactatctagttttctctataaatagaactccaattctttctaagtaataataaactatctctttagtaagtcttttaaacaagctatctagataatgaaaacacaaaccaaagtg

SEQ ID NO: 3968 - DNA, 2000 bp, Arabidopsis thaliana
ttaatgggcgttattcattagaccagtaaaattgactggaaattaaatatatatagtaatgatacgatggtcctgcgacgaaggaggagccatgtctacgcaactcatccaataagcaacacaagctattcttttttacttctttcatgattgtcagtttcttctttcatttattctatcattgcttgagatatgtattctttaatagaagttaaatagtgtgtacatataccatgttgtcactttttaacaaacaaaaagtcatatggtatcatcatcatgtcgcatgaagaggagctacaacatttcttgattcatgcgttacgtggtctaacaaagggaatgtgatgaattgtcgctctgggagtaatttcgaaacgaaagttttcttacctaaaactctttattaattatctgagtttctgtagagagaaatagcatcaatttaaagcttgaaaagtttaacacatctttgacaaaacaaatttaggaagaccaaaaccaaaataattactatttctctctatctgttttcagtggggggacgaaagacctttctttctttttggtaatgggccgggccgggccggtttaatccaaggcaaatggcaagatccgtagagttttacatacaaactttactctagtgtaaacaagaaagtcagaaaccgcatgcgttatagttagtgaaaggttcgatttctgtcaggtcttcgcatccgtcacgtttgctatctcgaacttcagggagcatattacaaacgtaaaagaaattgatatattacgctaattaatttattcccgttgttgtcaagaaactaatgtcttaattagccttttaggttaaaccctaatttttgtcgatttaagttttgaaaaacgaattttgattgtttggattttggtaaaaggagatcagagttcatcgctggtaccatgttggttaactggctcgccgggagacccagcaataagttttatgctctccaaaagtcaatagacgagctacacaaggtattatcatatatattggcaattgatgtttttaagttcctatttatttttctgtgacattgaatctattttcaaaagcacccaataatgtggttctcattctttttttctgatcactaatgtgtgttcacctcaagacgctcgagtctcttgaacaaaaagaaaaggtttctctgctgccgtacagtacaaggaagcgaaaacatgttacctggcaggttacaaaacatgttacctggcaggttacaaaacaagtatgaaacatcttttgattttgaagcacgaaaaagtaaaatatcttattatcttttatggatcaatttaaaacatgtgtgttgaatcttgtcatgcaggtgctaaactttgtttgaaagagaagaggattcacgagcgaacagctcaatataataggaattgtcagcttctcttacatgaagctgtgagttttttctttttctttttgtgtcttactaaattatttttttattaactactttttaagcgatgaattgaatttattgtcactatttttctttcttcttaattatacagctgattttgtgtgaaagtagaaaagaacaaatgattgaagctatgcgggatggagattttactacgcagaagacaatgcaagtttttatttatctttgtttgttccttttaatcttaacttatttgtatcaatctaactcatgtattatcctacgtctatctagactgatcggacggacataatgtgtatccatatttcttggctacgcgtgtccaccttttagagactatgcctttaggtagtagatgttttactacaaaataaacatatttagtcaaataaaataaaatttgagagaatcttctacataagtagctcacagacccaaccaaaggaccattgaataccatatatatatagatacacagacatataaacacacaaatattcgtgtttttttcaaactgtgagagaaaaagaaagagagaaagag

SEQ ID NO: 3969 - DNA, 2000 bp, Arabidopsis thaliana
ttacccttttccaaaagttttgagaaaatatatcttttggggaagactgaacactaaataatctcaattacttcaccaacccaacaaaactagaatccgataccaatttactaaagagtacaatggttataaatcaataagaacattgaaaaaacagttcatgaaaagtatccattattcagtgtcagtgtagttcacttagttgaacaaatattgtttttactctacttttattctttttttttagttttggcaaactattctacatttatttggtcttttctttttccagtgtactaaaacaagtttccattgtttttatctgattggtgtgcaagaagatgaacccactctatttgtttattctaactttaaacacagactcttggtttctagaatataactcaccatgaaaactatagaaacaaatgtcctattttaatatgattttaacttataacaattagtattgacgtggatacattaattatatagtagggccgatgctaacgttcatgaatagagaatcccagtataatggtgaaactataatcatgacgtccacaaagaaagattgcaacttgtagtggtcggggaaccttaaacctcaactttaccttaaccattggaggaaaaattctataatgaactttaactttaatgtatttgctgctttcttgacttatattgctaacatcatttcaagtagagggatcaattcattaacatgtacagctttttaatcagtggatctctctaagtaaatatcttcctccatttcatggatttttttacatgtcatattcaccttgattacagtcactttcgaatattacttataacggaaataatatgttttttttttgctttacacatctctggttgaatacgcaattcgtaatttcctatgtgacacctgaaatcttgtatctttcttaaaagttatagactagcttcttgtggatctaacaaatccttttagctaaaaataatccattaaacctagttccaaatgattcaacattttggtatactaaattactaagtgtatgtcctagggatgttgtgaacaaaaaccagtctgatttaaacatactcttggtgatatatatatatagtcataattttcttaatcaagtacaaattggttcatgattttttgatccaccaaaacatttctaatgaaacgaaatactcattaaagaacaacactcacactaatgattgaacattaatatgaaccatgtgatattgaagtgaaagcactaactttaatgcttaacaagtcatcccaaaatattagagaccatgcatatttgtaccagtgagagttcagattaatcttgaaccttgtgtgtataactcagtaaaaactgtccacgtggtagatcaataaacaaccacaatctggcacacatgatataaagacaaagatttttgatatgtctccaattaatgtaaaatcttaacaataaaaaacaattctatagtatggatggtaagagatttgttgaaggagaagaggacgtgggaaaaatacaaagaagctaaaaaaaaactcattgcaaccacaaacaaaatggtataaagagacaaaagagagtaatggacatggggaattacaaagaagcagaaaaccttgcaaccacatgaaataaacaaatgtctttgtcataagataatgaaatcacactgttgtctcaatgtttgtttagatctatctgatcatatatcgctgaaacaaccacacaaaaagcaaagccacattttatataaagacccatcatatatcaatcaatccccatctctcttcacatgcccatttgaatcgtatctcctctcatttcttcttttgttttgttggagttagataaaatcaaaggtctaataaaagtgtcaaaacccttatcgctataacctccactaccatcttaaacttctccttataactcacgcttctctgctttcttctctcagagtctaactgctcaaataagaaa

SEQ ID NO: 3970 - DNA, 2000 bp, Arabidopsis thaliana
tttacaactacataagttttggagtcacgtgttatatgatttatagacatttgaattattggctaatattggcccagtcttggtctctccgtgataatggatattctcttttgattccatgtcccttgtcaaatctctaacaactacactctgatgatttggaacaagctggaaacaaaaaaaaagttcttacataacaaccctaaatgattgatcagtaaatgttatattctaacttcagatttagttgtatcatgtataaaggaaaaaaaaactaatcatataggattgttaattaaccaaagacatcaatatatgactattaatccaatgcaataagattaattatatagtttttaaatatttaaattaatttaattaacttgaaaagctttcaaattattattagtgtacttgaatgagcgaaattggccaaaatgcaaacagccgcttatcgcctttatgtcttggtgctaaaactgctgccgcttcgaaaagccaaagccaaagcgttaattataaattttttggtacaacaaaagtgataacgagtgatgattctactgctaccacactttgagcccatcacacaagtttacattggaacactcctcttcaagtacacgtgtagtgtacaacacaattaaccttctgtttttcttgtcctatctttcaataaatagccatatcatacctacctaaaacgtaacccactaattttcatcaattaatgtcgagcaaatactatatcttaagtttgaaattatcaaaccaagcagaacaacacatgtagttataatcatataattatctttaaaacatttacaagttcattagaatcttcgtacagatacagccatatgcaactaatgaaagtctcaaactcataaatcaaagaaagcattaaactcaatgttcttaagttaaatatgtcaaatcatcacatataattccgattaataattagtcagttaagctgtttaagcatactctaagcattaataattagtcagttaagatatatcattgatccattctttcaagttaatgtcctttacatacatccaaattcatttgcacgaaaagaattaacatagagatatatagttacataaacacatacactgaccaccatagatttatttgaaccttatatataacaaaagatcgaaatgttaccggcacatatcggtgagaaatgaaatgcaatttattgttatagaatggcaagttaaagcacaaaagagtatatattaaagatttttttatacacgtgtcagtgaggattgcacatcacatgttaaatcacatatgtttaagcaaaatggaattctatatttgcctatagattagacgtcaaaaatagacgacaactttctaataaaccaaaaaatgtcgctcaaaatgatatattatatttattatgtattgtactagctagagtacgaaatcaactaagatcacaaacggatagtcggataccaatcaaaagtgttcaattctgactcttgaaaaactttatttatcttcattttgaattgaatacaattatctaactgtaactttttttcttactcgtcaatctatagaatcaagttaccctttctagagaatcaactaactagtagtctagtaccttcctcaatacaatagtcgtacgaacgcccatttatctaggtaccctcaaattttgtgtcgtctcacttattagttatctattactagttgattactcaatacaaatttccctaaatagagaggatatgagagttgcgtatttaaacaaacctaccaaaatatgattttcgtcaaaccaaagcaaaaacctaccaaaagaaattatttcttaaatacagaaaaaaacaaaaaggaaacttccgggaagctgcgtacatagatggacccaacataaaccaaaacaataacacgtagtcgccacctatatataaaaaacctgacgcaacacaaacagatgtagtagaatcaaaacgtcttaaaac

SEQ ID NO: 3971 - DNA, 2000 bp, Arabidopsis thaliana
tctgtcagttgtcaggtcttagagaaccgagagataatgatttccacgtaggatcttacgtgtgaacaagccagagtgggtcccacatagttgcttcttctcttatttttggcttttcatatcggttcgaagaatcttatttaatttgatacaaaataagtaatcaataagaaaataagggaatacattacgtggaaattttttgaaattcactcataaagttggaattaatggtctttttgggggggggaaaacgtggagggtaaacgaatatacaaagtaagcaagtagtatccgtgtaaagcttttcatatcacctaacttttttccattttcaatcatttatggtgaaaatttgtgaatattataacaaaaaattatttaggtaaataaaaaatggctactagtaagtgtgaaaaagaatatggaatgaaatgagaatgtaatttagctcatgaatctttgattatattgattgcaattcttaaaaccttctcttcatattgatactatgtaatgaattatcaaaacagaaaaataatatatacgaaaacaaaagtaaatccattatctgaaacgtgtctacctcattttgttttaaacgaaacaatatacttatcgtaaataaaatcattatacaatttctctattttctacaacaatcaaacacaaaagaattttacataatatttcgaagaatattggatttttaaatggttaaaatctgaaaaggaacttgaaaaaaggtgaagaagatccactagcttccttgtgacgcaaactttaaccgcctttgagttctcacctctttccattcttctccaatagctttcttcactttctccaattaattttatcttgctaaccaaacaaccccttagtttattaatttacaacccccccaccccactttttacatctacttgtatgcggtatactcaataaaaatttctgaaaatggaccacattaggacttgggaatattagtatgaccaccaatattctcatgtttgatatggctgcaatttcttctttttgtttgcatgaatattatttagtacttcaagtactgattccatgctttttttttttccttctaattcaacatgagtaaaatataaattattttataagaagatatgttggcaaaagaaaagaagtggtaaagaaggcaaactggcctttcaacttgcgctagaatcaactaatgtcagtttttggctcttacgatttttgaaattattgctgaaaagattatatttcggcgattttatttattaaatatagctccaaaactagagtcaaagatcatatgagaagttaaagaaaattaattccgtctttttggtgtgtgtgtaacgtgtaaacctaattaaactataacatgctctctttttcaaaaaaaaatataacacgctcttcacatataacatgaaatcaatataaatatatccttaataaacacaatagaaagtgaaattgatatttatagttattgcgagctagtatagttatgattttttttaaaaaattgagctgggaatttttgtaaaatttagaactcttagtctaaccatgatagatgattgttttgtcacacacgtacacaccataaaatcgtattatattccctgggaacggcttagatccatggaataaaagatttttatcaagctgacgagaaacaaatcgtcaacagaacaaaagcatctaaacaatgtaattattaaatttaacattctactgaagaaatttatatataattttaaaatgataatgatctcaatgggcggcttagcttatggtgttatataagcaaagaacttggcatcaagcgaaaccaaaagcgacagaaaaaaacaaatatttagaaacaaaaaatgctataattcttcctttttcttgttctttcagagattttgatttctattcaatcgactaagagggtgtgtttttaatccctctctgttttaattttgtttcctagtctttaaagatcc

SEQ ID NO: 3972 - DNA, 762 bp, Arabidopsis thaliana
atttatcattgttatcttttctactgaattaggtcacaattacgtggagtggaacaaaaaatacaaacgtagtccaaacggaaagctaattgatttttcaataaagagacaaaataaaaatgaaggaaaaaactttcttttgtcttatgatttgattctgtttttttttttttgctctcttaaattcagattgtgttcatgtatctaaagcagaattggaaaccaaaatttggatactagaattgtcagtttgacataaaattttatgtaaatgaattgaaaccaatcctaagcagtcatcacttatcaatatgctttttcaaataattttgcaaaatgtcatagatttttatgtgtgtaattcaaaccatagaaatttatttgaaaatataatattaaaatctttatctttatctcaagttattttcccaatctcatcaatcaaatcacccacttcagtggacaataatctttaatatttcattaatcattgatatctttctcattttcacatttgagaaaaacgttttgtcggtaaaagaaaatgtatcattgaaaattctaaaaatagatataatggagagagagatccacctcaagattatcgccacaaaacagagtagttgactgatatcgattgtgagatttcaaagcgataacgtggagaccccctcaccattataataaatcatcatatcgtcactttagccacatcacataccaaaaaaaggcaaaacactcacgaaagaagaaacggagagg

SEQ ID NO: 3973 - DNA, 2000 bp, Arabidopsis thaliana
atattaaaatataaatcattgacaaatataagtattctgttttttcgacgaaaaccaacttgtgtcaatttctaatatattttgacgttttatgattgaaatataaaaacgttattcacctgtacaattgtcatcattttcattattctactactattatgtacctaccatataaaaacgtttttgaactgtataccattttcatcatttcatgattttaccacaatgtaccatcatcgcagctatcagtctatcacaccgtgatgtcaattataatcacgaaggatgaatgacaatatcatataaaatataattggactatataataaaacaaatgagaacctgcagatcagtgtgactaatggggtcaatattcctcaatcaactaaaaagattctaaatgaacaatagccacactttcctgaagtggacagtactaagctactagctcgatttatttcacaactatgagcatatatagagaatctgtgcctgcatgtgtatatgtacatatactgtacacataattacatatacgtgttaataatgtcgttcattaattgttcaatgaattcttttataataacaactgggggaaataattaaatggaaggagtattttctatttattgtggtggccaatggccatatatacaataaatatcaagtaaagtggtttcctaattaattataatggcgccgaatcgaatatgacgtactaacagtcttacacagatacaataacatatatatagttacgttctatacatattccttcacataaatttgatatggtacgtgtacgttttatattaaatacctagacccattcgtattaattaaaatctaatgacgtggacagccatctcaattatgctttcatgcctttatttttcctctcgagaaggaaacaaaaagcttaatgacatttaattatgaaattaattaattgaaagagatggcttaatgctttggtcaaggaggctaggtgtgaatcttgtgtttctttattttattactcctagtgtatactcgacttatttacggcacgtgtaaacaaatacctcgagccgacatgtaatttgattatttggacataattagttactgtcgtaagtcgttaactaggttatttactcgaaaaaagtgacgttcttttaatttagaaaacaaaaactctgacaagtcttttaatagaccccaataatatagggttttggggttggggtttgataatgttctttcaaatttaaattaattattttaaaatcgcccattatcgtttaaccttttttaattacgtatagtatatagattaatatatacttaaaatttttagtctgataatgaaaattccgaaacaacatttgtgtatgggttctatccgagtcttggcattgtattcgtactctatttcttaatttaaccaatctaacatatttacgaaaaagaaaaaactctacgagaaatagaaattagaatagatgctaaatttttataaatgacgacgtgacactaactccaattttgtttggacgaataaaagtagaagatgggaaattcatgtgttaagaggtgacgcacatgcacgagggtcgggccatattagactaaaagtaaaaaaaaaaaaagtttaaacgacttgccatgcaattaatttttgttcttttttccctcaataaaatacataatatttttccttttaataacaaaattgttgtgtatgtacataataaataaaaccatgttgtttcaatttattttcacatggaacaaaactggttcgctgaaactgtgaatctcaataatatcttttttgttctatggaccccattccatactgcctccttcgttttattataaagaaaaaacattatatttttttccatataatatgaaaaagccaaagaaaaaaaaaagattgtggaggaatattaatacagcccacttcacatctatttttgtgcaaccatctctctaaagcttcttctctcataaca

SEQ ID NO: 3974 - DNA, 2000 bp, Arabidopsis thaliana
gataattgaataagctaaagtcgttggttgatctgatgaaatggttatttcctataaattctattgttacgaaaacgttttagaaagaagaaccgtttaaaagttatcaatcaataaagcaattaatcgaaacagttaaagaagacgattagagaaagtgactgaaagcactgcaagatggcaaatctagacaacgttctttatcatattttttttttttggattaaatatgttgaattggtgaaaaaatgcacatgtttttatcagtcatcgttttccgcgcatctctaacattttcttcattggtttttttaacagaaaataaaataaataaagccaattccgtgtactacatataagaccacatcttttaccaagccaccactccaacccattgcatgtctctttaacctttagttaacattcttactatagaaaatttcgaactgattaagtcacagaaagtttcaaaatgattatacttaatcagttttaatttcattttaagttaataatatatatattacgataaggataaggtttaaaaaaaaaaaacagagtaggtatagataaatcagataatgactgataccacttgttatttttcattgtagctatagtcaaacgatatatttttgtgttacttttttgttgtcagttatctttactggctaattattacgatgtaagtaaaaataggtatagccgagttcatacttataagtcaatatttctaaaagatagtttgaaaagatcgatgagctaaattctttagtttaactgtttaataaaaagtcattggttggttgcgttcaatgtaatggttatttctttcgaaatcaatttttggtttattcagaaagcatatgtaacgtatatattttataaaagacattacgtgaatatttttataaaacaaaaagccattattaagatgatattacgttacttatttaattcaaacgtgaaaagtacaaacttttttaccgcgtgtttattgtcaatttttgccacataatttagctatctagcaaatttatatatatatttttttttatcaccatcaccaaatattaatggtggtattttttaataataattgatatacatctttggtggttgtcagagatgaaaaacgccagtgatagaaatctatagttgtcgtcgttagtgtgtcgagcgtcaatggatcggatcagatgtaatgaatttcaaacaactgaataagatagctagcactttatattttagaaaacaaaatagtttaggtgtagactcttttttttatattaaaaattgttttgccactgacttaatagaacaccaatttgtcgtttttcttttttcttatatagacggaatcccgtgaattcgtgaaaacacgtatatttgttctttttaataaatgtggataacttttaacagattgatggggaacatggtctttgttaattcagtatctcgtaaatttggtcatgtagttatcaaaaaaaaaatttggtcatgtgtacgttttattatatgaatagtattgcgatttcaatctgttaacgttatctatcaaatattatatttcaagaatgtaaagtttcacacatacgtcatttggtttacatgattttaatcaaataatttttttaaatttttttttagtaattaaaatttacgataaaaaagaattgtcgtcataatataaataaaaattggatatgctaatttggttatatgagtgcttctctatatttttaattcgagtgctgggcaaaacaagagtcaacatgttcatttaatttgcttttaaaaaaaagacaagcacattgttttacattaatttatagagtatttggtgcaatgataatgaaaaagcatgtgcaaagaaaaggaaatcatagcacttcctcatgtactccactcactagcgttttctataaaatgtcatgatttgcggtagtgaaaggccaacacaaagaatcattttacctctaaagccaaagaccaac

SEQ ID NO: 3975 - DNA, 2000 bp, Arabidopsis thaliana
tgctactttttggcaacaaacctaaaattccgggaactacaatctataataatcttttacgattttctagagtggaggatctatcaatttatagaattttcgaattttcacagatttgttttctataacaattttttaaaattctcataattgttatattagtactagatattttagtgatgatacctactgaaaaataaatatcttgcaatagaaaacgatttttccatcatcattattaacaaagaaacaacatgtgactattattttgttctttgtttcatcaacattcaataacaaataaaattcatgaaaaataataattaaataaaaccaaaacaatagtgtaattatgtgaaaataatagttagattttaaaagaaatgaaaaagatagaaaacgaaaggagagacagagagtgaacggaaagaaaaaaagatggacgataaaataaataaatatttttttttttttgcacacccaaaaattgcagaaggaagctatatatgttaacgttagcttctctgcaaatctccttatctcactctctcgcgtccatttttttttctcaattcgtcttcaaaaattcgttagatagagaagaatctaaaagtctctctcggtcatcggaatatcttcttctcaggaattcgacgagactattcgaaatcggaaatcgcgctttgaatctgaaactcagaatttagaggacgcttactccaaagaatctagggtaaattctacgttcctttcgtctctataatcaaattatatatgcacagatcgagtttactgttttgttttccttcatgaagctcgacgaattttggtaaaaaccagatctggatttcgtaattttgctttctctgtttcgtattcttcatttgtcactgattcaaatagcatttgcttccgtataaacaaattctatcttaatctcctgtaagcaaatctgtggaataatctggataatctccagtatatagttttcgaatttggattcatttcgattttttcgctttgtgtatgtgcacaattccagattcattgtttttgattacattttgttgtttgtttggtgaaatttaagattaaagacgattccgtctctggcaagtaatgattaatgctaattctcttcatcttacactttttttttgaagtcctttatgctttttagctgtctctctgcaagctttttttttgggtacagatttgttttcagactttaaatgcgaaagtgaataagactttaaatagagattcattcatgtgtatgcatttattgttatttcatcgattcattgtttattgttctcgagttttgatggacaaatgtgagagcatgttatagcggtcgaatctgggtcccaaaacgccatgtgagattacattaaagcaacaatctattattgtcggcaatgttgtttgttccttttagatctcgattctatacatcctttgtttcctcaactttcgaaatactcatttgtcaaatagtaacacttggcccatcatttgtttattcaatgaattaaccaaataaagttctattttctaactttttcattaatggcagaagcttgtttgctgctcttgtctactgacttatttattcaatctcatgttgctaattttgtaggtgttaactttctaagaaaaggagtttgttaaaacaatgaagtataaagatgagaagtacgagaaagctgagaagggttcaaggattttgcccaagacagttttactgattcttctttgtggactttcgttctatcttggagggttgtattgtgggaagaacataattgaagttagtgatgttgcaaaagctgaatcttcttccttagatgttgatgactctcttcaagtcaaatctgtttctttctcggaatgtagcagtgactaccaagattacactccttgcactgatccaagggtatattcaaattgctgatttttgtggtatgagtgcttgaatttggaaaaagtgtagctaa

SEQ ID NO: 3976 - DNA, 2000 bp, Arabidopsis thaliana
agatcttttaccaattgagctaataatactcgattaaaaagatattttttgactttctcacgaaggatatttttccttttcatataaatgataagttcttttgtattaatctttttgtttcctgcattatttttttcgttttcgttgttagacattgtttcgttcttgaaaatgatagtaggtaacaaatgaaaaaaataaaaaatacaccttttctcctaatttcttatatgttttattaaattttattattaaatcataaatatagaaatgtataatttactaaaagggagggacaagacaaaaaaaagaagaagaagaatatataagcccatctccttgtgttggaaaattagttgctcctttacaatatacaatttcttaataggaaaacatgtcactgccagttgattgttctcatctctttttttccttagtggaatccgataaggacaattgctcatatctgtttttttttttttaattgaagatgtacattttctcttctctgattatcttccatacaaaatctgcactcagtaaaaagaaattatgtattgctgttttaataccactagatgatcacccgtactacgccgcagtttttttggattattttatattatttaatttaaatttaatttttatttgtctaatcattcactcatacaataagcaattactttagtattaaaaatatttttttctaacaatattctcaacaatgcatcatacatataattcataaacaacatttatcttaaattaatttaacagagggtagtattggattctagaaacctaagaatatgatgataaagctccttacgtattcttcagcgtcagtgatttattctataaatatcataagagaatataaatatcaatttaagagaataacttactcaaatcattaagtaatctacgactattatacattcatactttgaatttggattacaaaaaaaaatcttcgagtatgagaaaactattaaaatagttttattgaaaaatcatataaaataaaaataaatttagtaatagtataattaaatatgtaaaataaaattaaataagaaatatatcattaacctataaattagaagttgaagagcttacattaattatttaatagacacatgtcaaatgctaaagtgatgatgtgtcaatcatatgaagagagttggccaactttcatatatatgattcttagtttcgtaccaattagtttctcaattcagtgcatgtgtagtcaaatgtccaaaagattgtttctaagcaattaaaatcttatcaaaacttcattgcccaaaatattacgaaagcttgtttctgtgtatgatatacccggtaaaattaaaatgatcattatacagaacaaatcagcatgattttcggataaagatgacacacatttgaaatcgtagccgtactacgcgaaatacatgcactcttcgttatgttaacactttaacagtgaacgtagccataatgttgaccacattcaacagtcaacacaaacattactttacacacaaatatatgattatatatacatatgtacatgtaagtgaatgtgagcaataatgacgggaatattcagagaagacgatggtgaatgttagcagtgatcacgggcacattcaaaactgactgtggacaaaaaaagctcctggccttaaatatgattgtgccaaaaatagtacaaaactaagaacccaaaatggaattcgagacctatataataatatatatgtatatagtctttccttggaaagaaatcttatgttattaagaaaaatactataagttatctctctatctagatatgatatatatgtccaaacatttccacgtagatgacgtatattaccgaggataatcctctatataaggaagagaagctcgagtaataaatctcatcactttgaaatctcaaaagacaccaagcaaaaaaacaaagacagacaaaaaaaaaagagagagagagagagagaaaa

SEQ ID NO: 3977 - DNA, 2000 bp, Arabidopsis thaliana
caattctactataaacgatatttttgtttgtttgtgtagacctttgatattcattgatatcatcacttactgaaaaaataaaaaattgaataagcaaaaagctgaataccgacgactgtcgatccttaaactcacgaatcacgattgtcaaacgcacgctcacggctcacgggaagctttagccgctatgataaacggtatcttttatctaggcggccaaaactttgttcaccataacacttcaaacacaaatgtagaccattacacatatataatcaaatggtttccacttaatatatgttagtattcaaaataacaagatattttaaaagcataacaagagttagtgtctctattttctccccaccttctttctaaatataaatattgcgtatgattcatcattttcgcctttttttaatggctaacgttcggtggttgagtgtctgagtgtctgagtgtctgagtcatatgctatatattatgctttgtcattttccatatcatatttgtgtatccccttgtccatgaccgattaattaatttcgctctcacaacaaacacttcactagagaaaatataattaccatctgttcccctgaaacaatacataatcaatgatgatatcaacatcaagtgttatagtgagaaatgcacagcgaaatttctcaattcggtttagtattccaacaaataaatcaattattgttcacaaagacgatctggccaaaactcatataaatgttatgtgttatggatcctttaatctccgtaataacaccaaattactaaacttcgaacgtattttaccttttgtaaccatttaatatgattttaataaacttttcatagtttttttttttacctacaattatttatggaaaatatttttttcagttgtattattattattattttcttaaaacaactatatttttttcatgaagggaaaacactttatattattttgtgaaagaaagaaattacaaatattgaactaattaacttatttctttaacaaaaaaaaatcttttaattgtttttgccaatagggtccccacattttacaggtgtccctcgtcccagcccatcacttgcgtgtcacttggacccaaatttctcctgttttttaaaagaaatttaatttctttctagtatataagaaaaaacaaaacaaattaaaaatgaacctatgataacgtcagccggagaagatcccagatctgcgcgcgctggcatctttcatagagcgccacgtggcaaaaagatttttcactttcgtaagtgatcttatcaaatctcggtcttttgtgtaaattcatcatcatcatataacttactctatttcgatttttcaataaattacttaatatcaaaaaccacaattctggcaaaaaagaaaaatccccaaaatctagggttttcttctcgcccaatttcacttttcttctacgaaattctccattcctgccggctgtcgggttttctgaatcgattctccttcaccaacttcttctctggttctgttcgattctgattttttttcaaggtcaattttttcttctctttaaactctgcaaaatcgtgatcgattaaattcacctcagggttttttgatttctgaaagaagttaatcttcttcgaaggcgattgcaaaagagtgctctgctgtgaatttccactggtatgttcaattttttctgtttttgaaattttgtttgctagaattcgtgaagggattgaaaaaattgatgcaggtggctaaagaatctcttgaatattacgagcttatgtaggtttagagtgtaaattcgagacatgtgagattttggtgctttctcatatttttgcatgcttctgcattgcttcatagccctaaaattgctctcttttttttgtagttggagtctgtatctttttcacggttttagtgatgaatttttttttttgattggattttgaattggttactgaacatgtgttgacttgattatgtagag

SEQ ID NO: 3978 - DNA, 1764 bp, Arabidopsis thaliana
ctgcaaaacatgttatgaaacatcgtcagatctactataaaatcgactataaaatcgattataaaaacggttaccgtcggatctatcgatatctctggggattgtttgcgtcgtagagaaatgatctgaatccgtcagcgaagaacagatttatcggagaggaaattcgtcagcgattttggggtttctcggagagaaaatttgtcggcgattttgagtgaaatcggagaggaaattcgttggcgattttgagtgaaatcggagaggaaattcgtcggcaattttgagtgaaatcggagaggaaattcgccggcgattttgagtgaaatcggataggaaaattcgttggccaaaacgaagaagtttgtgccaaaacgaattgtattgtgaaacgaatgtgaaacctaatcattcagtaagggtaagacagtcatttgccatattagaaagggtagttttaaaaatggccttcaggaaaggacatttttacaaaaggttattagaataagggcagttttgcaaatctcccaattaaatattaaagtattttgaatcaatggcatttttgtaattaatctaaaccggaaggatattttttggtttatattttatttctctttcctatttacgtaaataacatatttttatgtataaattcttaatattctgtttatccatgtatatatttttaactcaccctatagttttctaagtaatttaagtattttggttacatttggttatattttggtaaaatataactaatatatttttggataaactaatcaggcatctcggttagatttaggtatagatgagtaaaaaactcgaactcgacctgaacccaaaaatattttgagtatttttgattatttttcaattcttactaaaataactaaatcgatccaaactcaaaccaaaaccgaaccaaaattttagaatacatgaatggtttttaacttcatacctaaatagatccgatactcaaaaaaaaaaagaaccgaacagatatgagtacccgaatatctacacctgcccagtattattattattattttttttgaacaaacaccggtactattattttaccagctaatttttctccctttaagaacgttttggacctattggtctattggatacaaaactattgtattcattttaaatttttaatgggtcttctttgttaataaaggcccattaaatatactatccaggcccatttagtccaactacttattacactgttgattaatcgccgtttagatattttgcattggagagaatcttcaccgttcagaaaactgaagatcgaagatcaccaaaaccggccaaaaagtatagtacacgtccgaagattctagatccatcatgccatttgcattgcatggcctaactctcgtagaaaacccaaacaaattctcccccacacaaataatgggacaaaaaccaaattaaaccaaattgtttccctattgaagaaaataaaatcttccacaaattttatgaatttttcataaagtcggcaacttcacacgagtccaggtcgattcttaaaacaatgatctttaaccatccacgtgtcaaaatcccaccttagcttacctcatttgttctattccaaatacctattctatcccttggatcttgacttatatgttcataagaaagtgtaccagataagggtatatacgtcatttacagtccagctcaacggttataaaatcctaattcgtgaggtttctctgaagaacaaacacaaaa

SEQ ID NO: 3979 - DNA, 2000 bp, Arabidopsis thaliana
tcaaacttttgatgattaatttttctctttcatgttatagttaatattatttccgtacggtaagtagcttttctcggcatgattcatgcacctacgccacctgattttattacctacaagtccaattccaattccaataccataaccaacttcaatttttttttattttttttttgaatatttgttgaaccaacttcaaatgttagataataaaatatattaagccacaaaactttactttttagggacagttaccgattctatagttagttatgttaacctcgcttctgttattttgacgtgatcatgtgtcatgaccatgttattctcttagaaaacatcaccccaaccattgtatcgagcaaggttgagataacagaagttgcaataatctattaattgtaactaactatagaatcggtaacagaagttgccctaaatctccaacaaagatatgttcattaattgcaataatttataatccttacaaatttaaaaaacactatacattatataataggattaattagttattgggcaaactagtggatatgtgacttccgcaaatcaatcatctaatttatctaaaatttttttgtttactctatattttcataaactgctacgttaggaaatatgtgtctatatcacctatcaagtcaaattaactataacgtcaaaaagaaaaaggtcgaactaaccataatttcaactctcgacttatcctgaatacatattataattatataaagaaatacaaatccctttttccaataaattacaagatccgttagcaagaaaataaaaaaaattgtggattgatttacatgcaaatttttataaactttttgagttgagatttattaataaactattagatttttaaaagctatgaagctacattggattgatctagtttcttatccatgcatgtgacctccgctatgaaattgaccaaacatgttacatcttcgactttatcctaatttaaaaaaaaaaaaaaaacagaaaccaaaatgaaatgggttaaaatttataataacaaagataatgtcatttttttatttggccgcaaaaagtgtcattttcttatgtgaaagcatatatatatataatttttttttctagatcattaaaatgggcatgttcattgcactctatttattttcgatacgtcctcattcttttcatttaaaaaataaatatattaatgcttttgaaccgacagttttttacatgacattactaaaactgcaaaagtaagttacagtcaaatatttgtttagtccatactatactattagaaccatgtttatttgatttaaaaccattgagaatttttggatgacaacgttattcttagaaaattaaagttactaaatactcccacttaatatttagtagtagaaaaacttattccacttttagtttcttcaacgaatttgtttatggtcttagcctcgtaggtagatccggaataaatgggtaaaagctggtttccttccgttgtttcacttaataggtagaggtagaggaacaaaatctctttgaatgacgtgataggagcacaatagaactagttgtacttgtacggttatactttcaaaaaagaaaaaaccatagttcaaatatcatctctatataggaatttggtttttataatatattcctcaatttccttttcttgaatttttcattttcgtacttagttttctttgttaaataatattttatgtaagttttttttttgataaaaaaatatatgaagtaagttgacattaaatgtttcatattttgacatgggatcaatccaagaggcccatccaattgacggataacagtcactcactcctataactgtcggacccgcatcactctctatttatacacacctgccttctctcacttttcttcattcatttcatacatatttgtctctcttaaatgtgtttatttccccttttgtagtaaccactcaaaaggttttacttcactcaaaa

SEQ ID NO: 3980 - DNA, 2000 bp, Arabidopsis thaliana
cgtgggtttcatccaaaatgtgatcaagtcctaacactttttttctttctttttttctgttgttgacttctactatagaacattatacttaagaatttagatgctgtatttttcttttcatatcttctactacatataaactgtacatatacaacctaaatcgtcaaaccaatctacccacaatcataacaaataagcacgaactcaaatggtcttaagtgaaacatgacatagacttatatactagcgtggcacctcaagaaagaacttcaaacccaccaatgattaaaacttggctcttgtcctattaggcttcgtgaatgatctcctcctaatcttccaaagtaaaaaggtcggtgcacgatgcaaggcttgtaatgttctctttgaatttatggtgagattcgatacgatgttagtgtcaagatccccttttttcttttagactcttgcttggatgataattaaggtgaatatttatgctatagtgcctatccatttcttcatcattgtcacgagatctaaaacccatacttattatactttagggacctcctaaaagacacattgagcttttgatcgcgtgttgctttgttatcatctttgcccactttagggacctccaagtgtcagaatttttcttttgaatagttagaggtttcttatcaaaacaaaaaaacaagaatagttagaggttttgaccccaaaagagaaagaatagttagaggtagggacattcaatacaatttttcgtttaagctctttagttttgaaatttcaagatggatataaagttgaatgtacttttggataagtttaacacggtttggattttttcgtttcaatatttttgaatcattattttccaattggttgtcaattcatttaatttagagctgacctagagatatcactatgtaataaagtaattgttctattcaaaattgttagctcaaacctatgtggtctaaaatgttttgcatacgtgcattatttttccacaaacttttccatcgatttagacatcaatggtctgctgaatgttgacgacatctagttttatatttgtattcaatgtctattttttgaaacgaacccgcaaccacaacattgagtattcgaagtattttttttttaactgtaaacccaaacgcaaaactcatgaaatatttttaccggctgagcaaactattatccatatttaaataaattttagatgttgagagctgatctcggattgcgtcactaatggcaacaatgatttacactttcacgtttgggagcttcaattggcaatcgaataagcttgactctttgtagttcagtatggagatacaaaaacagttatattttgctagtcaagcaagttccacaaaataagctttttgtatctccgacttaatattttcacgtttgggagctcaaacctatgtcttcttccgccaaggcatgttcctaccattgattatattttgttttgtggctttcttttgtaatatgatcattttcgtaaatttcgatttttgttatctattcgtagtgtctccgtttttcttataaaaagaacaaaaatggaagattataaaaaaatgaagtggttttatgatatgacgtgatgtttagtaaaataacgttttatcgaacggtttcacaaacacattgtacataaattactgaacgagaaatgttatttgtctacatcacgagtaaaactttaatgcatgtcaataccattgacctaattaatgaaaaatgttgaattaattaatgcatataccctactttttattaacatgaaacgagtcaaataaaaagggattgactcaataattttagaaatactgaatgggcctgggccacgtaaagtccaagtaaccttaataacctaaaaacccggaacacctgttgtgcttaaaccctagaccctaaatcttagcgaaattaagcagagcaacattttcgtaatccgatctccgtcgtcgtcgtcgaatcagataaaa

SEQ ID NO: 3981 - DNA, 1409 bp, Arabidopsis thaliana
tcatatttatataaatggtaaaatctaagcaaacttttaaataaaaatatatgtgattacgcaaataaattttcggcttattgatctaagtcgttagaccatatggatcggagtggctccaattggtaaatgcaagagaaacaaattggataaagatgaattttgatttggtgatcatgcttcttgtcttgggcttgaattttagagtagcatgaacattatttgatagatacatgtagcttatagtcagaatagataacatactatctccactcatagtatgaatatataacataccacaaaatctgatttcaagtatatgtttacgcatttaataaaaatctggttgacataataaactataaaatcaattttaaagtctcacacgaaatttgtaaaaaaactcaacccatcaagaaccacactaaatttgaaaaccaatctaaaattgtttggtttttcagttttgacagtttccgttacattaaaacaaaaaaaaaaaacttttagaactaaaattaaattaacaatgattaattacatcgctaatctctatggcaatttgcccattaaaacggttacacatgagttcgacaaagattaacaaagtctagcgcgagatggagatctaaagaacagagccggcattctccagaaaaaaatagacgacttgtaatttctattagtatgaacctaactcacacccaaaaactacctcaaaagtagaagtttacaacatacttatatattactccacaaattatcaaagtctcgatatgagatatattctaacagtctcctatatatatagaaactaatagtaagatactcaacgaactctttgtcaaaaaaataataatcaatgaactaataaaaaaagtcacaaaaagttcccgcgaaattacatgcattagcttctcttttaaaaacaaaatttagtcgtcgtgccaattatttcttccgacgatatgcattagagacattgcgtgattatttgaccttcacatcattcactatgtcaacgttattgaatttttagccaagtcgataatgatatttggagacttttttttcaaatgataatttgagactttgaatcgttattttgcaagtatctacctctttagattgaatcccaatctgaaccatgtccaatatattcatatagagggtgacatttttgttccaatattgttagagacaagctacaacttggttagtcaaatcataatattcaaaccaaaaaaaaaaaaattggttagtcaaatcctccattggagatggtcttattatgctcactttatttctgtgaatgataatcaaaagtcttcttctatattcactataaatattttgaaacccttttacttagaattagacctcatagcaaatcaagaatattacctcta

SEQ ID NO: 3982 - DNA, 1813 bp, Arabidopsis thaliana
attcggccaccttggttttgtcgtcattcacactaataccatgccatgatcgtgatgctaatttaatttggtaacccggtggtcatgtaaatactgattgatatattaaaaacataactacacgattgatgattcttgtgtgatttgaaaagaacgctgtctaaaggcccattgtccatcgatgggcctttttgctaatttctacattgcccatgttgtgtagtctgattttcgctaaaacgttacgttgatgcgtgtactcaatcactcgcccaccattttcttctgtgaaacagttggcaaaagttaggggccgccaagctggtttaaactgacccacaagcgaataaatgtcagacacgtgtaaaggacaaagagagcaagtgtcaccgtatctataaaagctaacattagaggatattcttgcttacgtgtgacatcgtcactggtacatatcatctaaaggaatctttgatcaacactactctggaaaacaaattgtatactatttataaatctgttgactgtatgtatattcagaattatgtgattgattgactaaaagcgactgatttttaaccttttataatacaaacagaacagtgtacatatccaatgtagtgaaacaaatccttttattgggaaataaaattaattttgtaaatgaaaatttcgttaaaacaaaccttaatgcttatcgtatatttatttagcttgaaaactaaagaaaagatgtaaaaaaaaaagaactaagtttggttagtgtgtgtaatgacgatgaaagatgatgagaagtgataacttattttaagggctaagaacaacaacaaagttgattattagaagaaagaaataattaaaaagcaaattgcaaacagcgaaaagagagatgatgacaaaaaatggttagtaacggccaaaaggtaaacaggttggctgctctttgtttccattaaaattagtaaaaattccgagaatggcattttcgcaattcatagatatcatcaacttgtgtgtttgttggccgattataatataaaggaagggaaactcttcttctctttcttctcattttctctcaattcctcgcagctgaagctatttggcatatacttgtcttcgcttttcgtagctctttcgcgcataataataactgaggtaattgttcgattctggttcgcagcggattttgtcgatgctattgaggaatctagatttctgtgatggatagatataagacatatcttatgtctctgttccgattcgatctgtttgtttcgttcctagttcgatctacttagatttcgtcccatgtttatagctctcaatcgctttgaatcttgtctttagtgttcgattttctggtgtttaattaggagcaaactagataggccttctttgttgatcctgtcattaatggtttgctctctatgtttcaggttgttgtttaatcaagaagagtgtgcaaaaattggaaggccagggaatgcagaaacatgtatttgaaagctgaactcaattgctctacaccaccctctcagatcctttgtccctttgggcccttgttctccctcatcccttatgtggacacccattttctaaacccctgcttccacaccttccagccttcctctcacaatgctagaaaaaacgccacttggaagcatgatctttgcgaagacggttgatccgacactaacagcctcctcctgagttcctcctctaccctttatgttgtctgcgttttagtatattctagggtggtctttttatttagtggtattagtagtgctctaagctaaccagttagtca

SEQ ID NO: 3983 - DNA, 2000 bp, Arabidopsis thaliana
ttttttttaaaccgtcgttggggttggaagagacggcgaagatgctgacgtggactcagcgactatgtttcgtcagtgcgttgacacgtgttctcatcattgcggatattgtttttgtatgtgttttagattttatggattttcattttaatcgttgggttcaaaactttaaaagcccaaattcataaaatccatagttatatcattttaaactacataaatacaaaacaaatatttacatcttcgtgatatcattttgatcctctacacatctaagatattattatcatcttggttttctacaatttttaccttccttactttgagtctttgattgtatatcatcttcaaaaatatacgccaaattcgttttttggatctttttacaaagatttttttcgtcgactatcacaaactttgactctatgaaacaaattgaagaaaaatgaattccctaaaaatcttggaagaaacaaggaggctaatggtgctttaacaagtaggctagtggtgcactggtgcttttacctttgttgacatcccaccaaatttaagctcgatcaatgtgactctaattggccactaggtaacatgttaaaaataaaaagaaagttccctaaaaacttcaaactttttacttcaacaaagagaaaccaaaaaaaatctagtgttcatgagtttatcattcattttaattttaaacaccggttcttcgattcatctccaaaaaatcccttcaaaatctagaaaccctaagggggtcgtgtgcctccatttcttttctctttcattttgtgaaatccaaaacattatcgtctatcatatgtataaacaaaaatttgttgcattttttactaacaagataggttactttgcatacaatttaaagtgacgacattttgccaatcgataagtctctttctcaagagagaattaaaaatgcaaggcctgcagcctctggcagcaaaaataatacaagggtagtggaccgacaaaataataaatggggcactctataatcagaagacggccacgactcgagctggtaataagatactaattgacattgtaatgcatggcaaatgataattgcctatttaggacaagagcattaaaataattttcaattatttagagtaattacttctaaaatttaaaattttagcctcgactccaggtgtatgaaaacatggtaagtatggtcaaataataaaaaacaatactgaaaaaagaagttgttggcaatgatttaataataaaataatgtttttttaaaaaatcccaaaaaatcatatctacccgatcacatactaagtcaaatgtagttttaaatagattaggtagtctatttttagggtgtattttactgaatacttcttccgtttcacaaaaatgtcattttaatttattttattatacatattctccttcattataagagtttttaaagaaaatcacggatttaggatgctgatgtataagcattatactaataatacactaatttatatagaatattggaatcaatacactaatagtactattgaagtctatatataatgttttgtaaaaaattcttacacaaatcagtctagtaataacattttctttattatcttttggattggaacgaaaacaagtacaaaatacgatacataatctacaaataactcgcaaataaacaagtcaagaaacggtacaaagaatctgcaaacacatttttttttgagagtgtaaacaaataaaatacaaatacaaagttttattgtcccatacaaagtaaatttcctttgccccacctttacttaaggctcattaactcatatgactcattggcccatctctgccaattgtcacacgacttgatggttttctttgttttcgacgaagtgctaaaacatgtggctcaactttgggttccaaaacaaaagattttgaaaataatatatcataacacaaagaaaagaaagaaagatataaagtcagcttaaagctctcgc

SEQ ID NO: 3984 - DNA, 2000 bp, Arabidopsis thaliana
tacaaaagatttcacggagcaatactcttaaaatacaatttcaaagcatcatttttttgtttttcttttcaacaatcatcacgtttgaaaaatagtatatattcggtaccaagattttttcacttgaaattaaaatatatagaaacttaggaaaaagtatatattaggatattatcaaaaatataaagtatatatcgaaaacataaagccaacgattttaaaaatgctcaacgttatcttgttcaaagagtgtggtacattaaaacgtgtcgtattctcatttgtacagtaagcaagtggaatccaagttgagttatgcaatttaaccgcgagataaaataagtaacgaagcttatttgtctgaaatcagcagcaaaatatccgtttctgttgaccgacgcctaccttactcatttagtcattacctacttttgtctgactcactcaccgtccatactttttacatttatgtgtagacataccaaagtttgttatatccaatcaagaactatgtgtaaacttaaattaaaccaaaaagaaacaagcaaaactgattatggtagttagaaaatagtctaactattatggacgttttaacaatcttttgtgttttcgtgacgatttttgtgtaaacgcgttcccgtgacgatttttgtgtttccgaaacgtttcgaaaacaggaaacggacctcggaacgggtttccatgcaacctaagacgtaacccgacctagatttgaaatcacaatgccttttttaagtcgagaatatataaagttgagagattacctgtttctggaaactctttgctaagtcttcaaaatgctttcaagtactctttgaaaatgtcattgtctaatcatgctaatctgatatattataagattttatttcggcccaactggtacaataatgtaaacgccattaactatgttgattggtacttttttgcggacaaataatacaccttatacttgttgacgttgtgcttatcatcttcagttctagccatgtttctagtaatatttgcatgtccatgaccataattctactttcgtcatttgataggagtgttctgatcaaaagatttggtgtaatatcgttgcatcttactatgttggattcatatatttctaaaaattagatcaggatatattattattattattattattgttattttgtttcgttgtatcaccatccaaatcaaactcgaataatacgttgttttttataaaaaaaattacataatcttatctgaaaattgctttaaatcataacattttaatagattttgttgttgtcaaacctacatgttttacaaacatgttttggttgagaatcaaaattttatgaaccttgtttttcgtgttttaacacataaacgcaagaccgttttcacatatatgtaatgtatgctttgcattaccggtttaaatttctaatttattttatttaatataattttagtgaaacaaaattttctctaataataaaatagaaacattgtatctttcacctttaccaaatcaaacaaaattttatgtttcttactagtaaaccccccaaagtagttgatatcttgtttgatagatttttcatgcatataatgaacatttaaattttacaaaacaaaaccattttttctttatttgtttcttggtcctctcaaatccaacccaccaagacaaagaaatagatattccctttcttatgtaaagacaaaagtccataaatactctctttcaacacctctctcacactcaccatgcaatttttctttccttgtgaccaagacttctctccaactctaaaccaaaaaacacccagattttttctctctgatttcaagattccccaaaactttttctccaagaccctctacaactttcttggtaagcctcttctacttcttcccaagtttgatcactcagcgaaacaaagcaaactaagtaacaaagttaaaaaaacaaagaatttgattgtttttttttcttatag

SEQ ID NO: 3985 - DNA, 2000 bp, Arabidopsis thaliana
tagtgaatgtaatgttgctctatcgaggtggagcctcgtaacattggtaaggctacaaaaatgaacatcgctctctctcttctttaagcattcctaaatcgtgtttttgtttttctttttggcagcatcttttattttgtttaaacgcctaaaactgcctttgatcttttttcctttttattgatagaatgagataggacaacaaataccttttttgccgggaaaattcaaaggttgttgatgattccttgtgtccgcaactagaaagagaaaagtctgtcgtatcaaattagatattgacaaaaatgtcaaaatatatgaagaagtgtgaggggaaaccgttgattgaacgtaagacatttgaaaaatggatatgtagtagtttctagatttgcttacaaggaatgttgagttgtatcattttctctaacgcaatagctaacgtgcacgacttttttttttttatgtaaacttcaaacaaaccacgatcaacgcgtttactatttattgcatggaaactatagcaagtgtgacaactcatatcaatttgtgatgaattgattaactacgtaggtagtataatatttgtaagttggttattcacgtaagaaatattgtattttactcttatccagattatttaagaactcgtttttcaatataatgtttgacattttatactcgagttaataaacaaattagctttacattgacaaaattctgttgtatattatttataattaatcttgactatgggtaattaaataatatttttttggaaaaaaatacattggattttctcaaatgatcacacttctattaaaaccaaaatagtacgtatacgctctagacgattctaaatagatgattaatttggctcgattcattaattcaaaaaataataatatttagtgttttaaattagaattaaaatattaaataattatcggatatttcagtgttttaaattattgaggatgatttttgtttagtaatgacgtcagattgtctaaggaatagtttgggaaaaaaatctgaatcaaatatgactaacaaatggttattggttattgaactggaccataacaaaaagacacacacacaaaaaaaaaaactttttttatctggtttgctccatggataagaatatagtagctaggatatcctgatctttagataacggtagaacatgtggcatgtgtttattgtttatttttattttattttgagaacaaaatagttacattgtttggttatatataaaaaaaaaacagaccaaaaagacaaaaccaaagcttaaacaaaaaaagaaaagaaaaacttaattagaccggttaacactaaactggtttatgtaaaacggattcataaatgtatctagacattcacttacataaaattcatcacaaaatttcacccaattacggttttgattcggtatagggaccaccttcaaaattacccaataaataaagagtggataacaactagcataaaataatcaaagcatccactaagacacaaaacacaatttcataaagatgatgatgaatcacataactttaaataaatattctttcaaaaaggcaaaacttttaaataaatatcattcgcctgtcggccaagaaaaaaaaaaagtaaacaaaaataaatatcatacgtattgacaacaaaaaattcatacgccagtccaattacaaattacacaatatttaaaaatttaaataaggaaaacagaagaagatacaatttcaaattaaaaaacaaaatacgtgtatataaaattgaataaaaccccaacagaaacgtgacacaaaagaaaagattggggaagctgacctctgcctttcctcctccattaatcaaggaatataaatcagctttaaactcagtcctcttatggaagacaaaaaagcaaatatttattcgtaaatataacttcagaaccctttcaacaaaactctctctgttctttctccgtggagaagttaaagatgacg

SEQ ID NO: 3986 - DNA, 2000 bp, Arabidopsis thaliana
acccaactaatcacaagaataatatttacttatttaatctttttgcttgaatcatctactaatcatattcttccaaatgtattaatctaattgacactcattatttaccgcttaatttaagtgatcatatccaactactaattaatcgatggctgagatcaagatgacaaatatgcagtagctttcggattgtggtgtgtagaattttataatagctattggacaatgggcaatttgatagtctgaaagcaacaggcaaaaaaatcagaaccccgaatctattacaaccatgatatttaaagcattacaagcacaaccacataatcctttagaccttaaaaggaaaaaaaaaaaacatagcaagaactttttttacatgggcgaggaaagcttaaactagtcttaaccttggtctggtataagccggtttaacttcggattagtcctatatgtgtcggtttaaaattattactgattttttcacagccttaagaataggataaccgcaacttcaatagggttggaccgatgggtccacattgagttattttccaaatgcactaaataaaaatactgaaactcagaataattttaagcgtatcggtatatttttgcttcaacataaagactttgcaacatccatcaatccaagtataattctctcagattcttgtaggtctttttcagagttttccacagaacaaaccaatttgaagaatcttgggaactctttgccaattagagatatattcagagaaaagaagaaatgttttattctttgcttctacggaccagcaaaccaggtacttgtgcatacacagagtcagaagaaccctctctgtaccctactctaattcacatcttgaagatgtaagccacataaactacacacgtgagaatatactataatgtaaggttactgaaattccaataaaccatgtgatactaaatgaatttctatattatatcttaaaacaagtattatcaacggctaatcttatgttcttcaaagatttatggactaaaagatcgaaactttctcataaaaacagagcaccaagaggcaaattacaaccaaagtcaagccaaatcaaattggcctttctcatctaaacaaataatttagttattatttaaaatgaattcaaaatcctaaaaataatatctaagtatctaactttcaatctcaagtgctgttgctagatacaaaaaagccacttatcacacacccaaaacaattcgaccccttttgctatatgctttataaaaaaaaaaaatctccttttttgttcttctttatttgccttttataagcttctacagtgatatttaaattaacctttaataaagtcaagagacacactgcaatcataaactcaccaaaagagtagaaaactaaatgtctagagccttctctccctcacacacacacgtttatgtatgtttcttccacattgttaaaactaaaacgatataagaaaactgcaatgataggttttacattattttctcttctggtttgatatttggatgctgttgatatttcactgacacgagagatagtgcaaatgaaactattgggacatgccaaaagaaaatataagaaagtgttcttattgcaacacaaaaagacaaaagaaaaggcagaattaatgggtgtgttacatcaaacgccctattaacgatcatttccatattttttatatgctctaatggcttgatggcatcacaaaacaatagaccccacattatcaacagcataatctctccccatatggacggtaaagattagaaaacaaaaaacaaaaagaaaatcattagagaattttaataatgtgagtgttatatcgcgtagacacaacacagtattcaagttggcttatataaatattggtaagaggaatgccataggttcccataaaccagctgagaagtaaaattttctattgcagagagaaagagagttagagaaagagagagagagagagagagagagagag

SEQ ID NO: 3987 - DNA, 2000 bp, Arabidopsis thaliana
tataagaccacctgtcccatggtgacgtacaaacaccatcaactttttcatattatttggtttgtttctatagtttattgtaataactccttatgtggaatccaacgaatcttatacgacaacaacaaagattagtgtaagatcgcatgtataaatatccttgacacttggagaaaccttagtggttcaataatgtgtataaccttaaaataatccagcaccatgatattcttttacttttaattatgctttctaagaaaatgttcattaaggaagttaaataattataataatcataatatatgtccctgcattaaacctctagatcatatacgtggcaacaaaacacaagttgtaaataactttagcttaaccctatcaaaaagataaaaatttagattaaaaggattattctattggatttgatgccttgttaaaccatgttacctaatgccttaacattatttctttaatcttgcataaaataatggatcaaaatgaatagccctgtaatatcctcgtttcgtgtatatgagaatgatgaagcttgggtggcttaataattataacatttaaatttgatttagtttcttaaacttttcaatagaattctaactgaaatcaaataaattatgctttggatctgtttagtttttgatttaggctgaattcgtttatatatatatatatatatatatatatatacaaatataatttctgtttgatttaatttatttttcttttttttggtttaacatattaaaaacaaaaaccctaaaactaatgagtttaaaacttgtgtagtaagtgaacggttatcttggtctgtcgaggttatgtaggaaagatactctttgggaagaccttttcagaaattttgatgtgggatcgatagctcgtaaaattcttctgattcattccaccatatgcgtaagaagtatttgcttatagcctatagggagacgatcagatagtgcttcaagggaaaattttcattggacccttcactgtttcatttgaagatgaaaattttgttataggttatgaagaatatttttctataaggatatatattgataggtttttgaaactgattgtgatgaagtagccacaactcaccattgttacgtctccttggaattaatccaaaaaatttcaacctaccatgacactagtttacaatgtgttaacttttctaatttctcgggttttattaatttctatacttgtaattcccatacagagactattaagcttagattcttagaattgtttttaaaaaaattaaacttgtaaacttttgtctttcagatttggttagcaactaaggactcaaaatgtagttggagaaaagaagaaaagttttggtttaatgtatcaatgcatgttttcatccatgattaaaactcaaaagaaatataccaacaagaggggtaatttagtaatttgtgtatgatgatgcctttggagatcaagagttgaatggacagaggaaatgatacatacgaaagacttatgaaaacgaccagtgaaaaggggtaacgagagcacccaagttctcgtaattcttttgtgtttacattaaattctaattattgctaattaagagcttgtagaactatttttgtagtttaaggggaaaaaggtatgtatattgcacggaattttcttttagttagtggttagatgatatttatgattctaaaaggtacacaactctaaaaatgtaaaaagattgtcttgtcactagtctatatctctatagaaaacaaacaaacaaaaaaagtggtggagccaaggagctagagtgagtgtatatataaataatgaaaggggaagaggaaaaacagaacaaaacacaacacaaagacaaaacagaggaacacttaggtttcacaagacagagagacaaaaagagattggtgggactgttagagaaggagaagacactacttctcttatttagctttcactaaagaaaaaaaaactaagaagaaata

SEQ ID NO: 3988 - DNA, 2000 bp, Arabidopsis thaliana
actaaactctattccagcaaaattatttcaaaattagatatatgggagaatttttacaggccattctagattttcattaacgctgtgatttatccgttaataagtacgattaagagtaaaacgacgtcgtttgcaattgaaacaaaaatccccaattcagaaataagaaaccctagatcctcaaatctcttcttcttttcttcttcgaattcactcctgtattttgaaatcaaagtgaattgcaaggcacaaagttcatgctttaaagcactgcaaatggcgaagtcatgatttatatggcatttttcctgtttttgtttcaattgcaaacgacgtcgttttgctcttaaacggtctcattaacggataaatcacatcttctaattgctctgtttattcagttgatgttgtgactaatttggctctgtcaacgaaagttagtgattttatctgaagtcaacacgtaattgatgattttaatcacaaagtacaaagtttatgtttaaagcaccacaaattgcgaagtcgtgatttaaatgacatttttcccgttctggttaaactaagtttctattatttaatatggatattgtggagcgtagtgtcagcactcagcagcttatttaacgtgatactctttaaccgagtaacaactagtgaggtcatattcaggaccgatccaacaatattgagggttttactccaagtaaaattttagttttatttttaattatcataaacgacataaatataatatggaaagatcacaaatactgattaaaaactaaaatcatcaaaacgaaaaagaaaaaagaaaaaattgggttcaactctcatgagttattaaacattttaggttttaggcttaaatctttaaaaaaaatcagaactgaaaaacgaaaaattctaattttattttggactctgattcatagcttatgtcgcttatgtagttatgctagggatgaatctgtatttcgttaccgtaatgagagttcgatactctcttacttgttacgattctggagcatgttacatttttttctttccgtcaacaacaactttaatatggtaaaacaaaatttatttttatttggctggtcctactcaagacaaatcttctgccgacatcacataatcatattaaaaaccataacttctgccactctgtttttttttttttttgtaaccattaactgattggattttgatccatctcatctgattttttagctcaacaatttacttgcacattttctatttggttttatttatacttagttacatatatgattatcgaactagtatctctttataattaagtatttttctatttttttttaatttagatttttgtgaattcatttacagtagaaaactgtaaaaccatatggtctaattatagaatgaaaacttcaacgaatccatacaacttattggctaaatataataaatctgcttgaagcatattgttattatttagttggatttgacgatctctgactttaatgtataccgacataccctatgatttagatgttgatttttcccattcttaatatatccatgttaagagattccaccataacatatctaattatttgcattgtaataaatattatcattaaaaaaaaatacaactggacagctggctcgtcccattgtttcttacgtccaccaattacatttgttaaagcaaacttattagaacgttcatgtgtgagaagttggtgtcgacatgtgtctaaggtctatgtcagaaatcggattagcttattaagtaaactatactatatcattgttaatatagataaaatatctagttcgtccaaattaaactattttcataactgccacgtggcgtaaacgtatccatcgagtcacttgtaatatctttataaccaaagtcttccaacacattcatcaccatctatctactctttactctcttctcttctcacatcaattattcatagttctctcttctccggcaagaaaag

SEQ ID NO: 3989 - DNA, 805 bp, Arabidopsis thaliana
gtctacacgccaatgcctttggattccggcaaatgcttgttttgcctgcgacgagttcgttatatcggataactcagttacctaccactactgtaaaggaacctctgattcatctagagggtcttcttctcagggacaaatattggtttagatcggtacaagaaaaattctacatgattctaaacccggttgagtacattggattcgataatccgatgcgtatactacacgttaaaaagtacattgaattttggtttaggccttttctccaattagtttattttctgagtcagacaaggcgttacattattgttcgcctttttagttttattttatccattttcgcaaacgttaaaacttaaagacacaacaaaatatataaaacggagatatgattgaggggcatatttgtcattttcttgtgatcgttgatttcgaagtcgctataagagtataagtagcagccttgaaaagtgttgttcatctctcgaagtaaaacttttctctcagtgatcggataaaattctcggcgaagaagtgaagtttccggcgatcagaggtgagttttccgttagatccttatcctagttgctacttgtgtgacttcgttgattaattttgatctgaatatcaaaaatcgggttttaagattctccagagtcctgatttttctcatgcacatgatcttccaaaattcatagggcttatgcaattgattagataaggatcattttaggtcaaaatctggtaatcacgtattgatttacttagttgtttgcattttttgatcgttttgaaaggtgat

SEQ ID NO: 3990 - DNA, 2000 bp, Arabidopsis thaliana
ctatatattgactcaacatatcatgatagaattacatatgagtcagatgtaattttatgatctgttattgtggattcattgttagcaagcatatatatacgtgtgttcagaagactaaaaaatttactatgaaatgaaagaacatttatttgtttggaacaaaaaatgtttatcataacaaattaacccatttttccacagagaacaataccattcgtaaccaatatcgagtagacaattctttaacaaaacagaaagcgacaaagatgaaagaaaacaaaaataaaaccaggggagagaccgagagagagagagcacctttctgacgtggaaatataatccaataagagcagagaaatgtcgctacaacgataaggatattgtgacgtggcaaaacattggccatgaacaccacattacaccacattccttttgtctatgtacactttttatttttccaatttatttttgtagacagactagtgattagtgaatactgaataatatacgtaagaaaattgcaattggaaatttggaattgaggagtgagagcaaatgattgttgaatatggggactaaacaacgtggcataagaggagtggttgggacggctgaactggagttggacttaatctgtatggacggtgccgatgcaattgacggagctaatcaattctatatggggcggtttctccggtccagtggacccaactttcatcatattttctactttagtggaaacataacccgtgaagcgacgccgtttcttttatcatgtccatgtgataaattatgtttttgttatatggtagggttagctgagagctatcaaaagactcttttttatccacctaatagatttgatttgtaacgttaagagcataggaagtcaatttaatcgttactaattacatgcataagaactagtataactatataaggagctccttctagaaattaaatgaaggatgatagaatctagataatcagaaattttactattgatcaatctagctatctcgtagttcaaaaagctttatcgttaacaagtaacaactttcaagtattgcccaaatagataaggttcataacttcatattttttatttattttatgtgtaaaagagtgacagtctatattattctagggggaggacaaggctcatgacataggacaagagaaagaaaaatatagaagcatatagtatattagggtcggtccaaatgaaaacaacgtttaggtatggggcggcgaggctaagttaaattaaccacaaaactccattatcaaccataattttagaattaaaaggtctctgttcctattgatagctccacaatcattcttttaaataatcagaatctcaaataagttcatctttagttacagatttgtatcaatagttgaagttgaaaccaaaataataataatttagttatagttaattttgtcaacaaaacaataccttaactatcatattatgacaaacactaattgagatgaaaaactcttagcagtagctaattcttactatcatcagttaattatactaatgtatatggaaattctgcttaaacaaaaaaaaaacagtggaacatgaatatattaagcaaaatcagtttctattgattatgtagcaatgattagattggtttagattatatatcatcatgacagctagctaggtaattaattagtgaaagaaagtttccacaaaaataatcataatcgtcatacacacaattctatattcatttcattgaaacgaataataaaaacaaccataagcctaccaaaaggaaaacattatcgtaatataatcaatcaataacacgtatacaattattaacgtatattgacaagcaaaattaatgagagcactcactatagctatagtctctctatataaacaactttcattcgtctcttcagtcttcacaaacacaacatatccacaatacaaaacacaactttcatatataacaaaaaaagttatagaa

SEQ ID NO: 3991 - DNA, 1336 bp, Arabidopsis thaliana
cactaaaacaaaggatttctgataactgtagctagctatatgtatgtatgtgtgtgcgtgagagatgatatgggttttcattaaaaagaaagaagatcttgaaagccaaaagtgtatgttacagagagctctcaaagatactttcttaaaccaaaatcaacacaacactcaaaagacagcaaatatagcagcttcaatcacaacgtaaatagtaaaaaacatgatgcagttaatatggacttctcagtcactagatcaacagaaaaggtttcataatcacaatcattccattcttctagtgttaatttgatggacctcttgatttgttcctagaggcgttactgaaaggtatcataatcatcagcagatgtttcttttccagtaatttaagtgattaacagattccatagtttccaccaaaacttccagtgaaacacttgctaactagtgaagctattctaagaacataaataatgtcaaaattgggccactaatgttgtgagctcaataacttgcttttagtacactgtatcgagcttagttttcaagccccatctagtgttattttggttttgtctttataaaaagcttgtaatatacactaccgacaaaatcaagtgattggatttatcattatcacccatcaaagcttcgaccgacagtctttaatggaacacgataattccatggaagatatttatgtgatatttcgtatgaatcataatgaccacgtaagaaaatttgtgatcgagaagagaacaccacattggtcacactgtatgacaataactgatcactaataaatgtctttttcggcaacgacagaatgatatcaactttagttagcctatcatcaacgtccaaatataaacttttctaacatagagcaacattattaagacaaataatatgagtattaaactccataaactaaagtggtgctgtcaaaaaaaagaaaaacttaaaagtgattagagttttatttatttattaatattcatagtgataaagagatttttatctctttcaatttatgaaatgttttcataatattttgttgtcaaatatggagtattattttattttcaataacaaaaaattataaataaatgagtcgttttcacatttacgtctacaatcacaatgtatgttatttagaacaataattatagtggcttaaaaatcattaatgaaagtagataatagtatactttttctttttctttgtgtggccaacatatccattttctagtctatatatacacatatccatctcttaactcttccatccaaaaaaaacaaaacaaaaaattatattcaagagaaaaaggaaaaa

SEQ ID NO: 3992 - DNA, 1452 bp, Arabidopsis thaliana
tcacttttcattattactatttgtttatgaaagtaataaatttaggcatgcctttttcttttttcttttggacagaattattataggtatgcctatcactctatttgtttcaaaataatgtttgtaatcaattctattagatattcactctttatcaatcatgttatatatttttgtagctggtaaacaaataattaatttttgaacaaaaaacaaaaacaaatacaattagtttttacaagcaagtatgcaactgaaatccaaagattttcttgacgccttttcgagcatattctaatccttcattttgatttagctcaagaaacgccataatagaaccatatatatgaactaagtgtttttaaaaagagtaggtcatgactcatgagtaatcttttccacgatctttaagatatattattcttggaaggtcgaaaactataatatttcattttctgtcgaatatatatatatatggatgacgatggttcccatgcatgatgaagaaaaagacgaaccctatatttatctgtttaattaaaattttctttgtggagataaactctctgtgaaacgcattccgccacctaatttatcatatattttcatgtgaaccaaaataattaaaatttgtttgccatatatatatttatttgttgttatctttctgagtgataaaggtgacaaacatttttgtccactgatacccaatctcttccacttcagttcccttcctttcaaattttatctcgtgcttttacagcatatcccacaattcctgtaaattatctcaaggatttggtgcataaattctattttttcgtacttttttgttggatatgtaaatcagaaccaaaaaaacttaacattgattaaactttacaatttacgtatgtcccattagaggggaactacagtttttgtaggaaaataagaaatttgcgaactaaagacactaaataatcctacttttaaaatcacaatagttagtactcaataaaaaatattgtatattgttgtgaaaaaatgtaaatagtttggagaaactgctactaataaacaaataattaagagatgtcggagatccaatttaatcataaaaataaaatgattagcacaatattgcactactgatttagatgcgatacacgtggaatctgcaacttttcaccaaccacatccgagcctacaccacgaaatttgaggatttttatttatttcccaaaaatttctctgtatttataaactaactatttcttgggacgtgaatatacacattttatattcaacggtccgtgagtgtatattgtatatactctctctcagattccctccttgtagctagcttctacctcctcctttcattcatggcgaaaaactaaaaaagacatccatctttctcaaaacatctctcttactctcttcgttttctgactgcaaccttttttccca

SEQ ID NO: 3993 - DNA, 850 bp, Arabidopsis thaliana
tctctgacctctgagaatccgccacgttttaatgcttcttcccaactttcaatttgtgtgtatagtttgttctcaatatttatcatttctcaaataattgtgattactatcttcttttcacttgttaaaatgtacatagactaatcttataatattatcttcctttggtattataagtttgtgtggctttctttctccctcaaagatttcattcattagactggtatcatttgatgatgctactacatgaattctttcttggatactaaacggaccactctagaaggtatcttacaaatttggataaactagaccaaaccaaatattggaaacgagtaatgatgagatgtagactctttgaattttgtttttgggattatcttgtccagttgcatttggaaatataatcggttgatgctgaaagatctatcattcataaaaaaatctaaaggaatggggactaatgcaatgtaaaacaatatcttatcaacaacgtataatggatctacacaactatgatcaaactgatgcataccacccagagagacactctgtctcaaagtttgtggagcctcttctttcacaaacaaacaagacaaaaatcttgtcttttccctttctgtgatagaaaaataaattaacaattcctaaaaaatagtctaatcaatttcaagacctcaagttgcaaaagccaactagctggatagttttgtttcttactctaattttcttaagtcgctcacatgctattttatctctcggtatatgtaattagtaataacttgttctatataaaccatgtcctatatctctccttcacattcatcccaaaacattacaaaacgttaca

SEQ ID NO: 3994 - DNA, 1038 bp, Arabidopsis thaliana
tgagcaataatataagctcgataacatggaaagtgtatgaagcaaaaaacataagattctttagattttgttgtgttatataagaaagaaatgttccaataataaatcaagaaagaataacttttgttcatttacttaaaaactagatcataatcaacacggattaagatctttttcattcaacaaaattctaaattttgtttttttaagtaaaaaatgttatagcataaatgttcagatttttatgtcgtattatattgaattaaatatagaacaaagaaaaataagatacagaacaaagagaaattttgatccaaaaaaaaaaagaaagagaaataagatctagaacaaaaacgatacattcagattgattattgaaatcaaataatcgaatttataattgaatttgatggaatttataatgtattttttgtcatggaaataataaagtttgttaatatagtaggcacgatcgaatctggagcttcaatttttttttaactaattgttatggaagatgctggaatgatctctttttacaagaaagctcctctcattcttgttccggttaaacaccattaatgacatcggcacacaaaaattcaaacaccgttgaagattgtttgctatactttatttttatcaataataagttgcggtacttggttaactgtatacgtacttctatttcttatagttgtgcgataattaccacaagtccaaaaaagtaaaatatgaatttgataaagcagtgtaaacctgagattttcaagatttgggcctaaacccattagagaatgctacgtagagaaccattgggcccataaacttattttattcccgcaaagcctgagtggattcgaaccactaccacaaaaagtaagagtttgggttatttgattttaatcattcactttgaattattatagacaccggacagtgacttatgataaagagatttttaacctttaaaactaaaacactaaaatacataatccaaagaagacggaacaaaaaacaaaaacagagccaggaata

SEQ ID NO: 3995 - DNA, 1733 bp, Arabidopsis thaliana
aaatctgatagatgtttctttttttggtttgcaacatttttttagtattggttatattgaatgcttgtgttttaaccttgcttttttctttagagacattctattaattagtaaccctaattgacatgagtaaaggaccaaaaatgttgtcatagcttagaaactctataatccaaaccaaccgaaaattttgaaatataccctaattgacatgagtaaaggataatttgacaaatttaaaatagtaaacttgcagtttgcactattgaaattaaagataatgttgacaaattctttatgaagccaaatcacattattgtataaccacaagtataatgtatatatttatatatagttggtaaaaacattcaagttcacaaccacatggtcattaattacacttgataggtagagagtgaagactaattcattgtgtatgtatccactacaccaattattcattgacttttggattcttatcagaaaagcatccgtgagtttatatgaaaggtcaatcgatcattaatgcataattccataattgtcgatataactcgattttgcaaactatattcttcaatcttgttgcaaaaaatgtcaatcttgttacgtgaataatggcatatgcattattatcgggtatcatcatttacaatcagagccaaaccaaacaaagagaactaaactgaaataatgttctttctttttttgtcgacatctatattagattgattcaaataactttcgatgatacgtacttaataaagacaagtctacgtaaacagacaaagaccaaaaattcaaaatatataacgcaaccaaaccggtccgcaaaaacgaatacttaatgcggtaatatgcctagttaaaatcgacgtaataaaagcaaaaatacaaccattgacagccctatagtcaactatagaaaaagataaaagtcaactttaaaaattgtcaaacgtttgtgagaaaacttgtacgtttagcaaaaagagattttgatattagttgcgttgccaaaagaagagagtaaactgcctaataatggacgtaaacgaatcaatatataactattgacaacctaaattacgtagtcaactgtataaaaaacgatcaactctgtcaattcaaaccttgacattatttgccaaaagaagagaagaaactgcctattaatttcaatataactaaaattattggactaggtctaaatagggtaaccaataaatttgaaaggtacatcttataaattacaaaattttggaaatttcatggaggcaattaagatttatgggcccgtggcaccccatgtgtttggatactttgacgatatttcagtttcaataatacatcattactcatggatgaagatgaaaaatagttttgtgctttaaagacagaggttgatggcttttgtggcatatctctctatagatcaccagtgttgacaattcttgtgttctgtcatctacagaattattcataattgttcatgtagcacaagtttttaaaacgatgaattctttaaaataattgacaatgactgaatgaataaatttattaaaaatgattatcttaacaaaaatacaagttgcaaccaaagaaatatatgattcatccaagtagtatataaaaataaaatctcactgtctatatatgtctctcattaaacacccaaatcaaatcgaaccaactaacacaaaagaaaagaaaaaaaaaacagagtatcaaac

SEQ ID NO: 3996 - DNA, 2000 bp, Arabidopsis thaliana
aattcatgtgaatttctttcgaaactttaaaataatatagggactaaattgtaattagatgtatgttttagtgccgacgtgtgtgattgagacagctttaaagatatcgaaactgagaagaaaatatagggactaaattgtaattatgtgtatgacatcgcttttgtcgacaaatcatcattggtgacgatttacgaaagcaaagaagaggtgttcttagctgcacatttgtcaccatttatacaaaaattgtggttcttgtgttttgttttttatgttggaaaacttatggtatagtttcttttgttacgatacaccttagttgaaccattcaaattattaggatattttcaaatatataatattttaattctaatttcgtatgtaaacgactctccaataaaacatctccactagcttgttggtctctaaacttgaaatcagtttttatttttcttgtaatattttcaaaattgtttcaatatcgtagacaaattttaaataaaatgtacatcatatctctataaacttaataatacccaaaattttgactaatcacattaaattccttatgatattcgaataaaaaaataatttaataatatttattgtagtcgcaattcaatatttattctgtaatgcttgaaaaatgtttttaaaaactgtgtcactacattactataacgttagtatgtactaaattttgtaacgtttcatggttataaaatagtattagtttaccgacaaaaatatatagattacgtaacgcttgttttacattaaaacaaatttgttaggattgttttgtctattctacattcgtcacatttgttttgtttaaactttttgttttctaattaaaaaattattctgtttttgtaattaaatatagtaaatttgtttgccgcccaaaaaaatattacataacgcttgttttacattaaaataaagttgcttcgattgttttggctgttcaactctagtcacatttgttacgtttgttctacttattgtcgtgaatcgatcgaaaacttgtgcaatgtggaattgagggggttagatgtaaaccaaaaaactaaaaagggcaatctccaattattttgttaaagaggtggcaattgcaaatctccaataatataaagttcataaaaaaggttaaaggagagagttgtggtggagagagtgagacccacgtgggtgatgtgttggcaaactatcttccttaaaatccaaatccatttatccatcactacttttttttcttttgtttggtagtaaaatccttcactagttgattgcagatgactaataaagtaataatctttcattttggtggttcatcgcctaatttgttgtttacttgattgataaatgtttgaggatgaaactgtatcatttatttttctcaaaattgtttggttcatgacctatataatccatttgtttaatattaatataggtaaatttaaaattcgttacttaaattggctaaacatactcttcaaaataatatatatccacttaacatagttaaaactctgtattcagataaaagcatggtaaaaaaccaaacatatccatttaaatgtattcaaagtcatgagaaaatttcctatacttgttcctttatatctgcgagaagtcatgaaccttatccatttattagttttcttctgaccgactaaacctgataatcactaatccaccgttagatcttaaaattccaaatccaaaatggacggtcaagatcacttaacgaaaaagaaaacagtttcctgtccagaaatgtctaaccttgaggcctttttctctttcctttaaacttttttttttcgattataaattttctcgtgaagctaatttttcctgagaaagaaagcgaaacttcgctggcgactaaagattgctgagaagacacgtcgtctctgtgagaactttttctttttcttctggtatattctggagacagatattgttttttcttctgattagagaataat

SEQ ID NO: 3997 - DNA, 2000 bp, Arabidopsis thaliana
atttcagccatctggtcgtcgtccgttatatggaccttttcttattctatcgttttaacattgtaattaccgattatcttttttgttgaataaattttaaatgcttaggacaaaactaatattacatgttgtggtttcggacctggagagattacaggcttcggcccaaaacttccttgtattaaaaaaaaaaaaagaataaattttaaattctaaataaaaaagatatttactaaggatttttgtgaaagcaatactaattgcattaacattcatacatgatttgtataattgtttggagttgggtaagatgctcgacttccacattagggaacaaacaaagctagattaatgcacgtctagtgaaagatccatccctttgattacttaacttcacattagggaaaaaacaaagctaggttcatgcacttctagtgaatgatccatccctttgattacttaacttcacatttagggaacaaacaaagctagattcatgcacttctaggtgaaggatatcaggatatgccacatttctatcaaagaatacggttaagaaagtctataggaggacaaaaatagatatgttttcccaaaaaagattcaaagctcaagttaaatggaacaatgagttagcaaaaaatggtttaacgggaggagaaatagtggtagtgtcaaccaagtcgccttggtccagtagtaaagagaggtaattcctgtcacatgggttcgagtagctttggccactgggattcgagtaatttaacatgggttttttcgggttccagaattagtctttggacctagaaaccctttaagatcacctgaattatcaaaaaatatatatatagtagtagtgttgtgtcctatgttgaaaagtaatatggatcagctttggaattctccaggaagcaatgggatcatgtgggatcaaaaagaataataaagagaccacgattgggcaattactaggcacttatgtcattgaggtgattagtggatcataagattatgcctactgttatcctcaatttgaccgtatactattttcttctcttttagccatccttgaatacctaaccgaggttcaagaatcagtttatgctttcatgttgggttgacctttgttaaataggttatctagtcatgaagagcgaatcaagccaaactcttttttttttttctctttaattaaaataggattgtctctaaaataaaattttacctaatccccgattttgtaattttacttttcatctcaaagaaatacaaattaatattacaaaataaaaaaaaatatgaaatataacccgtcaccattaccatcaagttttcaaagttttaacgaataatatatcaaatcaaaactttcgtgatgcagaattcaatctttagaattttaaacatctaatacatatgatcgtaataaattttagaatatacatataaaaatgcatattattttttacataataatatcgatttccgttgtttactatacacgtagcaagacctaaacagttttaatctgatatagcggaaactaattttggcaccttagacaattgattggtcaattcaaccctcaataagcccaagtggaaagacaaagaaatttagggtattttgtcgaatgagacataatcaacttgactgctccaataaactgttttcactagatgatggatagtagttctgttctaaacatggttaatagagatccaaaacccaatttctctatggactttattggtgcaactctttaagtgaaattgaaaccttacttcaacacatttcaaatgtatctacctaattaactctttatataaaattaaaaaaaaccttagtgcataagtgggtaggtgaacttgagtctcttggcaatatgtaaagaggcgaaatcaaagttgatcaacaattaaacacaaaaacccttaagttgacgtggctgtatctcttccaactcttaaaaatcaattactattatacccctcagaaaa

SEQ ID NO: 3998 - DNA, 2000 bp, Arabidopsis thaliana
ataagcctagttttggaaacatgtggacctctaggctctaagttttcatttgttgtggattctggcatttggctgttttctaacacacaactctggtgtaacggtaccattatcccagtttaaatatgtataatgcatgtttatatatatatatataaaaattaaagactaatgataagaagaaatcaatcaataattgattttttaagtactagatttttttctttcagtttttgacatcctagatttccagaaaaacttgaaaaactatagctaacatgaacgaatatagcaaacatttttttttgtaggaacgaattagtaaacatgaatactctgtaattattgagaagttaattatggattcgtctgggcaatacccattgatatttcccttgaaacaaagatatttgtaataagaacataagtactggacagacacacagagctgaactagacatgtaaattatttacaaatgttttaaataagtgaaaacgttgatttgaaaaatatattagaagattcatttaaacctacatctaggataagccttgagcaatatgtttcatatatatagtataaattgtcatactgatagaaaattgcatatgtgtgtgttaggctttgtaaattagtttcaagtatgaatcaatatctatgatgaagtaagcacattcgtacgaagacgtaaaatggatatatcacgttcgaaagcagcaaccaaagccaaaagtggtcacatggtttgttgttgtaaaatatatatttttggttataattattgtagaataattgagactagaacttaattagtattacgattccgctaattacgcagcccttatctttcgagactataactttaatattacgattcctctgatagtctaattatgcatgcatttttgtgtgtttgcgttttagtttatgttttatacgtaaggtaatatctattcacttacaaatgaagcgataagcttataattttgtagcttgtacccgtagacacaataaaaatgtatatttatcggtgtaatgttttactatgttcggcaacattttaacaacactttagttttcagtgattatataacagctagaaatgaacatatatatagtgttgatcattgaaataaaaacagctttctggtctgagatgtataaaacaaaaataatggatattttatcccgaaagattatgtagagattggatgaacaaattactggttgaacttgaaattattggactttttttttttaaatgtttttgggcagctatacgagaattccatgggtctttgtccacaaaatgttggcgaccatacgaaaacatcgtcgacattcgacaaagagaatctagtcttcataactaaaatatttttaatccaaaaacaaaaataacatccgacgtacgtgaagtaaaaccagtgtttttcttccatcaaattttgcaactatcataagtttttatataaaaacgtgtgtttatccaaacattgagttgatacggccgctaaattttgatattgcaaatgcatgcatgcgaagaattctcacaacgagtagtaaattaatcaaatattaacacgaaaggtactttataataactattactaaaccgtactaatattttgataaacatgaatcgataaattcttgtctaatcatctgccaaagaaacccaatattagagcgcagcctaattaaaatatttgtgttttgtttttttaccccagctgccattgatgaaccacacgatcaaaccgttgacgaggggtttataatctaatcaaacggtgtaaaaccggtgaaacacgcgtgtacatacaccatcccgcatttgataattttagattttaagtttaaaaaatcctgaggatgttgccttgaaagagtctctcattgacttgactctttcctataaatacacctttccactctctcttctccactgtcaaatcaaatccctcttcctcttcaattctctgtttcctccaaa

SEQ ID NO: 3999 - DNA, 1396 bp, Arabidopsis thaliana
atctttcaatagtttcatcctgttttatcaggctacattcactttggttgttctctttcaattcatgagttaacaaaaaaacatggataaagtttaaaactgagatcacttattaaaggcttttattcttcttcctcttgtgaagatgtaaagaagaacaaactctttttaggtttcttgttggtcaattcaccgttttttttaaagagatataagaaatcgcgatgatcgtgtagatgacatagagaccaacgaattgatggagtctttgctacggattgtggaaaaccatgtcttcgatacatattggaacttcaaaagagattttagtgataatctagttagtatctccatcgttagatccataggtccattaggcccaaacgcccaatcacgtggcgtgataaatacgttaacaattgcaatatgaagaaaacacgacaattaaatatggaagagaggctaattattcatcggtccaattgccaatgtctttgactgtagttaataataaatcattaagagattttcgtttaaaaacaaaaatacaccgtttcaagattaaaagataagttaattacaattgtatttttcctgattaaaaatcagatgtttacagggaaccgcagatcgctcagaaagtgtagtaagatgctcgcaaaaaccatgtgcatgtccatcaaccttcgccgtctcaatagcttacacaaaaatcgtttttgttttcttattaatataaaacctaatctaaatttacaaatttgttttcttattaatataaaatctaatctaaatttacaaatttgtattacacgtacaagtggatccaagtatctgactctacagatattttgaatctaacatttgtgtaattataatttataatctctgaagcatttaattttacttacaaataatgttagaccacgagacagaaggtaaaccaatcttccttatcccaagataagattcttcaaattaaatataacggctttttgcagaagtaataaagatagaaggaatatctagtatcaacggaaaaaaagaaaaaatctagagcacttcgaaaaattatggaccaaagaagattcagactgaaattattactgtattagtatttgtccattcacaaaatgccgaggaagaaaaaaggcattttggtttatattttgtttatttgatattcaaatgtccaacgatcctctctagctaagcttagctataattcaatgtttgaacacgaatcccattattttaacacaaacaacattaattaaatatcgtctcaaggaacttcacttccttgtccataaatacgttatttcacaccacatatactcatctatatctctatttttcttcttcttctctctctcgccggaaaaagtaaatcaaa

SEQ ID NO: 4000 - DNA, 1289 bp, Arabidopsis thaliana
taagggatcatggtccgagatggaaatcaagttacactagaagggaagcaaaggaaaggttgacactaaggcaaggtgaagttttgtggaagtattgcctaaagtgtcataaagactctaatccaaagagaaggtctcagcttgtgaaagaaacgaagtcacgagaggcgcacgtgctttgtcatacagctcatcaaggctagagacgtaattaacctcttgccaatggttcaaccattttgtctctttgtctctgcatttgaaacagagtacggaagaagagagaggagcgtggcggtgagtagagttgtataaaggagaagataagtgagacattagggttaagagagtaagtgcaagagaggcagctgaaagtttattcagtcttgtttctaagggtttgtgtaaccaaggctttctagtggatttccgggtaatctcggtccagacgtagcgttcatcactgaacgtgaactgggttaacatttgcttgtgtctgttttactttctttgtctaaacacacgagtgatcgaacaaagagagatttagtgagagcttccgcataaaacagttaaagattcaagctttttttttttacatcaacatttactaataaaaatgtatagttgaattttcaatattatatgctccaattgatacttcagaatgtgttaagattttcagcttagcaaaagtacacaaaaactatagtagaatagttcaaaaaaaattacaataacaattaatgataaattttgagaccatttttgacactgcaatttccttttaaaataattaataacaaattaacaatcaaaatggtgtatacactcacctaccattcaaacccataatttcatatagaacatattcctaaaaatgtgaaaaaattttaaaagattaaaaaatatttgacaaagagtcaaatacaaaaaaaaaaaaaaaaaatcctatctatgtttaattttggccatcagaagggaaatcaaataaaggggagatagagcgagtatacatatacaagctactcgcagcgtctgcaaattcatctatccatcatatttctctgctgctctctgctttcttcttcttcttcttcttcttcttcttcttcttcttcttcttcttagtttgattcaaaaaatctccttcctcttcttactttatctcgtattatccattaatcctaaaccctttagtctctccatcttccgcttcaacaatcagaatttgggtttggcgaaagatgctaactttgaaagtgagactaatcgtttgagtaaaaaac

SEQ ID NO: 4001 - DNA, 2000 bp, Arabidopsis thaliana
tgagatctttcatcggtaattccatgggaggtcttagaggtggtcagagtgccgcttcttgggtcgtcgccggaactattgcttactttctctggattaagccagaacaagatcttaaaaaggaacaagaggtaccaattttgatttttttgcacatccaaaaaagtttgtgtttttattgaatcctctagtctcatttccacagttatctctggtttgatttaggctagggcagctcttgcaatggctgatactaatcaatacgttgagaagaggaaaccaatcgctgaccctcaggtaaatttccaacatttattagtagtttagtattcatttgtggattcttcgtttagagtatcaatggttttttcttatgctatttgtaggttactggtttgatatatggaaacaagaacggaactgataagtcagaagattgaattttctgttaagtttgaacatttggttgtaagttagcttctacagttttgttccttatagctaatgatcatgtatagacactatagttgtaacttacaacgaataaaagatggaaactttttttgttaccaaaccatctctgaaggattttatgtgcattgtgagattgagtatggatctgaaacttcgttttgactccaaactttctatcatttccttttactctgttcaatttggcaccaattggtttcatggttagtaactttttttttgaagtttgccagtttggaacaccgatgctgtaaacttatatacgtcggattcgaaatttttttaccctttaaattggtgagatgcatcgacttgcatcatttcaggtccttgcaattattctgtggttggtttatgtttgtgctctgccacaaggatgggtgattttctcgtgtcatattagaaaagcatgtctgtcttgttctttagttcgatcgtgaatggaaagcttacttccccgggatataacttagttttatatcatgtgatggcgattgacaatggacctctgttttttgttgtggattatagtattgaagttattgcctcgactcattattggagctatatgctttagtgtccttatcttggatgttctatgagttggtcagatggatttggtttgttctgctttgcgtccttagattcatcagtttggtgtgcttgttgatgacttgatgtagtcttctaaccgaatttgtatccgtcggaaccatatgtaatgcgttgcaagttctttggtaaacctttcatgactttgctatccaaaagccatgttcatggatcgctttaatagttggcccattattttatctaactgtagtttggttatgatataggttaatctagttatacagttttcatatcgaaacgatgaaactaaatcttccgtatagtaggatgatgagaaaatcgtggtgccggtaagagtttccaacagcatcataccgcaaaccaaatgaatctctttccttctaggaacaacgccaacttagaagtttgaaaattgtagagaagattatttagattgacgagaaatagtccatgaccatctttaagttgtttatcacgtcgagaatgggtatgggttgagtacccggaaggaaaaacggtagcaacacgtattggctgagacaatgtgtctctttcacatgagatccaagagaccaagaccatctttatgtccatgagagagctaacgtagcttaagggcatttagcatgattagtattacttagttcacttttgtattcagcttaagactattactgaacaaatttactgacctggtcaactttctagaagacgtaccaaaatctcctctaatcccacatattatcattttgacggtaggaccaatgagaaacgtcacaaaaagtcaacacatacgacgcgtttccattgactaaataagtcttcgccgtctcctttggttcatcatcgtcctctctgtttaaatcaggagaaagctcacgagaatccctcttcagatcagaacaccacaaaac

SEQ ID NO: 4002 - DNA, 2000 bp, Arabidopsis thaliana
agtatcatctttctataaatctaaaagcttatcaatcttatgtgtcatttgtacgtagaacagaaaaatttagtagtaacttatggataaaagtgaactaaaaatcagcaccatgaagaaatctaaaagattaaaaaaggataatttggtgtgtcgctataaattgagagaatattaggtcaatgaccattaattccactaaatgtggttatagcacgatatactgttatgtggaatgaataagtaaaatatcatcctctttttttttttttttttttttttttttttttttttatggttgatttttggtaaagaaaaggttataagtgacacgtgaagagagatcgttaatctgttttttcttgcaatcttcattccctctcatttttgtttgatcatctattcctttaatgaggattcctccaggacaagtaattatgtgggtgttgctaatcaagtcactggtctttttgagaagagatatctctctaatgctctgttatagacacattttctaattagtgttttgtttctatatgaacttctctaatctagaaagatgctgcatcttcaaaaagttgctttgtttattgaatgctaagatgggataatggatcaactcagttcacgcagtgaaatcactagagcctaataacacatatattgcatttccctctatgattacctgattgggtaatgtaatgggccttagtctcattgtttcagaaaggcccaatttgttttttcttttattttctctcgtggtcgacatacgaaaatcacaggaataagattttcgtcacccattttattcatgtataagtctgaattccatgaattaaaaaataaaataaatcagtaaccgtacatgcatataaaagataaaatgcgaaaatagtagtataaaaaatacctggacgcgtatgtatacggaataccgtagggagtagctgtggatataacacgtagacatttaagccccagcttccaccttatctttatctgacacgtggcattattacaagcatgggtcccaagaactctcggtcttcttcttatgttttgtctacctgatgccactcgtttttgtctttcccatcttatccgatcgatccaacggctataaatgaattcatcattgggaattttcatatcagtatccatatttccataatatcaatttcatccctcatcttttcagtcaatacttttcttcctctaacttttgttaaaaacataatgtttgataaaatcatgatcttatttacaagagaatttgtttagctcatgaaatttgattaaaaaaccacaaaataaaaaagttgaattgaaaatcatgttctagttaaagaggaaaaaataatattttgtggtcttttatggatttgtgaggaagatcttggtgacaaaaattaaaaaataatttgatgtaaagcaaaaaaaaaataaaaaaaaatccatgttttgcaactatcttatttcaatgagaagaatgtcgattttctaaatattaatttattttactaggatttataaaacatatagaaaataatatttacatgtgtgtaaataaatcgaatataacaatttgtctaactgttgtttatgccgattaattaaaaatattttacaaatttgataaagatatcgaacctaaaatacattttttatacaaaaaatagtaagtttgctttgttaaaagtaaaataattttacattttgtttaattaactaatcaaatccgaactattgaagtaacaattaatttcaagaatgcggttttattttaaatatataaatagtaggggtaattgtttcaatgaaaatactaatataaggactaaatacgaatttcattacaatatgtattaaacaaaagaaaaaacagataaaggtatataataatgtcgacgaagaaatgcgtcggtattataatataaaagacgatcaaaatcgatcttatttacaagagaatttgtttctcgaagaagaagacgtta

SEQ ID NO: 4003 - DNA, 2000 bp, Arabidopsis thaliana
tattgtgaataaattcggaggcactcaaattggtgattaattttggatgattgtctaacttgtttcatcaaaaatgatctattcgagagtattacaatttacaagtgaagttgtagttgatagtagacttttagatatagtagtcgcaaatttaaaattaaaaaaaaaaaaaactattttacattacactttacaattgatcaaagattcggagacatgaaccgtctaacaaccttacttaaatttgtatataagcagaatcagacataatggtggtgaaggactcaacaaatacgaatttaagacagtgttttattatttcaaggagtggattttgggttgccttctacaattaatagacttgaaattaaatactatggtctggtgacaccaatagctccttgcttccgtgacgtgtaacctaattatctttgtggtctataaactaattcaactattggttgataaggcctttgattaaggctttagtcgcaaacttagtattctccagttccaactttgaataaacaacttaccaaattgccattgttattcactcaacacctaatagttacaatttccataaaaaaaaaagtaaagtaccaaaataagcagaattttcaaaattactagcattttttttttgttttttttttcaagtgaatttgatggagtaacggtgcagccatggagtgccacgtcatcgagcttggttcagtatctactattgtgttgccagaaacagaaactgccaaattcttatcttttgtttttttcagagccaaattcttatcttatgaatatgatattgggataaagttatgggggaattttgcaatttctgtgtatatttcccctacaaaagtcatggtctcatggactcattagggcatatttccaattcatacttttttttcaacatacaattttattcaaactaaaataaatatttttctataaatatatatttagttgtgtataaataattatattatcttgtttacttttttttaaaacgatgctatccgttgctgaccttttcatgaaataaagacagacatgtaagaaaaaaaagatgaatggcgtttcgttactttatctacttatttttaattaggtagacgtttcttcctctttaaaatcataacttgtccggattttaattttgcacaccttaagaaaataagaataaaaataattgtgtatgtgtgtataataaggtctcctgcttctgcaccaccctcgatctaaacattcttaccccattctcttaacccaaataaatcattttctctgttcttctgccattgtcgcatgaacctgtacaagctctctcaagtttccaaaggcttaaagacagaagagatccatcggtacttacaatctttccaaagagtacgtttcttttttctggaatcatcactcttattatatattgttgcgtgtgtctatctaaaggcatcgaattagtagtagatctgcaccgtttttgagttgctacgcaagaagatgattgttttcgatataccatgtcattttttaaaggatcataatatcacttgtttgtttaatcaaccactcctttgtctttaattatttagctttttttcttaaacaataacgtgctttgggattaagtgaaaacagagcaaagcgtcggaaacagaaagtgattaggtcaagtcttcgtaacttcaacttgttaaagaatatgatccttacttttttgcgtctaatcttcttcttttttttttttggttagtgtaagttttaaattcaagatcgatcatgctaagtatatacacaacaattctgttataatctatattgatcttcatattttgatgatatttcttgtttctatgaagtatcattgattttataaatctctaattggaattagactttagtatttactatttacttatttaggtgaaatctcattaaataaacaacgactggtcaagtgaatggttgtttgtcttgtatgttttagtaaa

SEQ ID NO: 4004 - DNA, 910 bp, Arabidopsis thaliana
cactcttttgtttaatatgtattaatttctctcttttaagttgagattctcgttgttattgtatatttgtataggtaaatgaatccatttatcttgtactataacttatattagtgttgtttaattgcctagaagtcactcattctaagtccaccaatattcgtataaaatattcacaagacttaatgtcttcatccttcaatatatcgagaagtccatgaatctcagactactaggccaattcgttgtgggcctcgtggcccagtaataataattattaaaaaagtataaagggagctaagctaaaatgatttttttaatagattcgaaaatagaaagtaagcattaccttttaaaaaccttctcctacgaaacgccatctgtcttctaactcctttttattaagtttcttaaagaaggttaaagaaaaaccctataaaataaatatcccaacgaaggcgataaaacccagattttccagatcttaaattctctcctcccccaattccatcttcgcaaattctccagattcttccgtcaatctttgaggtaatcaattttctcttaaatttcccaacattttttctgggtttatttcataatcaaagcttttgtcttcaatttatttgttatcgagggctaaaaaaactttgatttatgatcgtttctcttgttttgatgaaatgtatttttattttgttaatttcactacttttgcattcttttgtctgatttttatcttgtctgattattgttttgtctgatttttatcttgtctgattattgttaatgtgtttaagttgtgttttttttttgttttcaatatgaaacttataaattcattagtgtttttgatgatagaattaaaattaaaaactttgaaaaatgtttctcttagtttggtagagaa

SEQ ID NO: 4005 - DNA, 2000 bp, Arabidopsis thaliana
agactgaacatagaattctattccacggagctaattaatgacgtttcattgacttctataaatattataatatcaaaattaggggaagaagttatccaatggtgtaattatcatttgctgatttttcttcacctttccaaaatgattcttcaaagttcaaattgtatgttggaagaggcggaagaaaatagaaaaatcaacattcaaaaaagtctgaatcacaagagaaaatgtattatgattctcttttctttttttctttttcttttggtaatggattagatttttttttcttaattttttcaaaagtgtaatgttttttagatacttaccctaattaaggccaactaatcagaagaaatattttaaaacgtcgtcctatagttaattattttaatagaaatggtttacatgaatggtttaagagatctctttagaataatataaacgaacaaagtaaagaatcttctaagtccaaaacgtgaagacaataatctccaatatgttttcactccaagaactttctaaacgtggtataagactgatagaagttctaactggtattggacatatataaatgatagataactctttaattgcatataaaatctataattttctcatcgtttttatatttgctactaaactaaattgataatttagtcgttctagttctcactatttaatctgtcacattcaaatatctcggccagtcaaaatccaatacatattagtttgtgttttatacgacattactcgtgtttatctttctttcttttttgttaacacgtatttgtgtttatctcaatgtttagatgttgaaaagtatatatgctgattaataaataacaatttcttagtcaacaactcaatgatagaatgttatataactctcttacatcatttacatttttaaattgaatgaattctcatactatgcaatctacctggttagggtgaagtcacaacaacaacaacattaactaataacaacaatttaagctgcatgtcctaatcagaatctcggttattggtcgctcataagaacagttagaggtctttcagtcacaattgagagacgacatacataattggatgggaatcaaaatcagtttaattgcgctatacgcaacttgaaacgtcattatacaccgataagctttaaaaataaaatgttgtgatggacacgcgcactatatatgtatgtgtttggacatgattgaagctaaacaagataatatttattaagaagaaaatacataattattactaaataatgtgtattattatacgattccaacttttatttgataatgatttttgagcaaatcaggttgataggtatgattgagaccatcgcccaaactacaccttaaggtcttactattagaaacaaacaattcatttgggaattgaaaccaaagtcatctatggaagtaacctcaaaatttatctaagaaacagtgatgtattagaatggtcaagtcaacttattcacaaaattacaaaactatcgtttataaatatataatctatttttcacttgtgttacacgattcctcttttgatatgcaggaagaagagaagatcttacaacggctagaaatagaaaacttaatgtgctattaattacaacttaccaactaattagaactttctatatgaaccggatcttctacagcaaatcacggtcaattcaaaatattcatctctctctctctctccacatggacaagacatgattaagaaagtatataaaagaaacagagcagagaaagacattttgttccggtataccattgcaatttgcaaactgcttcaatccaatttccctaaacctcttagaaaattctgcaaaacccaccaaacaaagaacaccaagaaagacaaaaggcaggcaagactacaaagcaaaaccttcttcttcttcttcttctcgttactcaaatcatttccatatatacgcaaaaaccattaagacaagctagaaacaaagaaac

SEQ ID NO: 4006 - DNA, 2000 bp, Arabidopsis thaliana
agtcgtgaacgaggtagcgtaggagagaagtaagccccggatccactgtctgttgtacctttaatgggactgtcctctcgataacggtcttgagccactctttttgcataagaccttgtgtgatctctgactttaaaagccctggtgcgatcgaattcactctgatcttgtaaacacctaactcaagtgccatcatccttgtcatggtgtcaacaccgcctttagaacaagcgtatgcgactccaccaggcacctgaccgcggtggagccaggatactgatgaaatgtttatcaccgagccaccaccacgtttagcatcgcgcattaaaatgcatacgtatttggagactaaccaggttccggttaagttggtcttgaagactttgtcccactcgtcttctgacaaatccaaactcgacttgacattgcctctaaatcccgcattgttgatcaacgcatcgatctttccgaagatttcccaagctttcttaaccgctttttgaacggtggctgcgtctgatgaaacgtctagctcaagagcttcagcttgaattccagctgaatattcgaagcgatttatttcagagcagagagatttgagacgatcgacacgacgagctgctgcgataatcttacagccagctttggctagatcaagacatacctctcttcctataccagaggaagctcctgtcacaagaaccactttgtctttaagttcacactatggctccagttgcttcaatacctgctttgttagagtcatattaaagatgattaaaaagcatatatgataaattttcatataattgagctaacacagtgagatataagagaagaagtatctcacgcacagtttgatgattactcatgttgtttctctttgtgtgttctttggtggagaaggatatgcccataacatataaagacttgtctctaaaccaaaacgacattttaacgtggcaatctaaatctgtaagtctgtaactgatttgtctatcaaccaaactttaaaaccttttagaggcaggggagtctttattgttagttagatactgtctggtgatttctggaatttgagagctattaatacagaactgtttgatgaagttgagaaagggcatgttatcagagaaactctttaatgttcgttactagttttgtgtgtgtgttttttaaaaccttaataaaaacagaggatattggtcttaatgttttttccttgaaccaatctaagttttttaatgagaattaatgggattttgtcttttcttttttttatcatgtaaagagaacttcaagactgctagaacttagaaacatcaaacatgtttggtggttatattgctgattaagattatccaaatataagcatgtttaaaatttattttgttaactaaatctaaaatcgttttttttttttttaatcgttaattattgtatgcaaaacaatttaagttataagttaagcaatgacatgttaatagttcaaactaaatactgttttacaaatgtaatagcatgttatgtagagtaaataattagtaccttttatcagaaaagaaaaaacgttactaccttctttttttttttactcaaaaacaaacaaaagaaactatcatttctttatttcagttaaataatataaagttttagtgatacgcaactgcataataaattatctttaagtacactctttttttgagtttaatgcaatttccgagacgaaaaaagcgaccgaccgacatgagaacaattaaccgtgtaacagcgcgggaaagatgtcgacaaggtgagttataaccgaaccggtttataccgttttacacgcgtcatttacgcgtaacatccacgtcttcccaaatctgacagatacagagatacttaacttggtccctttccttcttcttcttcaaatataaatatctttaatcaattcagaaccaaaccaagtcaatcattcttcattgatcttctccgatttgaaatcgccggcgaaa

SEQ ID NO: 4007 - DNA, 2000 bp, Arabidopsis thaliana
actctttctctccgataaatttatatatttatgtttcaaaagctaataatcttttaagcagttttcagaagtgagttgtttagctttaagaatatacaagaatttgaatatttagagggttcattttcggatatggtctaaagaaatgggccgggtatgcattgtctcgacgactatgaccaaactgagaagaaaattgaacgtgcaacctcctagctaagtgacataccaatgacttatagaaatctcatatatgtttaataagtcataacgcaaaaattatttctaacaaaagcaaatgggttgattttggaactatatttaatggcatagaaaacttcttcgaatcagaaaagaatataaaatacgtgtgagttaggatgtcaccatagaaaatctccacaaaagcgtgaactcgattctatatatataacattcaatcattcttactaaaaacatctatatatatatattttaaacagtatggatccattcattctgatctgtaccagattgcaaaaattagtaagatatcacaattaaataaatgaaatacaaattgagttattttggattttcagatgaaaccaccaaacaaatacaagttgacttgaatgttctccaacgctatttttttctctattatattttataactaattaattcattaaatcacatgtccaaatatttaatgatgaaacataaagtaagtaagctagtgacgagagaaggacacctcattctcattacataatgtgacgagattgagctgtcgttttgttgtaaatatatggtcgggggtcaattattcatatgcagttttaggtcatttataaagaccattaaaaacgtctttaatatttcaacaatcttataattcaattattaagaagcatctagatatggattcacattagagttcgtattctttgacagcaaattcacattagacttttgatatatatattgtacatttgtaatatagtatacgaaaatattacttgaaaactgatgttatgtgttgccatgatgccattggtccatgacttttccacacgaaggccaaagcatactcttatattatatgagttgagtcattcttttttccttttgacggcaagttgagtaattcaattctcttgtcacttaccggtgatataagagttaatcttataaatagttttctgaaacttaatatactataacaatgtaaaagtcgtcgctttgttatttgaagtgaaaattaagcaatgttatgatatttttactaattaactcaatatgaaaaacaaaaatcctcttaactaaaacagaaacataaaagacgacttagtttttgctttagatctagactcataactcaaaaaacaatttcattataaacttttgtagatcttacaattttaaaataaaatgtacattaatgttgaaaagcaaaatcttaaattagtgtatactactactttttttttatcaccgtgatagatcattagatccttaacctcaatccctagagcctgcttattgcctttaagcattgtgcaatcactaccaaacacactcaaaactaaataaatataatttataacttatcaaataaaataaatactatcaagtgtgtatgaaatcgatgacaatttatttattaccttattaccatttgtgtcttgaagtacacgttaagctatttttatgtgttataaaggcttcttcgtcaaccaattacgaaatcaagcttttgaagcttctcaacaatggcggctattccttcccacaacaaccttcttaccatcaaccacaaaaactccataaccggttcttcttccctaaataccaatttctcagaaatcaattttcccgccaaattccgagtagctacgagagctttgtccagaaccgacgagtcgtctttatccgccgtgatttctcgcctcgagcgagaaaggcgggaaagacaaggtttattaatcgaggaagcggaaggagctggagaactatgg

SEQ ID NO: 4008 - DNA, 2000 bp, Arabidopsis thaliana
catggtgttgtacataacagttatacagaaactaattcttgaatctataccgtttactaacattctagatgattcatttactgaagaaatggcctcatgagcattttctgagtctattttatcctcccgaacaaatttatcggtttaaatgatctgctcggtaagatatttgttttatgataatgtttttgtttttgtcaatagtatcatcatcatctaacaacgatgtgtatcttatgatacaaaatcgaaatgggcctggccgtaactggtgaactgactgggcttggtcgacatgaagtctttttttttttttttttgacatgcacaaataataatagtcaatggaaaatgtcatcatcatctgtttgggttaaagacaaaggttttaaatgatgaagcagagtcaataaatacaaaaggatgaagacataaataagaatgctggaccactggactatgaagtttccgtagaaacgcaattataaaaagatcttctctatgactcttctacctatattcatttcatttgcatacgtaacctaattcgcatcttttttgccttctagaagccttgtaaaaaacagtatacggaatcacctatttttggaaacgacagcattccattttggtacctaatttccatttttatccgagcttatagttggattaagcaattttcctaacttacatattcattttaatgacttccagctatcttaggaagtttgattttcttgaccacttgagttcaaaatgtagagttttgtttgagccttcgacttttgtttttgagtatgagaaagtttgcttcttatttttccggaatctcttttcaatatagtagtaataattaagggatagatgtcaaaatggagggttaataagcctattgcatatattctctgttgtttaagacttttaaattaattaccaagtgaccaaactaaatacattgaccaaaatgcaatttgcttttttcgtataattatgttatacagtattataaaatatcacatttttagataaaaaatatattttcatcaaaaaaaaaaagctgaaaatatcattataaaagtagtattattgcacatgaaatttaataccgggaaaacatgtaaacaaaaattggtcataaatgtaagatataatatcagtcactagaaaagtattggatcccataacgtaataacaattttcatgtgattttctttctatcagtcactgaaaagtattggatcccataacgtaataaaaaaattcatgtgattttctctctaccaaacattattttttgggggtaaaatctctaccagaccttcacaaccgtaccctaataaatacgtgtatcttttgactgaaaagggaaagcatctaagaaagacaccacgtcgtcatatcaggaagactttctcttttaagtttatttggatgcttcggatagtctttcattcttatggattgttgatatagcaacgtggttcctcatgaaccaccgattagccctcacctacgttatctactccgaagacaaaacgtacataaattaatacaagcaaaatagacacaaccattaatgatatttcgttagttacataattagaggtaatcgggtgcgttacgttacgaattaaatctgcaatcttataagacataaacaaaaccaacacattagatttcttgtccagaaattgagacatgtatatacttgtggatctagtgcatggattggtggaaagtcatcgtcaaataatatttaaggatttttcattgaagaattattagagtccacgagtatatattttaattatcattagcttccacgaggatttttttcttttattttaaagaaagagaaaatgcatgattcatgattcaacggtttgttatataaaccaaccattaagtccgcaacaaaccttgactcagagaggcagagagagagagagagagagatatagaagagaagtgagtggcgtttggttaatcattttcagaag

SEQ ID NO: 4009 - DNA, 2000 bp, Arabidopsis thaliana
tttagcaaaactgtcctgtaacatctctccaacttggtttgaattcgttttaacattagtttggtgacaaacataacgttattgaatttttcatttttccgtaataatcattctgatttttttcttttcaaaatgttgttactagatgtttctttcccaagaataatatcttaaatcagtaatcactactaccagtaaacataaatggtacgtttctcctcattctacggaatttttaagaagcaatgatgatgattaattgaggatgtggacaagaatctttatatattcgcattcacatgccataactttcaaagtctatgaaaaaagattctattgcgtgtttatattctgtggtgtgtactgtagttccaaacataacgcttgtactacgttcatttccggaaaatatctaagaaatatggagtcataaatatttattaaccaattagatgtttttcctatgttctaaatacatttatggtaatctttgcggtcaaatatacgaactttaacaacgacgtttaacaatatatcttttgttttatacatatcaagttttgatatacggacgatagatatttattttcagaaaaccagtagttgtcgtagtcacatggtttgtttttcgttgatcaaaatttgttaatgttattcatttagaattagagactgtatatcgaatttggtactcggttctaaaaaaaaaaaaaactcaatatgattttttatacattctttttcttcccttttaatctgtaagaagaatagtaaagtgaagaagaaaaaactattcattatattgtaacatacgaatacgactcacaattaactaaagttaaagtgtctcattgtatttggactttggacattattctccattattgcattgtttctttctttcttgattaattatgtaaagttgaaatgatttgaagatgctttccggatgtaaacaaactaaactttactttaccaataactttgttttcagaaaactcagatatttatctctagtttctcgtataagtcccaatgaatctaagatttcaaaaaccaatcctatatttgtttcatatttacaaaaaaacaccaaatatttttccccaattatgccgacattaaactcatctttttacatacaaaatcccaaattaatatccgtttttacctttacttcatgaaagcgaagatggtaaaaagcagaaacatttcgagatattaatttgattgtataggcccgtgaataaactcgtggacccaaatcgaaaagataacaaaatttaaagatgtacttaattctctgaaaaaattctgtacgcaaacacgagaaagagaagagagacatacacacacaatacacatacgtggtttgagaggacaggagcaaaacggcaggtgtcactaatcccataggcttctctctctgttcactgtccttccgcacaaaaaaaaaaagtattcatttttatattctcacggttacttcgaaatctagctttcgttttctttttttttgatttaaaccaaaagggtaaacaatgctttatgattgcttagtgacgccattgaagcagcggctcactgatagtggcttcttctgcctccaattccaagttgctaaccctagttttcatctctctctctgtatatcatattctctcgtactttcttactttctcttctacttggtagagataaaaagtagtcaaattttattcaaagttttgattttgacatctgaggtttcacctctgttttttttttctagaactcctttgggtatgtgtcttttacgtcactaaagggtttgttatagtcttaggtcatgctttttggtgttatctctctctgttttatcttttagctcaccaagtgattgtgtctgattttcgaattttcaggtggattttgtttcactcactcatcgtcgttgatcagtgactctgtttttgcgaaattctcttcagatttcttgataaaagatagaagacggaatt

SEQ ID NO: 4010 - DNA, 2000 bp, Arabidopsis thaliana
taccagatttcggtaaattggtattcccccttttatgtgattggtcattgatcattgttagtggccagacatttgaactcccgtttttttgtctataagaattcggaaacatatagtatcctttgaaaacggagaaacaaataacaatgtggacaaactagatataatttcaacacaagactatgggaatgattttacccactaattataatccgatcacaaggtttcaacgaactagttttccagatatcaaccaaatttactttggaattaaactaacttaaaactaattggttgttcgtaaatggtgctttttttttttgcggatgttagtaaagggttttatgtattttatattattagttatctgttttcagtgttatgttgtctcatccataaagtttatatgttttttctttgctctataacttatatatatatatgagtttacagttatatttatacatttcagatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccaccgcaacaaccaccaaaaaccctctcaaagaaatttcttttttttcttactttcttggtttgtcaaat

SEQ ID NO: 4011 - DNA, 2000 bp, Arabidopsis thaliana
agtcaaaaacagcagggtttcttgacctttaagaattaggtaggattctttagggggatgtgtaagccagtcatatattgcaggtctcataattgatgattcttccatttgaaacttaaacatagataaatgaaaaaagtttctctaatcacaatggttatgaatcatggtggaagatgatctaagcattatctataaaatttattatttgtagatttgtagatctaagcttaaaagaggaatgtcatgtttgattacatcaattatttgtagattgtaaatattttagtccttgtcgcaattgttttggcagcgtatcttttcatactattgattttcaatacaaaaaaaaaggtaaataaaattcattttcttaaaaaaacaaggtttgtgtttaagaccaaaagtaagatacaacccgtaagcttaaagccatatttgcaaaaataatttcactttaattatagcttaaacaaactaaatcatataaaataaaatttgttaaaattccgactttttcttatatcaatcagctaaaaatgttcaaccatatgctttatgatttatctaatcaaattgactagacttggcaaaatacccgaaacaaggaatcaagccaaatccaatatgaatccgaattcgaaattttaaaatacccgaacagattctaaacatcaaaatccaaaatccggaaatcagaacccgattcaaacctgaacccgattaagtacccgaatatatccaaaatatatatacataaaaataatttaatagtaataatcatatttacaacaatttaagtgtctaaaatatttagattttaagatattttgtatatttttaggtattttacttacttttagattgattcggatagaaaatacttaagtttttctaaaagtttttgtataatttaaaataatttgaatatatttttgtacaaaatttgaaatttttgatatttcgaataaatctgaatccaaactagaaaaatctaatccgaaaccgacgtaaataccggaacgtatatatttttaatcgactgtcgaagaaaagtaagaaacagtggactgtgtagagaaatggtaacaataatagaatgactcttttaacttctaagattcttatttattacgaagatgtcattacccctagataagccgttcgatgaaattaaaagcagtaatgtcacataaacgtcggtcgtaacacatccaacggctaaaaccaattaaaaagcacgccaacactgacgacgttaagaaaaaaacaaagacaagaccgacaataaaaaaaaaaaaagaggaaaccgtgtctcgtggttcgtaaaccaaaccatataacaaaagcctcatttctctcatcaaccattgttgcgtgtttggttatctcttctttcttctctctcacctaaatcaagggatttgttctgatcaactttgaacagaatttacaacaaatccctagaaaaatctgacccttccttcttcctcaggaagatttaagatacttgttgataaggatattcggaagaagcttttgaaatttttggcaaaggtctcatttgatccgacttttctggtaatttttttccctttattgtttgtttttccaacagatctgaacatttttgttacgattaatcaaatttctgtgttcttaaattggatttggggaaattttgagtagcgagatagatcttatcaaagctgggttaaatcgaatttttgtttatagaaaagctgggtttagatcgaaatgaatcatttttgattatatagaagctgtgttttattggaatttgatcaattttgattgtatcgaagctgcgttaaatcgaaatgattgattatattgaagctgggtttgatcgaattgaatcggttatttgattatcatgttatgaattgaagacaaccttaaaaaatgagtcttctggtgtcagatgataaattgtttttgttgtttgtttagttgaaggtgaaatagatacaaaaaaa

SEQ ID NO: 4012 - DNA, 1058 bp, Arabidopsis thaliana
attttgtattggtgcagaaaatattaaggtgaatccgtaaatgttgtttacttgatcctcctgatagctatagggtgttctatacaaattcaagtaatgaaagtgcttattgttgccataggaggttacaacttcatctgtatcacttagcctacaccagagcatcactattttataattgaaagattcataggttcttccaaagaatgttagggtactattaattcgagaatctacagccatctagtactggctttatgtaagtataatgtctaaaagtatggtctatataagagagtcacacatgtattttgtatatatatgcgtgtagagtagtagcagatatatgatgtatgggaaacttagagaattacgtttacaatatttggtgccctattgaataccttccttgaatgtgcctcctcggtatttttctattgtaatgatccatccacaagtttcgctgttattatccgtttaatatgcagaagataatgtttttccttatattttttaaaagattccattgggcattggatagatatgaacatagagatctttataatctttaataatttgtaagctcagattagtttaactcaacatcggatgggatgatccaaaataacgcccatcttatccaataatctacatgaatcatgtgatgagacgtaacgcttaaggcggggggcgggaaaagagtcaaaaaaggcagtagccgttagatgtagcaaaaacggatggaccagattagttgcttaacaacgaaagatcaagagagggcgaaaaaggtaataattattggaatgtaggacccacaaagaggtgaggaagatcatgataaaaaggaagatgctatagaatattcgtaagagcccgtcgtttctcccattaccctccaattaatacactattttttttatttttttgtctttccctttttaaaatgatcatcatcttcttcttcactcgcctcaatttttgttcccttcttcttctataattcaactgtgaatttcaccgacgaaacaaaaaagagagagagagagagagaaacg

SEQ ID NO: 4013 - DNA, 2000 bp, Arabidopsis thaliana
gtgaaataagcataaaacaaagcctgaatttctttgatagtgagcacgagtcattattatccagcgagtacgttgattaatttgagattttatagtaagaacttttcttaagaagtataattcataagaactaattggaagtgcaattctagcgttagaatgtgtggatttagaattgcacttccaattagttcttatgatcaattgtttttctttgacaataacttcattttaatgagtaaatacagtttctttgacaataaatcgaaaaacaaaacacagtcatcttatttatctacttctcgtttctttttattcctaatgctaactcgcaacgaattcgtggtgattcagtacttgatagacttagcatgaagttaagaactaaggtttgagtaatttcattgcgattgaaatcattataattgatcattatgattatctcttaaactttaaaaatttccacgcggcgactcgagttttaaaaaatcattgaaaagaatgagttggttgttgaatcatacgattcctgaaagtccggaccagtgaggcagtgaccgagccggaacgcacaacgtccggtgcagttgtcacttccaccagaaaaggcgaaaccaagagctttgaattgaatagtcaaaaataattgcttctactcttcattcttcaacgtatgcaacgtaacttgtatgattgtgcatttatcattttttatcggcaaattttagccttacacaaaagacataataaagtatcatggccttttttgttgacattgtccttctcttgtcaacaatcttcctggttttaagatacatatggatggttcagaatgtcatatagtataatctattactctacactttgattgatgacattcttattccgatttttatccaagtcttttattagatgaaaatcaactgttattttataaaaaaaataaatagtggatttaaagtgatttgagtgacatacattaggtgaaatttgaaggaatttcttagttaaaaaatcaaagatgcaaatcttatagttttaggtgagattttagagaatgttaatagcaatttcctaaagttcactaaaaccatctcaaaactcatcaaaactaaaatcactctcaattcatccttcaatacagcccctaaaactgagaatcattttttgtcaactaaaactgaaattcatacatttgatggaatttgagtagccgccgggtaatggacccaaccaaaggctcacatagtcacatggtaccaagatttatagtgatattatgcgacatctctctaccacatagtcacatggcaccaagatttatagtgacaatatgcgacttctctacttagggccggctttcagaaactctagaagaactagccactgatcgactatattagagtagttaattttatcaattacatttgaaatgtttatctctagtaagataaatatcaaacaaacaaaacttaatccaaggacttgtcttcatatcgtctattaagagtcgaatttaagaaatgaaaaataaacgattcaagcttaagttagttttaggaaaaagacatactgtttgctccatatagtttgtacatgtattaaatatagaataacaaaatattttaatgtttgctccattgacattacatgtattaaacagtttaatagaaaaacgaacatttttgtttgttcaatcattgggaaatcatagaattgttcaaaatatgaaacaaaagtgagaaatatcaattaatataatagttctgtttaacaagaaaattgaatttagaccaagtccacaatattcatcttgagtaagaacacgaccaaaagtcaaactcgtttcgaaatacataaatatgtaccccgctatacaaaaaagaaaaagacatttacatccacttatcccaatagacaaatgaccaaactacccaacatctacccctatatatacctcaccacctttgccctctcaaccacaaacaataacacaaaac

SEQ ID NO: 4014 - DNA, 2000 bp, Arabidopsis thaliana
aaacagttttgttttattttttttcttctaacatatattaaatcgactatgagataatataattgaaaatgcgttaaacttttattctttatagaaccccaaaataataaatgtcaacattcaaaatgaaaaacatattatgaaaatataaaatttatttgataaattagatgtaacacattaaaaatactgtggtgtagaaaaaaaaacaggaatcatgtaatacttataagatgatatgagtaaaaaaaaccccgtataaaattacagtattctttgtactaatatttgaaatttggttaaaagtagattacgtttcccttaattcgttattgatttatagtatttttcctctttagttttctatcttcgtctcctaatttatatatgttgattagttaatactgcattattagatgacaattaaaaactaagtctagtggttagttggatgaagattaattactaaatctattaattagctgggtgatattgacaattcaaatatatcttagcacttacagctcgattggattttatatactaacaagtcaacttttaggccggtgatatactacatttagcgatcgtatgtataatgtatagttcaacttcaatttaaaaaacaaaagctgataatgaaactgttgcacgatttttttgtatatgtatcaagtatgttcattgtacatgaaagatatactcaattgcttatgctgtcataattatctaaattattaagtataattaagctatagatattgttaattacttaattgtattagtcacggaaactgataataccaagtcaaggggaaaccaaagattaggcgtgagacggttctcattgctgaccttgtcggaccaaagaccttagtcatgttactctgctttaggtttcgatctatttccaccaccgaaaccagttttgatttacaaataataatatttctctcattttatttaatcatataaaactctcagtgtttatttcgacccccgaaaatctttatctcttaccttgaattgtgttagatatatatatatactaatagtggaatcatttttcaaaatgtgaaaacgaaaaaacttgatgaagtttatgcaggtcattgtcatgctattgagtacatgctcatccagagttccatatatagaaccttgaaggtccctaatccttgagtcacatcctaaaggctttccttagcctatccaacctgaagtgatctcccaaccatttaggaatttgatctcgtttgctctctaaagctttaactactcttccgacgtattctccaaaacaaaaccaaggaaatttgaaccaacagttcacaaactccaaaatgtatgcacacgtaaatataagattatatttatggttttatgcaaaaaaaaaactttcaactaattttttttgtaactaaaccttacatctctaaaaaaatgtagatttattttataaagtcaaaaataatacacagtataaacctcacaactatatattataaatatttttctagtcatatacatcagatatataagatattaaaagaagagttgaacttcttatcgtgagaaattcgatttgataaattatttgtcaaatgtttacgaacttgacattagcatgaaagggttagaatgcatattattattgattttgtgtgattaattcgtattttctaaaagtgaaaaaaataaaattgagaaatgttttttgcacaaatcctttatatttaaatgatcgaccagacggtaattcatttgaatacattttgcttaaaagaaaataatacaattggatcggcgacagactgtatatttgttaaattggtcgatgataaacgtttgagttaaataaatattatcgacagacgactattccttcatatagaagcgacaattatttttttccagaacatttacctataaaatctttctacttatatttgtctgcgtgtgacttttaggagagtaagaaaatatcgaaggtcagaaga

SEQ ID NO: 4015 - DNA, 528 bp, Arabidopsis thaliana
caatcaccgttggaaaacactgaagatctcgagattgtgattcagattcgtatctctgatccaaggaaacaggattggaattggtgtttttgagagattgagagatggaagagagagattgatctacatacactggagaggacctggcacgaatgagaaagaagcttacacgtgtccaatcatgattggattcgagactcacggtttaaggaaaaacaaaccagaccaaattaggcttaaccgctaaaaaaccgggttctcgttttgaaagattgagagagacgatctacaaaggaggacaggacccggcacgaatgagaagaagcttacacgtgtccaatcaggattgaacgatttaatcaagcttaaccgtatgtaaaccggattttagctgggtccacaagtagtcaaatatagattttttaatagtcaaataattttcataggggcgaagttcaagatgagttactacactcatcaaagctcacaaaaagagaagagaagagacgaggatcaatcaccattctc

SEQ ID NO: 4016 - DNA, 2000 bp, Arabidopsis thaliana
taacgcgcaaggaaacgcacgttttctgagtgcaagcttcggcatacgagagaggccatacattgacatgaatatacaaagcccacaacttatccatcccatcattaaagaaattttattttattttagtggtttaggtttttcaccttagacattccaaaattgatgataacttaaaattttcaaataagttaactgaactttgtgataccttgtaaagtgaaataacaaatctaaaagttttcgttttttttgtcaatgtgataacgatgttaaagcaaactactacactaacgcattcatattaaaatgtatgtaaaactccaactaatttgtcacaaatttacaagatatcgaggcttgataaggggtgaagcttgagaaaaacgaggcttgtaacagctttacataggcccgcttatggctccgtaatattgggcctaatgaacattttgggcttgtatttaggttaatttggatttcaatatacgtagtttgtatttgtttttggtgagtacattatattttgtatttgatataaaatataattagggtagtccaatgcgtttttcttaacaagtctaaacacatttgtttttttgtttttcctggcttacaagttaggtatactctcttttcattacctataataacaaagacatcatataaagcaaatggttaaatttgtttgtggtgtaacttatgagggggaaaaaaccaatagtgattaggaagacagcttgtttcgtgtggctctgcgaggatgatctagttgtatattaagatatcagaagttataaacaaaacaaagataatgaaagacatgaatgcatcaaattaacggtatatatagtgttggaatcaaattagtggtgaattatcgggtttgcatcaaactaatttggttattcttgagattaggaatgtgtgttcacctaaaagctagtaattgattactaaaatgtaatgcatgcaacaagaagagtcaatcgaattttatagagataagtcatataaaatgattaattatcgctagaggaagctgcgatgaaatttcttacagcttttgtcttttacccatctaatcatttaatctctgagcctacgccatcacacatatctaaaagcaccttcttcgaaattcccttggaggacaaaacatggacctcttttttgttcacttggattttctcggaaaatgacttgcatgtcttcttactatattttatgtatcccttcattctatactttttcgaaattctaatttaactctacatataatcccactcccaccagctaaagtttagacatgacaagtattttatcaaatgctccttcaattcaaactactgaatattgtttggataagtactttttggagacgtaagctatattttccaatccgaaatgaatgaaccaaatgtccatagttctgtttttttttcctcctaaagtgaatatattaagagacactaaattctagaaaatatgtttaaaatataataatcagtaattgtccaaaaaaatgtgaatacttaaatcaaaatcaggatacgattgtcacaagaaacaaactttcctagataatgtatattttatattattatcatattatgtatgcacttaagacatctccatccatgagaaacctacaaagtttttcaaacaaaaaaaatattaatattatattataatttgattatttttattaaaaaagtatttttgttaaaaaattaaaccaatagtaagatgagaattgtcatgatgggttgtacaaagtatctcagagtatctcagagtttctcacttgagaaactttctacactctctctccttcatttttattatttttatttttttaattgtgagaaattcttatgagatacccacaatagagatggtcttataaatttatcaacatggtgaatctctcatgttatatatagaggtgatttaaaggctaaatagaataacacactacagcatataaactcaatgat

SEQ ID NO: 4017 - DNA, 2000 bp, Arabidopsis thaliana
tttatgaatctatagtatatttgttcataaacgaaagtagtgattacttcttcatagtagtgaactaggcaatggacttttcaattattaaaagaaagagtttcgatagtctaattggtaaattcttggcacataacattatcatattttggggtcaattttatagattttcagtttaaaataaatagaaaccggtttgataatgatttagaactttagattcagtttaatattgtttttagtcatatacagtaacatttgacatttctataagaaaactagattttttcgtttttgttttttccttttaagctcaggtaagtttacatgtggtgcacaaaaatatttgttgtaaagtttaacgtaacagattaattaaatcaatgtagcaaacgaaaacgattgctttgtttggtatcatgtgtcggtagagtgaccaccccaatgcctaaactttttaaaattcggtctgttaattacgggttgcgtgttcatgaaacgtctcaatttatcaagtggcacaacgtcttaaatctttcaaccgagcacgattcatataatttaatgaatttaagcaaaatccgaaattgtgcgttctcaaatgccccatctgttaaattttataaggaaaaagctttcgtctgttatcatacaaggcacaaaacgacatcccttacctaaactgttatacttataaaaacaaattgatttcaaaattaaaatctgctatgctgcatgtacattcttttggtaacgtcttaattcttaaaaaggattagaggagtgacaaaaaaaaaaaaaaaaaaaaaaaggattagaggagtaatggcatgttagtaatttacccgaaaaatatctgcaatctagctttagccgacgtgtctaatggcccacatgaccgacatctatgcttaaagccaatcaaagccgaccattcagctccatgtgtgggcccgttcccacctcttttaatacgtgtcagtaaattattggttcaattcatgccttctacattattctgtttttcttctaattcgtcctaacttctattgtataattagtctttccatttagtactgatcctttggctagataattctgttaatacttaatagttcggttataattcttcccttttaatttgcccctttatttatagtatattttacagatacaacctgaaagtcttaaaagagttggaaacatcacttttgaagtttgaaatttctttcatatgctttttatataatatttttcaacaagtaagtgaagtaaaatgtcaaaacgatttaaaataaaaatcaagaaaaaggttttaaaaaattgttaacttctatttccgggcaaattatgtagtgttttgttgttttttgttacaaaaagtttgaaataataggatggtgacacaacatcaaattcaaattccaaacaactacataacatatatgccaagtccattgaaactctttaaattatacatctgttatccttttaaatctgataaaatgcaatacaataatagattaaaaggatgtacttcaaccacgtaaccatagaccattgattaatccaaaacaaaaccatagaccatagttcgatacagcttctgttgataaaagtacatgactatgcgattatctaatattagtttaactcttcatctatatattaaaaacatatatcgtttaaattaagaaaaaagtggtgatactgatatcatgatattcatctaccgacttcaagaaataagaggggtcattatacaattcaagaaataaatatccatctttttggatcattttaaaaataattaaatctttacagcgttacctccgcgttggcctggacccttctcttgacactataaaaaccccactctctcttatctcatcacaaacattactcattcacaaaaccatcttaaagcaactacacaagtcttgaaattttctcatattttctatttactatataaacttttaatcaaatcaagattaact

SEQ ID NO: 4018 - DNA, 1188 bp, Arabidopsis thaliana
gactgaaaaaaaacaaccggagatttcgctcacctcccgattttggactggactggcgagagtcgctacaagtcgcttacggcgagggagcagaaatgggaaaattaaggctaattactaatttaccctcaagttttattattaaggtgacctgacctgctctgtctatatgtgatattgtgacctgctttgcctatatggctatatgtgatacctataatcacaaggatatttcaggtggagaatcagagaaagaaattgaagctgaataagacactatatgggagagattgaaaggaagctgttgggccattttggtgtagcgggtcgcaagtcgagcgtgagacttattgctgtgccattgcaggaatgcaaacagaggaaagatttcacaaatgggaaacggatacatgctcagatggttgttttgttgtaggaaatgcctttcaatgagtatgttaaacgctagctgtcctgtttaatggaccggtgtatgtcatcttgtcttgcactgtgtgagcacaacaacttgcaatgtttccattgatgctgtagcagtctctcacattaagctctggtttggatggctatgaacaagttgattggtagataagttaaaatgttgtgatttgaatctggaatgaatagaaagatgtgattggtactgatgtaaattcaatgctttagagaatgtatacaggcaataatataccaatcattatgtttattgctgactaagagccactcctctttgctgttgcaattcggcaatcgttctagatatggtttccatttcaaatcatgatatgcattgactttttccatgtggcgttcggaaatctttcatctatactacgtctacgttgcaagttttgcaaaatgtttaaattagtagaatctcacgtatataaaaactttagtcgccaaattgaaaatggagaatgaatggtaaactactagtttaccctcatattttagctgaaaaatatcgtcacagctgacgaagaaattagaaacaacaagcaacgtgtcacttctcatgtcgtcgttttccccaagaaatatccaaactaacacccaattacctaatgccacgtgtttactcacactcctttaaacaagctcgtaactgtttcatcttcttgtccccaaagtctcctcttccttatctcttggaaaccaagaagc

SEQ ID NO: 4019 - DNA, 1337 bp, Arabidopsis thaliana
gtttgtttgtgatcgtgtttttgtgttttaatgaatgtaatcgataagcaactacctcttggtgttcgttgtaaaatgaaataaaaatagttttctctgttcatatttgtctttgtgttcaatcttcaaatcaatgaagtttttgctctcttgaaccatccatgcttatgaggcaaaaataggaccacaacaaaaaagacaccgaatggtcattcctctgtttttgcagaaattattactgttcatcctttcctaatatcattggtgctatttagcacattggccatcaaatccacatttgcatttcacccttatctctgcagtcagcaaaatatatttttggagttatgtcccttgaagtaatttatgggtatgagatcagtaacacagtgttattatatctgcaaaaactcttacatattcaattttatcctttaagtattagatgaaaggaaacaattttgttattctgattttaaaatccaaacaactctttgtacttttttcatgttggataacgtaactgaatcttcagctactacatctgtagtataatacgaagtctgatatctcaatctgctacattattttttaaatgaaatttgcatttgcgaatgcaaataacatcaactgagttttaagacaaatcaagttttgtgcagatttgtaaccgtctttaatagcttatattaatgtcgttatacacgatttagtggtattcagtgagttagtgctaccacatatatagtatttttctttggtcactaaaataaatatggtctttcattaatttttctgaccagaaaccagagcatatactaatttagtcttgtttccatcattaagactttgaacttctgatcttgaggtgcatgttgtacacttgtaatccaagtcttcagcaattgtatgtactttccagttgaatgtattctttaaaatgagcaatattgttcggattccttaaatcacaaaatttgttctttaatttgctaaaacactaatcttatgaatcatgaactattttcacatatggaatgggccttgatatattcctaatttaaaagcccatatagatattaaaaattctgtaaagttatggctcatattttatcaaacctgagttacagagttcacaaaaaccagaacgaccaagacgtttctcgaacaatacggaagaacttctaaagaccgcgacaatcgctctctcgacaatcctctagaaatatccatctccactcctatttaagtccccacatttctcacatcaaactcatcaaagaaaacaaaaagccaagaatcaaagaatcaggaaagcaaacacaacacaactaaca

SEQ ID NO: 4020 - DNA, 895 bp, Arabidopsis thaliana
cgacaagtaggtttgttcaattagtagcatctttacaatgtaaagcttttctcttcatttctctttctttctttctttcatgcaagttctattgattagaaaccaaaaccatgacatatcacattttcaatttttaaccccaagtttcccaaaaaggtaatcacaattactttccatggtcatttcttctggttcaagcatgacatgaacaggcaataaataagttgagattttgatcacagtaactgatacttgaatcgaatcatttagattttttttttttttagtttacttgtttagtaaatatgttgtctatgtttgtcacaaaaacgtggctcagttcttgtatatatggagacaaaaaaatccattaaaagattgttgacattctcggaaatttagtgccaactgttattgcgagaacttactatagttttcctttggcgaaaagctaataatcttaaatcttgattttgtcctcttttctctgagttagattttcttaaattccacttccgacctattaagaaatgggcttttgcaaagaagatccgcttcactgagcccgtatctcgaagaggataatacaacaacaaagcaaaacggcacgtagttttaattgtaaccaaggattgcatttcggtcttgtttcaacaaacgaaacttcctgaaatgccaagaaaaatctggtcatttcaccacagtgatcattgtgtatgtgttctaaagactccaagcgaaggttttagaaaaaggagcattttctattctattcaagaaactcgaagaacattctctcttcatcctctaacttccctataaatatgtcctttgctaatcagatcaaatcagcaggaaaatcaagaaccaaaagtctcccgaaaagcaacgaaca

SEQ ID NO: 4021 - DNA, 1087 bp, Arabidopsis thaliana
tttcttctttaatatatgacgacggttaactatatgactatatcatacaagacttatattcggtttcgtttctcgactcacttgcccctgtccttaagactcttatagtaaagctggaattatatggttcaaggaatcgtctagtctatatacactggtttgaacaattgtgatatataatatagttaggggtatattatatttaatctgttagataacggttggggtacttgaagatctgtaggagttgacagcacgtagaggcagaggtaagaacacttctgcatgtagtgtgtctacataataaaatatagagtgtattttttacacacaccaaaaagagagattataattaatgtattatgtcaaagcatatatgaaggtcagcttagctagagacacgtcttttgtttatctctcgactaaacaacatggcgttttaataaaatcaaaacttaaaaggtccaattcagaacggccccatagtatatagtctacgttgaataaataaacctcaagatagcgtcaaactctttagtctttacccaaaaatatttttttttaaataacgtcaaaactctaagtcttgacctcaacaccaatatatatttgccttctccaatatctgatttttttaattgtttatccgagtcttcttggtcttttcgaatgtttgcccgaaccagaccttcccacgttcggtggttggtggccgcctcggcctttggttgatttctgtccacattttggtccttttcattcatgtaccatgttctagggtcatttgacttgttgaccataaatctactaaaacaggcctaataccgatgggccgtagcccgttaataaacaagacaatttatatttgtttcacttagcttgggagccacggatctctagaaacatccagagaaatatcaatctccccacttctccagaacattcactcactgacaatatcccaccttcaacacttaactcctgtatatagtcctcccctgtctccagtttcgtcgcacacagttctcagataaatactaaactcactgttaaaactttctcaacaaagcttcctgtttctctacaa

SEQ ID NO: 4022 - DNA, 1679 bp, Arabidopsis thaliana
agcttccaagtctttcgcgtctacctctcctttaccttttgcttcgttccataattaagtataccaaacaaaaaaatgataattttattaatgaagtgaacatcaatgaaagacgtgattttgggggagaaagagaaaggacgaaccggtattgagagcttgacccatattgtgataacttccttcttcttgtttttttgcatatcgtaacaaatttgaaggataatattgagaaataaattttggagaccgtgacttgtgacttgtgaggtgggatcagtatcttggcatttcctgatcgataagccacgtaccggaagcgtgacagtttaacttaaggatctagagaaaaagtgtgagtctattcatttcatattttacatatagcatataaatactattttattttcctttgtttacagtttaatagttttagactcacaatatgacttttgaaagccaaaatgtagcagaacaattaagtttttttaatattccttttgaaatgcaaatatgtttttaacctatataactggcaacattaaaaggaagagattctcatgatttgcaaaatatcaaggtggaaaaggcatgtaaatctttatttaatatatatctttgtttaaaaccacattggagataattgaccaaaaaaaatacaattttgtcaaaaagcttaaattattggattgttaatgagcatatggaagtttgacacttggagaaaattcacatgtcaccacatagagataatgtatttctatgttcactaacacgattacatttacaccccattccctcgtcgaccttgagtcactcccatctccttctttggactcttgcgagacacttagatttagaacaacaaatgagtttaagtaagtactaagcctatgaaaaaaaaaaaaggtagaataagcttaagaatccagcaacattcatggtatcattcgccatttatatcttaaacgtgaaagaaataaagagagaaaggttatgaattccttttgtcaatagatatcattggaactaagcgttatgaattctttttgtcaataggctaaaaaccgttttatatattttacaagaaacatgatttttccataatattgaaactttatatatttcttaatattctaggcatttataaattattctatgttttgaatatttattttaaatttttggagaatactagaacatataactttccaagtcctagtgatcccggctacggcaacacatccctacgagggatcaatatatcgaaccatctcaacgcaacacttgtcgtcgatcaaaagtctaaaaacattgcttctcaactttgatctctttcctctagtctctatcatcaccgccacgtcactattttcccgccttataactaggggcaatcaactctcgcgaacagagagagacggagaacaagagcaatcaaatcacacaaatcctcgaaaaagtaaaattcttgattaaaaaaaaacggacattttgtgctcagacactcagctttccttattagtcttttgccacctctctgcaaagttctcgaacccactctgtaaccaaaatcaatcataaagatttgatctttttttttcctttttcggtgagatttaatcctctaaggttcttgatactctctagatctattcttacttgggtttgttcgaaat

SEQ ID NO: 4023 - DNA, 1512 bp, Arabidopsis thaliana
tccgagttagaagttttgacaccccaacttgtatttttatttatattttgaaattttgtgtcaaattctgggaaatcgagtatggacccaaagctctctatatttccaaaaatagcaagttcttgtaatattcatagtatgactttattatagagcccgaaattggtttgctgctgtttcaagaataggattcaaatttctgttcctttcctcacatccctaaccaacttgacaattcgaataatggttgtgtctaaatttatcaactcaagttttgagattgttggcttatagtatgaaaattctaatcctgcaactagtttatttacaacattttttctttgtttaatgagttcttgattttatacagtttagtgtttatgagcttttcttcttaagcctctgtttccatagtttatatcttaatacgtgttttctctttcttttggagctttgattatctcttttaaactatgttttcgaagatatctttgttttctgccggttttgtaagatcggaaaatatatttttattttataatattaataaaaaagatgacaaaacaaaaaataatgattttctttcaaacttaatgaacataaaaaaaagggaaacgaaatcttattttgcctagctgacataattaactaatgcaactaaatgtaggtaggattaagtaaacaaaaatatgagacaaaattaaacatgccaacctccagggcatagtcaatgggtcaagtcaagcgaaagttggtctggatcttacaatgcaacttaatgtaaagtactcatttttcttcgacatgggacatccgccgaaattgttgatttttgatccatctttacacttgttttctccgattacaacaaaacataacaattcgactacgatttaacacctaacctttttaattttttaggacacgcatttagtatttacgatgcaagccaacaaatttaatccaacgtattaaacacaacttgctttttgtcaatacgtattaaattaaatagttttcttgcaatttttgtttacacatttcattagtattgtttttttccaatatttttgtttctatgttcaatcactatcatatgcataatacacattataattttggcacaattagaattacacacaaggattttataaatgtttttaaaatgatttacaaaagattttataaaaattttacaaaagtttttaaaagatttaataaaagttttaaaacgattttacaaagagttttaaaaacttttaaaggttttaaagaaagtttatgagaatttacaagaattgtaaaagatttataataatttttttagaattagaaaggagaccctcattttccacccaaatcgtcaaccttctcataattgacaagttattacactctctccacttactagttactataaaaccaaaggagaccaaatctcttagcaattatgaatttggtcttcgctataatctcacgttacattaaattggctcctgtgaacctaaattt

SEQ ID NO: 4024 - DNA, 2000 bp, Arabidopsis thaliana
gttatataagttacttatactgcaagagggtttattcaataatatgattgtttctcaggttttcatgaactatacctgatgattttgagaatatttgattattttatttgcatgagttttagagttgacattgagagtctttgacaaatgtcaaatgtgaatttttggtggttttgggttgcttgattcgttaagcgataaaacatgaccatatcaatatatagatgttaatagactgatcattgaaagagagaggctgttactacttacttgtcacggaagaatatcctagttttgtagagagattaggaaacgcatataagaagatactgtgaaatttaaacgcatatatatatatatatatatatatatatatagttgtatagttatatagcgtaaagtagataatgtgaagtttcattgaaagattttggttttatattaagattacaaacaaaacattatatctttgttttgacagcttaaagaactcaacatcatgtctgatcatgtccctataagatgtgcaaaaacgactatcggattcatatcaaaacaaaatttggattatttcccctcaccactgactatctcatgtacacggacatacagtttgtatattatagctagctcatgtgtttatatttcaccaaagttttttagtttcgacattgtagctcttataactcacttaagttctacaaatatatgtttcgagtactaatgagttttctaatcaatttgtttttgttaattatttcattgaccgattgaaataagacaagtaaccaaagaggccacgacaaagatttcaagatacaaattacaaatacttcccaaatcccaaccaaatccgtaatactggggatccacacaaaacaaaaaaaaaaaacaatacaaatatatgaacggagaaatgtgggcttttatttccatcattatactgccaattgggcttttacattaataactttggccgacaaaaaaaaaaaaaacgaaacaatccaattcccgaatttaccaagacgcgaaactaagtggactgtgcaatctcttttatacatttttaatcgatcgtctaacaacatataaaaagcaaattcaattgcaattcaacaacgaaggagtaaaaagatcaacttccctcctgctacgtggtccactcttattagcacaaacatcactaattttcctgcgaaaaatagctgtgtctatatatttaaacctttttaattacatcaattcaataaaaacagaagaataaataaataattccgaaaatcccgatgatgactgaaagagatatgcccgatcttccacgccacagtagtggagctgtggagaaagaagacaaaactgtaataatgttcattattacaattttcactgacagtttttttccataaaaagaagctaccacaattactactagcagtaaaaataaaagaaatctgaaatataataataacaaccaaaaagtgaaaaaatcaaaccacaccgtcccactaagaggattaaacggtaatttgctctatcacgtaatataaatgacgtggcatcatcgtgtctagtcagcttcttctttaataacctcttcagcttcagctatcacactgcacctataaaatcaaccaatctcgttttaaccccaaaccagaagaagaaacaaaaatcgaaattctcatcaatagcaaaaaaaaaattactcttagattttcctcaaaaaccttaatcaatcgccgggaaaatgaatattccggtgactatttcctccattactgtttctaataacgctgtttccgacaatcgtcgtcatgtttcccgtgaaaatcgtcagcgttaagaaaaccgtcacttatatttttttttcttttcttcttcgtttttgtgaagatgatgatccactgatttgagagtagtagcttgagaggtttttagtagatttcgattttgcgattatttttgtttcctggagagatctcatttttttgccacttccg

SEQ ID NO: 4025 - DNA, 2000 bp, Arabidopsis thaliana
gatagtttaaatttcaaaaaaataacaaaaaaaataatgatggatagactagaacctccaattaaaacaatgcaaatcaagatgttgaaccgatcgaaccatcaaactttttcggattgcataataaaataattcgtctttgttctcattctcaccgtgcatatacatatcaacaaagtcatgcgacctaatataatacagttgaatctatctaatttttttaaaaaaaattaagatacgaattccacacaaaccttctccaactaagtaaagtagccactattgtcacttaaagtgacattaatgcatattctataaaagataatggatgcccaactaaacataagtgaagtatttgggatatataataaaacaaaagaatccaatgagttatgctatgtggttagcttttgttcacgaatttatatattgtataatatatgaggtttacatttcggataagcaattctaggcagatcgatgatatgtacgcaaacatgtatagatgtattcaagaattgagtatataattgcttatccgaaatgtaaacaacaggtatgaacatatataattaagtgcccaaaacagaacatatattcaagattttcttgtactaataatattcttttttttggtaaggtgttctaataatattctgattagattaacttttaaccatatataactcataattattttgttacgtaactctaaaaatatctggggttttatttctttgtgaagagatcgataacagacaagacatgtaacacatattttgtccaccttaaatttctaaacatgaaatgtagttttgagatattggccggtcccaatgtacgtaggattgaacccaattgattattgctgccacgtggaactcaatctgtccacttatgcttcttcattgatttaacctcttattaaagatcgatgatttatgaccatgaatgtagtaattaggatagaggtggacatacgtcagattccacacgtatataaccccatattagcattacaatgagttaatctttttgcagaggtcggtcgatttgtcaaatttctactatacattaaccaaaagatattctactatatattaaataaagcaattagcttatgatggtgatgagtcatgagaccacatatatcgaaaaccacggtagactaacaatcgcaacaatttttctgtggctttcaagtttcttttaatcttttaacaatacgctaatccgatccggctaattttagttcagtttggattttgtgattttatagacaagtccacagtttaaaaaaaaaaaaaaccatgtttaaagccaattgcatgaataaaataatttacatgcatgttagaattacgttttagtgtccatatgtacttattagtttttttgttttttttgcaactacaacatatactaatgttgttgttttttgtgcaactaaaacatatactactataaacatgtaaattttgattgttaagaaatgaggtgatgttaattaatcacttgttccacactgatcacacttttaacctcgacttttagtagccacaagttttatttaaaatcctaatatgattggtttcacgaagtcatataaacagaatatatatatgtagaatgttttatccacttactttagagataatgaattcatgacacccaattcttatgccgaatcaaaccggaataattaacgctaacgtcaccgaaaaaaaataaaataaaaataacaaaaatacaaaggaagaaatcagagaacactgaacatatccgaataatatgctatatatacaaagaacctctcaccacttggttctcaggaaaaagcacattctccaagtgtttctctcctctcttttcctaactcagttttcttatatacataacactaatttgacaatttttttgtcctcgaggatcctaaaataactccaaaactttgattggtttttcttgctctaaaacaaaaacaaaaacaaaatattaag

SEQ ID NO: 4026 - DNA, 1712 bp, Arabidopsis thaliana
tttcaattttggaccgacctattctatgtgaactttcattttatccccttgtaaacgctaaaacaaacacgtttcttttactgtgttatccgtttgtatttgaataatcatatcttaagttaatagttgtcaagcaacaacatgagaaatcgaatccaaggatttgttttatttgtttgtgacatgggttatggggttagttatgatttatttatcatgtgggattaatcggagtcagaacaaataaatacaaaacagttataatataaaacagttactcaaatagaccaagatctaatttcgggtcatttcttggttagtttatcggtaatattaacaattagctggagtagctcagttggttagagcgtgtggctgttaaccacaaggtcagaggttcgacccctctctctagcgatttgttatttttaaattttgttttaaaaaaaaaaaaatgataaaacgcaatttgctcttacgcatgaatctttttttttccttgcatctgacttctttctttctttggttcttaatcattttaatacaaaactttgtaccttgccattgaaactttttttttttttccattgaaactttcagcaaagcttttacaaagcaatgatacctagtatgcaattttgacgacattggatgattctacgaaagtcaagaacgaagctgatataactatatttcttaatggtgataacttatcaaagccgtgactaaattcaatttgtaatcaaactaatacaaaattgtaccttgtcattgaaactttcctgaaagcttttacagagcattaaggaacccaaacaactttgaaaaactgaatgattctgagaaagtcaagaaagatgtgacacaactctattaattgtgtgaattaatgtcaagttatgactaaattaaatatttagacttagggcttttttcattaaaaatgatcatgttgcattttagagttttcttcttttagtttcagagaccaaaatttaatgagtacgacatgatttttttttcttcctttttcttgtattcattttcttcgccatttcgcagttatgtattattatataatttaaaatttatgatatgaattataaaaatgtgcaatatgttctaaaacgtctcgagcactcaaaagtttaggcaaaaccatgatttccacctctcttgcttataaatcttccaaaatttaaaacccactagcattgcgcctctcataattaaacaacgtctgaatcactatgcacgtcattgttatcaatgtggatgctaacgaactaacgaacatatgttaaattcgaatggactaaaatataggcaaaaaagaattcagaatttctattgttacaataaaataaaatggccatttgatgcttgttttgcatcggtgttacaaaaagaggtcctcacgtcatatacacaaatgcctcccccgaaattaagtttgttttcttgtagatatatattctcagaacaaatcaaatgccatatagaaagtcgtacacatttggtcaacattgtgaagcaaagtcaatgcgactaggttattattttgattagttataccaacacggtacataccaagactctatataaatgataatgtattttggagaagtcacatacaaaattaaataagagcgaaccactggtcgttcaaaaatatataagaaaatattaaacctctgtttttgctggcgatc

SEQ ID NO: 4027 - DNA, 1226 bp, Arabidopsis thaliana
cggagaaaggtgggagttacgagatgtgtggtggagattggtctacagagaagacgaaagagagagaattaagagaggatgcgaaaattagggtttgcatgggaaaagtaagtggttgttgttgcatgactcaaacttttggttggttttgagaagattttgctatttagagttagccagctcaccttaaatttccctttttctgttatttagaaaactatattacagaactcatataatatagtattatggcatttgatgatgatcaacgaagttgttactttttgtttacaagatatcgattttctaacataaattatatatgcatataagacatacatgagtaaaatcttaaaaaggttagcacatattggtaatgtttatcatgaacgagtcttattttattttgtacgtttcgaactaaaaccatttttgggtggtatttctggaccaaattttcattaaagtgttttttatttcaattctcttgcaacttctgtttctttagaaagcgaaaaatgcatatatacgaatatacgttgggattgacatgaacggaatgtatgtatttacacacattaatccgcagcaaccggccattcaaaattatgtttgtgggccttgttgctgcttcgctgacaatactatccaaaatttatttcatttttctttctttgaaaaacacacaatcacttaattttcatttataaatcaaacatatgtacatgaaaatatcaaggaaattaaaggaaatcttaccttcatatggtcgaaagttttctttcaaaaagcaaaaacaaaaattaatgtttctctaattcttccccggccccaatccacgtgaaacatgttatgttgcgagcattacactggaaactgttacattacattctaattggcgaaaaatgaagtgcatttgtattgtatctcacgaagatttgcgtttgtgacaaaaaaaaatatgcaatttttttcgaaatctgacaacccatgccgacctgtccgccgagttaacgacgtgcttataggatccttaagtatttttattcttatttcttactcattccaacggaccaaaaacgaccacgtcatcttcatacgcaactcccaaaacagacgataattaaatcattgaaatctaaactctcatatactttagcattttcaacatttctattaatatttccatagactagatctctctttcttatacatccatatcaccg

SEQ ID NO: 4028 - DNA, 972 bp, Arabidopsis thaliana
ttttgacttcaggtatgattctgtaacttgatgatgatgatgatgaggattggtaataggttaggattgagatcgaatttgtggaatagtctaggaagcttgacattgaattgaacgatgcaaaacatagttttcaatggttctagttagagaaagagaacacagtagttgggattctagttttgtgttgtttaaaatgtgttggtttagtttttgtgtgagattgataatgacttgttattctttctcttcgcttaagacttactttatctttccattggttcaatttctagattgtacatctcttgattgtagttgttgggagggtaaaagttatgatgttggctgatcttttccatgctcatatccattaagacttgagtgtccgatagtagaacaatacttcactcttattttgtctctaagactcctttttttttttcctttttttgttctatttgttttgcaggtgtcaatggaagtgcatgagagtcacttcaaggatcttgatccaataataagaatatgtaatgtttccaaaagcttatgaacctaatctatgttttatgaatatatatgactatcggctttagtcttcagtatcagtttcttgtttacatttggatgtatcagctgctaaaaaaatgcatagtttcccatcccatttgaaacgacgttttctctcatgtcttccactaatataatcttctggtcatgagaacagaacaggagctctgtttttctcacacaatgatcgaacacacttttgtcatatagtatagagaaatattaacacttctttttaggcatccgtatctagagtctttgtttcactgtgacctacctaagtatatcaaaacgcacgtttggaattctgaatggcactttcgtaaataggagggtacaaacatttctccttttaaattgttttcatcgtgaactctctcactcactcaacaaagtaaagaaaca

SEQ ID NO: 4029 - DNA, 507 bp, Arabidopsis thaliana
tttgttatgtaacttattcttctaataaaaaactccgctagttcatatcttgttaagtatttggttagcctaagaaattatatagcttgaggtttcacattttcaatattttttaaaaataatttgggtcaatattgatgttggaaatgaaatcaacggttgaattattgtcgtgtgctgcttgcaccatggtccatgctagatggaccgaccactatttttccaaacagtgcctatcctatcaagtagatattttctgaatacgtagataattgtagaatacaagaaaagaaatatcctctgtggaataaatgaataatatacttttgtcagaaacgttacaagttaaaattccacgactgattgccacgtgtaagcttatctcaaaagggccctacagtaccatgatgacgtcatctcttacaccactctctgaaaaattcctccgccttataaaaaaactcgattatcgtcttcacttagtagccaaccaccgaccaatccgcc

SEQ ID NO: 4030 - DNA, 2000 bp, Arabidopsis thaliana
tttgtaaataaagtatcttagttaatctgctgaggaaaataatgaaatgaaattaaagaaaaaaacagttgaaaaaagaaaaaatgaaaagaacttggtaacgtaaacattactaattttattacttataaatcataatcagttcaaagttcgttgccatcctcagtgtacactctgaacttgctagatgataaaagtctgcaagaatagtaatccgaagaatactttatgttcaggattgtagttatatcaataaagaaagatttggattgagatgcgtgtgggatttctttttattaaataaatacaaatataatgttttaaaagaaaatgatatgattctaaattggacacgacatacatatcactatgtcttgatgtgataacatttacttcatctatgaaattatatcgtctataaataactaaataaagggtgtttggttgttatgatatgtgggttcattacctggtcaatacatgaaaaggccaaagtcatatcatacaagttcctctgtttttcaagtataccaattctaaatttataataagatacgtatcacatatatattaccaaataatgtatacatatgtctatgaagttgaaatatttcgaatttaatattatctcttgtactggatgtcaaactagaatttcaacaacaaacaattatatgcacattttctcacttagttttatgaattttagctccctatgatatatatgtactttgtaacttatttatcaccatgctatatagtgataataacatgaagtaaaggttttttgaacatgcagtatgaaagaatgctatgtctttttcttaatttattcattaatctttttctatttaaaaaaactgttgaaccaattgctctagagtacactaatttaaatgattacataaagctatatctaagtgtagagtttaatatcaattttgaaaacaaattccaacatggttggaatgtctatttagcatattaaattaaaaagataagtaatattagctggtggtgaacgtaaacacacacacacacacaaattgttttgcggatacaagtatatatcaatatatgaatgtaaaattaagttacattagtgaatatttcatgtcctaaacattggttattgtcccatttaacaaaaaatccactttggttataagatataccgaccacaacactaaaataaaataaaatagaaagaaagtgatgaaaaatggtggcgtactaaggactgtgggaagattaatgagtgaaggaaaagatgggtatcttttatctctcctttctttatcctctctctctttcaatatatattagtcatttttattttgttatatattatttctcagctttttaaatgtattttatatttcccctttgagcaagaaaagagttgcagagatctttgagtctgacacagagaccaaactcacatagcaatcacacacatctccacaaacacaggtatgcatataaatatatatatataagtgtatattcgtgtgtatgtgtgtgtgtctgtctctctctctttctctttgatagaaattctctaatgtaactttccttttgcagcttgagatgatcatgaaacacgtgcatcctcagatctctatcaatccaggttcttcatcttttataatattcattttttctttcaatttctaactctattattttattattttattttcaatcatgattatgtcttaatttccatatccttcaatctctctttctcataatccataattcatcccttcttcttcgtcttcttgatgtgatcacgattctttttttcttcgcttcaactgtatatatatacagatctatattaaacttatagtggttttgtttttgctcctttttcatacttttgtttgtttttctatgatatcaatcagcttggtgaaagaaggtcaagaattgaaagagaatcaaagaaaacgacgtcgtttcattcgtgtgtaacaactactaattatacatag

SEQ ID NO: 4031 - DNA, 2000 bp, Arabidopsis thaliana
gagggtccagtgccttttgttttaatttagaagtttgaccatctttaattctaaatctctctaaaccacgttcttttttgtagtaaaccataaatttccgcactgttgagggccaacggatccctgatcgtaagactaggagtctaggatggacaagtttttacttcttacttttatcactcagtttatggagatggaaagtatgattgtattgtctttgtgcatatggtgtgttcatctaaaacaagtgaaaaaagctaaaaaattgccgttgaacaactctctcactatatatataatctatttatgtatgaaatttaatcaaaacgtgattaacaaattataaacaaacaactcttgtcatgttatgatcggtgttacttaattgaccattctactttttgaatgttataattgtttgcttaagaaagtaagcttttacgaaagtggtatcctaatgtataacacgtattatctaaaagatcaaaataacgggaaaaatgagattctcatcgttaacattttacgattattttgacaaaatatggccaaaagttgtagtaaatgtttaacttattcaattttaagctgaattggcagttgaaaataataagcatttaattgtagtccaactgtgcatgatcggtcgtatacgtgctttgctggaaaaccgagtgtttctaatgacttaatatctatactctacttatattcaattaagagatccaaattaattttcacaaatgcagcatagaagaaaaaaagagtttaggattaaaaatatatatgtgaaaatttttaaaaacagttatgagttgttttttttttgttttggttaaaaataggtttgagttgttcatgagcgtcatgttttacttttaccatttctatatgtattttcgtgtatatatttaacaatatttaaattttgtcgacatctatccttgccttgctagctagcaaaccaacaaatcaatttattcaacggttttatttattaaaattaaaatccatgtgctgccattccaactcttcaatcaattttgtcaccataaccttaccacctcctctctagctagatctatctatcttgtcctttccatttcataatgctaacaagttctaaaagaacttttggtgtaatttactttagatttttgactcgaaactgctattttcttatatatgaatattgttcttgtgatcccatttgatttttggtgtcgatagagtctacgtatataacaatgtctactttgaacatcatttggaaaaaaaacaaaaacaattagtttgatcgtttgatttgaactgttaataaaagtaagttaaatagctgtttgattttgattgcatcaattattggaactacaattatttcacactatcatccaacttgcttcatgatgtatccatttcaaatcctaaaaattaatttccaacttcatttgttaattgcaatgtgtatactatttgtgccgatagtcaaatacatgatacatctacaattctacatacattatgtaattatacactttggcaaatatatcgccactaatcgaggaaaacaattgctcataccatcatactttttttattttttttgataagttcatacaatcatacttcttggcaagttggcagttaattatctttaatttatccaaatcttttagtttcacccgcatattaagttaaactttcataattttgcctcccataaaatgttggaaagctagatcatatcgtgcatgaatgtatagtaaacaactatatatatttttaaaaatactataatgtataattacaaccaaattattattttatttatgaaaaaaataatgaaacaccaaaaactttgattcagatttgtgtattaattatttttctttattgttagggctgccagtttgactcttctacttataaaagcctctttacacacaaacacatacacacttgtgatcaaaatctcaagatccaaaactcttctttcaaac

SEQ ID NO: 4032 - DNA, 2000 bp, Arabidopsis thaliana
ctattgtttgtttaaggagtttatgagatagggtatcatggtaaataagacatttggtgtgacatgattttttaataattttgttttgtttttgtgtgaaagggagaaaaacagggaacgtgaaatcgcattaagtggttccactaccaccatccactattgtctactctatatcccaatattatatacatgtatctaaggtttagtttatattagatttattccttttggtgatagtcaaaattcactttgattgtagatatttggttcggctaatgctttgttttgtttctctaccactgcaggatgttacgtttacaaatcttatgatggtattacttttacttttcctgataaatggtacttacttttcttcgtgatttgtgcgtatattcatatcaaaatcaattatgcgataaaaatgttagaacaagttttaattttccgtgtgcacaaacaatcatttaacttcctctcgttattctctaaagatatagaataatttgaataatctactaatctcttacatgatgacataattaggtcagttaattcggaccaaattcaataatatatatcataattattagatgtcatcatatagctagttccaccaagataagttttttagctgattaatctttcttttcaattgaataatttcgaaatcaccaatttaaaagatgcaacaaagatatgtacatactcatttctacttatttcacccgattaatttgcaagtggaaattaatggtttgagtgtatattttgatagagatactaggtttggtcggaaaataagaatcaatcatataatatactattaattatcaaggaaaattcaaaatttatgggcccattaaccaaaatgccataaccctattatcactttacccatacggcttagttttgtttggttacccacactcatttataattgtgtttttttcgttttttttctaaatatcaaaatttcagttgacttgtaaattcgtatgaaattgattatcattgcattgcaaataagaaaaagaaacatttagtaaaaccaaccactacattcgattaactattatcactattaaatgttttgttagtgtttgataaaaaaaaaattgccgtgttagtaaaattttttacgggtgatcaatgatcatcatataattaaccaaaataatgtaagtctacatagttttagtattgaagatcacaaggatatcaaaaactaaagaatcatcactctctataatttagtaagctatgggtttgatcaaatttccagcatgtagtttttttgctacgtgtgcattttgttataacaagataaatatataaatgggcttacgcttcttcttttttgtgcaacaatgggcttacgctttatgcccaatatttacctataccaaggctccatataattagtatttgttatttataagcccacacacttttgagaagaagatgtctaaaaatgaaaatgctgagaagaagtaacaatttgtttttacaaatataaattatacctggccataaaataataaaaatctgacagcaaatatataagcaaataaaaatgggaagaattacttattctcaatataaatttgaattattcttaatatagacaaaaccatcaaaaatttcgtagtcattaataaggaaaatttcatacaatccagtggactatttttcttggtccgtaagctgccagagagagagagacttaaaaggataatttcgtaaatctaccaacccatcatataccgactcgccgagtaatcgccaagcctctcaaattatccatctcaattctcacatcacaacagataagagtcagccacgtcaacattacacgctactccgaataacacgtgattattaccccaattgttaattcccaataataacccttccctcaaataatattcgcatctattaatacacctctgcagaaaaaaaatcagagaaaaaatacaaatcgttcaccggaaaaaaacaaa

SEQ ID NO: 4033 - DNA, 2000 bp, Arabidopsis thaliana
gcaaatgcacacatgactctacctagctagctagctattcgcatatagtaaaaagaaaagaaaaaaaaaagtctatgaattgataaataggtttttgaaatttgaattagattgtatatatgacccaacaaaaaataatgtcatagaacatatgatgaaattcgctatacaaattcttttacccaatgtatagtctagttttgcaccatacgtaaatgtttattctttaacgtaaaacctatatatagatttttgcgtttaatttgaactttataagccatacaatacgtaactacattcgtcaagataagttgtttttgttaattatcaacaaccatgatttaaaatatgaaaaaatggttaagggttagatatattttattttttgttaaagcaagggttagatatataatatattacaaataacttcaacttcattaaaatacgtcacatgccatgatttgtctaccaaatacaattaattaacttaccgactttctcgacgaaattaaaaaaagttatcgaaattatcatctgtgtacacctttaattccacgaggaatctatataggctaataaatagccatcgtacgtaacatcaaacaaaatatatactagctttggaatttttgttagtgtcctggcatggcaagttggataaatacaaaggaaggtaataaaaattaaaatagtaataaaattatcacaaattttaggtatatagatctccatatctataacaaacatataacatgttaagaataaataaaaaagacgaaaccaccaagcaaattctaaagatcgttggtttgaatgacattaggaaggaaatgatagtaaatatactagttctcgagaaaatgtagggatttaagcttagaacatcttaattattcaaaaataataattgaaaaccacataaaattataaatcttgcctaatagttaatattgagactaaaactcaaactttttttttttctttggttttacttttttgattatatagataaatggatgatgattaatagttttgttggagatgattttttgctaccaaatatagacacgagttatggctctattgtctctcacataaaaacgttaaacgttctactaaaggtggcatgaatcctatgcattttggaactgacaatattcagttgtctctaatagataactaagacttataactttaatctccatttttttttccgcgaatcaggatcggttatgactaaagcgttaaacagtctctattaggacaaacctaattttgttttccaataagttatttcagttaaccttgctactatcgcatatcgttacccttcggtaaggtggttgggaagctttgatcattcccatgcggacaaaccagctacagttactctagagcactcaacattccatcgaaaaacaattcaaccattaagaagatctccaaaaatctggctcgaacaaacttttaaaatatttgttaattaattttattattcaatctcagttagtatagttttatgtaaattcaactagtcttcatacttattttctatcttcattaagtaataatacattagttttggtagaattagtttttgtctggctttataagctagttagtttaatttacaatattattttcaaaatcatttgattttatctattcatgtacttatttgtttaaattttattaacatttggagagaatctatttttttcttaattatatagattatttaccataactatatcaatatttccttaagaacacattagattataataataacaataagaaaagacaaggcaatagtatctttatgatgataattgaaatcaaacaggaataaatagaacatgtttggtagcttctttcttcttgttctcttctccacattgctttatcctctcacgaccaacactatatataatccctaacttgggaactcttatcctccaaacatagttaaaccaaattttctaagtgtctcataaaaa

SEQ ID NO: 4034 - DNA, 2000 bp, Arabidopsis thaliana
gctgtatattattatgtctagcttaaaaatttgctgtatattattatgtctagcttaaaaatttactgtttgggaaaaatatgaaagtctcctctacctgagtttgttttaaccttctttttaaaattatcaaatccaaacatgtgaaattttttggttcagtcaggtacccaatgattcatttttaacaattagaagttggaatatatttgacttaaatttctctagttaaaacatgtgatctgtcatattaattgcactgttgaatgttaatcgaatttggatatgtattcactctttgttatcccatatggcgggttgaatcacctgtcaaactaatattttcaatctaatgtcttattcattcctttgtacaactgagaccttaattccattttacttaatttatatagggatacgtgtatatagaaaaggtggatcggtgttttatttcaagagttttagtcatacagatatactttttgtgcatatacgagatatatggttgtatttctgtgtttaagagcaagcaaaattcgatcaagaagcttaatttggtcaaccttacgttactagaaaggtatgtgatggtggcgaaccgacgataaccgataagagagagagagagataatatacatttgaggtctattttacgaaagagtctaatttgactgtttatttgctttcttcttttttggtggcctgaaatatgaataccaagatagaaaaaaagactaattttggcttatcctacaagtggcaactggcaagtatacaaataagacttgtatttttatctgaacatactgtcaaatttctatgtcatctcatatactaatgttatataattatatgttatacacataatattagttaaaaatagaagtcttaaaaataaatttcgttatactcatcatatcaactaattatcgattctatgaatatgttgggttaaattttgatggtaggagagaagacgaatatcagatgttgacatgtgaacgaatcgacgtcaatgagaacatgcatacgatgaaatgagtgtgtaaatccaatatttgataagtgaataagaattatgtgattaatgggaattggaatcaaggagctcaaattagaactatcaagactagttgtttgaccataccaaaatatggtaaaataagactaatagtatgtgaaatcttagatcttgtggcctaaaggaattactagtgatagtgaaactacattattgcttgagctaataaaccaatataatttaaaacaatgtaccactcacatatcccataccgaaaacaagtagataattagatatttatatattactagtttccaaataccgtccaaattgggaagcatttctcaccaatttcttaaagaaatcagtttgctagttgccaaccctagcctcaagaatcaagataatgtttacttgttttatttatattagaaaaaaaaaacagaagaagaaatcattcccgcgcaaataaggacattattggtatttcgttgacttgcagcctataaaaagacccctagtaacggcctgatactgcatccgcttcttactcaaacactttatcctcaacctcaagtctctctttaaaacccaaaaatattccaacttcacgaacataaatcatcaactacattaaatcaatcgatttagatcggataatcatctccgtcccgatataatctgcgttttcagatattaatccgtgagtatcgcctctttacctatcgaaatctcgtgtattgatctgatctgtttggtttcaaggaaaaaataacgtaatcaagaaaattattgactaatgactaatcataattttgtttttgttaaaggcctgatcatagttttactctgtaattaatgtatcatgataatgtttgataaatgaatcaaaagtcttaaatcgcttcacgtgctattttaacttaccacaatgactaattctcgtggcatattcatcatttgtcagatctttaaagc

SEQ ID NO: 4035 - DNA, 2000 bp, Arabidopsis thaliana
aaccatttacttgttaaagatatgattattgtattcgtacgaattcatagatgtggtaccattgagcatatcaatattaggctagaatattccttctccaaattttgtgtgtttgatggcacaaattttagttgttttcattagtaactgtctttacttattggattagataacatggattataggctcctcgaaggtgccaatatccatcaacgcttacatcgaaattaaaccggccggtttatgctaaaatccgttgacccaatcgccgttatgctaatgttaagtgacaattctaaatacgataatggaatgatttttaaatataaacgtagtttatacctaaaacaacaaaaagaaaaagtagtttatacgtggacatgtcttagaccggctgcgtcttgttcatcgaattgtctccgaatttggatcattacatatctataactgtatttataataaacttgtaagttttagatatcgacttgcataatgtgtatacatgagctcatagatattgcatatatacaagcgatgtttaaattattaaacaatcgctatatatatacatcaccacctccagtcttcatcatgtgacgacattgattctgtttcttttataactaacaatacctaagccgctccaataatatataaataattggtaactacagttaacaaaacgaaagtcgcagagagatcaacattgtgacaatatttaataatgtaatttctctttgccatttaagattccatatgacgacggctcctttatttggatataagtttcaatttacgcatatttccgactatcaaaccttttctctttgtaagatgaatagttacactgaatccacccaaattttatagcttttctttttgaatatatgagaatagtcagttttgaatttcctttgcatagtttgatcacgcttttaacgttcttaattgatgatatatttttcgctagtaatactcttaggttttaggtaaaacagtaatatgtcgactaatttgactaatttactcggtttagcacttagttaaaatttcaaccctttttcttgagtcaccaacccattattaactgttggtcgtcattactctttaattctcagttgctgaccacatactttcttaaaactatttgttgacgagtaattaaaacaatttatgagtatcttttacttcataaaaaatattaaaaggacaactatattaggaaatataaaagaatattagttataaacttactgtcatattgatatatagctatgcaaacaatagaaaatagattcagcattcattgggtttcttaatttaagtgttctatatttttggtagttctcttaccaatagaataacgttaacaatatttttaataaaaacatatacagatatttctaaagtcttacacttcattatttagcataatgttttgttttatatatttgtaatataaaaaagtgctactcgatagagtttctctttaaatattttagttgataatccttgaatttttcttacttattgctaatatttttggtcaaatcttaattattgctagttacaaacttcttaaaatacccattggttattattagattttataaagaaaatgacaaccaaataggaatatttttaataccaccattgtatttattaatgagaagttgaataaaagaaaataggagcgtctcatctctttttgaagggcttttttaaaaaacaaatactagtgtgttttctctttataaaacaaacctcactcttttgtttctttcattcatcatctccacacaaaaaaaaaaaaaaaaaatgaacaacttaattagctctctcgaactcacatctcttacacttgaagacccatggcctgctttctagcctaaatttcctcgagaaaacaagcaaaaaaacacaagaaagctagaatcttattttcttcttggtctttcttggtttcttcaactttttcttaaaaacgttttcaaaaaatc

SEQ ID NO: 4036 - DNA, 1244 bp, Arabidopsis thaliana
gtctttatgagggagaaaaaatagttgttttagcatatttatacatgaaagaggctacaagtgcaattgtgtatgcaaaaagagtgtgttaggattggtaaattggatctcatggacatataaacgtttttgatgatgacttctcccgtttttttagttgttaccaaagacaaaaagatacaattttgaagatgtttcatggatttattgtcataatcatccgaactagaacttagaaattcaaattagaaaaagattttgtccaatgatgatgatccaagtttggtttgtaatgtgtaaaccagcttttttggaggtaagatattaattgcgcggggaaatcaactagatgacgtgtgaatcgcgaattacaattacgtttttggatggagaactgtcttttttttcctttttatatccctaaaatacttttttgtacattcatttatatcaggaaaaacagagttgtaaccaaattattacagagatattcaaagatatttcaacctatcaactaaagatgacgtgtatattgagaatggcaattgcgtttatgagtgggaaaccaaattatttcattaacatgatctttaggaataccgctaataagagattactaatcactatttgaggttttaatttaaatctttgtagtcctgattttgaatatttcgttttagctaaatcagctccaatttttcccagttatcgtttgtcgaattcatattactgttaatttagttaacttccgaagactattagtacatgattcttcaacaaagcaaataaagaaaagaatcttgatgtcgttctctcaacaattcaacaaaacttggtctcgacgactcgaccgtgtgagatgtttgagaagtcagaacaccacacgtgtcgacataaagcccgcaccacgcacgcttttcgtctggatatatccaaattactttacagaaatcatttgtattgtttgttaataaaaactttgaaccactttgattactatattatttttttggaatttattctggtgacattaatgttctatcctccacgcggttctcataaaccgacttggcttctttatttttcctttatctttctctatatatttacacacacacgcatttgtgcagagatattcaaagattagaaacattcttgatagatacaaaaaacatttttcagacacaaaatcataaaatctttgcctttagtagatcaaagttctttacattaatcgttagaag

SEQ ID NO: 4037 - DNA, 2000 bp, Arabidopsis thaliana
tacaagtatataatcttaaacactaaacaatatagataatatcaacaaaacgtatacaactcacagtttactatacatttaaaatcaaataaaataatattatatattttttaatcatctttacaataaaagtttttagtttaactaaaatataagcctacatgcggtatactgcaggttaatatctagattatagagcttattggatctaaagacgggtcatcaaagatttcctaaactgaagcaaaatatactaaatattcaaatatctatatgttaccaaattataaacaaataagtcaatttaatattttatatacaaaatcaattaaatcttaatcacataaaaattagcacaaaaaaatgtattcaacaattaaaaatttatcaaatctctgtgttatataagttttgatactatattcaaataaagtgtaatataccttttcaatttgtattctttaactaatttaagctaactaatatatttgctaatcttatatctatcaaaaccgactatcgtttcttatctctatattatttttgcaagatttttttggtggatttggataaaagtgcattcgggtcatatggtacattcccctattaaataaatatggtgcactcctatgttattagctaaaatatttagattataattcagagtcatatcattaataaaattaatattaataaaataaataggtttttggcaagacggatttggagggacgggtttttgaatcaacattaataaaaaagtaaaatataattaatccaccgtttcaatacgggttaaatctttaatttattattttttaagaccactaatattaaacatatcaaatcatcctaatttagaaaaaattatataaaaccaaaaatgttatgtagtatgtataatgttactatatataaaattaaactataaaatataaatgtactagagaatgatacaatttgcaaaacttttatatatgaaaaataattcttaaattttaaaaattactactttaaaaaaaaatcacgggacgggtaaagaaattacagaacgtgttttattttggaattgggttatatggtggatgtatttgaatcaatatttataaaattttaaaatattattaatatgctgttttaataggaattaaaaacttcagttttttaacaattgtctcatgaattcgtggtatagttttacttaataacaattataaactgtaaaatataaatattttataaaaataaaattttcaagttttaatatatattactttgaaaaaataaatcatcccgccggttaaaatctagtttcatgtataataatcttacgaataaatatatacaagatgaccaaaatgaaaacaaaatttagataatcaacgcaaatgacatgatacatgccactaaagttttgcttagttccaacgacctttttgcctagttcgtttaatcgttttgtttaaagcatatattatcgtgtcgttaacgaaaaatgagttgagagaacttgatcacgttgattactaaaatctgattagctgtcgatgattacctttaaaattcaagtctattgccattataagatcatgcaagaatgtgggttaaaaaaaagaaaatctagaagtaatcaattatttcggatagtagagtaggtagcgtcagaaaattctgctacaacaaaaggggtattattgtcaatttaataaaataacacggttaggttcgtcgcttacgtgtcgagttcttagataacctttgaatgcaaaaatacgcagtttcgatccaacaaggcaacgctttgtgaccaaacagtcttttttttttcccttataaaacaaaaaaaaaaatgattttcttaataaaaagaagggaaagaaggaaaaacacacaaagcaacttcttcttcttgttcggcttttatcatctctgaaaattgctttatttggttgaattcattggattgttgatcgagattggtttactgattgatcgaaagt

SEQ ID NO: 4038 - DNA, 2000 bp, Arabidopsis thaliana
aactcacaagcgtatattgtccagtctaaatttataaaatagtggtgacattagttacataatagtctttcgtcaaaaacaattttttgaccacttttatcattcataattcacacactcatattgtccaatttaaacgtgaactaaatatggtggtaacattagttacttagtaatcttcgttaaataaaaaaagttcaaccgttttatcatttttaacccacacatatatttaacgtgaattatatcacgagttacataatagtctccgttaaatttggaatttagctcaaatttgttgtaagtgaattgcttgttaccaatgtcgtcagtaaaacataacggtaaatgtttctattttgtattataactattttaacataaaagatataaagaaagatttctatgtataatacattatttcgatatatagatttaaattatagttataaatatattttttgcttgatatctctgtaaattaataagacggaatttaaaataattacaataaataaattttaagcaaattagatgttagttaaaagttagatgagaaaacactgtagcatatgaagaaaaaaaaacacaaaaaagtataattagatgtgaagcattaaaaatgttcccattgagatgacgccacgtgtcacaatctgaggtcggcggtcgatgttataccgttgaaatgaggaagaaacggaaaaaaagtttgaaacgttcctaggagggaatggatgacgtgtcataatatgattggagtacatagctgccgttgatcgcgaaagtaatgccaagtcatcagtcgcacatgcctcgtgacttttcttatctttctcttcccaccctaacacgccacgtttcctctacatgtttgccacgtggcttttcactatccacccaccaatattcctaacactaaaattagattaaaatttatttactatgggatatgaaattatgaattgtgaagttatgtgattatggttaggctgatgctacgtaatttgttactctttagtagcagtacaaatgtactttacaaaaagatttggtgtgtttcaagcatatcatacaattctttttatttttacagtacatatccctattttacaataaaaatatcgtattttatttatcaaaatgttgttttgctaataatatttagtaaaataattttaacaatagtaagaaaaagcttgaaaaatcaaattttgtaaatttccccttctacttgttagtaattaatagaaatagataaatattagtttcttttgattttatttttcccaaattcactagcatttgtggaaaattgatgtgagtacaaaactgatgtgatttttctttgttattcctcaaaaatataatttttcaaccttcaattttaagttttttgatggatatgagcagcttttgtcaaatctattaaataaaaagacgtgtgccacaaattatccacatcagcaataagtttttttttaaaacaacatatatatggaaaaataatagctgtaaaatatttatttcccatttaggttaaaaaagtagaaatataattggagataagagacgaaacagctcacagcaaactaatcagtaattagggttatagctttttaaagatttgtttccttttatttcatttttcaaagacaaaagtcggtttgagttaaccacacgcgcttatctaacggttcagatataccaatcatatccatctcgagaaaatcgagaccgtccaaaaattgtgttgattttttaaactttaattttgtttcctctttcgttttcgttcttatcctcaccgaaaaaatttccgttttttcttccttcttaaattccacaatatggacgctctcttccttcttcttcttcgtaaaactatccttctttttcttctctccttgttatgaaatctgagaaacccagaaacaatatttgatttcttcatttacccaattttaaagttttgatttttttttcttctcttcttcgtt

SEQ ID NO: 4039 - DNA, 873 bp, Arabidopsis thaliana
taaacaaggattgatttcaaaaggagttacatgactagctatcacatggagaatataatgaaagaatgaagaccattcatacgtagaagaagacatcttccaagttaaactaaataaacatatgtgtgttcttatttttctcaacggatatgtgttttaattgaggtttgtaattggtttaagagaaagtgttttcttatcaatggtttttttttttttttatgtttgttgaatcaaagagatttcacgtaaaagttaaaacgtgttatcttaattattagcatgattacttttatctttcttttttatcaaaaaactttttaatgagattgccaaacgtttttttgcatccacgtaaactcctctgaacgtaaacttttccagagtgtatttatgtggacgtcagaaaaacgtattttgcatccacgtaacgaaaatagttcatataaactaaaagtggctatgtcttacagatatgtacacgacgcatgaaattcgtaatgtttcgtagagaaaggggacaagaaaatataattaatcaattattattcaaaacaatttataatcgattttttttttttcttataattaattattactcgaatcaattatattttatcaaaagaataaaattaatttgttcatgacatctgatgggtccattttcactgctaggccctttgtggtggcgtccgatctgaatcgaatccacttggcttaatttatttgaccatttttcgaagtataaatttgaatattcaaactcgatggcttacgttatcccttatataaacacattatcaacctccaaatattttcatcatcaatctttcaatcacaaaaaacaacaacaccaaaaaaaaaacgcacaca

SEQ ID NO: 4040 - DNA, 2000 bp, Arabidopsis thaliana
ctggtttcttgtagaagaagagaagcagtcaaggttaaagatatagagatgaaaggtttgatatttgggctgtttgtgtagatggagaggattggtgggtatatatatttagattaaatacgtataggagtggggtacatgaagtgtaaaagaggagtctaacttttcaacataggaaaagtcatgcaagaaaggtgaataaaaaggacaagttggcctctaggtactgttggtctctcaggtagtgcatatgcaaaatcacatagatatcaaaattagaagattcaatattgggacgaaagacttttgggattgtctcaggttaataatgttgacagaatcaaagtaagactcatcgtcatgctgtagctaaattgctcccagtatctttctttccaaatatttttatatctttatttccgctttctttttctctagctagagagatgtatttaaactatccatggatattcgagcacatgagtcacaactaacaaactaacatttttcaaagtggccaaacttgaccttttaatcataatattatttgtctttatcacctaacataaagtcacgatacaaaacatctcttgaatttgacccccaagctgattgctatgccaagtccacaatgctcctcataggctcatactctctactttattacaaatatcaataaaaaaaatgtcaactgtgatatgtgtgactttcacaagccactctgctaagttgactgatcccaaccctgcacatatcacatatgcacacatggaaaacagttgcattgtaatttggggaaaataatctcatcctgcacatctcctctgtttcctctttacaactccacagtatcttgttcgaatttatttatccaatcaaaaaataagtgatatgctaaaaaaaacttgtgggattaaaaccaagatgaggaagaggaaaccgtcgtttgcttgtatgtctcggagaattacgtgtgctgatgattataataaattaaaagtaagagagtcaaatatttgtttaaacaagaaaacggtaagaaggatgagaccaggttttgtggtagaacaagtccgggagataagatagttgcgtgactaggaaatggcgtgtctacacaagggcaccttttgatttcgatcatataacaaagaagtagataggcctaaaagagcccatggtatgtatgtatgaggcagctattgtgaggcctatatatgggcttagctcattgtccatttgtttccaaattattcatatgatcaacgatagatgatcaaatgaagatatatttctaatacatttagttttatcattgtcaaaatatatatttctacaaagaaactttacaacatgatcggattacgtgaaactaaaaagagggaagaaacttgatagagacaaagaggagccttttgttataatcatattagttatcccaggctgagaaagtgatgattcctccatgcatttaaaaaattgtaggtacataaagaaaagaaaaaataaataaaggtggtagatagtggagcaacggccaagagtaagataacattctatatctctaaagttgcaagttgggttatatttaactaaaagtggaaatactaaaaggggaaagcaatcataaaagcataaccaaatagtcaaactgacgagtgtgttggacgattctgttcttctacccctctgatctctcacaggggatcaaattgtcatttagttttgatatatagagccacaacagtgacattagtttgttgttgactactgtaagggttgggtttcgaaaagagacatggaggagtgttattaggttgattgttctcaagtacctccagtgtcaaacaaacattgacgattgattctcttcccataatttattgttatgcattacatatcacagtaaacggactttcagtcaacaccgcatttatttgccctcttcattgtttcacgtacgtaatcaaggaccaagggattttcttcttttggctacc

SEQ ID NO: 4041 - DNA, 2000 bp, Arabidopsis thaliana
tataatatctattttaaagttgaataacgatggctttatatgttgccattcacatcaatcgcatgtatatgagtaacaagtggttctgcttttttgtattaacaaaataataatctgaaccattaaagtatatatgggatgatttgtacggtagaaacgtttatgaattcatcccattatatgtgttccacctatagttaatgtttttttccttttatattaaaacatctttttttacatttttaagttatgattaaaaatgccttctaattctgaaaatattgcatacacttataaaagtttttacataaatacaaaataacatattttgtaaatacagaattttttttgtagttattaaccttttatattctaatatattaatgggtgattgacacaaatagcacaaaaaaactttattattccaaaaatatcaccattttttgaaacttccaaaaatagcatttaaagtttttaatcctcgataattaaataaataataaagtgtttttattaccatttctatcaatcctccaaataaaaatgagagcaaacactaatctaatattaaattgaatcaaaaaacttttaaatagtgaaaatatatatcctaaattggaaataaaaaacccaaatataatactaaaaactaattttaaaataaaaaatctcttttaaatggtgaaaatatatattctaaattggaaataggaaacccaaatataataccataaattaatattaaaatgaatcaaaatttcttttaaatagttgaaatatatactctaaattgaaatagaaaacccaaatataatattttaaatttatttctaatttattttggttgaatagattttagataaaattatggtattattattgtccataaaacttgttttagtgttactaatttctcaaataatgaattgagtgctatttatgtctaaaaaactttttaatgctatttttgtccaaaaaacttaatagtgtgctatttatgggaatttatctattctttaagatattttatttaaattatatattttctatttgattcacattatttgatcgacttttactattcaaacatatatttagaccgtcaaaaaattattttgatctacacttgttacgcttgatccattgaatacatttgatccgctatgcttgatccactttctctattcaatcaatagtttcaaaaagagtatgttaataacaatatttctttttgcatttaacactgttaactcacaaaagtagttttcagacatgaaatagtaaactttagttaataaaaactttgaaaaatactagaaacgtattattcaccgaataaatagttaactaattatatataattttttagttggactatttcaaacaatcggccttcgccgaatctctcgccatcacaaacacatcagcgcttctcaatttgaagttgtgaactatttcatctcgcctgttacattgacatatctccaagattctaattcttaaaacctttttccggttctaaattaattttcgagtatatatcactaaattaataattctataaattaataaaaatatcatagtttagtttattaatttattaaaaatttactgaaacatttcatacttcaccttatacttcagtttcatacttaatcttatacttcattttccaaactatatttaatgttttaactttaaagatctatgtggtcatataattattttaaattacacctgtcgcaatgccgtcacttataatttgtcatataagcaacgtttgttgaccgcattcagcttcatatagtaagaagctgcctttttttaattggacgacgttccatatatttaatttattctcattacagtaaattgttttttaagaacacggaatattactatatataagcatcgagaggtccatggattatcactactctcatcataaaccaaagtatcaaacaataaaagatttttgagaaaaaagagagagagatatc

SEQ ID NO: 4042 - DNA, 2000 bp, Arabidopsis thaliana
ttaaatttgaactcgtgacttcttttacaactgaaaccgacgttaggtttgactattttatttacagtcttttttcttcttctttaaattgcaatgtttttaacaaaactaaagcagtactaattcataagtgataatgcatggagagtacatgtgtggacaccaaatgataaagagacaagtcgtatcaagtgttgaaaatacttttctactagcaattatagtgaaacagaagctttggccttctattcattctatacgtgttgtagaactagcgcattctccaattatagaggcggcggcaacgacgaaatctcagccaattcaacttcttaatcttgtaagaaaaaaaaacatcaagtcaatttcatgaagcgattactattatgtcgcagtcaatctttatataccgataagacgactaccatctaacaacaaatttgaccaaaagtttccttatttcgttaatatgtcattagtttgtgattgctctaggtattatagaatgaatgctaattaagtgacatatcttgatggttagttatttctattatatatccttcattaaatggtttatcaggttgtcattacatttttatggcacaccgtgaaaaaatagtaggaacatgagaaaacataataattaaaaactagtatataagttaaaaacttgaatgtgaagacgttgaagaaaacatgggttgtttttggcttctataatcgcatcgcatgtttgacccatttagccgcatatttctaatcattattgttagttaacctcttataatctaaacttttcaactgttgtgatggtaacatctgtttttactatacaatattcctatatgtaaactctattcaaaacaaatattgctacataaactctgttctgtcgagttgttgcttgttgagcctttagattcatttttcttcggaatctcctgtcctttggagtttgcatgcttggttggttcttcttgtggctcatgtttcttggtttcagcccgacgtcaaccgttactttgggattggttgcaggttacgatgttttgagtttcagatttagctcttaggttccttttaggcttaccttcttgtacctttatgtttacggtttgtttccctcttttgggcttaggtttctggagatattgttgtcttcctccgccttagtttctgacagagtttcgactcttgtcgttgttgtatttcaaaaatgtattataccttcgtataatataatggaatcattcagtcgaaaaaaaaaaaaaaaaaaaacgatttagccgcatgtttgacctattttgcccacatatttctaataattgttgtcactttaaaaaccttaaaaattaattttttgtgatggtaagtggtacgtttaacaactatttttactatgcagttcttatataaacgatttagctataaaagatacaatgtagcagcggtttaggattatcactctacgaatcaacgtctcattactttttcataattccgaaatttcaaaattcataaatgtgcaattgatcactatattagttgaactgatcaagaagagacgagagagtatatgaagaggccaaagtgtcgctaactggtgagctcatctattttgtcgggaatacgccgccgtacgtcatacactcaacctggtcttgtcccacgtggaacatttcacccacttctgtgtatctcatattaatagatagatcctattacgtaactttctttctttctatgaatattattattgtagcaccaattatctttttgttggccccattttccgtttttatgataaatggtgatcgcgtattcggaggcagcctaattgtcatattggacctattgaaataaaatatattaaaataataatattttgtgtaatagcccccaaattcaaatatctaatccgttctatatatttcccaaacttagtgccacttagacacaataagaaaaccgttaacaagaagaaaaaaaaaagatcgaaa

SEQ ID NO: 4043 - DNA, 2000 bp, Arabidopsis thaliana
attagctttttgacccaaaaatataatctttttatagggtcattgtgatcctaagtatatgataattctttacatacatatgtgcataggggccgcgtgggttacttgaaccaacaaattagctctcttgtatttgtataaaccaagcaatttttaaattctaaaattatattttgaaaagtgaaagaagatacactttttaccaaccgaacaagtctaactgaaccaaaccaaaacttgaagatgcgtatcctacatttgaatattatataagagaaattggtggaaaattatacgaaatttaaatttattgtaagtactattattatttggtaatcggaagttctgatccataggcatcatgtaaatactacaatagttaaatacgaccacatcaaaaccaaatcctaggaaacacatgaggttatgattttaaccaccatactcttactggtaataattcaccaccgagaaaccggagagaacctacaaccagaaagcacctacatcgaattttggaagcaataaagattacattatgtatcagaaataatcgttaatacatgtaacaatgaattatttgtttcgagtgcaaggtttatttatcatgattcacagtatatctaaaataataatttttttgtttagatatattaagagctccctctggcagtttgatttaaacctagaatttgtaatttgtatacttctgatttcaaattcatccctaaaacggtaaaaatatatatttcaacccgaatgttcaaaataaaattatatatgtatatatattcccaaccctacatgcacttagatattattgaacaaataaattaaatagagtaaacaaaagttaattactgcgcgtcggagagaagccttggcgtccaagtcttaccaccgaaaatatgtcgacttcccatttgctttaacttaatttgataatattataaatatactaacattttactgactcgaatacaataatagtgattccagtaaattattaactaataaagaatggcaatgcttttttttttttaagaatgacaatatttcataagattggcaagatgcaattgttttttctatcgtgtgaatctgagaatctcactcaccgcccaatctataaccctgttcaagtttaactatttctagtagcacgttagaaaagagctaaatatagaagactttatcgatgggttttatcttcaacaatatctacgtaggaatatatttcctgtaaaagcatttagtcacgttccttattattaatatctttttaatttcagtgacctaaatattagattgtgggcttgacaatatccctaatactaaatagtagtgttttctctacatatattttgtattttcattttaacgaaaaaagaaatttcatcaaaagactatagctttttcttacataaagcataactttatcttgtacattataatcgtgaaattgttgaaacatttcgagtcaagaattaattaagtaaaactacgacccgtgattcttttcttcctttgtcgacaatccatacgcgtgaatacgtgattagtcaaatgtaaaatgcaaaaagaaaaaacataaaacaggaccataccaataccatattctcactataccaacttcgatttcataaacccaaataagaaaataaaaacaaaaactccacgctgtatttccatgtgtgcgagatacaagaatagactcgacatgcaaaataaaaataaatatgaccaaataatcatataatatcttagaataaataaattaaaaaatcatagtaaccattttataaatttcgtaaccttttctccgtcatcccccacataccactccctataaatgccaagcaaaatagctttcctcgatagttcctaaatcataactacaaaaacttttccttcttcttcctcaacctttgcttcaatcttcaacaactttctttttataaagattttgcaagttaagtgtaaacctacaaaaaccaaac

SEQ ID NO: 4044 - DNA, 2000 bp, Arabidopsis thaliana
ttgtttctattttggtacaaactattcatgtttttgttttggtccaataattatttttgatatcaaaatatcagaaaaagattaaatcaaacgactactctatgatctatatcaaagggctaaaaagatcacgcgttgcagatgaagacaaagtgctattgacggtggagtatacccgccgcaatttcttatgtattttttttatttttttgtcgtttccttaagtatgtaacacttcaccaaatctattaatttggaatataatatttacaaaaattgttagttcatgatatattctttttttctgactaaatattttaagtataacgtagtaaaatgttaagagtcaacatatcttttgaaaatctatatatatggattaggataatttttctcactaaaatcacataaacgttataaaaacgacaattaatccaaaggaaaattaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttccaacaacatctttcacacaacaattcacacaatttctcgtttttttttgtttatcatcaaaagttttaatctaaattacgtatcaaattccgagcaagatgactattcttgttgaacattttgttcctggtaaggtttcattgcttcttttaagatatatagatatagataattaatcaaatattggagattagattgatattagtgcatgagaatatgaacaatatcattacaagaaaaaaagctatgaaaataattttgtggtgacgattatagattcaagagtggatgaaaagaaagtgatagaggagagggataatgaattggtgttggatggaggttttgtggttccaaaatcaaaggaaactgatgcattcgatgctcctgatatgaatttcttgggccattccttcaggtttgtttaatggattgatccatatatttatggacataaatgttgttttggatcaaaactaattacagtctctcttttcttttagggattatgagaatggtgaaagcgagagacaacaaggtgttgaggaattttacagg

SEQ ID NO: 4045 - DNA, 2000 bp, Arabidopsis thaliana
aaactctctcttttttgttaaaaaaaggttatatatcttttaaccttctaggattttagcctagctgaaaaaaagttacacattaaacttgtttttgttaacaacgttttagcatttcggttgtgtgttgtttcttccggttgttatagtttcgtactttcgttggttttgagttttggattcttgaaaggtggttataatttatacattttgtttctacacgaccttaaagaagtaacttcaattaattaaatctaattcgggaaagagcacgtctcaaaagagtcgtcgagtcccatgtgaattctatatgataacattaaacaaaatcacggttccatatttgtttaatactagtatgtattgcagagtagactttcctaatccagtagattcttaaagaaaaaataatataaaaagattgaaaatagaaataaaagatgggagacacgaagggtcacttgtattgtaccgagtccaaatgtaaagaagtctcaataatggtgtaataaaataaagaagttgaagacaagatcacaatcaccatgtgaagatcaacacacaagatcataattttattgtatgtttgcttcatttcaacttttttaaatattgttaagagggcaggcattgagtgcgccacgtggcaaatgaccatccctttgtaggtgcagcaaacgtgataaagattccggactgttcacccattcccttcttccatttgtttcttattttttcttacaaatcttatcgtatcataattttttttccataatgcgctcccttgaatggaataacgttggttattttgtttccaaccaaattttcataccattcgatcaaataggtgcatcaacttacaagaaatgaaagtgtgatccctattttattaggtagctaagtaagtgttagtgaacactacgttagattgttactcaaataacggatcaacgaatctcgtattcattactatactgctaatgaatgcatcaattttaatttttattggttatctatccttaaaaaaaagttataagaatattttgataatttgttccaagatgtagtactagtagtagtacttggtctcgtaaacgacgacgccgtttaggaaatcaaacggccaaaaatgcttccactttgcgaaattttattggtgggaaacgcaaatgtatcgataatgatttaaagaaaaagcggcgtttctaattggaccacgttgcccaatctctacggctcacgcacgatctgacgtcaaattggcataatactataataaccttatcgagaataaaataatagtcgcatccaaacaaaagaaaccaacccttttatatcacgacgagtgtcacgccatggacacttgtccatctctctcgctctgacccctttcaggtatcttttatttctcaaagaggaattattgattttccatttccaaagaaaaaaaataaattcgaaggtcaggaaaattaacaaaaaacttcctttttttttttgttagtttgtgtgactgagctgcttcattttttttctttctttttttttttggtttgatgaatcgatttttgttgtctattactgattggttttcttgttcagattcactgattcgaagagaatcatgatttttttttcccgctgaataataagcatatgattgggtgttttggagatttgtttactgattaaaaggagattcctttccattttcaccatttgctctgtttgacttcattgtgcttatatttcatttagatcttttgtttgggtttagctttggaactgataaaaatctgattttgtctcacggctttggatttggttcttaaattttggtactttaaaactggataaagatcagtgcttttttagattcttcgtttgttgatgaatttatggatgtatgtataattaaaccataatctctctgcttgtttgttttcttataggtaaatatccagaagcttgatcctcctagttgtacgaaagcttgagta

SEQ ID NO: 4046 - DNA, 1749 bp, Arabidopsis thaliana
tttttcgcggactaatcacatcctcagcttcttgctaagcttcaaagctcgcatgtttgggcttttctattatttgggcccaatatgagcccatagttttctgtttgtttacgcttctttcaatttttatccgagagaaatggcagccacacaaataccaactaaatgtcataactcataaacaaaagatacgtaacaaacttttaacgttttatttcccaccaaaagaaaatcaacatgtgtcatcatcactcatcatcttttctttcaacgacaaaaaataacattgttcttatcgcaacaatacatgttttatcatcatcatttgaatgtacgtaatcaatgtatctcgattctttttggttgatatagaaaagaatttggagttgtattttgttacctaataaaaatcaattaaaattaataatagtaatctacaccctcgttaagagaagcaagtagagctagttcatgcatgatgatgtcttagtaaaagaaataagattatctcatataaagtaatagttagaaagtgtggaaggattagaatgaggatgatgatgatgtgtgtcatgagtcattgatctttgtcattatcctatgattcatatctcttctttctcgtgcatccaattcttattggtcaacaaataccaatagaaatcatttcagcaataatggacagaaacctacttacgattggtgggagggatacacaagaagacaactagagtgactaactataacatgttcacgcatatgatcttttatctattttcataattctgatgtctgtgaccaccttgcaatacacctgtacttaaatgtagaatatacgttataatattcgtaatacaacgcatcacataggacctaaatggcgatttttatggttgcatagtttcttgaaaaatgttttattttgttgatacgtattcaatcgtgattgtcaagagaatgaaatatcatacagtgaaatcaaaaggaattaactaaacaataattggtagtcaaatcttaaaatgctatacgtataattttcttctttaatttttctttttttcttttttattttgtaagagatttctttgaacaataattaattcaatctttccttacgtattaaacaatgaatagaaaaaaatcacaagacattattgaataaatgtcggattatctactatatatgtgtgcgcatgtgatatagtactgtaatagtgggctacaggccaacttcggctttccaagaacatggttgcatcgagcatatctttgctagattttaaatataactacaacttcttgcttactttgtgatgcggaaactcaaaaccgtaatcactcatgttatattttttgttgttgctttcaacgctaatatctgaaaccagttttcgctggtctaagatccatttgcaagaaatgtcaacaaaataaaaagctcttatcattcccacgagttttagttaaggtaatctattattccaagacttccacgaaccacctatatatagaagcttacatattctatagacttaataaatgtatagttcaatattatgtcactaacgtacgcggctaacaggtttgttaatccttcctatcacatgattgacatacacacacacacacacgcacgacacattatttgtattcagtattcacatatacgatatataattacaagagacgtgtatattgagagattcattttttagtgattgtagatcttaagagagagagagagag

SEQ ID NO: 4047 - DNA, 2000 bp, Arabidopsis thaliana
ccgtaatccttccaagcgcgaaaccacaacatataatattaatttcgttttaaacgtcattcgaaccgacgacctctaagctttacctattatctttaccagttgagataacgatacttggtctcgctcaaattattaaaaatattgttcgagaccattttgtctatctccactatcccgaaacaagcaaataactacttctagttcaatttgtaaatatcaaatatcaaatttgaaacagtttaaagtttggaacttgtgagaatatagaaaattgtctagataaagtgaagcagtatttacctgtgatataatttgggccctcgacatttagtataattttccgtaaatcaagtgattggcttgccgataagttatgacaatcattgctgtaacgcttttaccgtacattattattcaaataattgtaaccttttcttagcagaacgcataacaatttctaattagcgatcatatattacggattcgactataaagaacaaaaccactactatagttcctaataattgttatagtggccagagtttatatagttcattatagattcgtattaaaaggctgatcacatgcacacatgtgtatgtggaatgattgaaataaagtcatgcaagtctcatcatcatcaatacaatctactcaaaaacatgtgtccatgaatttgtctagaccggttaatggttcaacggttgctatgattatttatttggcatttgtatagctaaaattggtacctacactatctatatacatgacttaagacgcatagataaacaaattgaaaatacatgatagaacagtaaacactaatatatatgccatttggttaatcgaatcttgaatcataataattcataacgtccaaaaattatatcgtgtgagtaaccccacactttagagattcgttccctcaaatttatctagtaaataattttgaactgttttacatcctttattaaagtaatacattgatctcgaacacatattataaacgacaaattaatcatgaaatgtgtgctcatttggataaacaaacttattattttgttaaataatatgatttgaaggctacaatgtcttgttgggaaacataggtttgcccgtcaagattcatgaaggacgatttttagacacaacataaggtttcactaatgaagatgtgaaaatggactcatcgttctaagtaaaaatggcaaaggagaagctaggcccttgcgaaaactaacccaaccaggcaaccaatgtcttcatcatccgtataagcgtgttgtcctacacgtaaccatcccttgaagaaacagtcgacaacaagaatcatagacaattgttgttaaacaatcttttgaggttacataatcaattcatgatcctgatccaagcctagctagatgcatgtcgatctttcattcgttgtagtgacgttaatactcaaaatcggcataacgtaaacaatatttttttttacctaattgaaagaaaatataatttgaaatacatccgttttgtcatttacatacttcacaagcaccgaatcttatccaaatgtattcaaaataaatccaagaataaaaccagatacataagtaaaatgaatctttagtcataacttagatttgcgaatgggcttccatctcccaaacgagtcgaaacaagcacaagtacggacaataacttattttcaatattttccacaaacccctcaattatttctttattctaattttggacaaaaactattcaaattagtcatttttttgaagttacatctttttccttctgacaatccaaaaatcacacaaaaaaaaattagtcgaaaaactttttaactagtcacagagcgaggagagagagagagaaccttttttttcctctataaaaagctgagccacttcctctgtttcccacaaagcagcttctgcaacctattcgttggttggttaatagaagctctctttctctgtctgtctttctctctcagagaa

SEQ ID NO: 4048 - DNA, 1965 bp, Arabidopsis thaliana
cgttatcacagagaatttgtcagtgttgtttttacaccgccgcatctcagtgaatgtggcgcggcggagcgatagagagaagaagaagaagtagaagaagcacacaaagatctctctctctctctctttccggtggttggagaacgagaaagcacaaagattgagagagagagggaaattaattttatttttttattattgtttattgtttgcttaagggcaaaatgttaattaaagtctccatcgattctggaaactaaaaagtgtgttaagaacacgcgccaccgttagcgcgtggttcagggagtgagaacaaaaatcatttatacaacaaagtgaacaaagtaaaggtgatagttgctgaatttgcaaattgcgtattacactttaacatttttataatttttgtttagggttcattgtaatgtttggtctcttttggcttgtttagtttggagtttaagtttaccaaattctcatacttaaaagaaaatgtacctaaattggaaagaaaggctcttggtgaagcagaaggtttaatggggttactaaaacaatatatgaagactctaaagaggtcttatgaccctaactaatatcaatagcatgaaatttgaaaacgtttagatatcttgacaaggtattaactttttgaataattaactccaacatgttaaaagttgaaatgttgaatcaattcgttgtaatctcaaatacacgcatgttaatgatatttaaagtccgtgttaacgataaaccatcatttcgaattatgtaacatattacaacaccaaatgaccaaaacaaaagattcaataacattaccatttcttcctcaaacagtcaaactaaacgaaacaaagttatatataactgaaaagtctttgtagattaggtcttggcccgtttacgctctaaggggccgtcatggttgaattttacaccacataaaaaatatatttgtcggtgctgatttatatagactagagctacactaactaacgatatccgaaatattcgaccccaaaaagtaaaatgataacattctttaaacacaatcccaaattctttacaaggtgttataaaatatgacacacaaaaatatatattcaaaaccgagagcgcccataggaggggccaattctttcgcttaattccgcttagacccacattatttctttttctattgcaaatggtgtgtagtactccggtaatctcaaaataaacaattcgatactgtaccttttcacaaatctattctcaagtaacaattcgatactgtagctttaggccaagtagatttcttcataccaaaaaagggtcatattatcatttgatgagtgttatagagctccttgctaaacacaacaccacgcatatccaaatttggtgacaccagaataacacattttacaagtacgccaatgacgcttagatgggtagtttagtgaagttttaaagaaaaaaaaaatcagtgaaaagaaaaacataatacacaattagacatgatggctaggtccatcgaatatgagtagggataagaaaaaaaaaaaaaaaaaaaaaaaactttccttgtgaagaagaaagaaacttcacataaatgatgttacaaggaaacacaatgggagtgacccaaaaccattaagaaattatgaaaaattcaaaaacttgtgatcacatggttgtatggactgaacttggacttttcttcaatcctattgttcattttacatttccaaagcagattcttatacaattttttattcattaaacgtaatgatgcttcaaattcaatgagttaacagaatagtgttgaaagaaactattgtttttgcctccaagtaggcaactatgcctcctaacacacaagagaaacagagatttaattttcacttatgcctataaatactctttctagattgcattcaacaaatctgtgtgtgagaaaaagtaaataaaaaagag

SEQ ID NO: 4049 - DNA, 2000 bp, Arabidopsis thaliana
aagtacgtaacacatccatagaacaattttcaacctctacaaatacacttttttataactacaaaatatacttttttctgggaccaatccaaaattatccgtacactaccaaaaaatatttcaaaaataccagcaagacacatatatatatatcataaaggtaagataaatggaagagtgggacatgcattcctcacgtataatatatagtttttttagttttagttggcctttactaatttaattactcttaagtctcttatgggtcatgtttaaaggagccaaattaaggctatgcgtgcgaaaccgcagccaaacatttgaaagacaacttttaaacgtatctgaatccaaatcctaacaagtaattatattaatttattttagtgaaaagttaatattaagttaatcgagtgaaaaagttaaattagttttaattaattggggatgggatagttaggtcaagtttgcttcttagttctttagattcttgtgtgtttggtcgacttcttactattgccacatcactgcatgattataaatatatacatgcataatatctgcagcatctactattttattacaactaattaatagaaaaatgtattctcatagtttttttttcctactttgcatgttgtatttaagttatattccccaaaaaaaatcctaatattgtatcaaaacgatttaatttttagcataaaatctaattcgaatcataactttagttaacaaagatgtctatcaagcgatagtttagacaacaaaagtaaacagaaatttacctcagagcataaattcagtggacacacacacatataaacggagtcattaataactagtaaaacgaaaatgataagagaagggtatcgattgagcaaataagattccaaaaatgcaagttgactaatttaattagagtaaagcaagatatcaaaactaaaaaaagaagatattatgaagcatttaaattggatattaaacagatccaaaacgaaaaactccaagcagacgcatgtcaatctcactcaccttggtttattgtttttttataattaaccttctttttatatatcccgagtttcaaaaacttattcccagttttcacgttctttttgtatatccgatccaactttctgaatattcatatccatactgtctcttaaatgctaaatttcatttactttctcgactattccaatgaatttaatcattttgttcattgattagatagttcttgaagcatatcaaatattttaacaattatatatttaattaaatcatcactatctgctttccctttacttattaagaagggatattattatactttgaccatttttcatataattgttttgcactacacaattaacaaaattaaagctttgatgatgttacaaaaagaagaaaaaaggtactagtattttttttaaaaatcattttctccaaaacgatcgcaaaattcacgcaattctctcgtcgctcctaaatcatcctctttttgttttcttccattttttctgctttagtatatgggtttcttttttttgttttctttatattaataaaataatgtaatttcattttgtttttttggagtaagcttatataaatggagattccttggtcttcttcttcgttgccagttgccaccagacatacataacacattgaaagcagcttattcatcgacataccaaactctcactctcgccctcgctctcgccctcgctctctttctttcttcatgtaaattgtttgttcttttccatgtatcgagattcgatcttcttcttcttcacacgaacctccttattgttttctcctgcattctctctattcttcgctaaaccttgaataaagacatgttctttaacatgggtttttccggtttaaagtagttgtatctttgtttcccctttaaaccgggtttaagctcaatcttttcttagaacaactccaactgtttgacgatttgactgagagaaaacagagtc

SEQ ID NO: 4050 - DNA, 2000 bp, Arabidopsis thaliana
taccgacatatatcaagtcaactgatcagattttgatacgtataaaacaaatagtacaataaattataaatcctaaagtaaaaggattgcaatttttaaaggtatataaaaataaaataatattttataattgctaattctgaaaagaaaaaactacaattattattctttgaaaatatatattgaatagaaattatatatacaaaaaaataaaatcatataatcttattatataacaattgatgtttcaaagttattaaatgatttctatatgtgttgcttaattgatgagattttgatttgtaagaacatttctcccaattatattttgacacatgctattatgctaatataaaaataaaactcacatatctttaacataaaataaaataatataaatatatattaaagtatataacttaaaaggatatatttcaattaaaataatatttataaaaataaaaaaacttacgaaaaagggaaagtgtaaaaaagcttacaattacaaaaaaatatattaaaatgaaattatacggaacaaaaaaataagtaatatatcttataatataatgtttgatgtttcaagcttagtaattaatgattgtgtcatttttatttataactatgtgataggagtatgtaaactttttcttttttaggtaggagtatgtaagatcaatataagtttatttttatttttatctcagctttgaattatctaagcatcatatatcattgtgcttaaaaaaaaaaaaattaatgatgtcaaattatttttcttttaatttcgcaacatttattggtatgtaaacattcatcgtaattgagtagcttttctttattttagttttcttaaaaacatcattaattattgttgtgtgatatatttttcaattgattttttatgtcggaaattttaatgatttaaaaaactatacaagattgaaagtaagagatatattgttggacgtaaaaatagaagacgtgttgttggtttaatgtgtatataaacattttataagtagtggcaaagaacatatttcaacagtaaaatatgattgagatgtaaaagcactagtggtaaatgatataagaggacagttggatctgtggtttgcatgtaatacattttctaaaagaatttgtagaataatatacagtaaaacctctataaattaataatgttgggaccgcaaaattctattaatttatcgataaattaataaatattaatttatagagagatttttctaatttggtaagttttttaaaatttttttatgaaaatataaacttccattcattatttgaaatatctttctagaactaattacaaataaaaataattatcatgttttgaaaacaacacgaacagtttttaatatagtaaaaattattaaaattaaattaaaaataactaatgtgagtttaagcaaaaagaaacaactaaaattatatttcattaaagttgttatatataattataatatatatatatatatagttgatatttttatataattattaatttatgatattaataagaccatatgtttctataggattttcaaaaaaattattaatcttattaatttatcgagttgtgtcactttttacactggtcccaactcgagaccggaagaatttattaatttatagaggttattaatttatcgaatattaatttatagaggtttaactgtataaggggaggccggaaaattacgttttttgagatacggtaataatagtaaacaaaattttggcaaaagttgtggtgatcgataattttaaccttactatatattattataataaaatgttccaactagatataaaatatagaaacgtaaattagtatagtaaaacaaaaacgaattaataaaatactaactcttgtttctagactttgtcatccatcaaaagctctataaaaccaataatcttcattggatgtaaaattatctatttacatttttctctttcaagaagaagcagcc

SEQ ID NO: 4051 - DNA, 2000 bp, Arabidopsis thaliana
aagattcgtctatcagaatcgaatcttattaaaggaaaccacttaagaaatattaaaattgagtagacaaactaaaatatatagcactcgtaaaatataattaagacaaggagcaacattatccagttttctttatacatgggatctgcgggaatatatgcttatgttctggaaaaataatggagtaattgagttttataaaattgcgtgaacctccaaaatcaatgtatcaaattcagatccacataaaagttatcaacataatcaaaattatctttcaattatattagtgcttccaaattcctagtagtctaaatatcttgttctttgacaaaaaaaaaatatatcttgtaggttcggctttgaggaatctaagaaaattaccggacccaacttaagatatattagtatttagtgacgtgtaaaactaataccataaaaataaaatcaattatggtgatttagtagaatataaataaaataatgttaagtagaatttaatgatgatttatgatatggccaaatgaattaacttataaaatagttaaaaagttgttttgtttaataattgaagaaaaattaagaaattatttaatagattggtaaactaatttatctaaatataattttcaaaaataatataaatgatataaaactttggctaccaaaattgaactagtcctctttgggttggtttgactgtttgagaaaattgcttcttacagtttagctttgttgtctatgcttggccttggctgatcgacaaagtgattcgcataatcgcatcttttggatgcaaagacaaataaagatatactccaaaagatgcgactataacattcttttcaatattaacgctactttatcatcaacataaattacttaatcaacaaaacatgaaaataaggaacaaagctcgaaacgcaacatgcactacggaaaaagaggaattaaaatgaacatgtctacaatttgtcagtgaagttttggatgtttctactatgatatggcttgtttcatgcctaccatatgataagtgttctcgtgattctcgctttatttttgcatttttttcatttgtttgtaaatcacttattattgttgtttttcattttttttttctgcgtttggcgttttactggaactttaagttacagaaaacatgaatagggaaatttgttaatatgtaactaaggttagatattttgtaagtgacgtaataagtaaacagattattccatatcatttgtattataaaaatatgaaaattgtggtataacaagtaattttttaaagtttttttttcagttgttttatgttgctttccaaaaatatattaacacaaaaaggaggcaaaaataatctttaaggaaaaaaaaaactttttttaggaaatttttgaagaattaataaaaataaaagaccatttttcatattttcacttaattaaattggcttaactctgcaacaagtgtcgtcatcagtccttttaaaacaccttgtatcttccttttaccaaatccgccattgaagaataagagagagagaagagaactactcagatataaaaaccctagatttcttctcttaaaacccacatcgaatctcaactcagaaccaacaatgctccaacctttctcttcctcctctgttttctcgagaatcctctggactttcttggtttaagaagattcgttgttgaatcagagagaaagaaagcatccatttttctatcattgcttgcttgctatggaattgggtaaatctcgattctacttatgttgcaattgcttttctcctgttagattttccgattattctttagctggaagtgattatccagacgccatctccatcactttcaattgtattcctataccttcttctgaagattcttcgtatttctcgattcgatgtttataaacttcaaattctcttccaaatcttgaaacgaatttctcccaaaaatctctgtttcttcacaaaaaaacaaaaaaaca

SEQ ID NO: 4052 - DNA, 2000 bp, Arabidopsis thaliana
cggagcttttttgctatataaatttcaatactatatatatatatatatatatatatatttttattctttttgtgataaaacagttttatggcaaaaacaaaccacacttaggttaagaattttacttccttaatttttcaaatatagatattaactcaatctataaaacataatattttcatgattttgagttaagaatgttacaaaagacaactccaaaattgtaaattcgtcataacacatatatactttaaactaaaattttcaattaaatcatttttttggtaaactaattcatgcaacaataaccgtattttatttataggaaacaaagaaaaaacccaaatggtgccggtcggcgaataaaatgtgagagacagagccaaccatagtccagctaatgtttcgttagtacctcacaaactcccccagtcacgagcttcacccaccttcttctaacactagtacttaaaacaaattaatgacaacgtctacgcgcgtgataatcacgtgtcaaaattcatgacgtggaagcgcgtagtgacacgtgccgacatagtgtcagtaaatgctctcaatttacctatggattaggaattgtaggattactctctcatcttcctctatctactaacttgtgccagctgtacactcttccccatattttccagcctgtccaaaaaagtcctcccaacgtctctcagaagtttcacattttttctttaactgcccacgcgctttacccacagaaggaaaaaaaaaaacagcttgcataagggtatttacgtcattagatctgtaactaagctgtatattcttcaacacatttttatcgatatggtcaattttgattcctctttttaatcgattttttattggctgtatgtaactattgcttaatctgacacaattaaatctttattaattgttttatagtttatataatacatatataaacactaattattcctttaatatttatttagattacctctagcaactcttttttattggtccaacttgatttcattttctaatttgtagtattaaataaaaacatccacaacatgtacagcttttacaacaagaatcctatgtctcattctagcctccatgagtagtcttatccaaatccaaatatattcaaaatatttgtatatatatttaaaaataaaattatacttagcattatataatactctttttgtttcatcaagattgatgttataggtttttttcttattccaaaaagtttgatgttttagatcaatatttttattacttttatttgtaactaatatgtagaaaagagaagagagaagtagtgttcgatattattaaacaaataaaaaataaaaaaaatattttttttaaatttgtgtgaaaaacctataacattaaacttcatggaacggatggaatatttatatgaaattatacgtagcattatacatatttttatgaaaacttttgatgaaagtcattaaagaaactgaagaatttataatgacattttcacattataatcataacattgaaaaataagaattttaaaccaaagttgtatgtaatgaataagttgtcggactcgaaactgagtaaattataatgacatttgactatatgaccataacataattaagaaaattcaaattttgacataaaccaaaagttgtgtagaactatggatcattcgttagctggcaacagtacaatggtccattactcctttgtatcttttctttcaatttctctgcaccttccctttctctttcactttaaagcattatttataacatacctctctctttttttccatctttattatttaaaattcatattcaaaatctaatttccatttttaataataataaatccactctgagagaggcatatatatagccccatcacactctcatatatctcacaaaccaatctaaacatcaaagacaaaaaccaaacctctttcactattacacttttcctcaaaaaaaagaaaa

SEQ ID NO: 4053 - DNA, 897 bp, Arabidopsis thaliana
ttcacgaccagtatggtttactcaggtgggaacggagaccggaagtggaaagaggataacggcacgccgatgacacgtgggtctctcgatttcacgccacgtcatcacgagttcagactttattggtcaacagtaaaaacggtcttaggaaagagagaacatgaagccatattacactaaatgggccttgaattttaatgggccaggatcctctcacagatatttttgactcttaaaatgatgaggaagtggatgtgaatacgtggtcgtatactcaccatggcattccatgaataattaatgtcttctaacttctaaatgatcgaaaagtactgacaagttaaagtcaagcagaaaaaaacaaatattatgaggtttttagatgctatattcattgcaagttgtatacatgcgaaatttaactagtgttgttaaaataataattatatcagcttttgactatttgctgccactctttgaatgattgaaactaattttctttcgcattaatgcattgttgaaattcatgcacaaaattaaaaataattggttcatgtatttgtaacccaatgtaacaattttattgttgaacagaagtcagtaactccacgtcatgtactccattaaatgttccaaaatattttgggcttgattccaaaaaacaaattatcacgaatagcgatgtttgacaatccaacaaacatggttccattcacctttttttgccacctgtaaatcgcgatattttaaataatttatttcctcttccacagatacgaatttttttataaagaataatacgtaacactctaaaacaacacaaatatcataatttctccacgaactgactaagagaggtaccaagaagaaaaccagagaagaatcttctttagagag

SEQ ID NO: 4054 - DNA, 2000 bp, Arabidopsis thaliana
tatgttcacaggttagctactcaattataactaaagttagctaacgtaatagtatatgaatgatttagttggaatgcgaataataatttttgttgtaggagcactgacttccacatgccatgagtaggcctagagcttaagtctcagtctcattttcatgcgtctctctcactcaatgttccactagttccagtagtattaaatgaataatagagcctttgcatataaccagagagagtgagagacctttgggccaaaagctctaacaaaaattccttttgtttcagagaatagagagaaagagagagagctagagagagaaaatgacaattgaaaaaacttgggagttggagttaagagatacctgaaactttctgtttctgtgatgactgtgaccactggactttgcttttctctatcatctctgctctcaggggctttcttgtctattcatcatcttatatatatcattttcagttaactctacttatcaaaatttacactgtattattgcataaaataagatctggattagactaaaatcttgtattgacactaatcaaacatctcagtgttttctctttgtattttcctcggtcaaacatctcaagatttttttttttaattattttttttcattttacaaatttcgtatctttacattatttgtttgacaagacatatacttctctgatttgaaagcataacaagaaaacgtacttgtgtgattgatacctcagtaacagtttttttttccgctcttcatattatctaccatatggaaaagacattcttatagatcaatatgttttttaaatgaaactatggtctaagacaaaatagctagacacaatggccatgatattttctgtatatataaaaacgaaaaaaaaaaatattgatcaaccagtatatgaaatttaagatcatgtaaataacaaataaagacatttagtagcaaaaaaagaaggatagatcgcgtaataagatacatttatcatcgaacaaatcacatattcatatgccgacccacaaaaaatcacatattcatattacagtcataattcataacaacattcgtcttatttatttgagttgcagacccccaatttatatagtacgtatgtatagtagacgggtttaaggtctacaacaattattcgattttgataactttgaaccatatggttcacgtggacaagagtggtgttttttattccacatatcatatatggtgttgagtgtcgatcaaattagaatccaaggaaaaaagaaactccataattaaatttattattctttaattatacagactatatatagtaatgttgcatttgtggacaagactaattaatatgttttcgataggtaaaatcgaataaaagagtcaatggtgaaacaagttggcgataattaacctttttctaatcgaggggccaaagaaaggtaaaataataatggcccgacaaatgaaattcgatatgatttaatgaggatttaccattaaatttggttgtcactttcatagacttttttcaccaatttccagatctcccactttaccattccatcatttttgggaatttcattattctaaattcaagtatcagtctaattaattaactaatactcctatctttccgtagctattattttataacagttacaaaaatacgtggcaagaaaaagagtgtatttccattttccagcgttcaagattaatgggccatttgattttctaaatattgggccaaagagagaatccatagaagcccattttaaactatcatatcttcccgcgaaaaagatagtgtaaccactttctttaacagcgaatatgaccttcccgtgatagtcactcttttggattccattcaccacctttgatcaattcaagtttgacacgcttctctcgaatccttctaacatataatagatccatcggatcctccaaaaccacaagttaaaaaaattattcaagaaacacgagaacaaaaaca

SEQ ID NO: 4055 - DNA, 2000 bp, Arabidopsis thaliana
gaagaatctggaagacgcaatgaaggaacttgttctgggacagcaaaatctgtatgtcttttttttttttttggttggaattgaaattacctacatcctatcgtcgttaataattaatattcagacaaaagaaactttttggtatatttcctggaaacttcggtgcctaaacacggaagttgcaaaggaagaacacgacataagccccaataattgaatggagaaaagaattttctaagaatctctggaaaacaagtgactacttctctgaccacgcatagggggaaaggaatttcgtcctgaatttcagaaaaatttcgacgtaatttctttgcaattcaaggaaaatttgcctcaaatatgttgtctcaggttttgtactacactactcaaatatgtttaagacaagttactaatactcaaagttacatgaaataaatagttagattgtattgcagaatccaatttgtaaaattagaattggttttaaaatatttagataaaaaaaatataaattattattagaacttaaaatattctattaaaaattttatatattttttacaacttatttaggtgagtcttatctagttacatacgatgatgaaagttgttgttgctagactccagatgaagagaacaaatgtgatgatttggactagaaatattaattgtcattcttctctggctccaatggttattcaaataagtatatgataattgaaattttaataaatgaataatgaaagcagaaaataataagagtatcatgttggaatctttcacgatagaagatgaagaagttgtagaaaatgtccaaccaataacgcaacatattggtgacatcttttgatggggaagtgctgatgtttgggagaggtccacagacaactcaacaactatcaattaataagtatactattttatttaaaaaaatcagaacattatcactagcaatatcgtatttcttatgtgtgaaaagaacacgattcctaatttctgctggttagatagattcatggcatttttttcttctttttttcgtggtttttaggaatttgtaatgctaatcagtagtacatgagatttttgctaatcattctccaataatctggtgtagcatgtgaaacacgtacaactgaacgaagcatattctgtcaacgcgtagtagcctactaggaattgatattattttttgtgtgaaacacacgtgttttgtgtgcacaaacttaattaggctagtgagtcgatcgtgacatcatatttgaatttcacataaaggcgatgttgttaagaaaacatctaaaagctaaaagttaaaacctaatgatggacatttcatatgatacttcatcgatgtttagtacaaactatagcgacgcgttgcctaatttttctgtaacttttcttgtgatggcattgaaaaactaaattctattaagttaaaatattggaacgttatagtaacatttactatcaaccatggacgaagtttaagtttaacattaaaaaaaaaaaaaaaaaaaacatggacgaagttccatgctcgctgaagacatcgaataagtaatatttcatagcgttttaatacaagttaattagaacatttttagagacttaacacgttaggttaattaaaaagtggtttaacattgtttaattaagatagaaagcggccattgcaagtttgaaacacaaatgaggatagaatatgatccgagtaaatatcaaatcatattttataatgtaatggatgttcaaagaaaatgtataaccagataaaatagacgaaagggatttgaaccatgagtcagcagtcagtatccattattaaaaaatagagaaaaacaaacactaaaaagaaaagactcgtcttcctataaataccttcaaacatctccctttcttcacgcctcttattgttgtttgctatataaatcctccaatttctcaatattctaaacaaattatatattttcttacttacttgttctcttgta

SEQ ID NO: 4056 - DNA, 2000 bp, Arabidopsis thaliana
aattgttctcaatattttatcattcaaaccaatttttaaagggaatcttgcaaaatctgccatatttcactctatttctttcaatttctgctatattctgaaattcctttcaaaatttgccacattttggtctacgtggaattcagtggacgaaattacccttaaggtgggtcagcgctctgacgaagatggtgacataacagcttttgcctgatgtgatgatacaggacgaaaaatcattgtggaagcataaaggattaggggacagaatagtgaagaacagctggtttctactgttgttattgggtatttaaaattctgcgggggacaacgtaatatataatacattaggagacatgattacctgataccgggggacaacgtaatatataatgcattagggaacatgattacctgttagcagaaaacaattggagtaagacttttgttttagtctccagatcttgtccccgaatagaaattctctgttgcatctacgttttgtcctcgatttcattatcttgctctattattatgaatcatacatcttatatgcaattgttctcatttaagaattttgaattttatttagattttcgccatctattttggtccacagattagttgagcgttattgtcttcacatagatgctgaaaccatctattttttgccatctattttcgccatcttatatgataattttgaaagataatgaaatcggggacaagatctagatacaacaaagaatttatgatgaataaaattgggagacaaatttaattgaaagttatatgtagagagacaaatgcatttcgtttagtcttcgggaaaataatggtgtatggtcaaagtgcacggatttcgaggaaagagagataaaatagagaagaaatggtgaggacaaaattgacatttcccatccaaatgtggcatgaattgtaaggcccagaaaaatatggcaaattgcataaggattttgaaaaatatggcatacgatgtaatttttccatttttaaatatatatttgatatttactgtttaaaataatacaaatatggataaagttagcaatacaaatgttatttgtcacttataattgttaaaaaaaatttctttaatgaattatttttaccctccttttggagcctttgtattttttttttttttttttttttctaaaaacctatatatgtttattttagctttctcacaagtcacatctagcaattgttttggttgatgaaggccatgtttaatgcatagtcgccgggactacggtctggaaaacaaatatcacggtagtgaaacgctgcaagccgtgataccattggaatttcggccggggacaaatataacctcttcttctaaaatagaactagaaagtcttacgttgcagttaaactaaagtaaccaagagtcaaaagataagacgcaacagtgttaattattttgtttttcctctgtcacatttagtcgcgtaaactatgcaccgaacaagactaaaattcacgagaggcatgggtcttcccctatttaggacggtgcaagatttagataaagagagagagggacgttgctttaaggcaaaaaaagcaaatcaaatagtattttcttgttgtcaggattcatgaaccacaaaaagtggaaaaataattaaggaatgcaattggaagaatgaatatattttttgtaattccgaaaactcatgaaatataataagattttcttatagttgcgaataattaaaacctgtaaacccacagaaacagtcagccaattattttaaattttcaactttttaatttagaatactttattcaaaaaaaagtcaaaacacgttatacaatagtttttctttcaagttatagatagaatattcacatggcatgcatgtttgactttatataaataccgaagaagatggagtaagaatttgacggtagagacgaaagaaaaaaaaagaagcaaaacaaaatagagaaagagaaagaaagagagg

SEQ ID NO: 4057 - DNA, 479 bp, Arabidopsis thaliana
gaaaacagagcaaatcgcatcagcgtctagccaacgccgcgtaacagacaactacttccatattactactcttctaattagcccaaattaaatgagcctattgggcttcttgtcttagtcggtgtagagcccaattgttgttttattttttaataatgcaaaagtattaagcgataaataaataagcatcgcaatcgtcccaaaactgtgtgtatgcatcagacatgagcatatagagtaagcacgtgtccacactttttcacaaagttatctaaaaacaaaaaacaattaattagcattcgacgtgtacatatcactcgccacgtgtacaagagccttggcctttttgcttcttcttcttgtctattaatatcatctcctgattatactctcttttgaccaagctgcttcttctccatctatccaacatctcaaatctcagtaatcttgttccttcgattctgttttggacgtttgta

SEQ ID NO: 4058 - DNA, 2000 bp, Arabidopsis thaliana
gttcagaaaattatggaaatcgttgtaacccaaacctgtgatagtaaaaactgtaggcgatacctgaatcgggaaaagtttactttataatacttcggtttatttctaccgaaactgatcaaatcagccgaatgagtacaataaaaagaaagtaaaaaattatgaaaatcgccgtactatttaaaattttcaccacaattagaagcaaaaatctttagtattttaccaacatatatatatatatatatataaaatctacgaaaataatactggaatgctgaaataatgggatgtagtttcgtttcttggagcaacgtacttacagagctatatttttattttagtttttgttaacaggataataacaataactttatagatatttattgtttatatattttattattgttattgctctcgttgaaaacagaataataataaaacaagcctttttcttgttaacgacttgacgtattttttttctcttttcctattaattatcgtcacgttttattacgtttctctcattgatatttgtggaatctgaatcgtattagtcgactccaactcttaacaggataatgatgtttgaaaagtaaaatacacacttttttggtccaagcaggaatattttgttacgtaattaattttacatgtatgtcaagtggatatagtttacttacaagtctaaacacattatatccgtggtacaatatttcaacaattaatattcaatttttaatttgcatgtgttgtcctactttaatattgatatatcagtgtataggaaaaacttcaattaccaaaaccacaaaagaatgaaaaatcatacatcaaaaatcaaaaacctaaatatattggaaagtcaattatattaaaggtagatatttacttgttgttgttgttgcattgcaacttttcaacgcgtaaacaataactgagtagcagtgagcatatttggttattagtcttatcagaaccaaaaacatatatggttattgtcttttaaagatatggacccatgaactatacaaaagtgactatttggtagatatacacaaataacgtgacaccaactgagaaaaccatatgacaaaacaacacatataaatttaaaaaattggcttcgactagttgtagatattttgttccataatcgtattagaacgagagtaaacaataattgaatcgagtggtgagcaaatatggttatatattataacgattttaaagatttggatccatattcttaattagggaggttggtgggttcgattggtgtcggtctagtactcacaataattgtttcatctcaatatgattctgaaataaaatgttgaatattgcttacggtgttaaaagtatatgggactagatatggcatataacgtaacacttatacataacatcaataaatttagacaatacaaaggacagaattagtaagataaaattcacaagtaacatgacgttggctattttgtatgaacacacggcccaaatcgttcatattctaaaaggtataatacatttcgagatattttgcttcggttgcaagattttcacaacacattgagtcattgacagcgatatgagaaaatgtaacaatctctctaataagaaaggagaatcttataatttaacataaaaataaatataatattcgaggataatactataacaagaaagagaagacttatatgatgatgggcaaattgtatattcaactataaggacttaaggagacgccacataaagcagaaagagtttagaagaaaacgtttgttgaccaatgacttgatgactcagtagcatgtgaacataaaaagagacgtgcaagaatctcattggctgcagataacatctatttttgcttcactacctcaacttctctatataatgaagtaaacacccccaatggtctctttaacttaagtgtttctgtttaactccttgagagaaaataacttttaaactttagcttctaagagatattcagg

SEQ ID NO: 4059 - DNA, 1009 bp, Arabidopsis thaliana
tactgcataatatagttagcgatgatctttagacttattactcggattaagtagctatggtattcttgttcttcataggttgttgatgaggaatctaagaatatggacctcctcgactctcagctcagtgatgatgatggcagagagagaagctgacacaggagttgagagacgactcaatgttgtgataatggctgttttttttctttctaagtactaatttttaaccgtacatattggtgaaaggcagagttaactgatgcatgcaggaccctgcggaagtgtgttttcgaattgcaggttttaaatgctgcatgcagaagctgtgcgagtatttactctgttttttttttttttttttctttcttcatgttttttggttccatggagtatatgtaaaaaaaaaaaccatgaatactcggttttatgtgggtattatgttgtaactctcacaactcttgttaaagcttttggcaatttgtacagtaagaaaaaaagaattgtctctcaagtcttttttgtcttattttttggacagaagtctgtcttgcaaaaaaaaaaaaaaaacagaggcacaacatttgaaaagatgaagatatacatctgaaactgaaattagttatgtcggtaccaatgaaattttgcgttaagctttacaattattttatgataagacttgcaatatatataaataaaaaaactagtgaaattatctatgatcgacatgaaattttgtcatgttccaatgaattagatatggtaaagctgacgtggtatcctaagtggggtggatttgaattggagttgattccaacggtggagattcaaagattctttgattgatagtgagcgactctcgttttccaatcacgtgtaactcggctccactctaaagcacgaaatcaacacgtccacgtaacgatcatatattcatgcagtgatatagtcgtttaacagaaagatcactccgtcaatctttccaccactgtgactaaatctaaacaatttc

SEQ ID NO: 4060 - DNA, 2000 bp, Arabidopsis thaliana
tagattccctcttggtgctaaagccgagtacatctacgtaccatttaaaatgatcatggcatgcattggtttatcaaaaaagagcttgatttcttatccttgtattatgtctatcttttggcagcctaatgttggatcggtttctagtagaatttaaagggcatagcaaaaaagatgaaagaggtgaaacatcaaattgtacaaaatcataaccaatcaatatttacaatatgacgcttcttgactcttcacactctttctctcttatgtatggttggttatgtgacaacaatttgctttacatgtttcctcatccgttgtatcttggtagagacacacacacatacacatgtttatcttgatatctattaatccttaccttcttggtttaaattttagactggacaactaaccaaaggtttattcatttaatatggtttagatatgcttcgctgctttctacgaggaagaaacccatgatatgatggatcatccaatccttaatctcatatattacctggtaagctctctcttaaactaatcataaaaattgatcatgaacatctgtctcatacataatcaaaccattgtttctgcttgaaacctaatcttgttgctcaattacagttggtagagatattaccgtttctctggttctgcccaccttgagaaacctgccaccaaaacgacgtgtacacgaaagttaatgatccttagaccagtttaatcccataatttctctgaagaatctcaagctttctatctcatttggatgttagcttcaataatctaagctttaaatcttgatggtctaatctccatttacatgcttttgaataaatctgtttgacacaattttttcaagtctaatgcggttaattaattgattgaccccatctgttttgacataatttcttcatgtcttttaggttttttaaccaattatgatacaaattttaaatattgctaccccaatgtctttgtttgtaactttgtgttaaaggccggatctaccaagatagccctgtctaaatttgatttatgttagtcatgtaggtgatgtatgatatcttataatggtcatgtaggtgatgtatgatatcttataattaatcatgttggaaatcacccccacaataatatatgtaaatatatatcttaattatatcttaaaatatacaattatggtaatcaaacttaacctactaaaagaaaaacattagatgataataatggcatctttgtaatatttgataaaaataaaagttgttatagtctatttatttgtgaagatgtataaaatattgacatttctcttctctatatacgattttcatgtatcttctcctcatacttaatttgattataagtttaaacacttgctgcaattacaaggaaagaagttgacaaagtggaatggtcaatccctattggcaaaaatagatattttatatccagaacatccaaaatggaattcataagtttccgattaaattttgagtgttgacaaaaatagatatttttctatataaaaaaaaaaaattggtatctatccaaaacactacttgtaccaaaatattatatatatatatatatatatatatatatatactatgtattgatgagtatactaatgaatctaattaatttgtttttccttgcaacttgttttagaaaataaattatcaaaaggataggttcgagacgttgactttgattgagacctttactcagtattattatgggtatccattgactttaaacatatcgaccgttgaaaagtcaaaacttaaatgtgaactacgtcattcaaaatttcttctttcttttcagcatagaagtttattcgttaaatcaaaagaaaaactcaatttttctattgaatattatttgattaatttcatggcttaaggaaatatagaatccttctccttctcaaattctcctataaatcaacccttcacgtcaaaactagcttgctacacttaacatatcaacca

SEQ ID NO: 4061 - DNA, 2000 bp, Arabidopsis thaliana
tggattagactagaatcaaaaggtcaactactatgattcccgtgaaataataatcaaatatgagtgatccaaatttctatataattgcacatcattgatttgtggatctatcaagtgttatcttttacttatattttcagttagatctgacaacaattttcgtacttattctattaaagttggacctcgcaacaacctttcatatcaacgttgaagttttatagttaattattagttcttgattttaaaatgtgtcaaatgatataatgattagttcaaagttcaaaccactgatcaaagattacttactcacgttgcacaaaatccaccttgaaacatcatagtctcgatgtcacatcccaacaactagttaatgttttaacaaaaaaaacaaaaactagttagtgtacttcaaaagtatatattggtataactgattagacgaatatgtaagaaaagttgactacaagagtatggaagccgtggtaagacttccaatgaaataaaagcaatcaaagcacactgttttttacctattttatttatttatttattttgtttgcaactaaacgtcatcaatttaaaaattgttaaatacatcaaatatgttttctttataaatatcaaatttggtcagatatattttctttttcaaatttagcttcataaacatcaaattttacttttggttttgtctctttagtttgttgggcttttggagtaaagagttcaagtccaacaactaagtcgataaacagccaaatcctcgtagataaacaggatccagctacatatgtcgattcacatgcatcttttaatattcgtcctcggtgaatctttagatcaacggttactttattactaattgtcattagcacctcttattttagcataaccaaatcaaacacctttaattatctttctaatatcactaccctagtttatattttaagatccactgagaccttaaagctgaaacaatgtttttaatcgagggagtgattagagatttaatcaaatggatttagactgaaccaccaaattgaatattgaatctagtgatgtttttggctttattttcacatatccaaaatcaaacatcaaccaaaaccaaatttaataaacctaactatttttttttttcaaaatcgacaatctgatatttagagtatgaacacaagtttcaaataaaaaaagaaagagtatgaactcaattttataagaaaactccaaatcatcttattgaccaaagtgtttgtattcacacttgtatctttcttgttttgagtaggagttctttcttgttatctttctggtaatgtcaattccgtaatatcggataaaaaacaaaaagagtccactaaagttttggtggatgattaacacgtccttcgatattgatctatttacactttggagtcaaaacaagataatatcaaaatctgatagcacaataggccttgcggctctaactgaaatatacaaaaactcaaagggttaaactgcaaacatgagaagaaaagtgagcaacgctcctttctatttccttggatataaaagctgtacgggaccagagctctgcaagtcttttttataagctcatgctcattattactccgacaagtgccgtgtaattcctcgccctcggctactcttttctcttcttgcctctcgtctccgccgctgattcagctgccgccgacaaaggtttctcccttttttctaagtcttttatgagttttcctttcgttacaagttacaaccataacctcatctggtcacacataaactataatttcagagcatgaaaatttcgtacttgcttgcttcatctgcatatttcgatctaagcatctactagtcaatttctttcacgtatatttttaagggttttctcataaccttatacctgaagtatggatctctaaattggggatctttaggtatgtgtttggtacatctttcttgaaaaagctaaactatttttctttattaggaat

SEQ ID NO: 4062 - DNA, 2000 bp, Arabidopsis thaliana
tttattaacaaaaactatatgtgattgtaaattcttttaattggtttttcttttctaataaatccactaaatttctttgtcaataacataacttggatcgtttcatgattgtaattcaaaagtcttacaccgttacaagtcgatatttctaagtaaaaatatagtttacaaataatttatatcatgttgtataataacatattatacacatacatcaacatatttgtatattaatagttacgattttatcgcatatacatatagtacgtatactaaaaaaagtattaataatctataaactagaaaacgtatttacatagtcaatattaaagaaatgtatggaaacaagaagatttatttttataatgaatattatattatttctgatgaatttgatgatttcacttgtacgcatgtgtcatatattggtgtactaactaacaaaatcgaaatttggattacaatatgaatgagagacccctatacagctgcggctcgacagtctcctcacgatcctctctgtaagacagattggtcttcttcttaatcacttgacttctatttttattatattatctctcaaactctttaaataatttatcactcaacatttaattacaaccccatgcataaatttaacaacacagattcaatcatagtaccatacgtgtgggaaccagagcaaaacgacacaaagttaatacgtgtggaaagctttcgaaacatcttctttatttagcatataaacatttttagtagattaaaaaaatattagtattatttttaagatagatagaataatagtataagccagtgaagatgatgccaactaaatgacttacgtgctccactttggggccagctcatgctccaagtgatgaacagagagatagataaagattgcgtaagggaggctgcatggtattcatctctcgaccctacctcgtattattcatccaatggcagcgattaacctctttgcgtccacggtgttttttacaattatttattttataatcaatttagtttcaaaaatcatactatcatatcaaatgaatattttatcattgtcccatatctaccgactatacaaaactgccacacaccaaaaatctaaaataaatctaccgactacaaattatggagtatctcatttcaggtgaaaaacttcaacgttaattttgttatttatctactagtagtatttttttaggtatatataattcgtgtaattgtaacatatttattattttgcaaagtaacgaacaaaaaaaatactttgtttgtttgcaaaacttttttttttaatttcataaatgcaaactgttatttttaaaaactattcaattttaagtatttctttatctattctgaaatatccatagaaaaggtttctgaaataatgtgcacaccgtactaactctcatgtagatggcatgatcagttacagaaaaaggaaacaaataaataaatacaaccagtttaaatttactctgcactgatttatacatttccataaagatagcaggaaaatattttttgcctttttcagtaaaaaataaggcaacaaatgttccagttcacgttttgagaaaaatccaaaaaaaaaacaaaaatcagattaaggtaataataatcgaaaacgtttagaaaagtaaaaaaatcaaaaaatgatgtgaaaaaaataagtctgcctctctggaaaatgataggtgaggttaataaagcccactgttttggggtttgaccccacagaatctctattttattctgtaaaaccaaatatctttttttgtaattaattaatttatgtacattccccagctattttccagcctgtgtttcctctcccaattctttccatttttataccttctctcttcctcctttcttcttcactcatctcttcttcttcccttcaaccttcataatcagtggctccttcgcttattagtctttgtcaatcttaaatcgttgagtatccaaaaatcttaaactca

SEQ ID NO: 4063 - DNA, 2000 bp, Arabidopsis thaliana
attaaaatgcatatgtttgatagtgacccgcaccacacagctcagcatattgagacagattagtaaaagcagtccaaaccttaggcacccagtccacggttcatatcatctgaccattgagaatggtgaagagagataagatgatcgaacggtgtacaataatatgaccataaaatcgaacggtgatacggtataggatcccacgtaaaggtccaaacaaaaaaaaattaataaagaagaaaagacaaagagggtttgcgtagaaatttgatggctcgcgcatgcgacagtgttaggcacttgcatttgcctaaaaggcgataaaagcctacctcatcttatcgtatttctctttctgtttctgtcttcactcaccgatttttatgtttgtgttcaatttgaattttacaagtttggttggacttaatctttcctttaacataaacattcaatgataattttattattaatgttcatttcttgtgaagattttcattgtttctatatataatatatattttacattgagaaaaaaaaatgatgcgaattgttttgaagttgaagtggttgattaatatttttttctacaataaatcaatgaaaatttagaattgaaaaatatctagacatggaatttctcaactcaacatctagataaacatatgtaccacacattcgagcaatcgtataaaattatatacgaataaatagaattagtttctttctcggaaattctgttaatatttttaggaggattaagtgggttcgaaatttaatcacttcctgcacaaattcatctcaatgtattaattggtgatatgtcatttttttattttattttttggtatgagcttccaaagttttaaggccagctctatatgtgtactattgtttctaactttattatattaaattttggtgatatgtgtttctttgtttgattgcaacccaaaatagtttaaggttcatcttagagtgcgatgactttttgtgcaaaaatattagatcatgttggtatgtacgttttgagttttatttatttgtttaccaattgaacgactctcaacaagcaattgtatgccaagatgacatattggacgtttcaagtgtgtgaattgtataaagcagtaaataaaatctactcttattaactagtttgaaagagagttttaacttcgaagaatctatcgccatgagtcaaaatcgtataaatgtgacaaatgtttatctctatcaataatagtaaaaattttaaaaggttctatataaattttaagattttgtcaggatcattaaagtgtagaactaagtcaactgattgattaatagaaaaaatcgatacaatctcacttcctttaagaaaataaaaataaaatatgctttagagaaaataaaatctcgcttatttatgagatatcatatcatttttaggtaaaaaagattagatgtccttttgagacacatcataccatatatatgaccgacaacacacataaaaccgcgtgaacaaaaaatatcatccatcaaccccttacgatgcaaatgtactgtaaaagatggttcattaatttaacatcgtattttaacgttacaattgtatggaacatggaaggttcacaatacgtggaacaaaacaataatgttacgtacggtgtaagaaaaacaaaaaaaacatagcactaaaatagttttcttttaattttcctcttcaaacttctcacgtggaggctactagtggcgaacgtcattcaaatttacccacacccaccatatattatctactcactcccttatatatacacacttccacaaataattcactacacccaaaaaagcttctaacaaagagaaagtgtctgtatgttgtgcccactctctacatttatcaatcacttcatgtgtgttaccttgattgcaaaaaagtgagaatatattctcacaacattaaatccaccccgaaatcgaagtgagtatatcacgagtgtagtaatatcttagag

SEQ ID NO: 4064 - DNA, 1551 bp, Arabidopsis thaliana
aaccgtttcagctcagttattggatattccttaccaagcaaaagcttgaatacaatgtgtgtcttaatatgtgttttgattttaccttacgtagctatttgattattttgtatggactgaaattcctttctttgtcaattaagggttttttttctgtcttgtttacctttttctataatcgcaacaaaaattatttgtgcttccactatttttttttggttttaatttgcttcatgttgacatgacattctgacggtttcttatacttgctcttgttctctctgtttcactctatctttctttagatataaaacaagagcactaactcgcttcctctctagtctttggtttgtttcttgttctaacacaaagacataaaatgagaagagagaaatatcgaggactacattttgttattgatcgtaaggatcattttacaaacaacacacaacatttttatactagttactattctactacacactcttagactcacttagacttctagatactagccactacgactagatatgattaactctagacacattttattagcaagaacttaagcagctctatattacacatccaacaaggcaacaactctaacgactcgctttactcgtatgacttggttgaatagttagcaaaaccgcttcttttattgggtcctaactaatctaatccctacataaaacacttcaacagtttgggccttgaacaaaaccgatggctcaattgacaaaacacaaacccatttggtttgttgactttgttatccacttttgactcttcttcttcttcttctttcactgtcgacctcgcgtctacttcttcttttctcttcatctttttctcactgattccctattattcgttgtaggatttaatcaaggattcaatttccaatactttcgcctcagtctctaacaaaaataaaataaaaaaatgctcaagtcctaaacaaatggcgattgtctacttaaatcgcatttttctttttcttcatttccagcgatctaataatggactttttcacgccgtcggcgatggagacgtagggtatgaactaaatggagctacgccggtgttttgaattttggctattacaacaatttgtttcaggcgtaactaatccaggatagctttttcctttaaagttcaatgggaattcaaaggtaagaaagaccagtctgtttcttccctaaaatttcgtggagaaaaagtattatagggaatttaaacgaaaatctttgtctaccagtctgtttcttctatttttcgtaactagaaagaccttcacttcactagacttggcttaacttatttcgtggtatattatcattacgcttatgactgtttactacaacgaccttgacttttcctatcatacaaatgatacaattcaaagtaaatgacagcgatcactaagtttacttcgactttttctaaataatacaataatttcttgttgaattttcataaacgtggaggtgtttgcatttttaactcatattcccacattgctttgtggattttatttcttttgca

SEQ ID NO: 4065 - DNA, 2000 bp, Arabidopsis thaliana
taattggtcttttccaagagtgaagaaagagttgataccaaattttgatcaaaggccattttggaattttgattgaacatgtttttttttttgtttttttttttgtttttttgtcaaggagtatggtatttctttaagataattgaattgctaaggaatataaaaaaagaaagaagaagaagcatgtctgattttgttttaattattttaggggtataatgcaaattttgagaatagagaaaattgattattttttctaaaatatttgtaagtaaactcattatcttcacgagggatcttaaatatttgtaagtaaacggttttgtccggcaattatttgtaagttctaaaaattatgatcacttaaaaacgaaaaggtcccactatgtgtcttctccacgcaaaagaaagtttcattttcttcattttattttttatttgtaatgcagtttcttattctaatgtaaattataaattaaatatttccatgtcccttattatactcaaatgtatataaaattttagtggccccataagaatctcttataacatgaatgataaacgatgacataaactaataaaaacattatcgtaattacctaatggttaatggtcaattttaattttatttccatacttcagatttgacatacaattctaaagttttataagattaataatctgtataatgtttcatatgattaataatgtttataggtttatacagtaaaaatgttttgacacacggattagctagcaactatgatgggtaaaccacatggtccattacattgtaaaacatatatatttgaaattgtcccttttctattcgacacttgtattacttgtaggaaattaaattttagtttaagaaatacatataaattaaattttagtttaagaaatacatataaattaataccttaagatattaaatatacatcaacattttcattagtattttcgcaaggaatcataataatagagacgaccatgtgaactaaaactcgagtaaactattcttccttttttatttttattttgtaaatccttaatctattcttcttaaaatataaaaatccacattatctgtcaatttttttttttttttggtgcaaccaattttctctcaacatttatcaaaagaatcttcttgtttggaaatcaaagaaaatcttgttttaacaattctatcatcaaacaatccgatccttcacgtgcttctatttacgtcccctatttgcttgggactagaagatatgtatttctaatttatcttcaccccaacccaatctaaccacatccacttggcacttctgagctgtcccttcccaccttgtcttaaccaataatagtggactcttcacaatttttacattttcatttttacctcactacttctctcttatttctttaaacccctcaattctttcgattggctccatcagccccatttaaaaataaaaattattaacttctaaacttttttgaatattggacaaaaacaataaataaagattattgactaactaaaaacatgattttaaatcattgtaggttgcatcttttttctcttacaaacaaatagttttggaaccatatacagtttttgagttaaaaaatagttaaaaaacgataaacatatgaatgtgaaaaataaatcaaaatgttgagtgtgtagatgaacatctagataaagaactaaaaaaattggacggctttaacaaatgtaattgactcttacaaattttattattttaattttcaccccactatttctcacttatttctttaattccctcatctcttataattgaccccactagcccattaaaaaccaaaaataactattttaaaatctttttgaaaagtggacaaaaattaattaataattaattaggaacactaattgagttttcccctttatatacaccaccatcaaatctctatctcgatcaaaacaattgtctacattcatcttcttcttcttcaaacaaaaa

SEQ ID NO: 4066 - DNA, 2000 bp, Arabidopsis thaliana
ttacatccaaaaaatgtatttatttgtgctctactcttttaaatacaacaggaggtgtgcaatatggactttctcaattatgttgtatcctacctatataatgaaataaaatccaacggaagaaggccattaattctcctccacgtgcgttatgtcttttatttgttttctatggggctctattatgtttggtcagcgcaacctaattattatttttttgtatcatcaaacagttgtgtttttattcttccacgatagttcaatcttgttttgtgtttttattcatcaaagattcaattatcttttaaacacctaattttcatacaaaatataacttttttttttataagatgataagacttttggtattccttctattataattgtgattccactcttgtgtattgtaatttaaaaacttaaaattttatattttagactaatatatcgtcaatattaaccacttcaaatatttattataaaatctacttcggcattttcaaacgtacccacttccgattctatgcagtttaacttattacactaatttttattttgatgtgtttttatttattatgaaattattacaataatctagtaaagttaaattataattcaccaaaagtttgcggttgccaaatattcttcattattattatttttcatatctcaaacaaagtagttatgcaaccttgcttaaaatatatgatcccataaattttcaaaaccggttttatatgcaaagtacatgtcaaaacgttatcttatttacatccatttactaatcaaatatctattttaccacaaaaggtgtgttttataccctatcatgttttactcttgagatatgttctttgacaccacccacaaaatatctctacgaaatacgaagccactatatgtctctttaatttcactttttatagtttttttcaccgctaaaattgttgactaaaaaatatattgcataaaaataattgataatatatttataagaaaaactatgataagaaaaaatataatcggttgaaatgagtcatgactaacaataattaaaggttaggaaattaaaagaaaataaattctgaaataactaaaaaaaaaaaaatagaagatgatgatatatggatccctatactaatattttggaagtacattgaaaaactaactttcaaagacccaattaattaagctcattaaggataaacatgttaaatactaacttatggacattaattaaattaaaaattataaaacgaaaataaattgatgacaaaaaaaaaactatgaattttcttattaggatttgtaatctactttcttgaaaaaaattgaagtttactgacggcttcctttttttggaaactccaaaataacaaaacatatgaagaagttttggaatagcctttgactcaacaactttaacaatagaaagaaaacatgtttaattaatgttcatgcacttcgtctcggctgccccttgtggcctgtggggttgccgggttggcttagcttgagacgacccaatactgaatttgttagctcggtcagtgaagtctacatgcatgatacaaaaagattgactagtgtttaagttttttttttttttttttttttttttcataaatggtagtgtctcatattagaaatggtagtttgaaaagtattcagtttgtttgttcactttggattatttgattttggttttgttaattgaatcagttttgtttgaaaagtattcacttttgaaaagtgttcactttaaaaagttttgtttgaaaagtgttcactttgaaaagtattctttgagaagtgctcagttttggtttgtccacttacgattattattcacaagctacagcggatagtagtgactagtgacttatgactttgaataaagaatttccctctaaaggaatgaatacattataaatagattattaacctaagcttgatagagaagacagaacaaaaaaaaacacaagaacagggcaaggaaa

SEQ ID NO: 4067 - DNA, 1596 bp, Arabidopsis thaliana
aattagggttttatcagattaaagagatttactgatttcaatccatttcatgtaactgatgaatccatgtgttcttaatcataacagtttgagcaatttcttttgagtcatgatcgtttatttgtcatcaatttttggaaaagtctgctatattgaatctgttattgtagttcaatcgcataacagaatcattaatctaatcaatattcatacatgatttgttacaccgtttttcgtattttgtataaagtttcgagctgtattattaaggtggaagaagagattaggaatccgataagtacttaaattgttttaagttatgattcgattatacgtatctcttgaaaagaagcatgttagagcaaaatatcaaacttgacaattacaagattgctttatagataaagcagattagctaaataagtatagggagacgataacatgtggtgatacaaagatgtgtcagattgattgtttaacatcatttagttgagaaaactttggacgacgactgacttcatcatatgagaaaacaccaagaaaatgtactactagtctctaatggagagacttggttatagaagttcattgtttaatttgaatatttactccaattcaggaaaatatcaaaaccagaaaattacatgaaaattactatagatggtagctttgcaatgattattgtccggttggatagtttcattgacatttaggattcagattatctcttttatcattatcagtttgttaaggcaagagttttctaatacatgcttaagtcctaatcatcagatatttcttcttcaaaccttttttgttttgttttgataatttgccccattttgtactctaggtttttccacaaagatcccaaacagagattaaaagatgacaatggcatggacctttcaatgctttgtttttttgttaaattagatataaacctttccaaacagtaaattatcaaattcattaacaagtatctatatctctctagtagaggtagaccacaacttaaaaatctcctcaagtcatggtgggtctaacttgtaggacttatatgggccaaattgtataactatatcatgttaagctgaaactgaaagtaattggttccttttaaaagcttagccaaaaaaacttcaaaatgtctgagtcaaatgtaggttgatttctctgcaatttccatgaaagatagatagataaactcttaccaaagtttctgcatatcaaaagttgtcaatttatgctcaagtctaaaccattccgattacataggatcacatgctttgattcgcattttcttctactatatatttacatatttttttgtcctctacacacaatgattaaaaaatgagaatggacctacctttcacagcatttctttattattattttataaaaccagtacaattttactaaattatgatgttaaagtaagagactttgaagaagacgacttagcaaagaccaaaaccaagaaattacataggaacaagccaagaagatacatagataatttctttttgcttgtaatatatttacaacttcataaacatcatcgttctgcaactctctactcgatatccaatc

SEQ ID NO: 4068 - DNA, 1717 bp, Arabidopsis thaliana
attaaataactcaaaagctgagttgcttaatagaggaattgatgtagaagaaatcaggaagattataactatgaaaaaaagtactactgaatgatagattctccacgttgcgggacatggcgaacttgatccacttgtcgaagtggggaacagtgtgctggttgctggttttgagatgaaactttatcatcttgagagctgtgtagcgagttagggtttcgtttatcgaagcagcatgcagtgtatcactatcatcaaaggaaagagaaggtatatcggaccatacatgcctccatcgtttttacaagacggaagttgtgatcgagagtttggtcggaacaaataataggatttgttggaggatctcatcaggcaataagctgattaggtcaatattccggcgatgacgaccacgatcgttacagtggataggaagactggaagtggctgtggagctctctcgggccatcttactttattaacctaacttgtgatcttcttaattagggtttaaatcttaattttagccgcatattgttttctatatataataacattctttcaaaatacatgtcaaacaatttatagcaaatttaattaactattttttttaaaaagtcttccctaataagtgctcttagaacaataaatcggcatttaaaaaaaaaaattggcattttatttttttcgtttttttaaacttattatatggtgtagtcgggctatactggacttttgcaaaaatgtggtttttatattttatattgtattaggtttctgttaaaattaaatgagaattttaattaaaaagagaaattatttgttaaaaaaaatcaggatggggtcctaattattatatgttttgattttctatgagaaagttgcaccgtccattgtttcttgaaaactattatctgactaaaagaacagaaaatgtaaagaaaagacaaagagacacagagacgactctgttaaataactctatagcagagtctctcgagttaaatcaataaaataaagacctgaaaacatatatttcttcgaagcagtgtctaaaaccaatgtacaatttatgacaaaaggaacatgttattttagtcgcatataattacaaaataatcgcatgatttatctaagttggtctttattaactcttaacaaaaaaataatataagaaaacagagtcagaatttaaaaaccacttaattagtccttcaagaacaattatcaaaaccttaataatgttttcatccaataacatcctcgaagtctcctctaaatcattggatccaacgaaattcatgtttatctaaactaactcgaataaagaaacgattataataattgcacactatgaaaaatatcagaagcgtcatagaaattgtcggctacctccatgcacggaaccttcacgaaacagttggtccctcacacacttcatcgccacgctataccacgtgtcaattttacatacaccaaaacatatctactaatcatacctcttcacgtgtaacaaagtcccattcaacgtggcaattacagaccccaaaattatgaactaatcaaacctcttcacgtgtcgcaaacttgtagaacgttgaaaccccccactcacacgaagtgtatatatcctcttcacaacacaaacataaacattacttcaaacaaagacttgaaagaactatctttgttttcactcatatcttatctttattaa

SEQ ID NO: 4069 - DNA, 2000 bp, Arabidopsis thaliana
tggtaaaatactgtgttagtagatctggaccacctggcaacgtctttgcttgcgtaagcagatccacgtcagattttttcttcaaagcttttttacattcacctttaagcaaaagcaaaactcctaaaagatgcatcaaatctaaagattaatttttggtaaaagattccattaaatttttgtcatttttagataatgtaaaattttttattaattaattcgaattggagtacagatggtttagtactgtttaattatagaaagagattagttaacacgcttttggaatattttaatttcaagtgtatcaaaactttattcatattaaccaaaaaaaactttatttcatgcattgaccccaaaaagaattcctctatcattcacattatgtttgaccgacaaatccaagagctttttttggacactacacattgacacgtggaaatgatattcgaataatgatttttttttgcaaattactatttcctcagtttctttttaagtgatgtttaaggttattacacacagattaaaaaaatatataatttttctcttttctatacaaatattattaaatagaatgaatttaaccaataaaaataattgttcaaaaattattaaatatatttaatatttgcataaaaagttaaaaacatcacttaaaatgaaacaattttttttgaactaaaacatcatttaaaaataaagaaagagagtatcataaagcattgtttaccagaacaatcactaaaaatagattatcaaatgagtaaaatgtgttatttattcgtccattttatggaattgtaaaatttgttaacacaaatcatgattccactaaaagttgtcatagaagaaaggcaaaaaaaaaaaaaattataattgtaaacatgtaatatacggggtagtgttgaaatcatccattatgagttgatgaagttaaaatacatatcatggtcatcagtcatcactcatcacaatttaagtttacattttactttttcagtgagacaagttacggttgtgccgctcagattactaaaattgtactataacaattcttttgtcggcaattgaatagcattaaaagtttaatgtccgtattttgcaacttgatacatatatatctccaagtgatttatataaatatcctaaggttttaacacgaagcatgtgaatagtataaacacgacaaaaagaagcattcaatagtaatcttttgactatttcaaactcttcttatatatagatttgtcaaccatattatctatccatgccatcgatgcattatgatatttatggataaaaaagatcatggactaaaaaagtagtaaacgtagtttatagattatgtttgagtgcatattattttatttgctatcatatttatactttcaatcttttctttgtcaacaattctatctttgctttacactctttagtatcttatcatctttggtttaatattttatcaaaatccataaattgaacatacgagttttattcagtttgtcgctttgaagtttggatgattcaatcaaaacacttaagtagagattaaaactcttaaaactccatctaaatcaaagattaacgacccttaaatgatgtgactctactttttgtcaacttcaaagcacccaccgaaactttccatcattttgcaacttacaaagactagcgtgtggtttttacgattagaaaacggcgtgtagtttatatttataattcaaacacggaaaccatttcacgagctgcactccaaaagtacacgcgtcatcgttaaccaatcagaaacgtcaagtgagatcatcagtccagtgattagcttccacgtggaacatcgacgtatctattttcgcgcctttgtaacagcttcatcttcccaaatccaaaacaaacatttttagtttgcgattctcggattcgatcagtgaaattcgaatcgaagcgccgccggaagaatcatcgccggtgtgggagcgtttcccggagcggcg

SEQ ID NO: 4070 - DNA, 1684 bp, Arabidopsis thaliana
gttttctttctcaaggtgtctatctatctagttcataagctccctcacaaacgcttgtaggcgacatatcatgatcatgacccaagtaaaatctttgcataagcatccttcgcaaatttctaacgttttggctgcagaacaggacgacttctatcatgaacaactcaaactctcattgaggtgcctgaaataggagaagagtaactttactcaagtagtcaaacatattcaagaacaaaaaaaccaaaatagcatacggctaaaactcagaaaaccatactatttaaggaacattttcggtatacaaaccaataaaactctttactctagcagggacagatcatccagtacaaatatctgactgtgcatactttccaacatgaaactagctaaaatgactactttctagtctcttcaagtttaaactaacaggaatcgctgaaactaaaatcgatcaacttcaccaaactattagcaaacccatcgtaactttgagagagtgtaaatcaacagatcaaaacatagaactaaatccaaaattcaatcaagtccgtgaaacaattccaaacctcaaaaaggaaacaaataagcgtcatttcgaaccaaaaactgagctaaaaacctctacccaaccaaaaaacaaaagccgatcaagccatcaaaaccactgaaactctagaaaatgcaagatctgagtatcattacccgaaattcaggtggaaacacatcggatccagagattttcgataataatgatcaaaattcaaaaacagcatacacctaaaaggaagacgagtaagcaaagaaggagagaagtagagaaaaaggtttataccaggaaaggcggcaccagagactgtgaagcgtcctcggtttgacgatcgatgagtaggagaagaagccaagtccttccttaaaatctctcttctaattttgacaattcgaaaaacaaaactatattctcgagaaaaaaactattatgcctaccaataaaataattgttatctacttacattatttaaaattctgaaaagcaaataaaatatcatataaaacataagaagctttcgtcatctccatagttagtcttttgtaatattaccactctgatccaataaagttttatttcttactaattagtttacacttgagaattttggtttctactaaattttttaaaatttggagttaaaatagtttagttttatttttgggggaaataaaaagagaagctttattccaattttccaaatattccaggtgtaatctaactgtcaaggccataataataaatacataattccacctgacgccaataataaattacatattttccttttttttttatttttttttctaatttatttccaaaattagccgcaaaatcacaaaacctaacagagctcaacactacacactgtttcaaaatcagactactatgctcagctcagccgccaccgccacctccgtgagtgctcgctccggcgatattctctgcggcttgtttcgcaaaaaatccgtcgcgccttttcgttttactcagcctgtgagttctcctctgtgtgtggacgtgttcctttgtgtctttgtttcatgttctgctaaactttttaatattagtggaattttcaatgagcaggtctatcgtacgtcgctgtgtccaagtttcgttgctgttcgagcc

SEQ ID NO: 4071 - DNA, 2000 bp, Arabidopsis thaliana
cgttaatcacataaattgtttgtacggtttcgtaacatttcaaaatgcttaacattagaatcttgtttcatcgatcttttattatagtaacaagcgattgttttttttgttttgagtacatttgaaagtaacggaaacttagtaaaacgaattcacgaagagaaaatgaaaagtgattaagtcatctcctcaacaagcgattgttataaagtaataaaattatttagatgaattggttgttttaaaataaaaggttgaaaatgttgaataactatttattttatttttacgatttgaaatgaataggttggaaaattgattcaactcattcaacaaaaaaaaaagaaaaatgaacaaattataaaagaaacttgttcaaccatttcatctactcttttgtagatgaatgagttgaataatgttcaacttggttttgctgaaaatggttgcatagagatgaaataattggaaattttgagttgaaaaataaaagttgaatattattcaactcatttctctgtgaaatagaagatatacaagttgaaaaaatttctttataattagtttatttttccaactttttaagttgaaagggttgaatcatttttccaacttattcatcttaaatggtaaaaaaaatagataaatgctcattcaactctttcaacttcttaattttaggcaaccatttgcacctatttttccaatcattcaactatatgtcattcatttggagcaattatatttcttaaatctatatatttatttttatttctgctataattcaaactgtcaaaccattaccaataagatgtggagctaattcaacataagtatataaagtatatgaaatgtatagatctttccacttattttcaaatgattaaaattgtacatggtgttagagcccgaacaaacccaagataaatgagcataaagatgatctcacttctaaaaccatttttgaaccaccatttctactgcattgccatttttcttaccgccttttttttttattttgattttcataaccgctaaaaaacttttcaccacatcattatattatttggtccaaccaaaccaatggtccaagatggtgccttttttttttgggctcaaagatacaaatcctctcttttgatttcttctctcagcccatgacgtgtaatgaatgaagaaaaaatcaataacttacatcacaatcatatatcaatttcatgaatccttgaaaccaaatacataccataccgacctctgtttaaaagacttatcttttctccaacaaatgcgacaaaaccgtgtggacgaatcagagagacacatgtataccaatgccgacttctttttatgcaatcgtagcgtctctctcacgtggtaaacgcgtcgccatttttataatacgaccacgtttgtgactccattaatggcggtctcatgctccctcaattcttcatgatctaactactaagagatctgattcactttcttcacactctccgagtctcatcttcgcttcttccctagctcttatctggttagttcctctctttctctctctctggttagctaattttgctttgttcagatttacagagattttgcttatctagctttgaatcagtcttgggaacatagacaaaatcagaattcgacctttcaaattaatgggtctgattgggtttatcgagttcatcacccgttttcccagtcatctataaagtttgagtttttaattcggttatatactctgttttgatacggagatatctaattgctccaaccatttagctttctagatctcatgagatgtttgcttttcattgtacagtttaaattaatgttaagctaaagagtgaattttgatgtggagctatttggctgaatataatgctgaaacatttgtgaagatttagatgtttgattgattagaattcttgtgcaaagtctgatggcttcttgatgctaaagagttatgtgtattaattttgatgcaggacaca

SEQ ID NO: 4072 - DNA, 358 bp, Arabidopsis thaliana
taattctgtgtacctgattctcttacagatgttcagatcctttgtccttgacaaagattttgacgtgtcacttgcttatgagtctgagggtattctaccaccaggaaccacctcccctgtgtttgcacagtattctgtctctggtttggcggatgcatctgagaagtaagagcttaaagtttgttctctgaatgttctgtttatctttctgtttggagagatatatgttttcttaatatggaaaatcttcgaataagttgataaatgtaagttcattgatatggacagatattcttctcggaatctatcagcacctatcaaggcaaatctgcatttctctctaagtagaagtgggatt

SEQ ID NO: 4073 - DNA, 1838 bp, Arabidopsis thaliana
aattttcacaatcacaacagcaagaaagaagttggccaaatcttttgagcagggtatcttttgtttcttttgttttgtattgtttagagtatgtttcaagatctgaagaaggaagcaaaaatatgtttagatataaaaagaaatgaagatttggaagcaaaataatggggagaaagataagattttttgcttgttcccgacttgtcaacacgacgttgtcacgacttcttcaacgaagactagatgggtccaaagcatttgatttttatttgtttccggccaatcatgaagcgacagtgtatgtaattgtcaccattttgagtagtttcttgggagaagctgcaacttcggagataagtgcatacattacacatttttcataacgtgtagaagaagtaaagattgcatgtaaattacattagtatattcataacggcggagacttatctgcttctgatagctcaagttctggaagataaagtttacacggataactaacttgtatttcgaaactctataattattatgtaatcaaattcataaagttgcatgtatttttataattttggatttgtgacaacattattaaacacttaaacgaacgatcatatagtattcaagaaattcacattcaattaaaactctactgaagaacattaaacctgataaaacaaaataggtttattgaaagtactctacaccccaaatatggtgataatgttcgtattataaccttttgtttcagtttcactttcaattaaaagcattatacattcatttattagaaaactagtgtaaccattgtatttaatcaatatcggtctggtatacacctgagctggttatctgcgatttaagaggaattggtgaagaagacttgaagtagaggagagggcttcaattcaaaggagagcaaagtaaaaaaaaaaaaaaaaaaactttgaacaagtcagagggtttgttgttacatctgataacagataaacagtgtataaatactctgttcttcacttatacttcttctatgttgtatccaagagttcattgagcctaatctctctcgattcttgcttgctgttcatgaaatttgagatgtaacaaaccttctctgatagtggatttttgaacagaatttgatctaggcttaatggcttatgatccaatcaaactagctagtatgttcttttcgaatatgtttcatcagtctttcttgtgcgatttcgttctataaatcaattgcgatttattctgtctttgagagattatgagtttgcaacgaaactaagatatgtttagtccatggttgaatctaacacaatcaaataatctctatagaaagcaatatatgtgtgagaaaagaaatgtcatattatatttgtcttgacacacctttgtggactaaaccaaaactttaaaaaaaaaaaagtagtactttgtcggttcacaataacaaaaaaaattgagattcgtcgttgttaatttatgggataagaaaggagcctaaaaaaaaaagattgagagagaaaagacaaaagatcataatttcgtgtaacacgaagaagcaataattaatcatcccttaaaaaatggccacaataataaaagagaagtagacccacccaccacaatatcagtagtgcttgtccaaatcacaaaagttattcaaatctttcatttgttttaagtttgaaccaaattcacgtaaagtttacaaaaggcaccgagacaaaaccgcacacgcatctttttaccctaccaccactattgaaatcttcccattttcttctgctctaaacaaacaatagcttggtcttgaggcaaagcaaaaaaaaggaaag

SEQ ID NO: 4074 - DNA, 1634 bp, Arabidopsis thaliana
gttttcccgctaaaaccgtaaaatatttttttcaccaaaaccgtaaaattatttttacctactaaaatgtggacgaactacaaaataatcaaacaaataaaaatccatttaaatgcatcatttagattaaatctcaaatggttaaacaaatactagaaacatcattcaaatgcatcatttaaatgaatcatgtaaatggatcatttgaatgaaaatgctaaatgatgaaacaaacagagcctaagtcgagaaattgtttttcacttacggacgatataaccaaaactatcatgaccttcaataatgtagaatatactgttacgtacttggtcttggtgtcaggtcttgtgcaacatctgatcttggtcgagataggagatttgttcccttgttctgtgtactttgtggaaggtttttatatgtatgacaaaaaaaagaaaacaaaacaaaacaaaactacgtacccttacgaaaggaggaaaccatgctgaaccaataataaaaaaataaaattaaaaaaaaaatgaaatccctaaagcttctcattagagtttgaagtcatctacctccatatataacatcatcctataccaagaacgatgttagtatttaatacgactttctatggaatggtttggagcttatattatatgtctcgaatttcaataaataaatagaaagatatacaataagacggctagaaagtgggtataactttaatttggtgatgatgatggcttgtttataaaatatatggtgggaaacaaactagtttgattaggtaaggctgtcgtattatcgattgtagactatttagctgaaaccaccaatattattaacgtaaagtttgttagttaaggtaactgtccccaataatgtttactagctaacctaatgattccctatactttttgtttgatttatttggttttgtaatttttgacaaaccagcaaggtattaaccattttacgatcatggacatggtataatatatctacacaagccaatagtaacgttgaatacttgaattccatattttccacactagtcttgtttggtgcaacattaatgttattttgtttggactgcaacttgcatgttggatgagtataatgtcctttgttcaaatttgtttttgtgattatttacaatatcaaataatcttggatgttggcctattgggttgtaaaacaaaaagtttgaagaaaacagaagaatcctactagataaagcaatttatttgtttttgtaaatgaaaaaaggctcacaaagaaaaatgatgttagtgaatccatcaaatttatgtcgttacgatttgattaaataattgttaggcatcgaatgattgcaccaaataatttgacattacgaaattaacaaaagagtttattgagatacgacgacttcgttggtcaaacctcaagtagttgactttcttaagttcaacgctgtttccttcaactattatgtaatcatcatcatccaaaaactactaatttcccattaagaaaaccaaatttgtaaccaatcaaaacaactcagacttggaacaattcaaagtcagacaaaccttatatgcaatgtgatcaaaactccaaacacacaagattgctaaatcaaagagacaaactca

SEQ ID NO: 4075 - DNA, 2000 bp, Arabidopsis thaliana
aaatcatacgatgccttcctgttctacacgaggactggacaacacatgtcaatacacatctaaactataaaagaaaattttgacaaaatatatataatatactgtatatgaaaggcaaaacatagttatctatataatattttttcaacccagtaggtcaaaatgtatttagatcaatttgatattcgtttatttaataatttttatctattaaattttttgataggtctattcaaacaaaatttgattttaaatccgttttcaaaaacttttacaccgaatatttttatatttaaaatataaatatttctaaaatttggttaaaatttaaaactatgaatatacttgtttgatttttaaatattttaaatcatattgtaattttaaatattttaaaaacagacatatattactccgattaacaaaaaatatgtgggtttaatatcatatatataaagtaaaaaatttagacaattattcaaaatcatatcataattaatattaacattaataaaagaaataagttttttaacgggacaaatttgacagaatattacttaataacaattgtaaattataaaatataaatagtttagaaaaaaatacaatttgcaaacttttatatatactaacttaaaaaaaaaatcgtttcacggtgtatcgcgggataaaatctagtttatccagtaaaatattgttagaattgcaaaaaaaaagttttttccaaattatttgcttctattatctttatgaaataatataaaaaatagtgaaacatttaagaatctgaaattagctttaattacaaaaactaacccttgttttcaaaaatttgaaaaaatacttttagtaagtaataagacaatacacatttgataaaatttgagaaatgcaattactaaatagacaatttttctgaaacgttatatattttagaataaaacaagcttattttaacggtaatatatgttaagatgtacacaagtcatggatatacatcgattttactttgaatccttctaagttcatcatcactagtcttacgaataaacttctatacatcactagatatacatacgacatggatatatatatcaatattacgtatgcactcaaaacttctatatacccttaatacgtcacggcaatgtatgtaattctttcgaggtttgaaaaaaaaaaaaaaactttattttattctttctcacttcaaacgtttgatgaatcacgtcgttctttttatatatatataagaaaacgtcgatcttaagacttatgtacgaattatataacaaacttttgcaggatttactgagttaaagtagtttacactatatttacaaagattgttgtgacttctctgatatcaaattaaattaaagttataagtaactttttatgaaagagaataaaagcttacaacaagaaagtagctagcaaaactaattaaatttggctaataatagtttattattcatatcaatagttatttttcaactcttctttaacttgtataactattgatatttattagtataattattattcaatatttgaattctagttcttaaaaagaaagattacgtttaattccaaaaaataaatttaggatattacttttcttagtacacaaaatagaatcaaaaatataactactatcataggtcggctaaaatgatgttcgtggtcatagttaatggaagtgtttttttttggatatactatactgtgtatttttatgaagaaaaatcaatatataataacgacttaaaagaaaaaaaaacaagatatatttccaaaactaaccatataggatcggattattacttttcaaagtacacaaacaacgaataaaattgacgtcctgcactattgacagaaaacgatgggttccaaaactgtcgctaataaactcttccaattaaccctataaatagcatgcagaatatgagttaaaaatcaccaatcaaacactttcttacatgagcaatattcaagaa

SEQ ID NO: 4076 - DNA, 2000 bp, Arabidopsis thaliana
ttccattgaaacaattttttctatatcctcatcaaatacatttttaaaatatgttgacaaaaaaaaaaagagaaaaatgcgtactataaatttatgagatctcagtctattaaacaaagaaaaatgttacatctccaactttacaaaaagctgattttatttcttctcatatttttctactggaaatgcaggtgtgttaatgataagtatgtgtagtaaaaattcaaacacaaaaatgatttatgataatgcattgtagattcacatattataaaggtgtaataattgaacaaattaggctcaatcctagtaacggaagcacttgctcttcgcaatgcccttaaaatggcagccgatcaatcggatatagcctctttcacggtattgttggactctcaagtcttgatctcacttatcaatgctaagaaatatctttcaaatctcaaagaaaatcatccatgatattgcttcgttttgtaattctttcgcttctatctctattgcttatgtcccaaagtcgtccaatactttagccgactccttagttaagtcagtccttgtggcttttacttcctcctcccctccaagaatgtaacactctctgtcttttagcaatgcaagttcggtttgaacaaaaacaaattatcacaaaatgccaaaaaatgaaagacaattaatttataattaggctcataagtcaaatagccaataacttgccccatacctaagatagttactttaggcgaaacgacggagaatttaaggacaattgactatagaaaagactctatattatactattcacagtgtcccaaatatatataaattgcctaacacattgccaccgtcgttgacaagttttcttagattcaaaatttagtacatagtatatattatataatttataaacctaagaaatgaaggaaggtggatcttaatatgtataattaatagaggcaagacatgaaggaagatggatctttaccaaaaacagctgggcagctttgaaaatgcaatgttcgatgataataatatctcaataacaaacaacgcgtttttatctcagaagactccaatatattgacttggaaccactaaaagtcgcattattattgttttgttatatatatatataatcccaaaaagtaaacaaacaaaaaataaaatacaaactattgcggaacaatacaatatatatatatatatatatgtaattcttattgattcaattttgaaagaaatttctttgtctatatattattttgatgtttttgtgtttaacctcatgaatagagagataattctccggcttggtaaacaaatacgttggattgtttttttacaaacaaaatctcaatatatttctaactttagccctacgaaccaaactacaggtcaataaacgacgtgaaatcaagctaaatggcaaattattagaattagtccgaataataaacaaattcgtctaaaattgtagaaaattttgggatctaagaatgagactacatcatttttttttatcaacaactacatcattttaaaccaaacttagaattgttaggtctcaaacttctaacaccgatttgctgcaaaaacaattatggatcggatcaagatatagagaggatttcacatttgacttctattgcttactcattccaaaagacggtttggtctagtttttgaaatttaaccaatcttgaaaatacggaatttgtaatgtactttacaaaaattgtatatgctaattataattttgtgatctcaaatattcatgtttatatgataagataagagataacatgaatgcattattatataataccatagaagatagaatgtatacagtctcaaaataacaaaatttaatacggacccacatcccaaacctctcccactctatatatttggtctctataaaacccactaaacctaaacttttccaaaatcataccaaaaaaacatttagtaacatcaaaatttacaaaaaacaaaaaaac

SEQ ID NO: 4077 - DNA, 2000 bp, Arabidopsis thaliana
aaaaaagtagattgtatttctacatgcgataaactgaaattaaatcgaatagaaaaataaacctcaagttgcaaactacattttattcaaaaagaaaatctacatgattcaacctttacaatttgactcacaatagatttattcgaccgacctgatttgattaatcataagctacacgttagaacacaaagtcgcctctactgttgcttttgtactaatccttaaaaaaatcatatagatttaattcaccaaaattaagttaggaaagaagaggtggtggtgttgaatttgattatgttatctattgatagtattcatgtgatcagtagacgaaaaattttcaaaatattgcctgtcgacatgggaagaatcgaatgactaaaaaaataatcgatcatgttctttaatttcaaatttaattatatatctatataaatacccttaacttgtttttgacgatcctaccaagccagagaacttataactgtcatattcataccatatgctatataattagtgggatataatactctatctttaactttacgcgtaacaactttttaattaggatttaggaataagaacctttcttttgtttgttaaaaaattctttctctttctctctcaattttttcactatataaattattaagttagacgcatgtatatgtctttttactaacacgtagaccggtagacgtccatgtgctccatgcacgtgtgtaaatacatctttttttgccatgtgtgaactaatttttttaatttgccaagccaaagttataattaattaaatagcagaaagagtcttaagagaaataatatgattataatggcagaagaaaagttaagatttacagatacatccaatagtgtatagccgcttaattaatttatccacacctcaacgaaaatttccgttggtgcgctaacgaattcaggctgtgaagttaaaagaaaataaacaaaattatagcttcacataagcgatcgatcttcaaactctacacatgacagaagcaaataactaaattaaatagcgtaaattttgtaataatactagaaaacctaaaaaccaaatgtaaaaaaccttatgggaaaaaatgtgataaagcacctaaaccatagaataacttaaaatttcaatttcccaatcaaggtatgatataaaaaccatggaaaacaaattctcagccatatttctatctgaccgagtctttttcaaaataatatatagacggtagagtcttatatagtaaaaacatttttttaaaactaatttatcttctcatatgaaaatgaatgcaaataaaaatgaccatatatgctgtaatgatattcaaggaagagatatcacaacaaggtcgaagaaatatacaatatctgaaagtcgactatatggtccactttccaaattagagatggaaagaagaaacgattatgcagcaaacccattgatcggacgaagaaagaataaatatggaggcccattactatagtatttggccttgaaatattttggtccgagaaataataaataaacagttatggcttttcggatttggttgctttcaattttctcaaatgtttggacaagtgttattacactcacctaaaacaggatcattccaatttcttgggctcagagtctgtactttcttcttctttaaaccaaggtcttataagtattctctaaaccaagtcactaaacaataattggtcttgggtctggttcaaacttggatcaatgttgccacatagccattagccacacaaaacaaaaattgtcttgcctttatatggaatgaagaaaaatcgaattttgtaaccatttttgactttaaagtcacactcgccgtatacggcacaccaaatgaccaaaaacatttgaccaccaactttgctttaatgttaaaactttttttttgcatcccactactctcttcttcacctcctcaagtcacagtgaccaaaatcacacacttcacaagaaacaacct

SEQ ID NO: 4078 - DNA, 2000 bp, Arabidopsis thaliana
tttattgcttattttggtttccacttgtaagctttctttattcctgtggcagcctaaacgaatcctacaatagcctgaagctcatccattttctgtaaaccagagaatgtctcataattcacaccactgggcattgtcttgcaaatatggatagaccagtaaccctcattttgctaattagcaatgcatggatgtatgaaatgtttattgaatcaggttagatggttcaaagtaggttgtattgtcggtcttagtggaacttggttcgagatagacataagaaccattatatatttatctcggaggtgtattatattagaattagaatctcactctaaaagttcttggacggagctaaaataacatataagagacatgtgcaaatccattcaaaaccaataaactcttcaactgtattataaatcttacaactattaatgtctaattttagctattgccactacggtctaaaatcttcgaaaccgtgtggaccatataaccctgatgagtgggactaataagatttttaacattaccccttagaatagaaaggtcctatgctatgtattagtacaaggaaatttcagcagccacgtttttttaccacaccactgcttatactaattaggaggattacttagcttggtttaagggtttagtaagaaaagtccatcttcttcctctctgtacgccctttgaatctcatctcataaagagacaattctttctagctcccatcacccttttgctgattgctgattagttttcccttttcatatcagatattatatttcgagatttgacatatataatacaatgttttcgataaactacaaaaccaatttcgaaaaacatataagttttgctggaaaaagccgtcgttgatcaaagccacacgacaggttttatgcctaacaacgttgacccattaatgaaaggactcaaaagcaaccctcatagtcacggcaagattcaattacttttcctcggacccaaagttggttcaatttatgaaccagtttctacgtctaagtcagtcgtctcaccttataatctttaaagtctcccgctgcactaatcactccgtttcatcgttttatatatcacttgattttattttatttcataaaatatttttttttaaatacagatttttcttcaactatgttctagacttctagaagccataaaagattacaatattattaaaatgcgggacaaaactacataacgataccatttaacgtacgaaatatttctaatttacctattcgtttataaccagattttatacctgtttagatgtttactgttttaaaaactacacattcatggtcatggaggatatgatatctaaaaccttaggattcaagctttcgcgttcaagtagcaaatcaggcctcttatgtatgcatctgttccggtcttataatcgaggattcacaccaaattaaaaagcatcgatctattcgggtttcatacaatcatactcatgggttacaacagtcaacaaacacatctatctggtcatctggatctcaaactcgcacctcacaacacaatatctaaccgatccggatctcatattcaattcgtggatcacaattagacacatctaattggatctcatagtcgcggatcacaattaaattcatctatacagatatcatactcgcggaccacacatcacatgacataaaacatcacactgaaccctaaggtttagtgtagtgtgcatcagccatggccgagtcaaaatgttaagattttttttttaccatttatagtaaactaatggaagtaaaaaccagtaatgcaaagaaaattcagagaaccaaaggaaatatctatcaagacaccaaaaattctaattgattaatcatgacaacattacgtcgctacccctcgaaccaacatctataaatagaggatcggtgccattaacattcatcatcatcacccacagcacagagacacacacaaaaaacccataaaaaaat

SEQ ID NO: 4079 - DNA, 1138 bp, Arabidopsis thaliana
taaaatataccaacttaaggcagaataaacacataaacccaaagtatatgtgtcattaaggtcaaagacaaccttgtgaaatgttttgtcctaactaacaggtgaatggaaagcgcagcctggaggtaactaaatcgaagaacaaacacactaagcgaccaggttaacataaacttgtaaaggctatagatatctggttggtgagtctgagtatcaatcgtgtaatctacaaaggtggttttgttttctttccctctctagttttttctttcttaaaaaatgagggtttaggtttgttggcttgattgttgtataatttatatgtatagcgtatggtggtttctcatctcctttagttgtcacatataaaatttgggtaaaatggtttgtttataataagaaaacaaaacaaacaaacaaacaaagagagtgttggttccttatttgtttgttttcattgtgaactctagaaacccttcattctttattagtttttcattctttattaattctaaaacgcatattcaaagagacatatttgatcatcgtgtcttcataatttggttcaaagtacagccaaaaaccaggaggtacactaaaaatcaataaaattacattacaaattatttttagtacactgggaacataaataaatgaatcagagaagagaaacatggcaactaccgatcatgagcttctacatttgtctcagaaaaagaggaagatagaactattttttaaagtttttagaaaagagagaattaatattatccaagacaacacggcactgctaacaacaagttgaacctatcccattccattactccatacccattcaatgattaacacgtggttctacatcattggttaactctctcctttccccttggataaggcatcttaaaataataataaataccataaatatcttccgattttttctccgactataataatgatgacaacaatatcttttaaaattatcttaaaagaaaccgaaagctaatctccaaagggaaaaagacgtgtagcagagacctatacatacacctatacattcacgttgcgtgtgataatctactgagggttctatctatattaatccttctctgcttccttcaatctaattgcaaatcaa

SEQ ID NO: 4080 - DNA, 2000 bp, Arabidopsis thaliana
agataaaggcgaatgaccctttttacatcctttatataagggatattttgctgcatctaacatatcaaaaaacttccgtgcttctaaattaggttcctctactctatcactatccccatcaaacgagtgtacattttcacgaaaagcatcatttaccatctgaacggtacctacatttgcatctacttccggatttggttccactaacctatcaacaggataatattcgctacaactaccataattcaccattgactcattctctccatgcatgaaccaaactttgtaccccgacataaacccttccccatataagtgcatccaaacttgagatacatgaagaactccaaaattccgacatgtacaacacattttttttgattcgatggttaccggttgatttgtcgcgaatgccatgaattgtttaagaccttctgcatattccggcattagtaactccgttagcggatcacgcatgggctggtccatccatgatcgaaaataattaaacggatttgaagaagccatttctctctggttatattttgttgctgcttggacgattttgtgaatgatggtagaaaaatataaagatgagaattatcaatgttttcgacgggttttcgacggacgtccgacgggttttggcgacgaatttccgacggaaattttgaatatttattttttaaaataaaaaaatgcacggctatgtgaccgtgcggcgaattgaccgagtagctacttgaccgagtgtatttcgttggaattccgtcggaaaagtgcagaatattctgatgaatattctagggatcaaaacggatatattttggtcggaaatccgtcgaaacatttggtcggatttaatttggtcggatttaatttggtcggagtttcgttggaaatgactgatgaattgtcgatcatttagaattcgtcagaaaagttcgacgacattttgacggaaaacatgtcgtcagaaaaccgtcggaataccattacgaaaccgtcgaaaattttcgaccgtttatttatcgtcgaaaagtctgtcgaaaagggttttgttctcttgtagtgtaccacaacttggtttgcaacactatatatactttttgatatataaaaattctattaaactacttaaatatttcgtcatgaggttatatgcattagaaaaaaatatataacaatattgttggaagactggacaattatcgttgaaactatagctatcaccaagatacaactttttgtggaaaatcttggtggcaattagaaactgttcccaatctcgggcatgaaaatcgttattcaaatatttgtcaacaactagtgaatagtgatacagctatatatgtttgctaatttattgaattatttaatgttacgactttacgtaacaattatttaacgtctattcttgtgtacctcacatttcttatcgtcatgtctcatctcttatattattcacagtacacccatctcttctcgctcactgtggaacctgttgtcaattactcgttttgcattttattggttttcccaattactctatcaattatttatcaaaaaaaaaaaaatgaaacatttactctatatattatttccgcaaacacaaattatactcacatcaacatattcaatacatttttctagtaatgtagaacaactttacagtattctccaaaacgaaactctaattcaaaatttacaagcagataagccaaagataatagaacaacaaaacgccaaattctagttaagcacacaatctcaacgtgcactaaaaacgagtggtgtaagtgaaaaatatcgtcgattataaacattatgggaccagtagcatttgttgcaccaatcgaaaacagacaagcacacatatctcctcatttctcatctggcttcttaatcatttctcataaccccacctcattataaataccaccctttgcgtcacacatataaacatcacaaactaaacaataaaccataccataaaaaac

SEQ ID NO: 4081 - DNA, 2000 bp, Arabidopsis thaliana
atatttatttggttttagtccgtatatatgtactatatttggaaggaaattccgattatatcttgatataaactatatatttcctttatcaaaaagctctaaatttcgtccattcagacccttgtactcttatctttttttttttctttttttttgttaataacatagttaacattcgcaaactattttcccatttttctgttttctgatcaatgtgcgtatttttagtttatgaaattataaacttgccatctcaaatcgctgtcacaagatatttgaccgtcttctcattatgcaccacaacaccagtgaaatattgtgatatataatagtttttttgcaacatatacatatagactaatatttttgttttgataaattatccgaaataatatataactaatatatatctacatacatatatatttgttgtaaaaaggaatagaggattgatgtttttctttaattgatgtttccatttgaaaaaagtaaaggtatttacttttaagaaatggaatactttgtttgaaaatccaactcgaaggcaaatcaaatgaggaaacatatgtagaaaaggaagatattttggatacaattggtttaaatagctagtgaaaagcaagaaagtcatcgaataattgtttcaactttcaaaccataaattcttcacgtgtctgtttgtctgttatctctacaagtttcttatatcaaaaactctaaaaactttttttctttttctttagtaatgaaatttggattagattccaactactttaaagaacacaaagaaattttaaaaacagttcacgtcgtaaataaatcaagtatcacgacaccacaaattaatgtcacgaaaacgcgaatatagagcttcagttatccaatcctatatatataagcttcctcaaataatttttttttgggtttaaattcaagtaatatatgaaagtagataaattaaataaatacgtaataactattttttaaaactaaaaataaactgctgaataccattggggcaaagtttgttgtgctatctcaggttacgattctaccagggaagttcgatgcaggggagttcgattctaagatttccacttaaccaacaaaaaaaactatttaaagatatggtttgcgtccttatctttcaagcatatatacgacatctcaacctaaagttttaagcaattaattacaagactaaggcaaaattatcttatgtacctacaatgatatctcaaccattgataccaaaaaaaaaaacaaaaaaaatgagatctcaaccattatatgatactcaatattttgacgtcaagaaatccaaaagttctagtagtataaaagattataatattctggtgaatatagttaaaagctataaatacagttgacgcgtaattttatggaccaaaaactgatgtatttggtaactatttagtaaatgagttagatgtttcttgttcaaacacatcgtttgtattttagttgtcaaatacgtcatacaaataatgctaaattttgtcttttatttaaagaataacattttgatgcaaacatttcaaataatcaggtgttaattcttagtagctttacccgtatatcaaactcagtattcaggatcaaataaatttgatcagttcactaacaaaactactaaccgtatatgtataatacttaagaactttgaacaataaattaataatatagatcattattgctaaaatattactataagattctaaataccaaaaactttcatatctagcgactagcgtacttaattgaattcaaccactccaataatcttaagaagttcaaacctgcttttctcgtccgcatcttcataatctctatttatatacccaccagtggccatcaccaaacctatatttaactatctctataaaaactttcatatattcctcttctttaaattaaaacacaaacactctcttctcttcataatcctcatctcatcatcactttgtcactaaatcaga

SEQ ID NO: 4082 - DNA, 2000 bp, Arabidopsis thaliana
ataattccatggttatctttactggcttcatgcaaggattatggaataatcaaaacagctgcttattgaatgaggttggttaaattaaattacgaaaatatgacacatcattataaaagtctaagagctcatttgtttcaaatttggaaaaccatatacatcatctatattcaacatcctatatattgtttaaaactttaaactcgttcttttttttcaattttttattttttataattcggatgatttggttcaacagattttatgatctctgaaccagagcacgaagatttctttttctagctggttcttgggtcaatggaccatgagaactgactaatcccaggacgaggggaagccatgtgaaaacctctaacactcacacatttgtggagtagtttttagggtagatcaaactttggatagctcattacaactttttttagtctgatcactaccactagaccaagcttgtgtgggcaaaaagacttcgttctcaagggcggacctagtaaagaagaagggggtcacttgacccaagttgaatagtcaaattttattttttgcatagaattttgtttagaattagcagaacaattggtaaattccaaggtgttgacacccccaaaacatgagttcaaatctctataatgacacttttactcttttctcctcaatttagttttaaataaatgttttttttgtcttatatatttctttactttttccaaaataacagcaattaatatactatttttatttccttatgaaattgattttatttttgtgagtttgtataaatattataagaaagttagttataaaatactgtttataaattttttttgaccccggtaaaatttatttatgggtccgctactgctcgttcttgcctataaatgtaaattttgtttctatttgagtatgcagaaaaatacaagtactatatatataaaacactcgttttttaagtcatgtaaattatcattaatgaatgaaggaatttgtaagttaccaaaaaattgcttaaccagcgaaggggataaaccttgccaaaaaagaataaagaacaaggatatattttgcatgtcagagattaggtattaccgtattagcaagccaaagctgcattagggaaatcccaataaggtttttacgttcatgatttcttgcacgactatgatctcgtcaatatggaattatacaacgtctgctatttgaatatggctgccttaggctctctcaaatcttatctatactgcatattcgattggacgaaatggaactatgattatttgccaattttgtccatacatcaatattttcaaagtattccctggaattgtttcttattggtgttaagattttgtcattgttgaagtacttttgatgttatttttatacgtaattaatttaaatgaagtgaaaaacaagaaatgaaacttttttgtttttattcaattgtttcttttgttagtttttctatttctaaaatcttatttttcatactttggaatattttttagtttttttgttcatcaaatatcctataatttatttaaactttttaacctaatgtaataatacaaaataaattagacggtatgctgttgtaaatgttacagaattcagatcaaatttaatcaactatttttaaaaaattaacaagtaagtcatgaagaacatatagtctttttatgtttaatgcatgtatctactatctctcccacctgctttatatatgacgccacgtctatgacgtaggtcaaaacagtaacattagatactatactatcagacacacattcatatggccagagatgaccaaccactggagatgctctaagaaatttatcctcgtaggcttttctcttttaaaagtcaacatattggagccagatgtttattttataaatactaagaaccacaccaaagaaaaaacatttcaaagcaaaacaaaagagagagagtgtatccatttttggaggggaaaacaaagt
